United States Patent 9,828,416 (MODIFIED POLYNUCLEOTIDES FOR THE PRODUCTION OF SECRETED PROTEINS) - sequence listing, part 4

SEQ ID NO: 6209 - DNA, 8199 bp, Artificial Sequence
  Description of Artificial Sequence: Synthetic coding sequence
atggaacagacagactgcaagccataccagccactcccaaaagtgaagcacgagatggaccttgcgtataccagctctagcgatgaatctgaagacggtagaaagcctaggcagagctacaacagtagggaaacactgcacgaatataatcaggaattaagaatgaattacaattcacagtctcggaagcggaaagaagtcgagaaatcaacacaggagatggaattctgcgagaccagtcacaccctgtgctctggttaccaaactgacatgcacagcgtgagccggcatggatatcaactggagatgggttctgacgttgacacagaaacggagggggcggcaagccctgaccacgcacttcgcatgtggattaggggcatgaaatccgagcacagctcatgtctgagctctagagccaattccgcacttagcctgacggatactgatcacgagaggaaaagtgacggggaaaatggctttaagttctcccctgtatgctgtgatatggaggcccaagcaggcagtacacaggatgtccagtcctcaccccataaccagtttacattccgaccactacctcccccgccgccaccacctcatgcatgcacatgtgctcgaaagcccccccccgcggcggatagcctgcaaagacgctctatgacaacaaggtctcagccttcaccagctgcacctgctccacccacatccactcaagacagcgttcatctccacaattcttgggtgttaaatagcaacattccgctagagactagacactttctctttaagcacggaagtggctcttccgcaatcttcagtgcagctagtcagaactatccccttacgagcaatactgtgtacagccctccacctaggccacttccccggagcacctttagtcgccccgccttcacctttaacaaaccctatcgatgctgtaactggaagtgcacagctctcagcgctaccgcaatcacagttacactcgcattgttgctcgcctatgtgatcgccgtgcatttattcggcttgacttggcagttgcagccagttgagggtgagttgtacgccaacggcgtgagcaagggaaataggggaacagagtccatggatacaacctacagtcccattggtggtaaagtgagcgataagagtgagaagaaggtatttcagaaaggtcgagctattgacacaggagaggtggacatcggggcacaggtcatgcagacaattcctcctggcctcttctggcggtttcagataacaatccaccatcccatctaccttaagtttaacattagcctggcaaaggactctctactcggcatttatggccgcagaaatataccacccacccacacacaattcgattttgtgaagctgatggacggcaagcagctggtaaagcaggattccaagggcagcgacgacactcagcacagccctcgtaacctcatactcactagcctgcaagagacaggcttcatagaatacatggaccaagggccatggtatcttgctttctacaacgatgggaaaaagatggaacaggtgtttgtcctgactaccgctattgaaatcatggacgactgctccacaaactgcaacggaaatggagagtgcatctctggccattgccattgcttccctggattcctcggccctgattgtgctcgagattcctgcccggtgctgtgcggcggaaacggggaatacgagaaaggccattgtgtctgtcggcacggatggaagggaccagagtgtgatgtgccagaggagcagtgcatcgaccccacttgctttgggcacggaacgtgcattatgggcgtttgcatctgtgtgcccggctacaagggggagatctgtgaggaggaggactgcctcgatccaatgtgttcaaatcacggcatctgtgtcaagggggagtgtcactgtagtacaggctggggtggcgtgaactgcgaaacacctttaccggtttgtcaggaacagtgctcaggacatggtactttcctgctcgacgccggagtgtgctcttgtgatcctaagtggaccggttccgattgctcaaccgagctgtgtacgatggaatgtggatctcatggggtctgctcaagaggcatctgtcaatgcgaagaaggatgggtaggacctacttgtgaggagcggtcctgtcacagtcactgtacagaacatgggcagtgtaaggacggcaaatgcgagtgctcccccggatgggaaggcgatcattgtaccatagctcattatctggatgccgtccgggacggctgtcctggactgtgttttgggaacgggcgttgcactttagatcagaatgggtggcattgtgtgtgccaagtcggttggtcagggactggttgcaatgtggttatggaaatgttatgcggagataatctggacaacgatggtgatgggctcacagattgcgtcgatcccgactgttgccagcagagcaattgttacattagtcctttatgccagggttcacctgatcccctcgacctgatccagcagagtcagaccctcttcagtcaacacacgagcagactgttttacgacagaataaagttccttatcggcaaagatagcacgcatgtaatcccaccggaagtgagcttcgattcccgccgagcctgtgtgatccgtgggcaggtggtagcgatagacggaaccccattagtgggagtcaacgtgtcattcctccaccatagcgactatgggttcactatctctcgacaggatggttctttcgacctggtagcaataggcggtatttctgtaattctgattttcgatcgctcccccttcctgcccgagaagcgtaccctgtggctgccatggaaccagttcattgtggtggaaaaggtgacaatgcagagggtggtgtccgatccaccaagttgcgacatcagcaactttatctctcctaatccgattgttttgccgagtccactgacgtctttcggcgggtcctgccccgaacgaggtacgatcgttcctgaactccaggtggtacaggaggaaatccccattccatcttcttttgttaggctttcttatctcagcagcaggacacccgggtataaaacactgttacgcatcctcctgactcactctacaatacccgtggggatgatcaaggtccacttgaccgttgccgtcgaaggccgtcttacccaaaaatggttccccgccgccattaatctggtatacacattcgcatggaacaaaactgatatctacgggcaaaaagtttggggcctggcagaggctctcgtgtcggttggttatgagtatgaaacttgtcccgacttcatcttgtgggagcagcgaaccgtcgtcttgcaaggctttgaaatggatgccagcaacctgggaggttggagtctgaacaagcaccatatcctcaacccacagtctggtattattcacaagggaaatggagagaatatgttcatatcacagcagccccccgtgataagcactattatgggaaacggccaccagagatcggtcgcatgcaccaattgcaacggacccgctcataacaacaaactgttcgcacctgtcgcgttggctagtggaccagatgggagtgtgtacgtcggagatttcaatttcgtgaggcgaatttttccttctggtaatagcgtgtcaatcctggagctcagaaaccgggacacgaggcatagtaccagccctgctcacaaatactacctggcgatggatcccgtgagtgagtcgctttatctatctgacacgaacactcgaaaggtctataagctgaagtctctggtggagactaaggatctgagcaagaacttcgaggtcgtcgctgggaccggcgatcagtgcctgccttttgaccagtcgcattgcggtgatggcggtcgagcctccgaggcatctctcaactctccaagagggatcacagtcgacaggcacgggtttatatactttgtcgacgggacaatgatccgtaaaatcgacgagaacgctgtcattacaacagtgattggatctaatggcctgacctccacacagcccctttcttgcgactccggaatggacataactcaagtcagactagagtggcccaccgacctggcagtaaacccaatggacaattctttgtatgtgcttgacaacaatatagtgttgcagatcagtgaaaataggagggttcggataattgccggccggcccatacattgccaggtccccgggatcgaccatttccttgtgtccaaagttgcaattcacagcacattggaatctgctagggccattagcgtttcccactccggcctgctttttatcgctgaaaccgacgagcgcaaagtaaataggatccaacaagtgacaacaaacggtgagatctatatcatcgcaggagcccctacagactgtgactgcaagattgatcctaattgcgactgtttcagtggagacggcggctatgccaaggatgctaagatgaaggccccatcctcactggccgttagtcctgacggcactttatacgtggccgaccttggaaacgtccgcattagaacgatatcccgcaatcaggctcatttaaacgacatgaatatatatgagatcgcatcacccgcagaccaggaactttaccagtttacagtcaacgggactcacttgcacacactgaacttgattacgagggactacgtctacaatttcacatataattccgaaggagacctcggggcaatcacatcttctaacgggaattctgtgcatattagacgagacgccggggggatgcccctctggttggtagttccaggagggcaagtctattggctaacgatttcttctaatggagtgctgaagcgggtatctgctcaggggtataacctggcattaatgacatacccaggtaacaccggcctacttgctactaagagcaacgagaacggctggactactgtctacgagtacgaccccgaggggcacctgacgaatgctactttccctaccggagaggtttccagttttcactcagatcttgaaaaactgaccaaggtagaactcgacacatctaatcgcgagaacgtcctgatgagtacaaacctgaccgcgaccagtacgatttacatcctgaagcaggaaaatactcagtccacatacagggtcaatccggatggctcgctgcgcgtgactttcgcctccggaatggagatcggtctcagtagtgagccgcacattctggcgggggctgttaatccaacgttggggaagtgtaacatttcccttccgggcgagcacaatgcaaatttgattgaatggcggcagcggaaagagcagaataaggggaatgtcagcgcattcgaacggcggctaagggcccacaatcgaaacttgctcagtatcgactttgatcatattaccaggaccggtaagatttatgacgaccacaggaaattcacactgcgtattctgtacgaccagaccggtaggcctatcctctggtctcccgtttcaaggtacaacgaggtaaacattacctacagcccctcaggtctagtcacatttattcagcgggggacctggaacgagaagatggagtatgatcaatctggcaaaattatctccagaacatgggcagatggcaaaatatggagttacacatacctggaaaaaagcgtgatgttgcttcttcattcacaaagaaggtacatttttgagtacgaccagcccgactgtttattgtccgtgacaatgccgagtatggtccgacacagtctccagacaatgctcagcgtcgggtattaccgcaatatctacaccccccccgatagctccacgagctttatccaggactactctcgcgatggaagactcctccagacattgcacctgggtaccggccgcagggtgctttataaatacacaaagcaagccagacttagcgaagtgttgtatgatacaactcaggttactttaacctatgaagaaagcagtggtgtgatcaagacaattcatctgatgcacgatggtttcatttgcaccattcgataccgtcagacggggccactaattgggagacagatcttcaggttctcggaggaggggttggtcaacgctagatttgactattcttacaacaacttccgcgtaacatcgatgcaggcagttattaacgaaaccccccttccgattgacctctacagatacgtggatgtgtcaggccggacagaacaatttggcaagttttctgtgatcaattacgacctaaatcaggttattacaacaaccgtgatgaagcataccaaaatttttagcgcaaatggtcaggtaatcgaagtccagtacgagatcctgaaggctatcgcctattggatgacgattcagtacgataacgtgggacgcatggttatctgtgatatcagggtaggggtggatgctaatattactcgttacttttatgagtacgatgctgatggccagctgcagaccgtctcagtgaacgataagacacagtggagatactcttatgatttaaatggcaatattaacctgctgtcacatggcaagagtgccagacttacccctctgaggtatgatctccgcgaccggatcacacggctcggtgagattcaatacaagatggatgaggatggatttctcagacagcgcggcaatgatatctttgaatacaattcaaatggactgctgcaaaaagcttataataaggctagcggctggacagtacagtattactacgacggacttggtcgcagggtggctagcaagagctcacttggtcagcatctgcagttcttctacgccgacttaaccaatcccataagggtaacccacctctacaaccatacttcatcggaaatcacctccctgtattatgatctccaaggacacttgatcgccatggagctgagcagtggtgaggaatactatgtggcctgcgacaatacgggcacacccctcgccgtgttcagcagcagaggccaagtgataaaggagattttgtacactccatacggcgacatttaccacgatacttatcccgacttccaggtcatcataggctttcacgggggactttatgattttcttacaaagctggtgcatcttggccagagagactatgatgtcgtagctggcaggtggactactccaaatcaccatatatggaagcaactgaacctactgcctaaaccctttaatctctattcctttgaaaacaattatccagtgggtaagatccaggatgtggccaagtacactaccgacatccgaagctggctagagctgttcggcttccaactccacaacgtgctgcccggctttccgaaacccgaactggaaaatctagagctaacatacgagctattgcgactgcagaccaaaacccaggaatgggatcctggtaaaaccattctaggaatccagtgcgaactgcagaagcaattgcggaacttcattagcctcgatcagctccccatgaccccgaggtataacgacgggagatgcctcgaaggaggcaagcaaccccgatttgccgctgtgccgtcggtcttcggcaagggcataaagttcgcaatcaaggacgggatcgtgacagccgacatcatcggcgtcgccaatgaggactctcggaggctggctgccattctgaacaatgcccactacttagagaacttgcatttcaccatcgaagggagagatacacattattttattaaactgggctcccttgaagaggacctggtattgattggaaacaccggaggcagaaggatcttggagaatggtgtgaacgtgacagtgtctcaaatgacgagcgttctcaatgggcggacccgccggttcgccgatatccagctccagcatggagctctctgtttcaatatccgctacggtacaacggtggaggaggaaaagaaccacgtgctggagatcgcgcggcagagagccgtggctcaggcctggacaaaggagcaaagacggttgcaggagggagaagaggggatccgggcttggacagaaggtgaaaaacagcaattgctcagcacagggagagtacaggggtatgatggatactttgtgctgagcgtcgagcagtatctggaattatctgattcagcaaataacatccattttatgcggcaatccgagatcggccggaggtag

SEQ ID NO: 6210 - DNA, 264 bp, Artificial Sequence
  Description of Artificial Sequence: Synthetic coding sequence
atgaaagtcctcctgctgaccggcttaggcgctctattttttgcctattattgggacgacaacttcgacccagcgtcactgcaaggagctcgagtcctgttgaccggggctaatgctggtgtcggggaggaactggcgtaccactatgctcgcctgggatctcacctggtgttaaccgcccacactgaagctcttttgcagaaggcgcgctggctgacactggttgtctccactctgggcggcagaggcaaatggatcacttag

SEQ ID NO: 6211 - DNA, 1233 bp, Artificial Sequence
  Description of Artificial Sequence: Synthetic coding sequence
atgcgggcgtgtatttcactcgtgctcgctgtgctctgcggtctggcttgggcgggtaagatcgagtcatgcgcaagcaggtgtaacgaaaagtttaaccgggacgcggcctgccagtgcgataggagatgtctctggcatggaaactgttgcgaggattacgaacacctgtgtactgaggatcacaaggagtcagaacctctgcctcagctcgaggaggaaaccgaggaggccctggctagtaacctgtatagcgcacccaccagctgtcaagggcgctgctatgaagcttttgataaacaccaccagtgtcactgtaacgctcggtgccaagagtttgggaattgctgcaaagatttcgagtccctctgttcagaccacgaggtctcccactcctccgacgcgatcactaaggaggagatacagtccatctctgaaaagatttatagagccgatacgaataaggcacagaaagaagatattgtgctcaacagccagaattgtatctcccccagcgaaacgcgtaaccaggtcgaccggtgcccaaaacctctcttcacctatgttaatgaaaagctgttctccaaaccaacatatgctgcctttataaacttgctgaacaactatcagagagcaaccggccacggcgagcactttagtgcacaggaattggcggagcaggacgcttttcttcgggaaattatgaagaccgctgttatgaaagaactctatagctttctgcaccaccagaataggtacgggagtgagcaggagttcgtggatgacctgaaaaacatgtggttcggcctgtattctagaggcaacgaggagggggactctagtggatttgaacatgtgttcagcggggaggtgaagaaaggcaaggttactggtttccacaactggatccgcttctatctagaggagaaggaaggtctggttgactactactcgcatatttacgacggcccctgggacagttacccagatgtgctggctatgcagtttaattgggatgggtattacaaggaggtcggcagcgctttcatcggtagctctccagagtttgaatttgcactatactcgttgtgcttcatcgccagaccgggcaaggtttgtcaactttctctcggcggatacccattggctgtgcggacctacacctgggataagagcacttacggaaacgggaagaagtacattgcgactgcatacattgtgagttccacctag

SEQ ID NO: 6212 - DNA, 351 bp, Artificial Sequence
  Description of Artificial Sequence: Synthetic coding sequence
atggccgctggatccgcgcccatgcaattgcatctgcgtgccaccatcagaatgaaggatggtctgtgtgtcccgaggaagtggatctaccacctgacagaaggctctacagatcttcgcacagagggccgtcctgatatgaagaccgaactgttctcgtcttcctgtcctggaggcattatgctcaatgaaacgggacagggttaccagcgatttctcctgtataataggagccctcaccctccagaaaaatgcgtggaggagttcaagagtctgacttcctgcttggattccaaagcatttctcttaacaccccgcaatcaggaggcgtgcgaactttctaataattag

SEQ ID NO: 6213 - DNA, 1200 bp, Artificial Sequence
  Description of Artificial Sequence: Synthetic coding sequence
atgagtgcaagaggcaggtgggaaggcggaggtcgccgcgcttgccgcggaagcctcggtctggccagagcccagggcgctgagcgggttacatctagtgagcagagacccgcgatggctagtcttggcctattgttattacttctgcttaccgcactccctcctctctggtcatcctctttgcctgggctggatactgctgaatccaaggctacaatagcggatttgatcctgtcggctctggaaagggctacagtcttcctggaacaacgactgccggagatcaacttggacgggatggtgggggtccgggtcctggaagagcaactgaagagcgtgagagaaaaatgggcccaggagccgctgctccaaccactctctctcagggtggggatgctgggagagaagctcgaagccgctatccagcgcagtttgcactatctgaagcttagtgatcctaagtacttaagggagttccagctcaccctgcagcccggattctggaagttgccgcacgcatggatccacaccgatgcctctttagtgtatcccacatttggccctcaggattctttcagcgaggagaggagcgacgtgtgcctggtccagctcctgggaacagggactgacagctcggaaccatgtggactgtcagatctgtgtcgatcactgatgacaaagcctgggtgttcggggtactgcctgtctcatcaacttctttttttcctttgggcgaggatgagaggatgtacccaggggccgctacagcaaagtcaggattatatcaacttgttttgtgcaaatatgatggacctgaatcgaagggctgaagccattggctatgcatatcctactcgggacatcttcatggagaacattatgttttgtgggatgggaggcttctctgacttctataagcttagatggctggaggccatactgagctggcaaaagcagcaggaagggtgtttcggggaacctgacgctgaagacgaggaactctctaaggcaatccagtatcagcagcacttcagtagacgagtgaagcggcgggagaaacagtttccagatggttgctcctctcataataccgccaccgcggtagcagcactgggagggttcctgtatattcttgcagagtatccaccagctaatcgggaaccccaccccagtacacctcctcccccaagcagtaggtag

SEQ ID NO: 6214 - DNA, 510 bp, Artificial Sequence
  Description of Artificial Sequence: Synthetic coding sequence
atgctctctagtgtggtgttctgggggcttatcgctctgattgggaccagcagagggtcatatcctttctctcatagcatgaaaccgcacctccacccacgcttgtatcacggatgctatggagacattatgacaatgaagacaagtggcgccacatgtgacgccaatagcgtcatgaattgcgggattagaggttccgaaatgtttgctgaaatggacctgcgcgcaatcaaaccgtatcaaactctgattaaggaggtggggcaaaggcactgcgtagatccggcagtgatcgctgccatcataagtagggaatcccacggcggctctgtccttcaggatggatgggaccaccggggactcaaatttggcctgatgcaactagacaaacaaacataccacccagtcggcgcctgggatagcaaggaacatctctcccaggccacagggatcttgacagaacgcatcaaggcaattcagaagaaatttccaacatggtccgtggcgtag

SEQ ID NO: 6215 - DNA, 300 bp, Artificial Sequence
  Description of Artificial Sequence: Synthetic coding sequence
atggagagaatctccgcgttcttttcctctatctgggacacaattcttaccaaacaccaggagggcatttacaatactatctgtctgggggttctgctgggtctcccccttttagtcatcatcacccttcttttcatttgctgccattgctgctggtctccccccggtaagcggggtcagcagccggagaagaataaaaaaaagaagaaaaaaaaaaagaagaaagacgaagaagacttgtggatatccgctcagcctaaactgctgcagatggaaaaacggccgtcacttcccgtgtag

SEQ ID NO: 6216 - DNA, 468 bp, Artificial Sequence
  Description of Artificial Sequence: Synthetic coding sequence
atgacatcacttaagtgtggcgagaatctctatatgagtagcgcatctagctcatggtctcaagcaattcaatcctggttcgacgaatacaacgattttgatttcggagtgggccctaaaactccgaacgccgtagtgggtcattatactcaggtagtgtggtactcctcatatctggttgggtgcgggaacgcttactgccctaatcagaaagttctgaaatactattatgtttgtcagtattgtccagcggggaactgggcgaacaggttgtatgtgccctatgaacaaggtgctccgtgtgcctcctgcccagacaattgtgatgacggactgtgtaccaatggatgtaagtacgaagacctgtactccaactgtaaaagccttaagctgacattaacttgcaaacatcagttggtgcgcgattcttgtaaggccagttgcaattgctcgaacagcatatattag

SEQ ID NO: 6217 - DNA, 2886 bp, Artificial Sequence
  Description of Artificial Sequence: Synthetic coding sequence
atgctgctcctgctgctacttgcccctctctttttgcgcccaccaggggccggaggcgcccagacccccaatgcaaccagcgaagggtgccagattattcatccgccgtgggagggaggcattaggtaccgcggcctgacgagggaccaggtcaaggctataaatttcctgccagtggattacgagatcgaatacgtgtgtcgtggtgagagagaggtggtcgggccaaaagtgcggaagtgcctggcaaacgggagctggacagatatggatacaccctctcgctgtgtgagaatatgttctaagtcatatctgacactggaaaatggaaaggtcttcttgacggggggcgacctgcctgcactcgacggcgcccgagtggactttaggtgcgatccggactttcacctggtgggctctagtaggtcaatttgttcacaggggcagtggtcgacacctaaacctcattgccaagttaatcggactccgcactccgaacgacgcgccgtttacatcggcgcccttttccccatgagtgggggctggcccggtgggcaagcgtgtcagcctgctgtagagatggcccttgaggatgtgaattcacgcagagacatacttccagattatgaattgaagctcatccaccatgactcgaagtgtgatcccggccaggccactaagtacttatacgagctgctgtacaacgacccaatcaagatcatccttatgcctggttgcagttcagtgtctactctggttgccgaagccgctagaatgtggaacctgatcgtgctaagttacgggtcctctagccctgccttaagcaaccgacagcgatttcccacattctttcgaacacacccctctgcaactctgcacaatccaacaagagtaaagctctttgaaaaatggggatggaagaaaatcgcaacaattcagcagaccacggaagtgttcaccagtacacttgatgacctggaagagagagtcaaagaggcggggatagagatcacttttagacagtccttctttagtgatccagctgtgccagtgaagaatctaaagcggcaggacgcccggattatagtaggcctgttttatgaaacagaggctagaaaagtgttttgtgaggtgtacaaagagaggctgttcggcaaaaagtatgtgtggttcctgattggctggtatgccgacaactggttcaaaatctacgacccatctattaattgcaccgtggatgagatgacagaggccgtggaaggacacatcactactgaaatcgtgatgttgaaccctgccaacacccgctccataagcaatatgacatcacaggagttcgtggaaaaacttacaaagagattgaaaagacacccagaagagacaggtgggtttcaggaggcccctctggcctacgatgccatctgggccctggcccttgctttaaacaagacaagcggcgggggtggccgaagcggggtcaggcttgaggattttaactacaataaccagacgatcacggatcagatttatcgcgctatgaactcaagttcattcgagggcgtgtcagggcatgttgtgttcgacgccagcggaagccgaatggcctggacattgatcgaacagcttcagggggggtcctacaagaaaatcggctattacgacagtaccaaagacgatttatcttggagtaaaaccgacaagtggattgggggtagccctcctgcggatcagacactcgtgatcaaaacattccgtttcttgagccagaaactgttcatttcagtgagtgtgctgtcaagcctggggattgttctagcagtcgtgtgtctgagttttaacatctacaattctcatgttcggtacattcagaactcccagccaaaccttaacaaccttacggccgtgggctgtagcttggctcttgctgccgtcttccccctgggactggatgggtaccatatcggtcgaaaccagtttccttttgtttgccaggcaagactgtggcttctcgggctcggcttctccctgggctacgggtctatgttcactaaaatctggtgggtgcacaccgttttcacaaagaaggaggagaaaaaagagtggcggaagaccctggagccttggaaactctacgcgacggttggcctgctcgtggggatggacgtgctcacacttgctatctggcagatcgttgacccgctgcatagaaccatagagacattcgccaaagaggagcctaaagaagacatagatgtgtccattctgccccaacttgagcactgctcttctagaaaaatgaacacatggctggggatcttttatggatataaagggcttcttctgttgcttggcatatttttagcctacgagacaaagagcgtctcgaccgagaagatcaacgaccaccgcgccgttgggatggcaatttataatgtggcagtgctgtgtctgatcacagccccggtgacaatgattctgtcctctcagcaagatgctgccttcgccttcgcgagtctagctattgttttttcctcttacatcacactggtggtcctgttcgttccaaagatgagacgcctgatcacgagaggagaatggcagtcggaggcacaggatactatgaagacagggagcagtaccaacaataacgaggaagagaaaagccggctgctcgagaaagaaaatcgggaactggaaaaaatcatcgcagaaaaggaagaaagagtctccgagcttcgccatcaactgcagtctcggcagcagctgagatcgcgacgacatccccctacccctccagagcccagtggcggtctgcccagaggccctcctgaaccgcccgatagactgtcatgcgacggttcccgcgtccaccttctctataaatag

SEQ ID NO: 6218 - DNA, 444 bp, Artificial Sequence
  Description of Artificial Sequence: Synthetic coding sequence
atggcgggaccatggacttttacgctgttgtgcggactgctagctgctacactcatccaggccaccctgtccccaacggctgtgctgatccttgggcctaaggtcattaaggagaaactcacccaagagcttaaggaccacaacgcgaccagcatcttgcaacaattgccgctactatccgccatgagagagaaaccggctggtgggatccccgtcttgggcagtctggttaatacggtgctgaaacatattatttggctcaaggtgattaccgccaacatactccagctccaggtcaaaccatcagcaaatgaccaggaacttcttgtgaaaattcccctggacatggttgccggttttaatacccctctagtgaagaccatcgttgaatttcacatgaccacagaggcccaagccaccattagaatggacacatctgcttag

SEQ ID NO: 6219 - DNA, 948 bp, Artificial Sequence
  Description of Artificial Sequence: Synthetic coding sequence
atgaaggttctgctgctaaccgggctgggagctctatttttcgcctattactgggacgacaattttgatcccgccagtcttcaaggagcccgagtccttctcacaggagctaacgcgggcgtcggagaggagttggcataccattatgcccgactcggatcacacctcgtgctcaccgctcacaccgaggccttattgcagaaagtcgttggcaattgcagaaagctcggggcccccaaggtcttttatatcgccgcggacatggcctctccagaggctcccgaatccgttgtacaatttgcgttggataagctaggaggcctcgattacctagtgttgaaccacattggaggagcgccagctggcacacgtgctagatcccctcaggcaacccgatggttgatgcaggtcaattttgtgagttacgtgcagctgacgtctagagccctcccctctctgaccgatagtaaagggtcactggtggtggtgagctccttgctggggagagtcccgaccagcttttccaccccctattctgctgccaaattcgccctggacggtttctttgggtctctgcggagggagttggatgtccaggatgttaacgtcgcgatcacaatgtgcgtcctcggactaagggacagggcaagcgccgccgaggccgtgcgcagctctactagccgtccaaggcaaccagagcacagaggggtgcctttgcagtctcaaaccgccatgttcctgccgccaacagtgccaggggcccgcacactgactgagaccccattaagaggctggccccaaccaaagatgaagagtagtagacaaaaatccaagacagagaaaaatgatggacatcttgaaccagtcacagcttgggaggtacaggttccacgagtgcggcgcctgtgcagaggactggcgcgacctcatttatttggccatgactag

SEQ ID NO: 6220 - DNA, 285 bp, Artificial Sequence
  Description of Artificial Sequence: Synthetic coding sequence
atgcagcactctttagtgttttttttcgctgtgattctacatctgtctcatctgttgcacctggacgcgagcattcatcctttccgtttgcccttctctagtaagccattcttactcatccccatgagtaacaccacactgcctcacactgcttggcccctgagctttctccaccagaccgtcagtacactcaaagcagtggcagttacacatagcctgtggcacctccagatccctgtggactgtcaagcatgtaacaggaagtccaagaaaatctactgttag

SEQ ID NO: 6221 - DNA, 783 bp, Artificial Sequence
  Description of Artificial Sequence: Synthetic coding sequence
atggagaagtttaataccatctctgtgtccaaatgtaataaagagaccgtagcaatgaaggaaaaatgtaagttcgggatgacctccactatcccaagcggccacgtttggcgcaatacatggaatcctgtgtcatgcagtcttgctactgtgaagatgaaggagtgtttgcggggcaaactaatttaccttatgggagactcgactatcaggcagtggatggagtattttaaggcaagtataaatacgctgaagtcagttgatctccatgagagtggaaagttacagcaccaactcgctgtcgatctcgataggaatattaacattcagtggcagaaatattgctatcccctcattgggagcatgacttattctgtgaaggaaatggagtacctaacaagagctatcgaccgcaccgggggagagaagaataccgtaattgtcatttctctcggacagcactttagaccgttcccaattgatgtgtttatcagacgggccttgaacgtgcataaggctattcaacatttgttgctgcggagtcctgacactatggtgatcattaaaaccgaaaatatccgtgagatgtacaatgatgctgaacgcttctccgacttccatgggtacattcagtacttgataataaaagacatttttcaggacctgtctgtgtcaatcatcgacgcctgggacattactattgcctatgggactaacaacgtgcatcctccgcagcacgtggtaggcaatcagatcaacatcctgctgaactatatttgctag

SEQ ID NO: 6222 - DNA, 1644 bp, Artificial Sequence
  Description of Artificial Sequence: Synthetic coding sequence
atgagcagcaacactatgctgcagaagacactgctgattttgatatcattcagtgtggttacatggatgatttttataatctcacagaattttacaaaactttggagcgctctgaacttgtccatcagtgttcactactggaataactcagcgaagtccttgttcccaaaaacctcccttattcctctcaagcctctgacggaaaccgagttgagaataaaggaaattatcgaaaagctggatcagcagattccaccacgccccttcacacatgttaatacgaccacctcggccacacacagcacggctactatcctgaatcccagagacacctattgtcggggagatcaattagatatactgctagaggttcgcgatcacctgggccagaggaaacagtacgggggtgactttttacgcgccagaatgtcctccccagctctgaccgctggagcctcaggaaaggtcatggacttcaataatgggacgtacctggtctccttcacgttattttgggagggacaggtctcactctccctgctactcattcacccgtccgagggcgcctctgctctttggcgggctagaaaccaggggtacgataagattatctttaaaggcaagttcgtcaacgggacatcccatgtttttacagagtgtggactgactcttaatagcaatgcagagttgtgtgagtatctggatgacagagatcaggaggccttttactgtatgaaaccccagcacatgccatgtgaggctctgacctatatgacaaccaggaatcgcgaagtcagctatctgaccgacaaggagaattccctgttccatagaagtaaagtgggggtcgagatgatgaaagacagaaaacatatagatgtgaccaactgtaataagcgagaaaaaatagaagagacatgtcaggtggggatgaaaccgcccgtcccaggaggctacaccctacagggcaagtggatcaccacattttgtaatcaagtgcaactggatactataaagatcaacggctgcctcaaaggaaaattaatttacctccttggggactcgaccctgagacagtggatttactatttcccaaaagtggtcaagaccctgaagtttttcgatctgcacgaaacaggcatattcaagaaacaccttctgttggacgctgaaagacacacacagattcagtggaaaaaacatagctacccatttgtgaccttccagctttacagcctgatcgaccacgattacattccccgggagatcgaccgactgagtggcgataagaataccgccatagtcatcaccttcggccagcatttccgaccattcccaattgacatctttattcgtcgggctatcggtgtgcagaaggctatcgaacgtcttttcctgaggagccctgccactaaagtgattattaagacggagaacatcagagagatgcacatcgagaccgagaggtttggtgactttcacgggtacatccactacctgatcatgaaagacattttcaaggatttaaatgtgggcattatcgacgcgtgggacatgacaattgcctatggcactgacaccatccaccctccggaccacgtgataggcaatcagatcaacatgtttctgaattacatctgctag

SEQ ID NO: 6223 - DNA, 399 bp, Artificial Sequence
  Description of Artificial Sequence: Synthetic coding sequence
atgctcatgctctttgtattcggggtgctcttgcacgaagtttctctctctggacagaacgaggcccctccaaatacacattccattccgggagagccactctacaattacgcctcaatccgcctgccagaggagcatattccattctttctccataacaataggcatatcgccaccgtgtgccgtaaggattctctttgtccttacaagaagcacctcgagaagctgaagtattgctgggggtacgagaagtcctgtaagcccgaattcagattcgggtatcctgtttgctcatacgtggatatggggtggactgacacgctcgaaagtgctgaggacatcttctggaagcaggcagacttcggatacgctagggaaagattggaggagatgcattag

SEQ ID NO: 6224 - DNA, 861 bp, Artificial Sequence
  Description of Artificial Sequence: Synthetic coding sequence
atgggctcagctctgtttgtgaagaaagaactgcagttgcaggccaattttcttggcaacgtgaagcggttgtacgaggccgaggttttcagtactgacttctccaatccgagtattgctcaggcaaggataaatagtcatgtaaaaaagaagacgcaaggcaaggttgttgatataatccagggtctggatcttttaacagccatggtcctcgtgaaccatatattcttcaaggcgaagtgggaaaagccttttcacccggagtacaccaggaaaaacttcccctttctggtcggtgaacaggtgaccgtccacgtcccaatgatgcaccagaaagagcagtttgctttcggagtggatactgagctcaattgctttgtgctgcaaatggattataaaggggacgccgtggccttttttgtgctcccatccaagggtaaaatgagacaactagaacaggcactatccgccagaacccttcgaaagtggtctcattcactccaaaaacgatggatcgaggtctttattcctcgattctctatatctgctagctataacctggaaaccattctccccaaaatgggtatacagaacgtctttgacaaaaacgctgatttttcgggaatcgccaagcgcgactcacttcaagtgtctaaggctacccacaaggccgttttggatgtctctgaggaggggaccgaagcaactgcagctactaccaccaagtttattgtgagatctaaggacggcccgagttacttcaccgtgagctttaatagaaccttcttgatgatgatcaccaataaagctacagacgggattctgtttcttggaaaggttgagaaccccactaaatcctag

SEQ ID NO: 6225 - DNA, 60 bp, Artificial Sequence
  Description of Artificial Sequence: Synthetic coding sequence
atgggatggttgaccagaatcgtatgtctgttctggggcgtgctgctgacagcccggtag

SEQ ID NO: 6226 - DNA, 1197 bp, Artificial Sequence
  Description of Artificial Sequence: Synthetic coding sequence
atgaagttccagggcccattagcctgtctgttgctggcactgtgcctgggaagtggcgaggccggaccactgcagtctggggaagagtctacgggaaccaatatcggcgaagcactggggcatggtctcggagatgctttgagcgaaggagtaggcaaagctatcggtaaggaagccgggggcgccgcgggctccaaagtttcggaggcactcggacagggcacacgagaagccgtggggaccggagtgaggcaggtccctggattcggagtggccgatgcgctgggtaaccgcgtaggggaggctgcacatgcactcggcaataccgggcatgaaatcgggcgccaggctgaggacgtcatccggcatggagctgatgctgtgagaggttcgtggcaaggggtaccagggcacaatggcgcttgggagacgagtggaggtcacggcatcttcgggagtcagggaggcctaggaggtcagggacagggtaatcctggcggactgggaaccccctgggtgcacggctatccggggaactctgccggcagcttcggaatgaacccccaaggggccccctgggggcagggcggaaacgggggccctcccaattttggaacaaacacccagggcgccgtggctcagcctgggtatggatctgtgcgcgctagcaaccagaatgaaggctgcaccaatccccctccgagtggcagcggaggcggctcgtcaaattcaggaggaggatctgggtctcagtcaggctctagtggatcaggtagcaacggggacaacaataatggttctagctccggtggttctagttctggtagtagctctgggggctcttcaggcgggagctcaggggggtctagtgggaacagcggagggtcccgaggcgattccgggtccgagagctcttggggctccagcactgggagtagtagcggcaatcacggcggctctggcgggggaaacggacacaagcccggatgtgagaaacctggcaacgaggcacgcggttccggggagagcgggatacagggcttccgaggccagggagtcagcagtaatatgagaaatagcgaaacgagtcctggaatgtttaactttgacacattctggaagaatttcaaaagcaaactcggcttcattaactgggacgcgattaacaaggatcagcgcagctcaaggatcccatag

SEQ ID NO: 6227 - DNA, 81 bp, Artificial Sequence
  Description of Artificial Sequence: Synthetic coding sequence
atggcccccaagaagctgagttgcctccggtcgttactcctccctctgtcacttaccctcctactgccccaagctgattag

SEQ ID NO: 6228 - DNA, 696 bp, Artificial Sequence
  Description of Artificial Sequence: Synthetic coding sequence
atggcccaattattcctgccactgctggccgcactggtgctcgcccaagcgccagccgctctggctgacgtcctcgaaggagacagctctggtatttaccgatgcgaagtccagcacggaatcgacgactcttccgacgccgtagaagttaaagtgaagggggtggtctttctgtatcgcgaaggctcggcgagatatgcgttcagcttcagcggagctcaagaagcgtgtgctagaatcggcgcacatatcgccacccctgaacagctgtatgccgcttatctgggtggttacgagcagtgtgacgccgggtggttgtcagatcagaccgtacgttaccccatacagactccaagggaagcctgttatggcgacatggacgggttcccaggagtccggaactacggcgttgttgatcccgacgacctttacgatgtgtactgttatgctgaagacttgaatggtgagctttttctcggcgaccctcctgagaagctgacgctagaggaagcacgcgcctactgccaagaaagaggtgctgaaatcgctacgactggacagctttatgccgcctgggacggaggcctggaccactgttccccaggatggctggcggacggatctgtgagatacccaatcgtaaccccttctcagagatgcggaggcggcttaccaggtgtcaaaaccctgttctag

SEQ ID NO: 6229 - DNA, 600 bp, Artificial Sequence
  Description of Artificial Sequence: Synthetic coding sequence
atggatgaactgctgcccctgatccccgttctcgagcagtataagacagatgcaaagttaattacccagttcaaagaggagatacggaatctaagtgcagtgttgacgggcatccaagaagaaatcggcgcatatgactacgaggagctgcaccagcgtgtgctcagcttagagaccaggttaagagattgcatgaagaagctaacttgtggtaagcttatgaaaattacgggtcccgtgaccgtgaagaccagcggtacacgatttggggcttggatgaccgatcccttggccagtgagaaaaataatagggtttggtacatggacagctacactaacaataagattgtgcgcgaatataaatctatcgccgattttgtaagtggtgctgagagccgaacatataatctgccattcaagtgggctggcaccaatcacgtggtctacaacgggtccttatatttcaataagtaccaatccaacataattattaagtactcatttgatatgggaagagtccttgcccagaggagcctggagtatgccggattccacaacgtaactcccactcacggagttgactctttaacaagcacctag

SEQ ID NO: 6230 - DNA, 609 bp, Artificial Sequence
  Description of Artificial Sequence: Synthetic coding sequence
atggccgatatgcagaatctggtcgaaaggctggagcgcgccgtcggcaggctcgaagcagtgtctcacacctcagatatgcatcgaggttacgccgactctccttctaaagcaggggcagccccatatgtccaagcttttgacagtctcctcgctgggcctgtcgcggagtacctcaagatctcgaaagagatagggggtgacgtgcagaagcatgcagagatggttcacactggactcaagctagagcgggccttattagtgaccgcatctcaatgtcagcagcctgccgaaaacaaattgagcgatctgctagcccccatctcggaacaaatcaaggaggtgattactttccgcgagaaaaatcgaggctccaaattgttcaaccacttatctgctgtgagtgaatcaattcaggcactcggctgggtggccatggcaccaaaaccaggtccatatgttaaggagatgaacgatgccgccatgttctatacaaatcgcgtgcttaaagagtataaagatgtggacaagaaacacgtggactgggtgaaggcctatctaagtatttggactgaacttcaagcttatataaaggaattccacacttag

SEQ ID NO: 6231 - DNA, 2886 bp, Artificial Sequence
  Description of Artificial Sequence: Synthetic coding sequence
atgttacttctcctgctgctggcccccttgtttctacgcccacctggcgccggaggcgcccaaaccccgaatgccacaagtgaggggtgtcagatcatacaccccccttgggaaggcggaataagataccgcgggctcaccagggaccaagtcaaggcgattaatttccttcccgtggattacgagattgagtatgtgtgtaggggggaacgggaggttgttggacctaaggttagaaagtgcttagctaacggttcatggaccgatatggacactccaagcaggtgtgtgcggatttgctccaagtcttatttgaccttggaaaatggtaaagtgttcctcaccgggggcgacctgccggccctggatggagctagggttgactttagatgcgaccccgactttcaccttgtcggcagctcccgtagcatttgcagccaagggcagtggagtacccccaaaccacactgtcaagttaaccggacgcctcacagtgaacggagagctgtttacattggggctttgtttccaatgtccggcggatggcccggcggccaggcatgtcagcctgcggtcgaaatggcactcgaggatgtcaattctcgacgcgatatcctgcccgattacgaactcaagttaatccatcacgacagtaagtgcgaccctggccaggcaacaaagtatttatatgagctcctttacaacgacccgatcaagatcatcctgatgccaggatgctccagcgtatcaaccttagtggcggaggcagcgaggatgtggaatcttatcgtactgtcttacgggagttccagccctgcactcagtaataggcagcggtttcccactttctttcggacacacccttctgctactctccacaatccaacccgggtgaaactgtttgagaagtggggttggaagaaaattgccacaattcagcaaaccactgaggtgttcacaagtacactggacgatctagaagagagggtcaaagaagctggcatcgagatcacctttcggcaaagcttttttagtgatcccgcggtgcctgtgaagaacctaaagcggcaggacgcaaggattatcgtgggcctcttttatgagaccgaagcacgcaaagtgttctgcgaggtgtataaggagagactgtttgggaagaagtacgtatggttccttattgggtggtatgccgataattggtttaaaatctacgacccttctattaactgcactgtggacgaaatgacagaagcggtggaaggccacatcaccacggagatcgtgatgctgaaccctgcaaatactaggagcatttcgaacatgaccagtcaggagttcgtcgaaaagctcacgaagcggctcaaacggcaccccgaagaaaccgggggtttccaggaagcccccctcgcatatgacgcgatatgggcattagctctggccctcaataaaaccagcggtgggggcggaagatctggtgtgaggttggaagatttcaattacaacaaccagacgatcaccgatcagatctatcgggcaatgaattccagctccttcgaaggcgtcagcggccatgtggtgttcgatgctagcggcagcagaatggcttggaccctcatcgaacagttacaaggaggctcttacaagaagatcgggtattatgattccactaaggatgatctatcctggtccaaaaccgacaagtggataggtggctctcctccagccgaccagaccctggtaattaaaactttccgattcttaagtcagaagctgtttataagcgtgagtgtgttgtcatcactgggtatagtgctcgctgtggtgtgcttgtctttcaatatctacaattctcatgtgagatatatccagaattcccagccaaacctgaataatcttactgccgtagggtgtagcctagcactggcagctgtcttcccacttgggctagacggctaccatatcggccgtaatcagtttccgttcgtctgccaagccagactctggcttcttggccttggctttagcctgggctacggctccatgttcaccaaaatctggtgggtccacacagtgtttacaaagaaagaggagaagaaagagtggagaaagactctggagccttggaaactctacgcaactgtggggctcctagtaggaatggacgttctgaccctcgcaatctggcagatagtcgacccgctccatagaaccattgagacattcgccaaggaagagccaaaagaggacatagatgtgtccattttgccccagctggaacattgttcatctcgaaaaatgaatacctggctcggaattttttatgggtataaaggattgttgctgctacttggtatattcctcgcttacgagaccaaatctgtgagcactgagaaaattaatgatcatagagccgtgggaatggccatctacaatgtggcggtgctctgtctgatcaccgcacccgttactatgatcctgagttctcaacaggacgccgccttcgcattcgcgagcctggccatagttttcagctcatatattactctcgtggtgctattcgtgcctaaaatgaggcgactgattactagaggcgaatggcagtcagaggctcaggataccatgaagacagggtcttccaccaataacaatgaggaagaaaaaagcagattgttagagaaggagaatagagagctcgaaaagattatcgcagaaaaggaagagagggtcagcgagctccggcaccagctacagtccaggcaacagctgcggtcgcgacggcacccgcccacaccacccgaacccagtgggggactgcctagaggcccacctgagcctccagatcggctctcatgcgacggtagtcgggtccacttgctttataagtag

SEQ ID NO: 6232 - DNA, 351 bp, Artificial Sequence
  Description of Artificial Sequence: Synthetic coding sequence
atggccgccggatctgcacctatgcaacttcaccttcgagctacaatacgaatgaaggacggcttatgcgtgcctcggaagtggatctaccaccttaccgagggctcaacagacttgcggaccgaaggacggccagacatgaaaacagagctctttagctccagctgccctggcgggatcatgctgaacgagactgggcagggataccaaagatttcttctgtataaccgctctcctcacccgcctgagaaatgcgttgaggagttcaagtcactcacctcctgtctcgactctaaagccttcctgttgacaccacgcaaccaggaagcatgcgagctgtccaataattag

SEQ ID NO: 6233 - DNA, 2334 bp, Artificial Sequence
  Description of Artificial Sequence: Synthetic coding sequence
atggctgcggcaggccttgtggctgtggccgcagcggcagaatattctggcaccgtggcctccggcggcaacctgcccggcgtccattgtggaccttctagcggagccggacctggcttcggccctgggagttggtcacgttctttggatagagctctggaggaagcagccgtaacaggggtgctctccctgagtggacgcaagctgcgggagttcccacgcggcgcggccaaccatgacttgacggacaccactagagcagacctgtcccgaaacagactctccgagatacctattgaggcatgccacttcgtgtcactggagaacctaaacctttatcaaaactgcattcggtatatccccgaagccatcctgaatttacaagcactgacttttctgaacatctcccgcaatcaattaagcactctgccagtccatctctgcaatctgccactcaaagtcctaatcgcctcaaataataagttggtgagcttaccagaggaaattggtcacctcaggcacttaatggagctggacgtgtcatgtaacgaaatacagacaattccttcgcagatcgggaatctcgaagccctgcgcgacctgaacgtacgaagaaatcatctggtacacctgccggaggaactggctgagctcccattgattcggctggatttctcctgtaacaagatcaccacaatccccgtgtgctaccggaaccttcgtcacctgcaaacaataactcttgataataatcccctgcagtcaccacccgcccagatctgtatcaagggaaaggtgcacattttcaaatatctgaacatccaggcttgcaaaattgcccccgacctgccagattatgataggagacccctggggtttggtagctgtcacgaggagctctattcaagccggccttatggtgcgctcgacagcggttttaattccgtggacagtggcgacaaaaggtggtcaggaaatgagcccactgacgagttctccgacctgcctcttcgcgttgctgagatcacaaaggagcaaaggctgcggagagagtcacagtaccaagagaatagaggcagtctggtggtaacgaacggaggcgtggagcatgatctggatcagattgattatatcgactcatgcacagccgaggaagaagaggccgaagtgcgccaaccaaagggccccgatcctgactctctcagttcccaatttatggcatatatcgagcaacgacggatctcccatgaggggagccccgtcaagcccgtcgcaattcgggaattccagaagaccgaagacatgcgcagatatctgcatcagaatagggttcctgctgagcctagcagcttgctgtccctaagtgcttcacacaatcagcttagccatacggaccttgagttgcaccagaggagggaacagttagtggagcgtacaagacgggaggctcagttggctgctctacaatacgaggaagagaagatccgtaccaagcagattcagagagacgccgtgcttgatttcgttaagcaaaaggctagccagtccccacagaagcagcatccccttctcgatggtgtggatggagagtgccctttcccttcccgacggtcccaacacacggacgattccgcactctgtatgtcgttaagtgggctcaatcaggtcgggtgcgccgctaccctgcctcactcaagcgcttttacccctctaaaatccgacgatcggccgaacgccctgctgagcagccccgccacggaaaccgtccaccacagtcccgcttatagctttcccgcagctatccagagaaatcagccacagcggccggagagcttcctatttagagcgggcgtgcgggcggaaacgaacaagggacatgctagcccactgcccccgtctgctgcccctaccacagactctactgattcaatcaccggacaaaattcccggcaaagagaggaagagcttgaactgattgaccagctccgtaaacatattgaataccggctcaaggtgtccttaccctgcgatctcggcgccgcgctgactgacggagtagtgttgtgtcacctggccaatcacgtaagacctcggagtgtgccctcgatccacgttccctcaccggctgtgccgaagctgacaatggccaaatgtcgaaggaacgtggagaatttcctggaggcttgtcggaagatcggcgttccacaggaacaactgtgtctgccccttcatatccttgaagagaaaggtctgagtcaggtcgccgtgacagtgcaggcccttctcgagctggctccacccaaacaacagcagcatcagctttctgcagtttag

SEQ ID NO: 6234 - DNA, 834 bp, Artificial Sequence
  Description of Artificial Sequence: Synthetic coding sequence
atgctccatccagaaactagccctggtcgaggccacctattggcagttctcctcgctctgctgggcaccacatgggcggaggtatggccaccccagttacaagagcaggctccaatggcaggagcactcaacagaaaggagtctttcctgctgctcagtcttcacaacagactgcgctcatgggtacagcccccagccgctgacatgcgaaggttgctcgtgtgggccacaagcagtcagctgggctgtggacgccacctgtgctccgctgggcagaccgctatcgaagcgttcgtgtgcgcgtactctccgggaggcaactgggaggtcaacgggaagactattattccgtataagaaaggagcatggtgctccctatgtacagcttccgtaagcggctgcttcaaggcctgggaccacgccggggggctgtgcgaagtgccacgaaacccgtgccggatgagctgccagaatcatggcaggctgaacatctccacctgccactgtcactgtccacccggttatacaggacgttattgccagggccacctgcccaattcgaacatgccacatagcgcaatggggaccaaaccaaagacccccggcgtccctgcaatcggtagcctggtaaggtgctctctgcagtgtgttcatggccgcttcagagaggaagaatgttcctgcgtctgtgatattgggtatggcggagcccagtgtgcctccgagtcctgtccacgcgcacctaaggagcccgctcctctaaaaactcctcttcaatgggggatttccagccaagagcctgctgtgtgtctctctttccaactaatacagtag

SEQ ID NO: 6235 - DNA, 456 bp, Artificial Sequence
  Description of Artificial Sequence: Synthetic coding sequence
atgtcggatttactcctcctcggactgatcggtggcctgacccttctgctgctcctgaccctcctggctttcgctgggtattccggtcttctcgccggcgtggaagtgtctgctggatcaccccctattcggaatgtcaccgtggcatacaaatttcatatgggcctgtacggggagacagggaggctcttcacagaaagttgttccatctcccctaagctccgctccatagctgtctactacgacaacccacacatggtaccccccgacaaatgccggtgtgctgtcggttcaatcctgagtgagggggaggagtctccttcaccagagcttatcgatctgtatcagaaattcggttttaaggttttctccttccccgctccatcccatgtcgttaccgcgacctttccgtataccaccattctcagtatctggctcgcaacgagaagggtgtag

SEQ ID NO: 6236 - DNA, 390 bp, Artificial Sequence
  Description of Artificial Sequence: Synthetic coding sequence
atggcagccggatccgcccccatgcagcttcatctccgagctacgatccgaatgaaagatggactgtgtgtgccacggaagtggatctaccatctaaccgaggggagtacagacctcagaaccgaaggcaggcccgacatgaagaccgagctgttctcttctagctgtcccggcggtatcatgcttaatgaaaccggccagggttatcagagatttcttttgtacaaccgcagtccccatcctcctgagaaatgcgttgaggaattcaaatctctaacctcctgcctcgacagcaaagcctttcttctcacccctcggaatcagggaaagggactgaagtctcataaaaccggtctggggctgacaaaatcttccggggtgactggatag

SEQ ID NO: 6237 - DNA, 390 bp, Artificial Sequence
  Description of Artificial Sequence: Synthetic coding sequence
atggccgcaggcagcgcaccgatgcagcttcacctccgggccaccatccgtatgaaagatggcttgtgtgtacccagaaagtggatatatcacctcacagagggttcgacagacctgagaaccgagggacggcctgacatgaaaacggagctcttctcgtcctcttgccctggcggtatcatgctcaacgaaaccggtcagggctaccaacggttcttgctctacaacagaagcccccaccccccagagaagtgtgtagaggagttcaagtctttaactagttgcctggactcaaaggcttttctccttaccccgcggaatcaaggaaagggattaaagagtcataaaaccggacttgggctaacaaagtcgagcggcgttactggctag

SEQ ID NO: 6238 - DNA, 891 bp, Artificial Sequence
  Description of Artificial Sequence: Synthetic coding sequence
atggaagccctgttgctcggggccggcctgttgctgggagcatatgtgctggtttactacaacctagttaaggcccccccatgtggggggatgggcaacctgcggggtcgtaccgccgttgtcacgggcatctccagttgcggtcggactagagaagcctttaacctcttgttacgtgtcaatcatattggtccattccttctaactcacttgttgttaccctgtctgaaagcatgcgccccgagtagggtggtcgtcgtggcctccgcagcccattgccgcggtcgcctggattttaagcgattggatcgtccagtagtcgggtggaggcaagagctgcgcgcctacgctgataccaaactggcaaacgtcttgttcgcaagggagcttgctaatcagttggaagctaccggcgtgacatgctacgccgcccatccaggtccggtcaactccgagctttttctgaggcacgttcctggttggctgagacctctcctgcgacccctcgcctggctggtgcttcgggctccccgtggaggggctcagacaccactctattgtgccctgcaagaaggaatagagcctcttagcggtcggtatttcgcaaactgccacgtcgaggaggttcctcctgctgctcgggatgatcgcgcggcccaccgtctgtgggaagcatccaaaaggttggctggcctcgggcccggcgaagatgccgagccggatgaggaccctcagtccgaagactccgaggctcccagctcactcagtaccccgcatccggaggagcctaccgtgtctcagccatacccctcaccacagagttcccccgatcttagcaaaatgactcatcgcattcaggctaaagtggagcccgagatccagctctcgtag

SEQ ID NO: 6239 - DNA, 567 bp, Artificial Sequence
  Description of Artificial Sequence: Synthetic coding sequence
atgtttcatcagatttgggctgcactgctctacttctatggcataatacttaactcaatctaccaatgtcctgagcactcccaactgacaactctcggcgtggatgggaaggaattcccagaagtgcacctgggccagtggtacttcatcgccggcgccgctcctacaaaagaggagctcgccacctttgatcccgtggataacatagtttttaatatggccgctgggtcagcccccatgcagctgcatctgagggctaccatacgcatgaaagatggtctgtgtgtgcccagaaaatggatctaccacctcaccgagggcagtacggacttacgcaccgagggtcgaccagacatgaagactgaacttttctcgtcctcctgtcctggtgggatcatgcttaatgaaactggccaaggttaccaacgatttcttttgtacaatagaagcccacaccccccggagaaatgtgtggaagaattcaaatctctgacctcttgccttgatagcaaggctttcttgcttacaccccggaatcaggaagcctgcgagctttctaacaattag

SEQ ID NO: 6240 - DNA, 978 bp, Artificial Sequence
  Description of Artificial Sequence: Synthetic coding sequence
atgcaggggagggtggcagggagctgtgcccctttagggctgctgttggtttgcctgcacttaccaggtttattcgcacgttctattggagtggtggaggagaaggtgagtcaaaacctggggactaatcttcctcagctaggccaaccatcatccactggtcctagtaattcagagcatccacagcccgccctagatcccagaagcaacgacttagcgcgcgtgccactgaagttgtcagttcccgcgtcggacggcttccccccagccggcgggagtgctgtacagcggtggcccccctcctggggtctgcccgccatggatagttggcctccggaagacccttggcagatgatggccgctgcagctgaggacaggcttggcgaggccctgcctgaggagctatcttacctttcttctgcggcagccctggcaccagggtcgggccccttacctggcgaaagcagccctgacgccacagggttgtctcctaaggccagccttctgcatcaagatagtgagagtagacggcttccacggagcaatagtctgggtgccgggggaaagattctgagccagagacctccatggtcgctgatccaccgggtgctcccggatcatccatggggtaccctgaacccatcggtgagctggggcggcggaggccccggcactgggtggggaacaagaccgatgccacacccggagggaatttgggggattaacaaccaaccgcccggcaccagctggggaaatattaaccgctatcctggggggagttggggaaatatcaatagataccctggcggcagctggggcaacatcaaccgctatcccggggggtcctgggggaatatacacctctatcctggaattaataaccctttcccccccggagtgctgcggcctccaggcagctcttggaatatacctgctgggttcccaaatccccccagcccacgccttcagtggggttag

SEQ ID NO: 6241 - DNA, 2631 bp, Artificial Sequence
  Description of Artificial Sequence: Synthetic coding sequence
atgggaccagaggccctgtcctctctgcttctgctgcttctcgtggccagcggggatgctgatatgaaaggccacttcgatcctgctaaatgcaggtacgccctgggtatgcaggataggacgatccccgacagcgacatctccgcaagctcatcttggagcgacagcacagcggccaggcacagccgactggagtccagcgacggggatggggcctggtgcccagccggctctgttttccctaaagaggaagagtacctccaagttgatctgcagcgcctgcatctggtcgccctggtcggcacccaaggacgccacgctggcggcttaggcaaggagttttcaaggtcatataggttgcgctattctagagacgggcggaggtggatgggctggaaggacagatggggccaggaagtaatttccggtaacgaagaccctgagggcgtcgtgctaaaagatctcggacccccaatggtcgcaaggttagtaaggttctacccacgcgcagatcgcgtgatgagcgtttgtttacgcgtggagctgtacggctgtctctggagggacggattgctgagctataccgcgcccgtgggacagaccatgtacctgagcgaggccgtgtacttgaacgactctacctatgacggtcacacagtgggaggcctgcagtatggaggcttgggtcagctagcagatggggtcgtaggactggacgacttcaggaaatcccaggagctgagggtgtggccaggatatgactacgtgggctggagcaaccatagctttagctcaggctatgttgaaatggaattcgagtttgatcgtttgcgggcttttcaggcaatgcaggtgcattgcaataacatgcacacacttggagctagactcccgggcggagtagagtgtcgcttcagacgaggtccagcaatggcgtgggaaggcgagcccatgcggcataaccttggtggtaatctcggtgacccaagggcccgagctgtgtccgtacccctcgggggaagagttgccagattcttacagtgtagatttctttttgccggtccctggcttctttttagcgagattagctttattagcgacgttgtgaacaattcctctccagcgctgggcggtacgtttcctcccgcaccctggtggccgcccggacctccacctactaacttctcctctttggagctggagcctagagggcaacaacctgtcgcaaaggctgaggggagcccaactgctattttgatcggatgcctcgttgctatcatcttactccttctcctgatcatcgcactgatgctctggcgactgcactggcggaggcttttgtccaaggccgaacggagagtgctggaggaggaactgaccgtacacttgtcagtgccaggggatacgatcttgataaacaacaggcccggccctagagaacctccgccataccaggagccgcgaccccgaggcaatccccctcactcggccccctgtgtgcctaatggctcagcttatagcggcgactacatggaaccagaaaagccgggggcccccttgctgccacctccacctcaaaattcggttcctcactacgctgaagcagatattgtgactttgcagggagtgaccggagggaacacctacgctgttccagcactgcccccaggagcagttggagacggtccacctcgggtggattttcctcgatctcgattacggttcaaagagaagctcggcgaaggccagtttggcgaggtccacttatgcgaggttgattctccccaggacctggtctccctggacttccctctgaacgtcagaaagggacatcccctcctggtcgccgtgaaaatcctgaggccagacgctactaaaaacgctagaaacgacttcctgaaggaggtgaaaatcatgtcccgcctgaaggacccgaacattatacgcttgctcggagtgtgtgtgcaggacgaccccctctgtatgataactgactatatggagaatggcgacctgaatcagttcctttccgcacatcagctcgaggataaggcagcagagggcgctccaggtgatggccaggccgcccaaggcccaactattagttaccccatgctcctgcacgttgctgcccaaatcgccagcggcatgaggtaccttgctaccctcaactttgtgcatcgtgatctagcgactagaaactgtctggtgggtgaaaattttactatcaagattgcagacttcggtatgtctcgtaatctttatgcgggcgactactatagggtgcagggcagagctgtcttaccaattaggtggatggcgtgggagtgtattttaatggggaaattcactaccgcaagtgatgtgtgggcctttggagttaccctctgggaggtccttatgctgtgtcgtgctcagccattcggccagcttaccgacgaacaggtgatagaaaacgcaggagaatttttcagggatcagggcagacaagtctacttatcacgacctccggcgtgccctcaggggctgtacgagctgatgctgcgatgctggtccagggagagtgaacaaaggcccccctttagccaattgcatcggttcctagcagaggacgcactgaacaccgtgtag

SEQ ID NO: 6242 - DNA, 1482 bp, Artificial Sequence
  Description of Artificial Sequence: Synthetic coding sequence
atggctctcttggcaggaggtctgtctaggggattgggttcccacccagcagcggccggacgcgatgccgtagttttcgtgtggttattgctaagtacttggtgtacagccccagcaagagctatccaggttaccgtctcgaacccttaccatgtagttattctctttcagcccgtcactctgccgtgcacctatcagatgacgtctacacctacacaacccattgtgatctggaaatacaagtcattctgcagagatagaatcgccgatgctttcagcccagctagtgtcgacaatcagctcaacgctcagctagcagccggaaatcccgggtataacccctacgtggaatgtcaggatagtgtgcgaactgtgagagtggtcgctaccaagcagggaaatgctgtgaccctgggagattattaccagggccgaaggatcactataaccggtatgtacgcagctggcaaagccgcaacatcgggagtgccctccatctacgccccctcaacgtatgcacacctgagtcccgcgaagacacctccccctcctgcaatgatcccaatgggccctgcctacaacgggtatcccggaggctacccaggtgacgtggaccgctcgagtagcgctggggggcagggttcttacgtccccctgcttagagataccgacagttctgtcgccagcgaagtccgaagcggctaccgaattcaggcctcccagcaggacgacagcatgagagtactctattacatggagaaagagctagctaattttgatcctagtaggccagggcccccctctggtcgtgtcgaacgggccatgagcgaggtcaccagtctccatgaggacgattggcgttccaggcctagccgcggcccagcacttacaccaatcagggacgaggagtggggcgggcactccccgaggtcgccacggggatgggatcaggagcccgcaagagagcaggcgggtggagggtggagggctcgtcggcctagggcgcggagcgtggatgctttggatgatctaaccccacctagtacagctgaatccggatctcggagtccaacttcaaacggcggtcgctcgagggcctacatgcctccaaggagccggtcccgagacgacttgtatgatcaggatgactccagagacttcccccgaagtagggacccccattacgatgatttcaggagtcgcgagcggccaccggcggacccccgctcccatcatcaccggacacgagaccctagagataatggatcccgtagtggcgacctgccatacgacggcagactgctcgaggaggctgttaggaaaaagggatcagaagaaagacggaggccgcacaaagaagaggaggaggaggcctactatccaccggctccgcctccctacagtgagaccgattctcaggctagcagagagagacgactgaagaagaatctggcactttcgcgcgaaagcttggtggtatag

SEQ ID NO: 6243 - DNA, 1788 bp, Artificial Sequence
  Description of Artificial Sequence: Synthetic coding sequence
atggactttttgcttgcccttgtgctagtgtcctctctgtacctccaggcagcggctgaatttgacggcaggtggccgcgccaaatagtttcctccattggactctgccggtacggcgggcgcatcgattgctgttggggatgggccaggcagtcctggggccagtgccagccagtctgccagccacggtgtaaacacggagaatgtatcgggcctaacaaatgcaaatgccaccccggatatgcaggcaagacttgtaatcaggatgagcacatcccagcgcctctggaccaggggagcgagcagccactgttccaacctctggatcatcaggcaacctctcttccctcgcgagatcttaacgaatgcggcttgaagccacggccatgcaaacacaggtgcatgaatacttacggaagctataaatgctactgtctgaatggttacatgctgatgcctgacgggtcttgcagctcggcactgacatgttccatggccaattgtcaatacggttgtgacgtcgtcaagggtcaaatcagatgtcaatgccctagccccggcctgcagttagcaccagacggacgcacttgcgtggatgtggacgaatgcgcaacaggccgagccagctgtccccggttcaggcaatgcgtgaacacctttgggtcttatatatgtaaatgccacaagggatttgaccttatgtacatcggtggcaagtatcagtgccacgacatcgatgaatgctcccttgggcagtaccagtgcagtagttttgcaagatgttataacatcagaggctcctacaaatgcaagtgtaaggagggataccagggggatggcctcacttgtgtatacatccccaaggtgatgatcgagccttccggccccatccacgtgcccaagggtaatggcactatcctcaaaggcgatacaggcaacaataattggattcccgatgtggggagtacgtggtggccgcccaaaactccctatattccccccattataactaacagaccgacgtctaaacccaccacacggccaactccaaagccaactcctatccctacaccgccaccacccccccctcttcccacagagctcagaaccccactgccaccgaccacaccagagcgcccaactaccggactgacaaccattgcaccagccgcatccacacctcccggaggcattactgtcgataatcgggttcagacagatccccagaagcccaggggggatgtcttcatccctagacaaccatctaatgatctttttgaaatattcgaaatcgagcgtggtgtgtctgccgatgacgaagctaaagatgacccgggcgttctggtccacagttgcaatttcgatcatggattgtgtggctggattcgggaaaaggataatgatctgcactgggaaccgattagagacccagctgggggtcagtacctcaccgtctccgctgctaaggcgcccgggggtaaggcggcgaggcttgtcctgcctctcgggcgactgatgcactctggcgatctttgtttatccttccgccacaaggtcactggattacacagcggtaccttgcaagtatttgtgcgtaaacatggcgctcatggagctgcgctgtggggccggaatggtggccatggatggcgacagactcaaatcacccttcgcggggctgacattaaatcggtggtctttaaaggtgaaaagcgccgcggacatactggcgaaatcgggctggatgatgtttcactgaaaaagggccattgctctgaggaacgctag

SEQ ID NO: 6244 - DNA, 210 bp, Artificial Sequence
  Description of Artificial Sequence: Synthetic coding sequence
atgaagaatcaggataagaaaaatggcgcggcaaaacaaagtaacccaaaaagcagtccgggacagccggaagctggcagttttgatagtttagatctggagaaagtctctttgggcagggcccttgcgggtcggtccgagcttggcatctcttgtctggagcagggaacctggaggatgttcctgcgggggatgatgtgctggagctag

SEQ ID NO: 6245 - DNA, 483 bp, Artificial Sequence
  Description of Artificial Sequence: Synthetic coding sequence
atggcccgggattatgatcacctctttaagctcctcatcattggcgattccggggtgggcaagtccagccttctgctccggttcgctgataacacattcagtgggagttatataacaaccatcggggtcgattttaagattcgaaccgtcgagataaacggggagaaggtgaagctgcaaatttgggatacagccggccaggagcggttcagaactatcactagtacagcggaaacagctttacgtagcctcccgcagcctgaggctcacggcggctcatccggcgactcactctcattcgtccctctgtttaaggaattttcaccatgcttctgcattgggagatgccatcgacattttcttcctaggccaccgcgagttcctagacggtgttggacgtctcccccatttccaacaggagccccatctagccccgctaaggctcccggcccaggcgaagacgccgccaggcgcgcagactag

SEQ ID NO: 6246 - DNA, 360 bp, Artificial Sequence
  Description of Artificial Sequence: Synthetic coding sequence
atgaataagattctctccagtaccgtgtgtttcggccttctgactctgctcagtgtcttatcctttctgcaatcagtacacggtcgtccgtacctgacacagggcaacgagatttttcctgataaaaaatacaccaatagagaagaactgcttctggccctcctgaataaaaatttcgacttccagcgtcccttcaacaccgacctggcactccccaacaagctcgaagagttgaaccagctggagaagttgaaagaacaactggttgaagagaaggacagcgagacctcatacgctgtggacgggctgttctcatctcaccccagtaaaagagcctgcttttggaagtattgtgtttag

SEQ ID NO: 6247 - DNA, 2514 bp, Artificial Sequence
  Description of Artificial Sequence: Synthetic coding sequence
atgtttaagtgctggtctgtagtcctagtgctgggcttcattttcttggagtcagaaggaagaccaacgaaggaaggcggctacggattgaagtcttatcagccacttatgagactgaggcacaaggagaagaaccaggaaagctcaagagtcaaaggctttatgattcaggacggccccttcggcagctgcgagaacaaatattgcggtttaggaagacattgtgtcacttctagagagaccggccaggccgagtgcgcctgtatggacctctgtaagaggcactataaaccggtctgtggaagtgacggagaattctacgaaaatcattgtgaagtacacagggccgcttgcctgaagaaacagaagattaccatagttcacaatgaagattgcttttttaagggtgacaaatgtaaaacgaccgagtactcgaagatgaagaatatgctgttagaccttcagaaccaaaagtacatcatgcaggaaaatgaaaacccaaatggagacgatatttcccggaaaaaactactggttgatcagatgtttaagtacttcgacgctgactcaaacggactcgtagacattaacgaattaacacaggtgatcaagcaagaagagctcggcaaggatctgtttgactgtacactctacgtattattgaagtacgacgattttaatgcagacaagcacctggcgcttgaagagttttatagagcattccaggtgatccaactgtccttaccagaagatcagaagctttcaattactgccgcgaccgtggggcagtccgctgtattgtcctgcgcaattcagggaacactgcggcccccgatcatttggaaacggaataatatcattttaaacaacctggacctcgaggacattaacgactttggggacgatgggtccctctacattacgaaagtgactactactcacgtgggcaattacacatgttacgcagacgggtacgaacaagtgtaccaaacacacatcttccaggttaatgtccccccggttattagggtgtatcctgaatcacaagctagggagcctggtgtaactgcatctctgcgctgtcatgccgagggtatccccaagccacagctaggatggctgaaaaacggaatagacatcacccccaaactcagcaagcagctgacgctacaggcaaacgggtccgaagtccatatatccaacgtccgctacgaagacactggtgcatatacatgcatcgccaagaatgaagccggagtggacgaggatatctcatccctcttcgtggaagacagtgcaagaaaaacgaggctgggtatcggaaacatgttttacgtcttttacgaggacggaatcaaagtgattcagcctatcgaatgtgaatttcagagacacatcaaaccaagcgaaaaactgctgggctttcaagacgaggtgtgccccaaggctgagggagacgaagtccagcgctgtgtatgggcgtctgcagtgaacgtaaaggacaaattcatctacgtagctcaacccacgttggaccgcgttctgattgtcgacgtgcagtcgcagaaagtagttcaagccgtctccacagacccagtgccagtcaaactccattacgacaaatcacatgatcaggtatgggtgttatcttggggcactctcgaaaaaactagtcctacgcttcaggtgatcactctcgctagcggtaacgtaccccatcataccatccatacacagcctgtgggcaagcagttcgatagagtagacgacttcttcataccaacaacaaccttgattatcacccacatgcgattcggcttcatcttgcacaaagacgaggccgccctgcagaaaatcgacctggagacgatgagctatattaagactataaaccttaaggattacaagtgcgtgcctcagtccctcgcttacactcatctaggcggatactattttatcggctgcaaacctgacagcactggcgccgtgtcaccacaggtaatggtcgacggcgtgacagactcggtgatcggttttaactccgacgtgacgggtactccgtacgtgtcaccagatggccattatttagtgtcaataaatgatgtcaaagggttagtacgcgtgcagtacattaccatacggggcgaaatacaagaagccttcgacatatacacaaatcttcacatctccgatctcgcttttcagcccagctttactgaagcccaccagtacaacatctatggctcctcttccacccaaactgatgttctcttcgttgagctgtctagtggcaaagtaaaaatgattaagagccttaaagagccactgaaggctgaagaatggccttggaatcgaaaaaaccggcagatccaggattcggggctgttcggtcaatacttgatgacacctagtaaggattctctgttcattctcgatggcaggttgaacaaactgaattgtgagattactgaggtcgagaaggggaataccgtcatttgggtgggcgacgcgtag

SEQ ID NO: 6248 - DNA, 648 bp, Artificial Sequence
  Description of Artificial Sequence: Synthetic coding sequence
atggctgatatgcagaacttagttgaacggttggaacgagccgtcgggcgcctcgaagctgtgagccatacctctgatatgcataggggctacgcggactcaccatcgaaggccggtgccgcgccatacgtgcaggcctttgactcccttttggcaggacctgttgctgagtacctcaagatcagcaaggaaatcgggggcgatgtccagaagcacgcagagatggtgcacacaggtttaaaacttgagagggcactccttgtgactgccagtcagtgccagcagccagctgagaataagctaagcgacctcctggctcccatctctgagcagattaaagaggtcatcacttttcgggaaaaaaatcgcgggtccaaactatttaaccacctatctgctgtttccgagagcatccaggcgctggggtgggttgctatggctcctaaacctggcccttatgtcaaggaaatgaacgatgccgccatgttttacacaaatagggtcctcaaggaatacaaggacgtggataagaagcatgtggactgggtgaaggcctacttatccatctggacagagcttcaggcctacattaaagagttccacactaccggcctggcttggtccaaaactggtcccgtcgcgaaatag

SEQ ID NO: 6249 - DNA, 3837 bp, Artificial Sequence
  Description of Artificial Sequence: Synthetic coding sequence
atgagactgctcctattagtgcccctgttactggctcctgctcccggctcctcagccccgaaagtgcgcaggcaatccgatacgtggggaccgtggagccagtggtccccctgcagcaggacatgtggcggtggggtatccttcagagaacgaccatgttacagccagcggagggatggaggctcctcatgtgtcggacccgcgagaagtcacaggagttgtaggaccgaatcatgcccggatggcgctagggattttagagcagagcagtgtgctgagttcgacggcgcagaatttcaaggcaggagatatcgctggctgccctactacagcgccccaaataagtgcgagctcaactgcatccctaagggcgagaacttctattacaagcacagggaggccgtcgtggatggaaccccatgtgaacctggcaagcgggatgtctgcgtcgatggctcatgtcgggtagtggggtgcgatcatgaactggacagcagcaagcaggaggacaaatgcctcagatgtggtggagatggcactacgtgctacccagtggctggcacctttgatgcaaatgatctgtcaaggggctacaatcagatcttaattgttcctatgggcgcaacttcaattctcattgacgaggccgctgcttcccggaacttcttagcagtgaagaacgtgcgcggggagtattacctcaatggccattggaccatcgaggccgccagggcactacccgcagcatccacaatactgcattacgagagaggcgcagagggggatcttgccccagagagactccatgcccgaggaccaaccagcgaacctctggttatagagttgatcagtcaggagccaaacccaggtgtacattacgagtatcacttgcccctgcgtcgcccctccccagggttcagctggagccatggttcctggagcgattgtagcgcggaatgcggaggcggtcaccaaagcaggcttgtcttttgcacgatcgatcatgaggcttaccctgaccacatgtgtcagcgccagccccgacctgccgataggcgaagctgtaatctgcatccttgtcccgagactaagcgctggaaagccgggccttgggctccatgctctgcttcgtgtggggggggcagccagtcccgttctgtgtactgtatcagtagtgacggagccggcatccaggaggctgtagaagaggcagagtgcgccggactacctgggaagccgcctgcaatccaagcttgcaatctgcaacgatgcgctgcatggtctccagaaccctggggagagtgcagcgtcagctgtggagttggagtcagaaagcgatcagtcacctgccgcggagaaagaggatccctactgcataccgctgcatgcagcctggaggaccgccctcccctgacagaaccatgcgtgcacgaggactgccctctactgagcgatcaggcctggcacgtgggtacttggggtctctgtagcaagtcgtgctcttccggaactcgtcgccggcaggtgatatgtgctatcggaccgccaagtcactgtggttctcttcagcattcaaaacctgtggacgtggagccctgtaacactcagccctgtcacttgccgcaggaagtgcccagcatgcaggatgtccacacccctgcatccaatccttggatgcccctcggtccccaggaatcacctgctagtgacagcagaggccaatggtgggcagctcaggagcacccttccgccagaggcgaccatagaggggagcgaggtgatccaagaggtgaccaggggacgcatttgagcgctctgggccctgcccccagcctgcagcaacccccataccaacagccactcagatcaggatccggcccccatgattgtagacacagtccccacgggtgctgccctgatggccataccgccagccttggaccacagtggcaggggtgtcccggggccccttgccagcagagtcgctacggctgctgccccgaccgcgtgtccgtagccgaaggaccacaccacgctgggtgtaccaagtcttacggcggagatagcaccggcggtatgccaaggtccagggctgtggcctctaccgtgcataacacccaccagccacaggcccaacagaacgaacctagcgagtgtcgcggctcgcagttcggctgctgttatgacaacgttgccaccgcggcagggcctttgggtgaaggttgcgtaggccagccatcccatgcctaccctgttaggtgcttgctgccaagcgcacacggctcttgtgctgattgggctgccagatggtatttcgtggcaagcgtaggccagtgcaaccggttttggtatggaggctgccacggaaatgccaacaattttgcatccgaacaggagtgtatgtcttcgtgccagggatctctgcacggaccccggaggccacagcccggcgcttctgggagaagcacacatactgacggcggcggcagctcacctgcgggggagcaggagcccagtcagcaccggaccggcgccgccgtgcagaggaaaccgtggccaagcggaggactttggagacaggaccaacaacctggacctggcgaggccccccacacccaggcatttggggagtggccctgggggcaggagctgggaagcagagctcccgggttaggtggggacgcagggagccctgctccacctttccactcctcatcgtacagaattagcctcgcaggcgtggagccctcactggtgcaagctgcactaggacagctggtgaggctgagttgcagtgatgacacagcgcctgaatcgcaggctgcatggcagaaagatgggcagccaatcagctctgatcgccaccggctccagttcgatggatcactgatcattcacccgttgcaggcagaggacgccggaacctactcctgtgggtctactcggccaggacgcgatagccagaaaatccagttgcgtattatcggaggggatatggccgtgttgtccgaggcagaactctccagatttccacaacccagagaccctgcccaggactttggccaagccggcgccgccggtcccctgggagccatccccagttcccatccacagcccgcaaatagactccgcttagatcagaatcagcccagagtggttgacgcttctcctggccagaggatacgaatgacatgcagagccgaggggttccctccacccgccatagaatggcagagagatggccaaccagtgagcagccccaggcatcagctccagcccgatggttctctcgtgatttccagggtggcagtcgaagatggggggttctacacctgtgtggcatttaacggacaggatcgagaccagcggtgggtgcagttgagggtattaggtgagctgacaattagcgggctccccccaacagttacggtgccagagggcgacactgcacgcctcctctgcgttgtagcaggagaatccgtgaatattagatggagtcgaaacggcttaccagtgcaggccgacggccacagagtccatcagtcacccgatggtactctgcttatatataacctccgcgctagagacgaaggctcttacacttgtagcgcctaccaaggctcccaagctgtaagccgatccactgaggtgaaagttgtgtcgccagcccccacggctcagccacgggatcctgggcgggactgtgtggatcagccagaactggcaaactgcgacttaatcctccaggcacaactgtgtggcaatgaatactactccagtttctgttgcgcttcatgctcaagatttcaacctcacgcccaacccatttggcagtag

SEQ ID NO: 6250 - DNA, 546 bp, Artificial Sequence
  Description of Artificial Sequence: Synthetic coding sequence
tgaaaggggcacgcttcgccactacccccctcagccgctccaacaacggactctactgatagtatcaccggtcaaaactcccgtcaaagggaagaggaactggagttgatagaccagctcaggaagcatatagaataccggttaaaggtgtctctgccctgtgaccttggtgctgccctcacagatggtgtagttttgtgccacttagccaaccatgttaggccacggtcggtcccaagtatacacgtcccctcaccagccgtccctaaactgaccatggccaagtgtagacgtaacgtggaaaacttcctggaggcctgccgcaaaataggggtgccacaggacaacctgtgctctccctcagatatcctccagctaaacttgagcgttaaacgcaccgtggaaaccctgctgtcactcggggcccacagtgaggaatcatcatttgtttgcctgtctttacagctcttgggcttcgtggccttctactgcactgtgatgcttacactttgtgttttgtactactggctattcccggctcggtag

SEQ ID NO: 6251 - DNA, 804 bp, Artificial Sequence
  Description of Artificial Sequence: Synthetic coding sequence
atgggccctgaggccctctccagcctcctgctgttgctgctcgtggccagtggcgacgcggatatgaaggggcatttcgaccccgccaagtgcagatatgcactgggaatgcaggataggaccatacctgatagcgacatttctgcctcctcttcttggtccgactccactgctgcccgacactctcgattagaatctagcgatggcgatggcgcctggtgcccggcgggctcagtgtttccaaaggaggaggaatatctgcaggtagatctgcaaaggctgcatctggtcgcattagttggcacacagggcaggcacgctggagggctgggaaaagagttctcccgatcctataggctgagatatagcagagacgggcgtcgttggatggggtggaaggatagatgggggcaggaggtcatatcaggcaatgaggaccctgaaggtgtggtgctgaaagacctgggcccccccatggtcgcccgacttgtaaggttttatcctcgcgccgacagagtgatgtctgtatgcctgagagtagaactgtatggctgtctctggagggacggactgctaagctataccgctcccgtcggccagacaatgtacctcagcgaggctgtttacctcaatgattctacatacgatggccacacggttggagggctgcagtatgggggtctggggcagttggcggacggcgtagttgggcttgatgactttagaaagtcgcaagaacttagagtatggcctggttacgactacgtgggctggtcgaatcactcctttagttctggttactag

SEQ ID NO: 6252 - DNA, 345 bp, Artificial Sequence
  Description of Artificial Sequence: Synthetic coding sequence
atggcacccaagaagctgagctgcctgaggtctctgctactgccactgtccctcacactgttgctgccacaggctgataccaggtcttttgtagtagatcgcggccacgaccgatttcttctggatggcgccccgttcaggtacgtttctggaagcctgcattatttccgcgtacccagggtgctgtgggcagatcgactgctgaagatgagatggtccggattgaacgcaattcagttttatgtcccctggaactaccatgagccccagcccggtgtgtataactttaacgggagcagggatctcatcgcgttcttgaacgaagctgctcttgccaacttatag

SEQ ID NO: 6253 - DNA, 507 bp, Artificial Sequence
  Description of Artificial Sequence: Synthetic coding sequence
gcgcctagaatggaaatgttccaggggctgcttctgctgctgctcctgtccatgggaggtacttgggcctccaaggaacccctgcgtccgcgctgtcgccccatcaacgccaccctcgcagtggaaaaggaggggtgtcctgtgtgcattaccgtgaacactacaatttgcgccggatactgccctactatgaccagagtgctgcagggcgtgcttcccgctctgccacaagtggtctgcaattacagggatgttcgcttcgaatcgataaggctccccgggtgcccacggggagtgaacccagtcgtcagttatgctgtggcgttgtcatgtcagtgcgcactatgtagaagatctacgactgattgtggcggtcctaaggatcaccctctaacctgtgacgacccaagattccaggactcgtccagcagcaaggctcctcctcccagtctaccctccccgtccaggctgcccggcccctccgatactcctattctgccccagtag

SEQ ID NO: 6254 - DNA, 1203 bp, Artificial Sequence
  Description of Artificial Sequence: Synthetic coding sequence
atggaaactcaagaactgcgcggcgcgctcgccttactgttattatgttttttcacctctgcctctcaggatctccaagtgatagacctgctgacagtgggtgagagcagacagatggtagctgttgccgaaaagattcggaccgccctgctgacagccggagatatttatttgctgtcaacatttcgcctgccacccaaacagggaggggtgctctttgggctttactcaaggcaagacaacactcgatggttggaggcttccgtggtggggaaaattaataaggtaacaaacgccttgcattccatcctcggcgagggcaatgtgcctgaccctaagcatcactacggggtatctggatttcacgagcagcggagtcactgcagtccgaacccttgcttcagaggcgtagactgtatggaggtgtatgaataccccggttacagatgtggcccttgccctcccggactccagggcaatggcacccactgttctgacataaatgagtgtgcgcacgccgacccttgtttccccggctcaagttgtatcaataccatgcctggatttcactgcgaggcttgccccagagggtacaaaggaacacaggtctctggcgtggggattgactacgccagggcgtccaagcaagtttgtaacgacattgatgagtgtaatgacggcaacaatggaggatgcgacccaaactcaatttgcaccaacacggtgggtagttttaagtgcggcccttgcagactgggctttttagggaaccaaagccaaggatgcctacctgccaggacctgtcactctccagcccattccccctgccacatccacgcccactgtttgttcgagcgcaacggggcggttagttgccagtgcaacgtgggctgggccggcaacgggaacgtgtgtggcacagatacagacatagacggatatcctgaccaggccctaccgtgtatggacaacaacaagcattgcaagcaggacaactgtcttttgaccccaaactcaggacaggaggatgcggacaacgatggtgtcggtgaccagtgtgacgacgacgccgacggtgacggcatcaagaacgtggaagccagccctatggattggactatcgcactcaaaagccctacccattatcggcagaccggaatgagaacggggtgggaaatgctggccaccgctgccttgaagtag

SEQ ID NO: 6255 - DNA, 618 bp, Artificial Sequence
  Description of Artificial Sequence: Synthetic coding sequence
atgatgaggacattgattactactcatccactgccactcttactgctgccacaacagctgctgcagcttgtgcagttccaggaagtcgacacagatttcgatttccctgaggaagacaagaaagaggaatttgaggagtgtctggaaaagtttttttctaccggacccgcacgcccccccaccaaagaaaaggttaagagaagggtactcatcgagccaggcatgcccctaaaccacatcgagtactgcaaccatgagataatgggaaaaaatgtttactacaaacacagatgggtcgcagaacactatttcctgctcatgcagtacgacgagcttcaaaaaatttgttataataggtttgtcccatgtaaaaatggcataaggaaatgtaatcgctccaagggtcttgttgaaggcgtttactgcaatctcacagaggcctttgagatccctgcatgcaaatatgagtctctataccgaaagggatacgttctcatcacttgttcatggcagaatgaaatgcagaaaagaataccacacaccatcaatgacctggtagaaccaccggaacataggagctttctctccgaagatggtgtcttcgtgattagcccttag

SEQ ID NO: 6256 - DNA, 177 bp, Artificial Sequence
  Description of Artificial Sequence: Synthetic coding sequence
atggatctcctgcagtttctggcctttctcttcgtcctgttgttgtccggcatgggcgctacaggaaccctgagaacttctctggatcctagcctggagatctacaaaaagatgttcgaggtgaaacgaagggaacaactgctggccctcaagaacctcgcccaactgaatgactag

SEQ ID NO: 6257 - DNA, 450 bp, Artificial Sequence
  Description of Artificial Sequence: Synthetic coding sequence
atgaaagtcatcgccatcctcaccttgctgctcttttgtagcccgacacattcaagcttctggcagtttcaaagaagggtgaagcatattaccggccgcagcgcctttttcagttattatgggtatgggtgttactgcgggctgggcgataagggcattcccgtggacgacaccgatcggcacagcccgagctcaccatctccctacgagaagctgaaggagttctcctgtcagcccgtccttaactcttaccagtttcacattgtcaatggggctgtcgtctgtggatgcaccctgggccccggggccagttgtcactgtaggctcaaggcctgtgaatgtgataagcagtctgttcactgttttaaggaatctctgccaacatatgagaaaaactttaagcagttttcctcccagcccagatgtggtagacacaaaccgtggtgttag

SEQ ID NO: 6258 - DNA, 237 bp, Artificial Sequence
  Description of Artificial Sequence: Synthetic coding sequence
atgggcagcgggcttcctctcgtgctccttttgacactgctggggagctctcacgggaccggccccggaatgaccctgcagctcaaactgaaggaatcttttctgactaactcctcatatgagtcctcttttttggagctcttggagaaactttgtctcctgttgcaccttccttctgggacttctgtaactctccaccatgctcggagccaacaccatgtagtgtgtaacacttag

SEQ ID NO: 6259 - DNA, 1461 bp, Artificial Sequence
  Description of Artificial Sequence: Synthetic coding sequence
atgatcagcccaagcccgagccaagaggagttgcagacaacactggaagaaactgaccagtccacccaggagccctttaccaccaagatcccacgaactacagagttggcgaaaaccacacaggcaccgcaccgattttacacaactgttcgtcccaggacatccgacaagccccatatacggcccgtgctcaatcggactactacccggccgacacgccccaaacctagcgggatgcctagcggcaatggggtcggaacaggggtgaagcaggcacctcgacccagtggagctgatagaaatgtgagtgtcgatagtacccacccaacaaagaaaccggggacccgacgtccccctttacctcctcggcctacccacccacgccgcaaaccattgcctccaaataatgtgactggaaagccaggcagcgccgggataatctcctctggacccataaccacccctcctctaaggtctacacccagaccaaccggcacaccactggagaggatcgagacagacatcaaacaacccaccgtcccagcaagtggcgaagagctcgaaaacataactgacttttcctcatcacccacaagagagaccgatcccctgggcaagccgcgattcaaaggacctcacgtccggtatatccaaaaaccagataatagcccgtgcagtatcaccgactcagttaagcggtttcctaaagaagaggccacagagggcaatgctacatcacccccacagaacccgcccactaatctgacagtcgtgacagttgagggttgcccatcattcgtaattttggattgggagaagcccctgaatgataccgtgaccgaatacgaggtgatttctagggagaacgggtccttctccgggaaaaataagagtatccagatgacaaaccagaccttctctaccgtggagaacctcaaaccaaacacatcatacgaattccaggtaaaacctaaaaatcctttgggtgagggcccagtgagcaacacagtggccttctcaactgaatcagcagatccccgggtctcagagccagtatcggccggcagagatgccatctggaccgagcggcctttcaactctgattcttactccgagtgtaagggtaaacagtacgtgaaacgaacatggtacaagaaattcgtgggagttcagctctgcaactccctgaggtacaaaatctatctcagcgatagcctcaccggaaagttttataatatcggtgatcaaagaggccacggcgaagatcactgccagtttgtggacagctttctggatggacgcaccggacagcagctgaccagcgatcagctcccaatcaaggagggttacttccgcgctgtcaggcaggagcccgtgcagtttggagagatcggaggacacacccaaatcaactatgttcaatggtacgaatgtggaaccactatccccgggaaatggtag

SEQ ID NO: 6260 - DNA, 243 bp, Artificial Sequence
  Description of Artificial Sequence: Synthetic coding sequence
tgaaacggcccagttttgtggttcaaggggaccgggcccaatcgtaaactgatttacaacttcaagcaagagcaaaacccccgccccccaaagaaccggccggccggaagagccggatctcgggcacaccacgacgctcacacgtgcctttctgccctgccagagaggaacagcaccaactacttcgtccagccatgctgctgcctgaggctgctcggcctcaccggcctgctgtcgaagtag

SEQ ID NO: 6261 - DNA, 1341 bp, Artificial Sequence
  Description of Artificial Sequence: Synthetic coding sequence
atgctgcaccccgagacaagtcccgggagagggcacttgcttgccgtcctgctggcactccttggaactacatgggcagaggtctggccgccccagttacaggagcaggccccaatggctggcgcccttaataggaaagaatctttcttgctgctgtcactgcacaaccgcctaaggtcatgggtccagccccccgctgccgatatgaggcggctcgattggagtgattccttggcccaactagctcaggccagagccgcgctgtgcgggatacccaccccttcgttagcctccggactctggagaaccctgcaagtcgggtggaatatgcagcttttacccgcggggctcgcttcctttgtggaggtcgtgtcactctggtttgccgaaggacaacgctattctcacgctgcaggagaatgcgccaggaacgctacctgtactcattacacacagctcgtctgggcgacctcctcccagttgggatgcggcaggcacctgtgctctgctgggcagacagcgatcgaagccttcgtgtgcgcctattctcctaggggtaattgggaggtcaacggcaagacgatcatcccatacaagaagggtgcttggtgttcactgtgcacagcttccgtgtctgggtgttttaaggcctgggatcacgcaggggggctttgcgaagtgcctcggaatccttgtcgcatgtcatgccagaatcatggcagactgaatatttcgacctgtcattgccactgtcctcccgggtacaccgggaggtactgccaggtacgatgtagtcttcaatgtgtccatggaaggtttagagaggaggaatgcagttgcgtgtgcgacatcggttacggtggcgcacagtgcgctactaaagtccattttccatttcatacgtgcgacctgcggatagacggagactgcttcatggtttcctctgaggctgatacctactacagagcaaggatgaagtgtcagcgaaaagggggggtcctggcccaaattaagtctcaaaaagtgcaggacattttggctttttacctggggcgactggaaaccaccaacgaagtcatcgattccgacttcgagaccaggaatttttggatcggcttaacctacaagactgcaaaagacagcttcaggtgggccacgggagagcatcaggcatttacctccttcgctttcgggcagccagacaaccatggatttggaaattgtgtggagctgcaggcgagcgccgctttcaactggaatgaccagcggtgcaaaaccaggaacagatatatatgccagttcgcacaggagcacatcagtcgttggggaccaggttcctag

SEQ ID NO: 6262 - DNA, 432 bp, Artificial Sequence
  Description of Artificial Sequence: Synthetic coding sequence
atgcaggccgcctgttggtacgtcctgtttctactacagccaacagtctatctggttacttgcgcgaacctgaccaacggcgggaagagcgaactcctcaagtccggtagtagcaagagtaccctgaagcatatatggaccgagagcagtaaggacctctccattagcaggctactgtcccagaccttccggggtaaggaaaacgatactgatctggatctccggtacgacaccccggagccctactccgaacaggatctttgggattggctccgcaacagtaccgacctgcaagagccacgccctagagctaaacgcagacctattgtgaagactggaaagtttaaaaagatgtttgggtggggtgatttccacagcaacatcaaaacggtgaagttgaacctcctcatcaccggcaaaatcgttgactag

SEQ ID NO: 6263 - DNA, 783 bp, Artificial Sequence
  Description of Artificial Sequence: Synthetic coding sequence
atgcagggcgagccctttgcctgcctaacacatcaagagcctttgcccaagatgttcaaactgctatcaagggcatacgcagacgttcacccaatgatgatggataggagcgaaaacagatgcggcggaaatttcctgaaacggggcagcatcattaatggggctgactggtatagttttaccggtggaatgtctgactttaactacctccacaccaactgtttcgagattactgtggaactgggttgcgttaaattccctcctgaagaggccttgtatattctatggcaacacaacaaggagagtctgctgaacttcgtggagaccgtgcatcggggaattaagggtgtggtcacagacaaatttggaaaaccagtgaagaatgcccggatctccgtgaaaggcatccggcatgatataaccaccgctcccgacggagactattggcggctgctgccccccggcatacacatcgtcatagctcaggcaccgggctacgcaaaggttataaagaaagtcattattcccgctaggatgaaaagggctggcagggtggacttcatccttcagcccctgggcatgggacctaaaaacttcattcacggactgcggcggaccggaccccatgatccactaggcggggcgtcttccctgggggaagctaccgagcctgatcctctgagagccaggcggcaacccagcgccgacggatcaaagccatggtggtggagctattttactagcctatccacacatagaccccgatggctgctgaagtactag

SEQ ID NO: 6264 - DNA, 882 bp, Artificial Sequence
  Description of Artificial Sequence: Synthetic coding sequence
atgagcagtgggggtgggtcccggggtctcttggcctggctgctcctacttcaaccctggccaggtcaaaattgggctggcatggcggcaccacgcctccctagtccactgttgagcgaggaaggaggcgagaatccggaggcctcgccagcaccagggcctgaggccggaccgccactgaacctgttcacatcatttccaggcgattccttactgtgtgggaggacacctttacgcatagtggggggggttgatgccgaggagggcaggtggccctggcaagtgtctgtccggacaaaaggcaggcatatctgtggaggcactcttgtcaccgccacttgggtgcttactgcaggccactgtatcagcagccgttttcattacagcgtgaaaatgggagataggtccgtgtacaacgagaacactagcgttgtggtctcagtgcaacgcgctttcgtgcacccaaagttcagtaccgttaccaccattcgaaatgacctggctctcctgcagctgcagcaccccgtaaacttcacgtcgaacatacaacctatctgtattccacaagagaacttccaggtggaggggcgcacgcgctgttgggtgactggatggggaaagactccagaacgggagaagctggcctccgaaatcttacaggatgttgatcagtacatcatgtgttatgaggaatgtaacaagataatccaaaaagcactttcctcgactaaggatgtgataatcaaaggcatggtgtgcggttataaggaacaaggtaaggactcgtgtcagggggactccggcggacgcctggcatgcgaatataatgatacatgggtgcaggtgggcattgtctcttggggcattgggtgcgggcggtag

SEQ ID NO: 6265 - DNA, 870 bp, Artificial Sequence
  Description of Artificial Sequence: Synthetic coding sequence
atgtttgtgctgttgtacgtgacttctttcgctatttgcgcgtctggccagcccaggggaaaccaactgaagggagagaactatagcccccgctacatttgctcgattcccgggttgccaggtccaccgggaccccctggtgccaacgggagcccaggtccacacgggcgcatcggattgcccgggcgggacggcagggacgggcgtaaaggtgaaaagggcgagaaagggaccgcaggtcttagaggcaaaaccggcccactggggctagccggcgaaaagggtgatcagggggaaactggtaaaaaaggacctatcggacctgaaggagaaaagggcgaggtcggacccattggcccacccggtcctaaaggcgaccgcggagaacagggtgatccaggcttgcctggggtctgcagatgcggatccatagtcttaaagagcgcattctctgtcgggataactacttcgtaccctgaggagaggctgcccatcatctttaacaaagtccttttcaatgaaggcgagcactacaaccccgccacgggaaagttcatatgtgcctttcctgggatatactacttctcctacgacataaccttggccaataagcatctcgccatagggctagtacataacggccaatatcgcattaaaacattcgacgcgaacactggcaatcatgacgtggcaagtgggtcaacagtgatatatctgcagccagaagacgaggtttggttggaaatcttctttacggatcagaacggtctcttttctgacccgggctgggccgattctctgttcagcgggttcctattgtacgtcgatacggactatttggattccatatccgaagatgacgaactgtag

SEQ ID NO: 6266 - DNA, 2742 bp, Artificial Sequence
  Description of Artificial Sequence: Synthetic coding sequence
atggggcctgaggctctatccagtcttcttctcctgttgctcgtggcctccggagatgccgacatgaaaggccactttgacccagccaagtgccggtatgcgctgggaatgcaggataggactattcccgatagcgacatctccgccagctccagttggtctgacagcactgcagccaggcactcgagactggaatcatcagatggggacggagcatggtgtccagccggatccgtgttcccgaaggaggaagagtacctgcaggtggacttacagcggctccacctggtcgcattagttggtacccaaggccgccacgcggggggccttggcaaagagttttcccgtagctaccgtctgaggtacagccgggatgggcggaggtggatgggttggaaagatcgttggggccaagaggtcatttcaggtaacgaagatcctgaaggagtggtgctaaaagatttagggcctccaatggtcgccaggttagtccgcttttaccccagagccgaccgcgtgatgagcgtgtgcctgcgggtggaactgtacgggtgtctgtggcgcgacggactgctgtcatacaccgcacccgtcggtcagacaatgtacctgtccgaagcagtgtatcttaatgactcgacgtatgatggccacacggttggtggtctacaatatggcggcctgggccagctggcggatggagtagttgggcttgatgatttcaggaagtcacaggaactgagagtgtggcccggctatgactatgtgggatggtctaaccattccttcagctctgggtatgttgaaatggagtttgaatttgatcgcctgcgtgccttccaagcaatgcaagtccactgtaacaatatgcacaccctcggagctagattgcccggtggagtcgagtgtagattcagaagaggccccgctatggcctgggaaggagaaccgatgcgccacaacttaggcggaaacttgggggatccccgggcaagggccgtgtcagtcccacttggggggagggtggcccgcttcctacaatgcaggttcctatttgccgggccctggctcctttttagcgaaatatccttcatctctgatgtggtgaacaacagcagcccagccttgggggggacgtttccccctgctccctggtggccaccggggcctcccccaactaatttctcatctctggagctggaaccccggggtcagcagcctgtggccaaggccgagggatcccccaccgccattctgattggttgcctagtggccatcatccttcttttgctgttgatcatagctctgatgctctggagactgcactggaggagactactcagtaaagccgagcgcagagtgttggaggaagagctgaccgtccacctgagtgtgccaggagatactatcctgatcaataatcgccccgggccgcgcgagccccccccctatcaagaacctcgccccagagggaacccaccccattccgccccctgcgttcctaatggcagtgccctgttactgtccaatccagcataccgcctcctcctcgctacctacgctaggcccccacgcggaccggggccacctactcctgcctgggccaaacctaccaatacccaggcatactccggagattatatggagcccgaaaaacccggagcccctcttttacctccacccccacagaattccgtaccacactacgcagaggcagacatcgttaccttgcagggggtgaccggcggaaatacctacgctgtccctgccctgcctcctggtgcagtaggcgacgggccccccagagtggactttcccaggagccggttgaggtttaaggagaaactgggagaaggtcagttcggcgaggtgcacctgtgcgaggtggactccccccaagatctggtctccctagactttcccttgaacgtccggaaaggacatcctctcctcgtggcagtcaagatccttcgacccgacgctacaaagaatgcacgcaacgacttcctcaaggaagtgaagataatgtcacggctcaaagaccctaatatcatcaggcttttgggagtttgtgtccaggatgatccactctgtatgatcacagattacatggagaacggagatttgaatcagtttctttctgctcaccagctggaggacaaagcagcagaaggtgcacctggagacggtcaggctgcccagggtcccacaatatcttatcccatgctcctgcacgtggccgcacagatcgcttccggtatgcggtatctcgccaccctgaattttgtgcatagggacctggcgactcggaattgtctggtcggcgagaacttcaccataaagatagctgatttcggcatgtcccgaaatctgtacgccggcgactactacagggtgcagggcagggctgtgttgcctattaggtggatggcctgggaatgcattttgatggggaaatttaccacagccagcgatgtgtgggccttcggggttacactgtgggaggtgcttatgctgtgtcgggcccaaccattcggccagctcactgacgagcaagtgattgaaaacgccggtgagttcttcagggaccaaggacggcaggtgtacctttcccggccccctgcttgcccgcaggggctatacgagcttatgctgaggtgttggagtagagagagcgagcagcgccctccattcagtcagctgcacagatttctcgcggaagatgccttaaataccgtgtag

SEQ ID NO: 6267 - DNA, 1089 bp, Artificial Sequence
  Description of Artificial Sequence: Synthetic coding sequence
atgcgaactctttttaacctgctatggcttgcccttgcttgttcacctgtgcataccaccctgtcgaaaagcgatgcgaaaaaagccgcgtccaaaacgctgctggagaaatcccaattctccgataagcctgtgcaggaccggggcctggtcgtaaccgacttaaaggccgaatctgtcgtcctcgagcaccgctcctactgctcggctaaggcaagagatcgacattttgcaggagacgttctgggctacgtcactccatggaacagccatggatatgatgtgacaaaagtgttcgggagtaagttcacccagatcagtcctgtgtggctccagctcaagcgtcgtggtcgggaaatgtttgaggtgactggcctgcatgatgtggatcaggggtggatgagggccgttaggaaacatgccaaggggctgcacattgttccccgtctgcttttcgaagactggacttacgacgacttccggaacgtcctggattccgaggacgagatcgaggagctctccaagacagtggtgcaggtggcgaagaatcagcactttgatggttttgtcgtcgaagtgtggaatcaactcctatcgcagaagcgtgtgaccgatcaacttgggatgttcacccataaggaattcgagcaactggctccggtcctcgacggtttttccctcatgacatacgattattccacggcgcaccaacccggacctaacgccccactatcttgggtccgagcttgtgtacaggtattagatcccaaatctaagtggcggagtaagattttgctcggacttaatttttatggaatggactatgctacaagcaaagatgctagggagcctgtggtgggggcacgatacatccaaacgctaaaggatcacagaccaaggatggtctgggactcacaggcatctgagcatttttttgagtataagaaaagtcgctcaggccgacacgtagttttttaccctacgctgaaatcactgcaagtaagactcgagctcgcaagagaattaggcgtgggggtttccatctgggagctgggacaggggctcgattatttctacgacctgctctag

SEQ ID NO: 6268 - DNA, 1350 bp, Artificial Sequence
  Description of Artificial Sequence: Synthetic coding sequence
atgaagtttcagggacccctggcttgcctccttctggcgttgtgcctgggctcaggcgaggccgggccattgcaatccggggaggagtccacgggcacaaacatcggagaagctctgggacatggactgggagacgcattatccgagggagtggggaaggccattggcaaggaggcaggcggcgctgctggctctaaggtttccgaggctttgggacagggaacccgggaggctgtgggcacgggagtgaggcaggtcccaggcttcggcgtagctgacgctctgggcaatagagtgggcgaggcagctcacgccctgggaaacaccgggcatgagatcggcaggcaagctgaggatgttatccgacatggggccgatgcagtgagagggtcctggcagggcgtgcccggccataatggagcctgggaaacaagtggcggtcacggaatcttcggaagccaaggaggcctaggcgggcagggccagggtaacccaggaggcttagggactccgtgggtccacgggtatccaggtaactcagccggctctttcgggatgaatcctcagggagcgccgtgggggcagggaggcaacggagggcccccaaacttcggtacaaatactcagggcgcagttgcacagcccggctacggatctgtgcgggccagtaatcagaacgaaggatgtaccaatcccccaccaagtggctcaggaggggggtcttctaattcaggaggctcctcgacaggctcctcctccggtaatcacggtgggtccggcggcggaaatgggcacaaaccggggtgcgaaaaacccggcaacgaagcccgaggcagtggggaaagcggaattcaaggccaagggagctcctggggatctggcggaggggatgccgtgggcggggtcaatacggttaactccgaaacgagccccgggatgtttaacttcgataccttttggaaaaactttaaaagcaagctgggattcattaactgggacgctatcaacaaaaatcaggttccccccccgtccactagagctctgctatatttctccagactctgggaggatttcaagcaaaacactccttttttaaattggaaagctattatcgagggcgccgacgcttcgagtctgcaaaagcgagccgggcgcgacgatcagcctggcgccggctggcaagaggttgctgctgttacgagcaaaaattataactacaaccagcacgcttatcccactgcttatggtgggaagtactccgtcaagacccctgcgaaaggtggagtttccccaagctcttcagcttcccgggtccaacctggactgttgcagtgggtgaagttctggtag

SEQ ID NO: 6269 - DNA, 735 bp, Artificial Sequence
  Description of Artificial Sequence: Synthetic coding sequence
atgtggggtgcccctctgcctaggcggcccgtgtgggacgtaaggtctgctagcgctgggccccagccttgcctgggtggaaagatgaagttaaacctggtgcagatcttctttatgctactgatgttactcctgggccttgggatgggactcggtctgggactgcacatggctacagccgttctagaggaaagtgaccaaccacttaacgagttttggtcaagcgactctcaagataaagctgaggcaacagaggagggcgatggaacacagacaacggagaccctggtcctgagtaacaaggaggtcgtgcagcctggttggcctgaggaccctatactgggggaagatgaggtggggggcaacaagatgctaagggcctctgcattgttccagagcaataaggactacctccgtctggatcaaaccgacagagagtgcaatgatatgatggcgcacaagatgaaggagccttcccagtcctgcattgcccagtatgcattcatacatgaagacctgaataccgtgaaggctgtgtgtaatagtccggttatcgcctgcgaacttaaaggaggaaagtgtcataaatcatccagaccatttgatctgacgctgtgtgagttgtcgcagccagatcaggtcacccctaattgcaactacctcacgtccgtgatcaaaaagcacataattataacgtgtaacgatatgaaaagacagctccctactgggcaatag

SEQ ID NO: 6270 - DNA, 1728 bp, Artificial Sequence
  Description of Artificial Sequence: Synthetic coding sequence
atggcatcatggttacgccggaaattgagagggaaaagaaggccagttatagcgttctgtttactcatgatattaagtgctatggccgtgacccgattcccaccgcaaaggcctagcgccggacctgatcctgggccgatggaacctcagggcgtcaccggggcacctgcaacgcacatccgccaggctctcagctcctccagaagacaaagggctcgcaatatgggtttttggcggtctcgtgccctcccccgtaacagtatactggtgtgcgccgaggaacagggacacagagcaagggtagatcgctctagagagagtccaggcggagacctccgtcacccagggagagtgcggagagacatcactctttcgggccatcctcgtctctctactcagcacgtggtcctactaagggaggacgaggtcggtgatcctggtacgaaggacctcgggcacccacagcatggttccccaatccaggaaacacaaagtgaagttgtaacccttgtctcccctctgcctggatccgacatggccgcacttccggcctggagggccaccagtggtttgacactgtggccacacacggctgagggacgggacctgctcggggcggagaatagagcccttactggaggccagcaggctgaggaccctacattggctagcggagcccatcaatggccgggctccgtcgaaaaactccaggggtccgtctggtgcgacgccgagacgttactgtcctccagcaggaccggggggcaagctccaccatggttgaccgatcatgatgtgcagatgctgcggttgctcgcccagggcgaagtggtcgataaggcaagggtcccagcccacggccaggtgctgcaggtgggcttcagcactgaggcagctctgcaggatctgagtagcccccgcctgagtcaattgtgttctcaagggttgtgtggtctaataaaacgaccaggggatctaccagaggtcctgtctttccacgtggacagagtcttagggctgagacgttctctgccagcggtcgccaggaggttccatagcccgctgctcccctacaggtataccgacggtggcgccagacctgtcatctggtgggcccccgacgtgcaacatctttccgaccccgacgaggatcagaactctttggccctcggctggcttcagtatcaagctctcctggcacactcctgcaactggccaggccaggccccctgcccaggaatacatcatactgagtgggctagactcgcgcttttcgactttttattacaagtccacgatcggctggaccgctactgctgcggcttcgagcccgaacctagcgacccatgtgtggaggagcgcttacgcgaaaagtgtcagaacccagccgaactacgcctagtgcatatattggttcgcagcagcgatcccagtcatctggtatacatcgacaatgccggaaaccttcagcatcccgaggacaaacttaattttcggctgttggagggcattgacggattccccgaatctgccgtaaaagttttggccagcggctgcctacagaacatgctcctcaagtccttgcagatggatccagtgttctgggaatcccagggcggtgcccagggcctgaaacaggttcttcagaccttagagcagagaggtcaggtgctgctcgggcacatccaaaagcataacctgacactgtttagagatgaagacccgtag

SEQ ID NO: 6271 - DNA, 390 bp, Artificial Sequence
  Description of Artificial Sequence: Synthetic coding sequence
atggcggccggatcggctccgatgcagttgcatctcagggccaccatcaggatgaaagatggactctgcgtgcctcgaaagtggatctatcacttaaccgaaggctctaccgatttaagaacagagggaaggccggacatgaagactgagctcttctcctccagctgccccggaggcataatgctgaatgaaaccggccaggggtatcagcggtttctgctgtataataggtctccacacccacctgagaaatgtgttgaggagtttaaatctctgactagttgtctggactccaaggcctttctgctgaccccccgcaaccagggtaaaggcctgaaatcacacaagacaggattgggcctgacgaaaagctctggggtgacagggtag

SEQ ID NO: 6272 - DNA, 567 bp, Artificial Sequence
  Description of Artificial Sequence: Synthetic coding sequence
atgtttcaccagatttgggccgccctgctgtacttttacgggattatcctgaacagtatctaccagtgtcccgaacactctcagttaaccaccctgggtgtggatggtaaggaatttccagaagtccacctcggccagtggtatttcatcgccggtgctgcccctacaaaagaagagctggccacattcgaccccgtcgacaatatagtgtttaatatggcagctggaagcgcccccatgcagctccacctccgggccacgattaggatgaaggacggattatgtgtaccccgcaaatggatctaccatctgacagagggctctacagatctacggacagaaggtcgccccgacatgaagacagaactgttctctagcagctgcccaggcggtatcatgctcaatgagaccggacaggggtaccagagatttctgctttacaatagatctcctcatccacccgagaaatgcgtcgaggagttcaaaagtctgacctcgtgtctcgactccaaggcattcctcctgacacctaggaatcaggaagcgtgtgagttgagtaacaattag

SEQ ID NO: 6273 - DNA, 2676 bp, Artificial Sequence
  Description of Artificial Sequence: Synthetic coding sequence
atgttacccacagaagtgccccagtcccacccaggaccatcagcccttttgctcttgcagctgctcctccctcccacgtccgctttcttcccaaatatttggtcactactggccgcccctgggagcatcactcatcaagatttgaccgaggaggctgctttaaacgtgactttgcagcttttcctcgagcagcccccaccaggtagacctccccttcggttagaggactttctggggcggacgttgctggctgacgacttatttgcggcttacttcggacctggtagttctagacgattcagggctgcactgggggaggtgtctagggccaacgcagcacaagacttcttgcctactagtcgaaacgatcccgacctgcactttgacgctgagcggctgggccaggggcgcgcaagactcgttggcgcactgcgtgaaacagttgtggcagcacgggctctggaccacactctggcaagacagcgtctgggtgccgctctgcatgccctgcaagatttttattctcactcgaactgggtcgaactgggggaacagcaaccacatcctcacctgctctggcccagacaggagcttcagaacctcgctcaggtggccgatccaacgtgttctgactgtgaagagctgtcttgtccgcgtaattggcttgggtttacactgctgacctccggatactttggcacccaccctccaaagcctcccggaaagtgctctcatggcggccacttcgatcggtcgtcaagccagccccctagaggaggcataaacaaggattcaacatcaccaggtttctcccctcaccacatgctgcaccttcaagccgcgaaacttgccctgctcgcctctattcaggctttctcgcttttacgaagccgacttggcgatagagactttagcaggctgctcgacatcacccctgcctcaagtctctcttttgtgttagatactaccgggtccatgggggaggagattaatgcagcgaagatccaggcacgacacctggtcgagcagaggcgtgggagccctatggagcctgttcattacgtcttagtcccctttcacgaccccggcttcggtccagtgttcactacctctgaccctgacagcttttggcagcagctgaatgagattcacgctctagggggtggcgacgaaccggaaatgtgcctctcagcccttcagcttgccctgctgcacacacctccgctctcagacatctttgtgtttacagatgctagtccaaaggatgccttcttgacaaaccaagttgaatctctgacccaagagagacggtgccgggtgacattcctggtcactgaagacacttcccgagttcaggggagggcaagacgagaaattcttagtcccctgcgctttgagccatacaaagccgtcgctctggcctctggaggcgaagtcatcttcacaaaggatcagcatattcgcgacgttgccgcaatcgttggggagagtatggccgctctcgtgaccttgccactcgatccccccgttgttgtgccgggacagccgctggtgtttagcgtcgatggcctcctacaaaaaatcaccgtgcgcattcacggggatattagcagcttttggattaagaatcccgcaggcgtcagccagggccaggaagagggaggaggccctctcggccatactcgcagattcggccagttctggatggtcacgatggacgaccctccgcagactggtacctgggaaatacaagtcacggctgaggacactccgggcgtaagagtgcaggctcagacaagcctcgacttcctgttccatttcggcattcccatggaggacggtccccacccaggattgtaccccctgacgcagcctgtggccggccttcaaacacagctgctcgtcgaagttaccggattaggttcgcgggccaatcccggagaccctcaaccgcattttagccatgtgattctaagaggggtgccagaaggggccgaactggggcaggtgccccttgaacccgtgggcccacccgagcgggggttattggccgcttccctgtcacctactctgctctcaacaccaaggcccttctcactcgaactgatcggccaggacgctgcaggaaggcggctgcaccgggcggcacctcagccatccacggtggtgccggttttgttggagctaagcgggccctcaggattcctggcccccgggagcaaggtgcctttatccctgcgaatcgctagctttagcgggccacaggacctcgacctacgcacttttgtgaatccatctttctctctgacttccaacttatcccgtgctcacttagagttaaatgaatccgcttggggacgtttatggctagaagtaccggacagtgccgccccggattctgtggtcatggtgacagtgactgctggcggcagagaagctaatcccgtcccacctacgcacgcctttttgcgccttctcgttagcgcccccgcgccccaagatcggcacaccacacctactggatcgtccgatcctatcctgaccaccgccacaccagccttcagcccgtttacactggttacacagggacgagctggtgccggcctggccgcgggttccccttggtggggtacagtgggcggggtcttgctcctcctgggtctggcctcttggtag

SEQ ID NO: 6274 - DNA, 2742 bp, Artificial Sequence
  Description of Artificial Sequence: Synthetic coding sequence
atgggccccgaggcgctgtccagcctgcttcttctgctcctggtcgcatcaggagatgcagacatgaaaggtcactttgatcccgctaagtgccgttatgcccttgggatgcaagataggacaattcccgactcagacataagcgcctcaagcagttggtctgactccaccgccgctcggcactcccggctcgagagcagcgacggtgatggcgcgtggtgccccgccggctctgttttcccaaaggaagaggagtatctccaggtagacctgcagcgtctgcatctcgtggcgttggtcggcacacagggaaggcatgctggaggcttaggcaaagaattctcccggtcatacaggctaagatattctagggatggtagacgctggatggggtggaaagaccgttggggtcaagaggtcatctctgggaatgaggacccagaaggtgtggtcttgaaagatctcggtccccccatggtggctcggcttgtgcgcttttacccccgcgctgacagggtaatgtccgtctgcctcagggtcgaactgtacggctgtctttggagggacgggttactgagttataccgccccagttggccagaccatgtacttatctgaggcagtgtacttaaatgatagcacttatgacggacacacagttggcggtttgcaatacggaggcctgggccaactggcagacggggtggtgggactggacgactttaggaagagccaggagcttagggtgtggccagggtacgactacgtggggtggagcaaccactccttttccagtggctacgtggagatggagtttgagttcgaccgcctgcgtgccttccaggccatgcaggtccattgtaataatatgcacacactgggagccaggctgcccggcggcgtggaatgtagattccgaagaggtcccgctatggcctgggagggagaaccaatgcgccacaatctcgggggcaacctgggggacccccgtgcccgagccgtcagtgtgccgctgggcggaagggtggcaaggttcctgcagtgcaggttcctatttgccggcccttggctcctgttctccgagatctcattcatttcagacgttgtgaacaattcctcacccgccctgggcggcacatttcccccagcaccatggtggcctcctgggcctccacctactaatttttcctctctggagttggagcccagaggccagcagcccgtggccaaagcagaagggagcccgactgcgattctcattgggtgtcttgttgcaatcattctcctgcttctcttaatcattgccctgatgctctggcggctccactggaggcgccttttgtccaaggctgagcgcagggtgttggaggaggaattgaccgtccatcttagcgttcctggcgataccatcttgattaacaatcgacccgggcctagagaacctcctccatatcaggaaccacgcccccgcggcaacccgccacatagtgctccctgtgtgcccaatggatctgccctcctgctgtcaaatccggcctacaggcttctgttggcaacttatgcaagaccccccagaggtcccggcccgccaactccagcttgggccaagcccacaaatacacaggcatatagtggagactacatggaaccagaaaaaccaggcgcccctttactccctccaccgccccaaaattccgttccccattacgccgaggccgacatagtgacgttgcaaggcgtaacaggtggcaatacctacgctgtgccagctctgcccccaggagccgtgggcgatgggcccccacgggtggactttcctaggtcccgactcagatttaaggaaaagctgggggaaggccagttcggggaagtgcacttgtgcgaagtggattccccccaggacctcgtgtctctggacttccccctgaacgtgcgcaaaggacaccccctgttggtcgccgtaaaaatcctgcggccggacgcaacaaagaacgcacggaacgattttctcaaggaggttaagataatgtcccggttaaaggaccccaatattatcaggttactgggcgtctgtgtccaggatgaccctctctgtatgattacagactatatggagaacggcgacctgaaccagttcctcagtgcacaccagctggaagataaggctgccgaaggtgcccctggggatggccaggcagcacaggggcccaccatctcctaccctatgttgcttcatgtcgcagcacagatagcttctggtatgcgctacctggcaacccttaatttcgtacacagggacctggctactcggaactgcctggtgggagagaatttcaccattaaaattgctgatttcggtatgagtcgcaatctatacgccggagattattatagggtgcagggtcgggccgtcctgcccattcgttggatggcatgggagtgtatcctcatgggcaagtttactacggcctcagatgtctgggccttcggggtaactttgtgggaagtgcttatgctctgtagagcccagccctttggtcagctgaccgacgaacaggtgattgaaaacgccggcgagttctttcgtgaccaggggcggcaagtttatttgtcaaggccccccgcttgccctcaaggcttgtacgaattgatgcttcgctgttggagccgcgaatctgagcagcgacctcccttttctcagctgcatcgttttctggctgaggacgctctcaatacggtatag

SEQ ID NO: 6275 - DNA, 453 bp, Artificial Sequence
  Description of Artificial Sequence: Synthetic coding sequence
atgagatttatggctggtccagccggttcacagtcactcggccctttgtgttttcatagcagtccccaggccttatatacagtgctgctgatcgtcctggtgatgatgtccctcgtgttcggcaaattcgtccccgtaaattgggaaccaccacagccacttccatttcccaagtaccttagatgctaccgatgcctgttagagaccaaagagttggggtgccttctgggctccgacatctgtctcacccccgccggcagttcctgtattaccctgcacaagaagaattcaagcgggagcgacgtcatggtctcagactgtaggagtaaggaacagatgtcggattgttcaaacacgcgaacatcccccgtgagcggcttctggatcttcagccagtactgtttcttagatttctgtaatgatccccaaaacaggggtctatacacaccctag

SEQ ID NO: 6276 - DNA, 192 bp, Artificial Sequence
  Description of Artificial Sequence: Synthetic coding sequence
atgggacccgaggccctaagttccctgctcctgctactattagtagcttccggggacgctgacatgaagggacatttcgatcctgccaagtgtagatacgctttgggcatgcaggacagaaccattcccgactccgacatcagcgccagcagctcatggtccgactctaccgccgcaagacactcacggtag

SEQ ID NO: 6277 - DNA, 1212 bp, Artificial Sequence
  Description of Artificial Sequence: Synthetic coding sequence
atgcagggaactccaggcggtgggactcggcctggaccctctcccgttgatagaagaacacttctggtgtttagctttattctggcagccgcgctggggcagatgaattttaccggagatcaagtgctgcgcgttctggcaaaggatgaaaagcagctaagcttattaggagatttggaggggctgaagccacagaaagtcgatttttggcgtggacccgcgagaccatccctcccagtcgatatgagagtcccattttccgagctcaaagatatcaaggcctacctggagagtcatggactggcctactccatcatgatcaaggacattcaagtcctcctcgacgaggaaaggcaggccatggccaagagcagacgactagagcgatctacaaatagcttctcttatagctcttaccatactcttgaggaaatttactcctggatcgataacttcgtgatggagcacagtgatatagttagtaaaatacaaattggtaatagttttgagaaccagtccatcctagtgctcaagtttagcacaggaggctctaggcacccggctatctggattgatactggaattcattctagagaatggatcacacacgctacaggaatatggacagcgaacaaaatcgtctcggactatggaaaagatagagtgttaacagacatcctgaacgccatggacatatttatcgaacttgtaactaacccagatggattcgccttcactcatagtatgaacaggctctggcgtaaaaataagagcatcaggccaggcattttctgcattggagtggatcttaacagaaattggaagtcagggtttggtgggaacggctccaatagcaatccctgtagtgaaacttatcatggccctagtcctcagagcgagccagaagtggctgccatcgtgaacttcatcaccgcacatggcaattttaaggcattgatatcaattcacagttatagccagatgctgatgtatccttacggacgcttgctggagccagtaagcaaccagagggagttgatgtggccagtcggaagcccttcaaccgggccaatgaccgttgcctcaagtacgccaagcgcattatcgtctggcactcttggttccatggcctcctgctgcagaccacatcgatcttctccccgtcctagacgcaggggctggcggttcggcccaagttggtcaacaccttag

SEQ ID NO: 6278 - DNA, 1542 bp, Artificial Sequence
  Description of Artificial Sequence: Synthetic coding sequence
atggccccggctaggacgatggctcgcgccaggttggcccctgccggtatcccagccgtggccctttggctgctctgcacactggggctgcagggcacacaggcagggcctcctccggctccgccgggacttcccgctggggccgactgccttaattcttttactgctggtgtcccaggcttcgtgctggacacaaacgcatcagtgtccaacggagctaccttcctggagtcccctaccgtcagacgggggtgggattgtgttcgagcatgttgcacgacccagaactgtaacctcgctctggtcgaactccagcctgacagaggggaggacgctattgcagcatgtttccttattaactgcttgtacgagcagaattttgtatgtaagttcgcacctagagaaggctttattaattatctaacccgggaagtctataggtcatatagacagctgcgaactcaaggcttcggggggtccggtattcccaaagcctgggccggcattgatctcaaagtccagccccaggaaccactggttctcaaagacgttgagaacaccgattggcgactgctgaggggggacacagacgtgcgggtggagagaaaggatccaaatcaggttgaactgtgggggctgaaggaggggacttatttatttcagctgacggtgactagttcggaccaccccgaagatacagctaatgttacagtgacagtcctgtccaccaagcaaacagaggactattgtctcgcctcaaacaaggtcggccgatgtagaggttcctttccaaggtggtactatgatcccactgaacaaatatgcaagtcgttcgtgtatggagggtgtttgggaaacaaaaacaattatctgcgagaagaggaatgtattttagcctgtagaggggttcagggcccaagcatggagcgcagacaccctgtgtgctccggcacctgccagcctacacagtttagatgctcgaacggatgttgcatcgacagctttctggaatgcgatgacacgccgaattgcccggatgccagtgatgaggccgcctgcgaaaagtatacctcagggtttgatgagctccagcgcatacacttcccctcggacaagggacattgcgtggacctgccagacacgggtctgtgtaaggaaagcatcccccgctggtactataatccattttctgagcattgtgcccggttcacatacggtggctgctacgggaacaaaaataactttgaggaagagcagcagtgtttggaatcctgccgtggcattagcaagaaagacgtctttggactcaggagggagatacctatcccttctacaggttccgtcgagatggcggtcgcggtcttcttggtgatctgcattgtcgtggtggttgcaatactaggatactgtttcttcaaaaaccaaagaaaggatttccacggtcatcatcatcatcccccccctacgcctgcatcttccacagtaagtaccacagaagataccgagcatctggtgtataaccacactactcgccctctgtag

SEQ ID NO: 6279 - DNA, 798 bp, Artificial Sequence
  Description of Artificial Sequence: Synthetic coding sequence
atggcgccttggagtcacccatcagcccagctgcaacctgtcgggggtgatgcagtgtctcctgctttgatggttctgctgtgtcttgggctaagcttgggcccaagaacacacgtacaagcaggcaatctgagtaaagcaactctgtgggcagaaccaggctcagtaatttctcgaggaaacagtgttaccattagatgccaaggcacattagaggctcaggaatatcgactcgttaaggagggatcaccagagccctgggacacccaaaatcctctcgaaccaaaaaacaaagcccgattttccatcccatctatgactgaacatcatgccgggcgttacaggtgttattactactcccccgctggctggtccgagccaagcgatccgcttgaactcgtggtgaccggtttctataacaagccaaccctgtccgcacttccttcccccgtcgtcacctctggggaaaacgtaacgctgcagtgtggatccagacttcggttcgatcggttcatcctcactgaagaaggggaccacaagctgtcctggacgttagattctcagctcaccccgtcggggcagtttcaagctctgttccccgtgggccctgtgacaccatctcacagatggatgctaagatgttacggctcgcgccgccatattctccaggtctggtcagagccctctgatcttctcgagatcccggtctccggggaggaagccactgttttcagttctaccatacagggaagccagaccggatgcggggagctttatcgccaagggtcaccttgttag

SEQ ID NO: 6280 - DNA, 795 bp, Artificial Sequence
  Description of Artificial Sequence: Synthetic coding sequence
atggaaaagcctatactcaagaatttaaatgagatgctgtgccccatcattgctagtgaggtgaaggcattgaatgccaacctgagtacacttgaggtgcttaccaaaatagacaactatacattgttggactactctctcatcagctcaccggagattacagagaattacctcgacctcaatctgaagggggtattttatccccttgagaatttgaccgaccccccctttagccctgtgccttttgtcctccccgagaggagtaattctatgctgtacatcggcattgccgagtatttctttaaaagcgcctcattcgctcacttcactgctggcgttttcaatgtcaccctctctacagaagagataagtaatcactttgtccagaattctcagggcctcgggaatgtcttatcaagggttgccagtacatcggtgggattggtgatcctcgggcagcgcctagtgtgcagcctctccctgaacagatttcgccttgccttgcccgagtctaatcgctcgaacattgaggtactcaggtttgagaacatcctaagcagtatcctccattttggcgtcttgcccctggccaatgccaagctccagcaggggttcccccttagcaaccctcacaaattcctgttcgtaaatagtgacatcgaggtgctggagggcttcttgctgattagtaccgatctcaaatatgagacgtcgagcaaacagcagccatctttccacgtatgggagggattgaacctgataagccggcaatggagaggtaagtctgccccatag

SEQ ID NO: 6281 - DNA, 117 bp, Artificial Sequence
  Description of Artificial Sequence: Synthetic coding sequence
atgaacaaaattctgtccagcaccgtgtgctttggtcttctcaccctactgtcagtactcagttttctccagagtgtgcacgggcgcccttatctgacgcaaggcaacgaaatctag

SEQ ID NO: 6282 - DNA, 567 bp, Artificial Sequence
  Description of Artificial Sequence: Synthetic coding sequence
atgttccaccagatctgggctgccttactgtacttttacgggatcattctgaattctatctatcagtgccctgaacatagtcagctcacaaccctgggagttgatgggaaggaatttccggaagtgcatctcggacagtggtacttcattgctggcgctgcgcccaccaaggaagagctggcgacattcgaccctgtagacaacattgtgtttaacatggccgcaggatccgctccaatgcagctgcacctgagagcaaccatacgtatgaaggacggcctgtgcgtccctagaaagtggatttatcatctgactgaaggttccactgacctgcggactgagggccgtccagatatgaagaccgaactattttcctcatcatgtcctggcgggattatgctgaacgagacagggcagggatatcagcgttttcttctgtacaaccggtcgccacatccaccagagaaatgcgtcgaagagtttaaatctctgaccagttgtttggactctaaggcctttctgttgaccccacgaaatcaggaagcctgtgagttaagcaataactag

SEQ ID NO: 6283 - DNA, 600 bp, Artificial Sequence
  Description of Artificial Sequence: Synthetic coding sequence
atggagacttttcctttgttgcttctgagcctgggacttgtcctcgctgaagcctctgagtcaactatgaaaatcatcaaggaagaattcacagatgaggaaatgcaatatgatatggccaaaagcggccaagaaaaacagaccatcgaaatcctcatgaaccccattctgctcgtgaagaatacgtccctgtccatgtcaaaggatgacatgagctctaccttactcacatttagatcgctgcactataatgatccgaagggaaattccagcggcaacgacaaggagtgttgtaacgatatgactgtatggcgaaaggtgagtgaggcaaacggttcttgtaaatggagcaataatttcattcggagctcaacagaggtgatgagaagggtgcaccgggcaccttcatgcaaattcgtccagaacccaggtatctcctgttgtgagagcctcgagctcgagaacacagtgtgtcagttcactactgggaaacagtttccacggtgtcagtaccactctgtgactagcctggagaaaatattgaccgtgctgaccggccattcactgatgagttggctcgtgtgtggctcaaaactgtag

SEQ ID NO: 6284 - DNA, 30 bp, Artificial Sequence
  Description of Artificial Sequence: Synthetic coding sequence
atggctcccaagaaactcagctgcctttag

SEQ ID NO: 6285 - DNA, 831 bp, Artificial Sequence
  Description of Artificial Sequence: Synthetic coding sequence
atggcccctagccctctgcagcgccttcactgtgggccctcaccctcgcctcgacctacagaggtcccacgcggaacagtctctgtcagttgtagatatttgaagaactcccttcatgttttcgttagcggcggagcaattgggacatctagcccagctcttcttgagtgccaggaaggagttgggcccgccagacccagccttctggtgcctcctccacccaggccccggcggctggacctggctagaacactgcctgccgaaaggactgattcacagtccctctacatcgtgtacatcgctttgcccgggagaaccccacgccctgcactggcctttgctttcctgatgcccgcctgctgcaaccgtccaagcccacggcccagccctgcccaccttaccgcctcttctgttctcagacgacaaagacacgtgcttgccgcaagtgcggcgtccccatgtcagtggagtggattaagggttgctcattccttgcgccaagtcgtgagtttgtgcccgaggtgcacaggaagctgccccttcagcggagcatgtgcctctagcctgcccagtcccttgagttgcccccattctcactccggctcctggggaacatggtcgcagggcaggccatgctcatccaccgaagttgcagggttggctctgtggccaactgactttctgtcttgcctgctggacgcctccgagttacaaacccaaggatcccatggattctccttcaccccaaccgggttttcttcaaataggaaggtaggggtcggctcgtgccgcgacggggccggacgtggagctatgggtggactattttag

SEQ ID NO: 6286 - DNA, 678 bp, Artificial Sequence
  Description of Artificial Sequence: Synthetic coding sequence
tgagctgatcttccttcgtgctggggcgccgggccttgttacactggccacaaggtgggagccctacgtagggatactgtgatctgctgctgccgccacggcgactactctactccctgtctgtttacccccggcaaaccgagcaggaatccatctccttggaaacggaccctgtggaccctgtcagctccctgggccggacccgccggctggaccggagaggagcagaatgctacgaagaccggccttatcactcggcgtccgcggcctttgcgcaggcgtccgcacccagctccagcctctcctctccccgaaattatccgagggaacataccccgcatgctgggcaaatttgtgccagtgaactgggaaccgccacagcccttaccctttcccaaatatctcagatgctacagatgccttctggaaacgaaagaactcggctgcttgttgggttcagacatctgtctgacacccgctggctcttcgtgcatcaccttgcataagaaaaatagttccggatcagacgtaatggtctccgattgtcggtctaaggagcagatgagcgactgcagcaatactcgaaccagtccagtgagtgggttttggatattttcccagtactgcttcctcgacttttgcaatgatccacagaatcgcggcctatatactccctag

SEQ ID NO: 6287 - DNA, 534 bp, Artificial Sequence
  Description of Artificial Sequence: Synthetic coding sequence
atggtgcctgccgccggggccctcctctgggtcctgctgctgaatctgggcccacgggccgccggagctcagggcttgacccagactcctaccgaaatgcagcgggtctcccttaggtttggaggccctatgacaagaagctaccgcagtactgctaggaccgggttgccaagaaaaactcggatcatcttggaggatgagaatgatgcaatggccgacgctgatcgtttggctggtcctgctgctgccgagctgttagctgccacggtttccacagggttctcccgctccagcgctatcaacgaagaggatggatcaagtgaggagggagtggtcatcaacgcaggcaaagattccacatctcgcgagctaccatccgccacgcccaacaccgcgggaagctcatctacacgctttatcgccaatagccaagagccagaaattcgcctgactagctcactgcctcggagtcccggtagaagtaccgaggacttgccaccttgccacctgctcaggatctgtgggtggtgttag

SEQ ID NO: 6288 - DNA, 912 bp, Artificial Sequence
  Description of Artificial Sequence: Synthetic coding sequence
atgcttcatccagagaccagtcctggtcggggccatctgttggctgtattgctggctctgctggggactgcgtgggcagaggtgtggcccccgcagctgcaggagcaggctcccatggcaggtgcactcaaccgcaaagagagctttctgcttttaagcctgcacaataggttgcgctcttgggtccagccaccagcggcggatatgcgtcggttggattggagcgactccctggcacagttagcgcaggcccgagcggccctttgtggaatccccacaccttcactagccagtggcctgtggcgtacgctacaagtggggtggaatatgcagctccttccggcaggcctcgcctctttcgtggaagtggtgagcttatggttcgctgaaggccaaagatacagtcacgcagcaggcgaatgcgcaagaaacgctacttgtacccactacacacagctcgtctgggcaacatcatctcagcttggctgcggcaggcacctgtgcagcgctggccaggctgcaattgaagccttcgtttgcgcctactcgccgcggggcaattgggaagtgaacgggaaaaccattgtaccatataaaaaaggagcgtggtgctctttgtgtacagcctcagtcagtggttgctttaaagcctgggaccatgccgggggcctttgcgaggtgccgagaaatccctgtcgcatgtcctgtcaaaaccatggtaggctgaatattagtacctgtcactgccactgtcctcccggctatacaggccgatactgccaggtccggtgtagcctccagtgtgtgcatggcagattccgggaggaagaatgttcgtgcgtctgcgatatagggtatggcgagccgtcagtgccacctagatgtattttcccatctaccccagtcacgtag

SEQ ID NO: 6289 - DNA, 1482 bp, Artificial Sequence
  Description of Artificial Sequence: Synthetic coding sequence
agcgaggccgtttacctaaacgattccacttatgacggccacactgtgggaggcctgcagtacggcgggctggggcagctggctgacggagtagtggggttggatgatttcaggaaatcacaggaactgagagtgtggcccgggtatgactacgtgggctggtctaaccattccttcagcagcggatacgtggaaatggagtttgaatttgatagactacgtgccttccaggccatgcaggtgcactgcaacaacatgcatacattgggagccaggcttcccgggggcgtggagtgtcggttcaggcgcggcccagcaatggcctgggagggcgagccgatgaggcacaacctggggggaaatttgggcgaccctcgcgcccgggctgtgagtgtcccacttggcggtcgggtggccagatttctgcagtgccgattcttatttgcaggaccctggctgctgttttctgagatttctttcataagcgacgtcgtgaataatagtagccctgctctgggagggaccttccccccagcaccttggtggccacctggccccccccctacaaatttctctagcctggagctggagcccaggggccagcaacctgtggccaaggcggagggctcgcccacagccatcctcatcggctgcctggtcgcaataatcttgctgctgttgttgattattgctttgatgctctggcggctccactggcggagactcttgagcaaagtgttggagtctcatcccagaacccgcagtccgggcctcgtgggcatcagacctacacccttgcccgtctcccctatggctctgagatgttgttcccctatacagcctaccgcctccttctggccgcttaccccagtgcctctcgaggccagagcaccgccacacccaccagggccaaacccccctacaccacgcggtgttacagggggcaacacttatgcagtcccagcactaccacccggtgcagtgggcgacggtcccccaagggtcgactttccacgttctaggctccggttcaaagagaaactcggcgaaggacagtttggtgaggttcatctgtgcgaggtggacagtccgcaggatttggtgtccctcgattttccgctgaatgtgcgcaaaggtcatccgctcctggtcgcggtaaagatccttaggcctgatgcgaccaagaacgcccgcaatgatttcctcaaggaggtgaagatcatgtctcggctcaaggaccccaacataatccgactacttggggtatgcgtgcaggacgacccgctgtgcatgatcaccgattatatggaaaatggagacttgaaccagtttctgagtgcccaccagctggaggacaaagccgctgaaggtgcacccggcgacggacaggcggctcaagggcccaccatatcctaccccatgttgctgcacgtggccgcccaaattgcttctggaatgcggtatctcgcgacccttaactag

SEQ ID NO: 6290 - DNA, 807 bp, Artificial Sequence
  Description of Artificial Sequence: Synthetic coding sequence
atgaagcagatccttcacccggcgttagaaacgactgatccttgtagtacagggttcgttttcccagccatgacgttgtttccagtgctgctgttcttagtggccggactgctgccatcatttccggctaacgaggataaggacccagccttcacggcactgctgacaactcagacccaggtgcagagggagattgtgaacaagcacaacgagctgagacgcgcagttagtccccctgcacgcaacatgctcaagatggaatggaacaaggaagctgcggccaacgcccagaagtgggcaaaccaatgcaactacaggcattccaacccgaaagatcgcatgacaagcctgaagtgcggagaaaacctttacatgtcttcagctagctctagctggtcccaggccattcagtcttggtttgacgaatacaacgacttcgacttcggcgtgggtcccaagactcccaatgctgtcgtggggcactacactcaggtggtgtggtattcttcctaccttgtgggctgcggcaacgcatattgtcctaaccagaaggttttaaagtactactacgtgtgtcagtactgcccagccggcaactgggccaacaggctctatgttccctacgagcagggggctccatgcgccagttgcccagacaactgcgatgacggtctctgcacaaatggttgtaagtacgaggatttgtactctaactgtaaaagcctgaaactgactcttacctgtaaacatcagctggtgagagattcttgcaaagcttcttgtaattgctccaactccatttattag

SEQ ID NO: 6291 - DNA, 372 bp, Artificial Sequence
  Description of Artificial Sequence: Synthetic coding sequence
atgctacccaagtccagacgggcgttgactattcaagagattgccgcactagcacgctctagtttgcacggcatttcacaggtcgtgaaagaccatgtgaccaaaccgactgctatggctcaggggcgggtcgcccacctgattgagtggaaaggatggagcaaaccttccgacagcccggcagcactagagtccgctttttcctcatatagcgacctgagcgagggggaacaagaggctcgctttgcggctggggtggccgaacagtttgctatcgccgaagccaaactgagagcttggagctctgtggatggagaggatagcactgacgactcctacgacgaagactttgccggcggaatggatacctag

SEQ ID NO: 6292 - DNA, 726 bp, Artificial Sequence
  Description of Artificial Sequence: Synthetic coding sequence
atgggggcagtgatggggacgttcagctcccttcagactaaacagcgtcgcccaagcaaggataagattgaagacgaactagaaatgactatggtgtgccatcgtccagaaggactggagcagctcgaggcccagacgaactttacaaagagggaactccaagttttgtacaggggctttaagaacgaatgtcctagcggcgttgtcaatgaggatactttcaagcagatttatgcccagttcttccctcatggcgcgctgccatgtctggaaggcagtccctgcgttgagtttctgcccccatccccggcattgctcttttgcttggtggacgcttccacatatgcccactatctgtttaacgccttcgatacaacccagacagggtcagtgaaattcgaggattttgtgaccgcgctgtcaatcctcttacgcgggaccgttcatgaaaaattgcgatggacattcaacctgtacgatatcaacaaggacggctacatcaataaggaggagatgatggacatcgttaaggcaatctacgatatgatggggaaatatacataccctgtgttaaaagaggacactccacggcagcacgtcgacgtattcttccaaaaaatggataaaaacaaggatgggattgttaccttagacgagttcctggaaagttgccaagaggatgacaatatcatgcgatctctgcaacttttccagaacgtgatgtag

SEQ ID NO: 6293 - DNA, 630 bp, Artificial Sequence
  Description of Artificial Sequence: Synthetic coding sequence
atgggtcctgaggcactgagcagccttctgctactgctgctggtggccagcggcgatgcagatatgaaaggccactttgatcctgccaagtgccggtatgctctggggatgcaggaccgcacaatcccggattctgatatttcagcgtcatcctcgtggtcagacagtactgcagcccgacactcccgcttggagagcagcgacggcgacggagcatggtgtccagccgggtccgtctttcctaaagaagaggagtatctgcaagtcgatctgcagaggcttcacctcgttgccctggtcgggacacagggacggcacgccggcggactcggaaaggagtttagtcgatcctaccggttacggtattctagggacggtcgacgctggatggggtggaaggataggtggggccaggaggtgatcagtggaaacgaagatcctgagggcgttgtgctgaaagatctgggccctcctatggtagcacgccttgtccggttctatccacgcgctgacagagttatgagcgtgtgtttacgagttgagctgtacggatgcctttggagagacggtttgctgagctacacagcccctgtgggccagacaatgtacttatctgaggccgtatactag

SEQ ID NO: 6294 - DNA, 312 bp, Artificial Sequence
  Description of Artificial Sequence: Synthetic coding sequence
atgcggcagcggttgctcccatcagtgaccagtctgttgctggtcgcgctgctctttcctggcagcagccaggccagacacgtcaaccactccgccaccgaagccctgggcgaactgagagagagggccccaggacaggggacgaatggctttcagctcctaaggcacgctgtaaagcgcgatctgctgcctcctcgtacacccccataccaggttcacatcagtcaccaggaggctagaggcccttccttcaaaatttgtgttgggtttctagggccgcggtgggctaggggttgttcaaccggcaactag

SEQ ID NO: 6295 - DNA, 426 bp, Artificial Sequence
  Description of Artificial Sequence: Synthetic coding sequence
atgaagacgggtctgttctttctctgcctgctgggcaccgccgcggcaatacccaccaacgctaggcttctttccgaccacagtaagcctaccgccgagaccgtcgcccctgataacactgccattccttctctgcgggccgaagcagaggaaaacgaaaaggagactgctgtgtctaccgaggacgacagccaccacaaggctgagaagagttccgtgctgaaaagtaaggaagagtctcacgagcagtctgccgaacaaggaaagtcatcctctcaggagctgggtctgaaagaccaggaagacagcgacggccatctctccgtgaacctggaatatgcgcctaccgagggaaccctggacattaaggaggatatgtctgaacctcaggaaaagaaactctcggaaaacactgacttcctgtag

SEQ ID NO: 6296 - DNA, 642 bp, Artificial Sequence
  Description of Artificial Sequence: Synthetic coding sequence
atgagacttgcaggccctctgagaattgtggtgctcgtggtctcagtgggcgtgacgtggatcgtcgtgagcattctcctgggaggtcccgggagtgggtttcctcggattcaacagctgtttacatcaccagagtcttccgtgacagctgctccaagagcccgcaaatataaatgtgggctccctcagccttgccctgaggagcatctggcttttcgtgttgtgagtggcgccgccaacgtgataggtcctaaaatttgccttgaagacaagatgctcatgtcgtcggttaaggacaacgttggcagaggactgaacattgcacttgtgaacgatgtgaatgacctgcttaagtttattcgccccctgcatgaaggtacattggtgtttgtggcatcctatgatgatcctgctaccaagatgaacgaggaaacacggaaactgttctccgagctcggctccaggaacgcgaaggagcttgccttcagggattcttgggtctttgtgggagcgaagggggtgcaaaacaaatctccattcgagcagcatgtaaagaactccaaacacagtaacaagtatgagggttggccagaggcgttagaaatggagggatgcattcctcggcgctccaccgcttcttag

SEQ ID NO: 6297 - DNA, 2700 bp, Artificial Sequence
  Description of Artificial Sequence: Synthetic coding sequence
atgctgctacttctgctgctggctcccctgttcctcaggcctcctggcgcgggcggtgcacagaccccgaacgcgacctctgaaggttgtcagattattcacccaccatgggaggggggaatcagataccgaggcctgaccagggatcaggtgaaagccattaattttctgcctgtcgattacgaaatagagtacgtgtgccggggagaaagagaggtagtcggaccgaaagtgcggaagtgtctggcgaatggttcttggacagacatggatacaccgtccaggtgtgtgaacaggacaccccattccgagagacgggctgtgtacatcggagcgctcttccctatgtctggaggatggccgggtgggcaggcgtgtcagcctgccgtggagatggcactggaagacgtgaacagtcgtagggatatacttccggattatgagctcaaattgatacatcacgacagtaagtgcgaccctggacaagccactaaatacctgtacgagttgctttataatgacccaatcaaaattatcctgatgcctgggtgttcaagcgtgtctacgctcgtcgcagaagctgcccgtatgtggaacttgatcgtgctctcttatggaagcagttccccagcactttctaatagacagaggtttcccaccttcttcagaacacaccctagcgccaccctgcacaatcctactagagtaaaattattcgaaaaatggggatggaagaagatcgctacgattcagcagacaactgaagtgttcacctccacgttagatgacctcgaggagagggtcaaggaggctgggattgaaatcaccttcaggcagtcgttttttagcgatccagcagttccagttaagaacctgaaacgtcaagatgcgcggattatcgtggggctgttttatgaaactgaggcacggaaggtgttctgcgaggtctataaggagcgacttttcgggaagaagtacgtttggtttttgatcggctggtatgccgacaattggtttaagatctacgatccttccatcaattgcactgtggacgagatgaccgaagctgtcgaaggtcacattacaactgaaatcgtgatgttgaacccagctaacacccgcagtatcagcaatatgacatctcaagagttcgtcgagaaactgacaaaaagacttaagcggcacccagaggagacagggggcttccaggaagcccctctcgcgtacgatgctatctgggcactggccctggccttaaacaagactagcggaggcggggggcggagtggcgtccggttggaggacttcaattataacaatcagacgatcactgatcaaatttacagagcgatgaacagctccagttttgagggggtctcgggtcatgtggttttcgatgcatctgggtcaaggatggcctggaccctgatagaacagctgcagggcggttcttacaaaaaaatcggctattatgacagtactaaggatgatctgagttggtcaaaaacagacaaatggatcggtgggtcaccaccagctgatcagacactggtgattaaaacttttaggtttctttctcagaagctgttcatctctgtttcggttctcagctcgctgggaatcgtgctggccgttgtgtgtctatcctttaatatctataactcacatgtacggtacatacagaattcacagccaaatcttaacaacctgacagcagtcggctgttctttagccctggccgctgtgtttcccctggggttggatggataccacattggacgaaaccagttcccctttgtgtgccaggcacggctgtggctgcttggcttagggttttccctgggttacggaagtatgtttaccaagatatggtgggtccacaccgtgttcactaagaaggaggagaaaaaggaatggcgaaagaccctggagccctggaaactgtacgcgactgtaggtctgctcgtagggatggatgtactaactctcgccatatggcagatcgtggatccccttcaccgtacaatagaaactttcgccaaggaggaaccaaaagaagacatcgatgtttctatcttgccgcagttagagcattgtagtagtcgaaagatgaatacatggcttggaattttttacggatataagggcctgctcctgttacttggcatctttctggcctacgaaactaagtccgtgtccaccgagaagattaatgaccaccgggccgtgggcatggcaatctataatgtcgccgtgctgtgccttattactgcaccagtgaccatgatccttagcagccagcaggacgccgcattcgcctttgcgagtctggctattgtcttcagttcatacataacgctggtagtgctcttcgtccccaagatgcgcagactgattactagaggcgagtggcaaagtgaagctcaggacaccatgaagaccggatcaagcaccaacaacaatgaggaggaaaaatcgcgtcttttggagaaggaaaatagggagcttgagaagatcattgccgaaaaggaagagcgtgtttctgaactgcgacatcagctgcagtcccgccagcaacttcggtccagacgacacccccctactcccccagagcccagcggggggctccccagaggccctcccgagccaccagacaggttgagctgtgacggaagcagggtgcatctgttatacaagtag

SEQ ID NO: 6298 - DNA, 192 bp, Artificial Sequence
  Description of Artificial Sequence: Synthetic coding sequence
atggggcctgaggctttgagttccttgttgctcctccttctggtcgcttccggtgatgccgatatgaagggtcactttgacccagccaagtgtaggtatgccttaggaatgcaagatcgaaccattcctgactctgacatctcggctagttcttcttggtcagactccaccgcagcccgacacagccgctag

SEQ ID NO: 6299 - DNA, 489 bp, Artificial Sequence
  Description of Artificial Sequence: Synthetic coding sequence
gacgaggatcggtatacaacatgctggcccaaaacgtggctggctaaagactgtccggccctgaggatcatctctgtggaatatgatacaagcctgtcagattggagagcccgctgtcccatggagagaaagtcaatcgcatttcgaagtaatgagctgctaaggaaactcagagccgccggcgtcggagacaggccagttgtttggatctcacactctatggggggccttctggtgaaaaagatgctgttagaggctagtactaagcccgaaatgagtaccgtcattaacaacacaaggggaatcatcttttattctgtgccacatcacggcagtagactggccgaatattctgtgaatattaggtatctcctgtttccctctttggaagtaaaggagctgtccaagggcaacacattctgtcataaggggaattggggctacatcaatatatcctatactgagaagaaaaagaaatttctaccttag

SEQ ID NO: 6300 - DNA, 1083 bp, Artificial Sequence
  Description of Artificial Sequence: Synthetic coding sequence
atgcctgagctggtggtgaccgccctcctggctccttcacggctcagcctgaagctgctgagagcctttatgtggtccctcgtgttctcagtggccctggtggccgccgctgtgtacggatgtattgctttgacacacgtactgtgtcgtcctagacgtggatgctgcggtcgtcggcggtctgcctctcccgcttgcctaagcgatcccagtctaggtgagcatggcttcttgaatctgaaatcaagtgggctgcgtcttcattacgtatccgctgggcgcgggaacggcccacttatgctctttctacatggattccctgagaactggttctcctggaggtatcagctgcgagaatttcaatcacgctttcatgttgtcgccgtcgacctgcgaggctatggaccaagcgacgctcctagggacgtggattgttacacaatcgacctactgctcgtggatattaaggatgtaatattggggctagggtactccaagtgcatcctcgtggctcacgattggggcgcgctgctcgcatggcacttttccatatattatccctccctagtggaaaggatggtggtagtctctggcgcacccatgtcagtgtatcaggactattccctccaccatatttctcagttcttccggtcgcactatatgtttctatttcagctgccctggcttcctgaaaaactcttgagtatgagcgactttcagattttgaaaactactctgacccatcggaagacgggcattccctgcctcactccctcagagctcgaggccttcctatacaatttctcacagcctggggggctgacaggaccgctgaactactatcggaacctgttcaggaacttccccttggaaccacaggagttgaccaccccaaccctgttgctgtggggtgaaaaggatacctacttagagcttggattagtggaagccattggctcccgctttgtaccaggccgtctcgaggcacatattctccctggcattgggcattggatcccacagagcaacccacaggagatgcatcaatatatgtgggcctttctgcaggatctgctcgattag

SEQ ID NO: 6301 - DNA, 678 bp, Artificial Sequence
  Description of Artificial Sequence: Synthetic coding sequence
tgagctgatctcccctcctgctggggggctgggccttgctataccgggcataaggtcggcgctctccgcagagatacagtgatatgttgttgcagacatggcgactacagcaccccttgtctttttactccagggaaacctagtcggaacccatccccgtggaagaggacgctgtggacactctccgcaccttgggccggaccagcgggctggactggcgaggaacagaatgcaaccaagactgggcttatcacccggcggccacgtcctttaaggcgcagaccccatccagcgccggcttccccgctgcctgagatcattcgggggaacataccccggatgctcggtaaattcgtaccagtgaattgggaaccccctcagcctctaccgttccccaagtatctgcggtgctacaggtgcctgcttgagacaaaggaattggggtgtctactcgggtctgacatctgcctgacgccagctgggtcttcctgcatcacacttcataagaaaaactcttcaggttctgatgtgatggtgtctgactgccgcagtaaggagcagatgtccgattgtagcaacactcggacatccccagtcagcgggttttggatcttctctcagtactgctttcttgatttttgcaacgacccccagaatcgcggtttgtatacgccatag

SEQ ID NO: 6302 - DNA, 192 bp, Artificial Sequence
  Description of Artificial Sequence: Synthetic coding sequence
atgaagcacgtactgaatttatatctcctgggcgtggttctgaccttgctgagtatctttgtgcgcgtgatggagtctcttgaggggctgcttgaatcaccgagccctggcacctcctggactacccgctcccaactcgccaacactgaaccgaccaaaggcttacctgaccacccgagcaggtctatgtag

SEQ ID NO: 6303 - DNA, 5235 bp, Artificial Sequence
  Description of Artificial Sequence: Synthetic coding sequence
atgcgattactgtgggggctcatctgggcatccagcttttttacgctgagcctgcaaaagccccgcctgcttttgtttagtcccagcgtcgtccatctcggggttccgctatctgtcggggtacagctgcaggacgttcctcggggccaggtcgtcaaaggtagcgtcttcctccggaacccatctaggaataacgtcccttgctcccccaaggtggattttacgcttagctctgagagagacttcgcactgctgtctctgcaagtccctctgaaggatgcaaagagctgcggattgcaccagctgctccggggacctgaggttcagcttgttgcacacagcccgtggctgaaggattcactcagccggacaaccaacattcagggaatcaatttgttgttctccagtaggagaggacacttgtttttacagaccgaccaacccatatataatccaggccagagagtccgttaccgtgtttttgcgctcgatcagaaaatgcgtccaagcacagatactatcaccgtgatggttgaaaactcacacgggttgagagttaggaagaaggaagtctatatgccctcctccattttccaggatgattttgtgatccctgacatatccgaaccggggacctggaagatcagcgctcggttttctgacggcttggagtctaacagctcaacccagttcgaagtgaaaaagtatgtgctgccaaacttcgaggtgaagataacccctggcaagccgtacattctaacagtccctggccacctagatgagatgcagctggatatccaggctaggtacatatatggcaagcccgtgcagggagtcgcttacgtgaggttcgggcttcttgacgaggatggaaaaaagacgttcttccggggattggagtcccagaccaaactggtaaatgggcagagtcatatttcgcttagcaaggctgaattccaggatgccctggagaagttaaatatggggattacagatctgcagggtctgaggttgtacgttgcggcagctatcatcgaatatcccggcggcgaaatggaggaagctgaactcacttcctggtattttgtgagtagtcccttttccctcgacctcagcaaaactaagcgccatttagtccctggagccccgtttcttctccaggcactggtgcgagagatgtctggtagccccgcctccgggatcccagttaaggttagtgccacagtaagtagtcctggatctgtgcccgaggtccaggacatccagcagaacactgacggctcaggccaggtgtccataccgatcatcatccctcagaccattagcgagttacagctgtctgttagcgctggcagcccacaccccgctattgcccgcttgactgtcgctgcacccccatctggaggccccgggtttctttctatcgagagacctgattcccgccctcccagggtcggcgataccctcaacctgaatctcagagccgtcggaagcggagcaaccttctcacactattactacatgatcttaagtcgcggccaaatcgtgtttatgaaccgtgaacccaagcggaccttgacatctgtttcagtgttcgtcgaccaccaccttgcacccagcttctactttgtggctttctactatcacggtgaccatcccgtggcaaacagtctgcgagttgatgtacaggctggtgcctgtgaaggtaagctggagctttcggtggatggtgccaaacaatataggaacggtgagagcgtaaaactgcatctggagaccgactccttagctctggtggccctcggcgctctggacaccgcattgtacgccgcaggaagcaaatcccataagccccttaacatgggtaaggtgttcgaggcgatgaactcatatgatctcggctgcggccctgggggaggagatagcgccctgcaggtgtttcaggccgcggggttagctttcagtgacggggaccagtggacgctgtctagaaagcggctgagttgcccaaaagagaaaacgacaagaaagaaacgcaatgtcaacttccagaaggccatcaatgagaaattgggccaatacgcatctccaactgccaagcgctgttgccaggacggagtgacccggctgcccatgatgagaagctgcgaacagcgggccgcccgtgtccagcagccggactgccgggagcccttcttaagctgttgccagttcgcagagagcttgcggaaaaaatcccgggataaaggtcaggctggactgcaacgggccttagagatcctccaggaagaagaccttattgatgaagatgacatcccggtaagatccttttttccggagaactggttgtggcgggttgagacagtagacaggtttcagatcctcaccctctggttgcccgactccctcaccacgtgggaaattcacggtctgagcctcagcaagaccaaaggcctctgtgtcgccacccctgtgcaactgagggtatttcgcgagttccatctccatctcaggcttcctatgtccgttagacggtttgagcagctagaattgcgtcccgtgctctacaattacctggataagaacctgactgttagcgtacatgtgtctcctgtcgaaggcctgtgcttggctggcggtggggggctcgctcaacaggtcctagtgccggctggatcagccaggcccgtggcattctcagtggtaccaacagcggccgccgcggtaagcctaaaggtggtggcacgaggctctttcgaattccctgtgggcgacgctgtctctaaagtgctgcagattgaaaaagagggtgccatccatagggaagaactcgtgtatgagctgaatccgctcgatcataggggcagaacactagaaatccctggaaactctgacccgaatatgatccccgatggcgacttcaactcgtacgttagggtgactgcctccgatcccctggataccctgggctctgaaggtgctttgtctcctgggggggtcgccagtctgctgaggctgcctagagggtgcggggagcagactatgatttacctggcgcctacattagctgcttcacgttacctcgacaagacagagcaatggtctacattgcctcccgagactaaagaccacgcagtggacctgatccagaaaggttatatgcgcatccaacagttcaggaaagcggatggcagctacgcagcttggctgtcccgagggtctagtacgtggctgacagcattcgtgctgaaggtgctcagtctggcacaggaacaggtgggagggtctccagagaagttacaggagacctccaactggctgctctcacagcagcaggctgacggttccttccaggatctatctcccgttattcatcgctcaatgcaagggggtcttgttggcaacgacgagactgttgccctaaccgcgtttgtgacgatcgcacttcatcacggcctcgccgttttccaagatgaaggcgccgaacctctaaagcagagagtcgaggcttcaatcagtaaagccagctcctttcttggggaaaaggcttcagccggcttgctaggcgcccacgccgcagcaataacagcttacgctctgacacttacaaaggcacctgcagatctcagaggcgtagctcacaataatctgatggccatggctcaagagacaggggacaacttgtattggggctcagtaacaggcagccagtcgaatgcagtcagccccacaccagcccctagaaatccttccgatcctatgccccaggctcccgcactttggatcgaaactacagcctacgcgttattacatttgctgctccatgaaggaaaggccgaaatggctgaccaggccgccgcttggctgacccggcaggggagctttcagggaggtttcaggagcacacaggacaccgttatcgctcttgacgcgttatctgcctattggattgcctctcacaccactgaagagcgaggcctaaatgtgaccctctccagcaccggcaggaatggctttaagtcccacgccctgcagctcaataaccgtcagatacgggggctggaagaagaactccagttttccctagggtcgaaaatcaacgtcaaggtagggggcaacagtaagggcactctgaaggttttgagaacgtacaatgtacttgacatgaaaaataccacatgtcaggacctccagattgaggtgacagtcaaagggcacgtggagtacactatggaggctaatgaagattacgaggactacgaatacgacgagctccccgccaaagacgacccagacgcgcctctgcagcctgtgacgcccctacagctgttcgaaggtcggcgcaatcgtaggagaagggaggccccgaaggtagtggaggaacaggagagccgcgtccactacaccgtatgcatctggcgcaatgggaaggtgggactgtcgggaatggccatagctgatgttactttactctcaggtttccatgccttgcgggcagatctagaaaagctaaccagcctgagcgaccgctacgtatctcattttgaaaccgaggggcctcacgtgttattgtatttcgactctgtccccaccagcagggagtgcgtcggtttcgaagcggtccaggaagtccctgtaggacttgtacaacccgctagcgcaaccctgtacgattactacaacccggaacgaagatgcagtgttttctatggtgcaccatctaaaagccgcttgctggctacgctgtgctcagccgaggtttgtcagtgcgccgaaggaaagtgtcctcggcagcgtcgtgccctggagcgtggtcttcaggacgaggatggctataggatgaaatttgcatgttattaccctcgcgtcgagtatgggttccaggtgaaggtgctgagagaggattcaagagcggctttccggctgttcgaaacgaagatcacacaggtcctgcattttactaaagatgtgaaggctgccgccaaccaaatgcgtaatttcttggtgagggccagctgtcggctcaggctggagcccggtaaagaatatctcatcatggggctagatggggctacctatgatctagagggccacccacagtatctgctcgacagcaacagttggattgaggagatgcctagcgagcgtttatgccgcagcacccgccaaagagccgcctgtgcacagctgaacgacttccttcaggagtatggaactcagggttgtcaggtgtag

SEQ ID NO: 6304 - DNA, 792 bp, Artificial Sequence
  Description of Artificial Sequence: Synthetic coding sequence
atggccgacatgcagaacctggtggagcggctggagagagcagtgggtagactggaagcggtgtctcatacatcagacatgcatcgaggttatgcagactccccatccaaaggagccgcaccctacgtgcaggcgtttgatagcctgcttgctgggcccgtcgcagagtatcttaaaatcagtaaggagatcggtggcgacgtgcagaaacatgccgaaatggttcatacaggcctcaagttggaacgtgcactgctggtcaccgcctcccagtgtcagcagccagcggagaacaagctctcagacttattggcacctatctcagagcagatcaaagaggtgatcacttttcgagaaaagaaccgtggaagtaagctctttaaccacctgagtgccgtaagtgagtctattcaggcactgggctgggtagctatggccccaaaaccaggtccatacgttaaggagatgaatgacgccgcaatgttttatacaaatagagtgcttaaagaatacaaggacgtcgataagaaacacgtagattgggtcaaggcctacctgtccatctggacagagctgcaggcatatatcaaagaattccataccacgggactggcctggagcaagactgggcctgttgcgaaagaactgagcggcttgccttccgggccgagcgcaggcagttgcccaccaccccccccgccctgcccaccccccccgccagtgtccacaatcagttgttcttacgagagcgcctcccggtcctcactgtttgcccagataaatcagggttag

SEQ ID NO: 6305 - DNA, 501 bp, Artificial Sequence
  Description of Artificial Sequence: Synthetic coding sequence
atgggcccagaagctctgtcttcccttttattgttgcttctggtggctagcggcgatgcagacatgaaggggcacttcgaccccgcaaagtgtaggtatgctctgggtatgcaggataggactatccctgacagtgacatctctgcttcatcatcctggtcggactccacagctgcccgccacagccgccttgaatccagcgacggggatggcgcgtggtgtcctgcaggcagcgtattccccaaggaggaagaatatctccaggtggatctgcagcggttgcacctagtggcccttgttgggactcaaggtcgtcacgccgggggtttgggcaaggaattctcacgctcatatagattgaggtatagccgcgacggccggcgatggatgggttggaaagacagatggggacaagaggtgatcagcggtaacgaggatccagagggcgtggtgctgaaagacctcgggcctccaatggtggctcggctggttcgcttctag

SEQ ID NO: 6306 - DNA, 2349 bp, Artificial Sequence
  Description of Artificial Sequence: Synthetic coding sequence
agcatcctgcgcgtcgaggccgtcgacgccgactgcagcccacaatttagccaaatctgtagctatgaaatcataacaccggatgtgccattcactgtggataaggatggctacatcaagaacaccgaaaaacttaattatggcaaggagcatcagtacaagctcacagtcaccgcttacgattgcgggaagaaacgtgccaccgaggacgtcctcgtcaaaatctcaatcaagccaacatgtacacccggctggcaaggttggaataaccgaatcgagtacgagccaggaactggggccctggccgttttccccaacattcatctagagacttgcgatgagccggtagcctctgtacaagcaacagtggagctggagacaagccatatcggcaaagggtgtgacagagatacatactctgagaaatctttacatcggctctgcggcgcagccgctggtaccgctgaactcctgccaagtccttcaggcagtctgaactggacgatgggattgcctaccgacaacgggcacgatagcgaccaagtctttgaattcaatggcacgcaggcagttcgcatccctgatggcgtggttagcgttagcccaaaagaaccgttcacaatcagcgtttggatgaggcacggaccctttggcaggaagaaggagaccatattatgctcctctgataagaccgacatgaaccggcaccattatagcctttacgttcatggctgtaggttgatttttctgttcaggcaggacccgtcagaagagaagaagtacaggcctgcagaatttcactggaagctgaaccaggtgtgtgatgaggaatggcatcactatgtactgaatgtggaattcccatccgtaacgctgtatgtcgacgggacctcccatgaacctttcagcgtcaccgaggattacccccttcacccatcaaagatagaaacacagcttgtagtaggagcatgttggcagggaggagacttacatatgacccagttcttccggggaaacctcgcaggtctgactctgaggtctggcaagctggcagacaaaaaagtaatagattgtctttatacatgcaaagaaggcctcgatttacaggtcttggaggatagcggacgaggggtgcagattcaggcccatccctcgcagttggtactgacccttgaaggagaggatttaggcgaactcgataaggccatgcagcacatcagctatcttaattcaagacagttccctacgccagggatccggcggctgaaaattacctctaccattaaatgcttcaatgaagcaacctgtataagcgtgccacccgtagatggatacgtcatggtgctccagcctgaggaacctaaaatatctctttcaggggtgcatcatttcgcacgtgcagctagtgaatttgaatcctcagagggcgtttttcttttcccagaactgcgaataatatcaaccattacacgggaggtggagccagagggtgatggtgccgaggatcctactgtgcaagagtccctggtgtcagaggaaattgttcacgacctcgatacctgtgaagtcactgtggagggggaggagcttaaccacgagcaggaatcactggaagtagatatggcccgcctgcagcagaaaggcattgaagtgagctcatccgaacttggaatgacctttacaggcgtggacacaatggcctcctatgaggaagtgcttcacctgctgagatataggaattggcatgccaggagcctgctggatagaaagttcaaattgatttgttccgaattaaatggcaggtacatttctaacgaattcaaagtcgaggttaacgtgatccataccgccaaccccatggagcatgcgaaccacatggctgcccaacctcagtttgttcacccggagcataggtcttttgtggacctgtcagggcacaatttggctaatcctcacccttttgctgtagtcccctcgacggccacagttgtgatcgttgtttgtgtgtcgttcctggtattcatgatcatcctgggcgtgttccggattcgtgctgctcataggaggaccatgcgagatcaggataccgggaaggagaatgaaatggattgggatgattcagctctgacaattaccgttaatccaatggagacctatgaggaccaacactctagcgaggaggaggaggaggaggaggaggaggaagagtccgaggatggagaagaagaggacgatatcacatccgctgagtcagagagttctgaagaggaagaaggtgaacagggggacccccagaacgcgacccgacagcagcagcttgagtgggacgacagtaccctgtcatactag

SEQ ID NO: 6307 - DNA, 531 bp, Artificial Sequence
  Description of Artificial Sequence: Synthetic coding sequence
atggcccgaagacattgtttttcttactggctgctcgtgtgttggctcgtcgtgacagttgcggaggctctgtctacgttttatctccagcagcatattaatctacacatggataagaagcggtatctgcggctcctggaaatccataagattatgcgaacactgcctacagccagaagcctccattcccctttgcacttaccccggggagttagaagccaggggcctagtccctcccagcgccacccaggggtgccctccatatttttccacgaaggaccggagagtattctgggttttcagacagacctctccagtctgcagggcgtcacgaccgtcttccattcatcgcactttatcggccacactgtgaccctgctgatcggtatctctccagaagaggactcacgagaggaggcccatctccgcaaagccgagcgagaggaaaagcctaaacatactgaggcaaaaaagtccctgtcgttccgtaaaaaacagcaaaaggacttttgttttatttttcggaactag

SEQ ID NO: 6308 - DNA, 1182 bp, Artificial Sequence
  Description of Artificial Sequence: Synthetic coding sequence
atgagaacattatttaacctgctgtggctcgcgctcgcctgtagcccagttcacacaacccttagcaagtcagacgcaaaaaaggcagcctcaaagactctgctcgagaaaagccaattttcagacaagcctgtccaagatagggggcttgtggtgactgatctgaaggcagagtctgtggtcctcgagcacaggagctactgcagcgcaaaggctcgcgatcgccacttcgcaggagatgtcctgggatacgttaccccttggaacagtcacgggtacgatgtgaccaaggtcttcggaagtaagttcacacagatatctccagtatggctacagctgaaaagaagaggacgagagatgttcgaggtcaccggcctgcacgacgttgaccagggttggatgagagccgtgagaaaacacgccaaaggtttacacatcgtgcctcgactcttgttcgaggactggacttatgacgacttccgtaacgttctggactcagaggacgagatcgaagagctgtcaaagaccgtcgtgcaagtggctaagaatcaacattttgacggttttgtggtagaagtgtggaaccaactactgtctcagaagagagttgggctcatacacatgctgacccatcttgccgaggcccttcatcaggcccggcttctggctctactcgttattcctcctgccatcaccccaggcacagaccagcttggtatgttcacccataaagagtttgaacagctggcaccagtgctggacggttttagtcttatgacatacgactactctactgcgcatcagccagggcccaacgctcctctgagctgggtgagggcttgtgtgcaagtgctcgatccgaaaagtaaatggcgctcaaagattctgctgggacttaacttctatggcatggactacgccaccagtaaggatgcgagagaaccagtggtgggtgccagatatattcagaccctcaaggatcatcggcctagaatggtctgggattctcaggcttccgagcacttttttgagtacaaaaaaagtcggtccggacggcacgtggtgttctatccgacacttaagtcactacaggtgcgcctggaactcgccagggagctgggtgtgggtgtctcaatttgggagctcgggcaagggctcgactatttttacgacctgctatag

SEQ ID NO: 6309 - DNA, 324 bp, Artificial Sequence
  Description of Artificial Sequence: Synthetic coding sequence
atgctgccttgcttagccctgttgctgctgatggagctttcagtttgtaccgtggcgggagacggtggtgaagagcagactctgagcactgaggcggaaacctgggagggagccggtcccagtattcagctgcagcttcaggaggttaagacaggcaaggcgagtcagtttttcggattgatggggaagagggtcggaggtaggccactcatccagccacgccgaaagaaggcttaccagctggagcacaccttccaaggactgcttgggaagaggagtctgtttactgagggtcgtgaggacgaagcacagggctccgaatag

SEQ ID NO: 6310 - DNA, 1086 bp, Artificial Sequence
  Description of Artificial Sequence: Synthetic coding sequence
atggggattattcagtccattttagcaacatctcgtgactgctattccttcaagaaaaagccaattccaaagaaacctactatgctggccttagccaagattctgttgattagcaccctgttttattccctgctgtctggaagccacggcaaggagaatcaggacattaatactacccagaatatcgccgaggtctttaagaccatggaaaataaaccaatctccttagaaagtgaggccaacctgaactccgataaggagaatatcacgactagtaacctcaaagcttctcactctccccccctgaacctacccaataacagtcatgggataaccgacttttcttcaaactcctctgcggagcatagtctcgggtccctgaagccaacaagcacgatctccactagcccccccttaattcactcctttgtgagcaaagtgccttggaatgcacccattgcagatgaagatctcctcccaatctcagcccatcctaatgctactccagcactctctagcgagaattttacatggagccttgtcaatgatactgtgaagactcctgacaattccagtattactgtatccattctaagctctgaacctacgtccccatctgtgactccactgatcgtggagccatcaggttggctgaccaccaattcagattcctttacggggtttacgccgtaccaggaaaaaactactcttcagcccacgctgaagttcaccaataacagcaaactcttccccaataccagtgacccacaaaaggaaaaccgaaataccggaatcgtctttggggctatacttggcgctattctaggagtttccctgctgaccctggtgggatacctcctttgtggtaaaagaaaaaccgactccttctcacaccggagactttacgatgacagaaacgaacccgtgctgcggctcgataacgcacccgaaccctacgatgtgtccttcggaaactcaagctactataacccgactctgaacgacagtgctatgcccgaaagtgaagaaaatgcaagggacgggattccgatggacgacattcctcccttgaggacctctgtttag

SEQ ID NO: 6311 - DNA, 279 bp, Artificial Sequence
  Description of Artificial Sequence: Synthetic coding sequence
atgagaggacccgggcaccccctccttctgggactgctcctggtgctcggacccagccccgagcagagagtggaaatcgtgccccgggacctcaggatgaaggataagtttctaaaacacctcaccggcccattgtatttttcaccaaagtgcagtaaacacttccacagactctatcacaacacgagagattgcacaattcccgcttactacaagcggtgtgcgcggctgctgactcgcttggctgtgagcccggtgtgcatggaagacaaacaatag

SEQ ID NO: 6312 - DNA, 1125 bp, Artificial Sequence
  Description of Artificial Sequence: Synthetic coding sequence
tgaagggtacgcagggggcctttacctgctgacagacctcgagcactgggtcccgcacggcgatgctccaggcatccccatccagcaccgtttagagtgtgtagtgagggagccgcccatcgtctccggcgccccgaacgattaccgctgccatccagggccctccgacctcggcctgcccataccccaatattggggccggcccccagagcttgccctggcgccccgcgagcttccgattctccaacatgcgccgccgccgccgctactgcctggccgaggacaagggccgtggagagaaaaggctgtcaggttgccgcagccgctggagtgaggggtactggttgtccaagccgtgcagatctggaaaaagattcgtggaatgataccaaagaggacgtattcgtgcaccagaccgcgatcaagaagaacaacccgcgcaaatacctgcgttctgttggcgatggcgagaccgtcgagttcgacgtggtcgagggtgagaagggcgcagaggctgctaatgtgactggccctggaggcgtgcctgttcagggctcaaagtacgctgccgatagaaaccattatcggagataccctcggagacgcggcccacctagaaactaccagcagaactatcaaaatagcgagtcaggggaaaagaatgaaggttcagagagtgcccccgaaggccaagcccagcagaggaggccctacagaagaaggcgtttccccccttactacatgaggaggccatacggccgacggcctcaatactcgaacccccctgtgcagggggaagtcatggaaggagccgataatcagggggcaggtgagcagggaagacccgtccgccagaatatgtaccgggggtataggccccgctttcggcgcggaccccctagacaaaggcagccccgggaagatggcaatgaagaagacaaggagaaccaaggagacgaaacacagggacaacagcccccacagcgacgatacagacggaatttcaactataggcgccggcgcccagagaaccccaaaccccaggatggaaaagaaaccaaggccgctgaccccccagctgaaaacagcagtgcgcccgaggccgagcagggaggggctgagtag

SEQ ID NO: 6313 - DNA, 420 bp, Artificial Sequence
  Description of Artificial Sequence: Synthetic coding sequence
atggcacttaggatgctctgggcgggccaggcgaagggcatcctcggaggatggggcatcatctgtttagttatgtcgctgttgttacagcaccctggcgtgtactctaagtgctatttccaggcccaagccccatgtcattacgaggggaaatactttaccctcggcgagagctggctgaggaaagattgctttcattgtacttgtctccatccggtcggagtgggatgctgtgatacaagccagcaccccatcgacttcccggcaggatgtgaagttcgacaggaagctggcacttgtcagttctctctcgtgcaaaagagcgacccccgtctgccctgtaagggaggcgggccggaccccgagtgggggtctgcgaatacacctgtgcctggtgcaccagcaccacactcgagctag

SEQ ID NO: 6314 - DNA, 462 bp, Artificial Sequence
  Description of Artificial Sequence: Synthetic coding sequence
cactactgtaaggaaggctattaccgcgacatggggaaacccattacccacagaaaagcttgtaaagcctgtgactgccaccctgttggagccgccggcaaaacttgtaaccagacaaccggacaatgtccttgcaaagatggtgtgactgggattacctgtaaccgttgcgccaaagggtatcagcagtcacgaagccccatagctccgtgcatcaagatcccagtcgcgccccctactacagccgcatctagcgtggaggaacccgaggcggcaaggcaaccaaataccttccaggccgaaggtctttcccttttgcctggagccgccgagaaggaaggggcccgctgctggggatacagacgccgccttggccatcgcgttgcgcaagccgaatgccgagggccacggtcttgggcctggggccggatcacttccagcttttccttcgcatctaattag

SEQ ID NO: 6315 - DNA, 213 bp, Artificial Sequence
  Description of Artificial Sequence: Synthetic coding sequence
atgttggtgctgtttctgttgggcacagtgtttcttctgtgcccttattggggagaactacacgatccaattaaagggcaaagcatgtatcattactctaagttaagctgcatgaccagttgtgaagatattaacttcttgggcttcaccaaacgcgtcgagctaatttgctgcgatcattccaactactgcaatctgcctgagggcgtctag

SEQ ID NO: 6316 - DNA, 567 bp, Artificial Sequence
  Description of Artificial Sequence: Synthetic coding sequence
atgttccatcaaatttgggccgccttactgtacttctatggaattattctcaattctatctaccagtgccccgaacattcgcagctgacaaccctgggggtagatggaaaggaatttcccgaagtgcacctgggtcaatggtatttcatcgccggggcagctccaaccaaggaggaactggccactttcgatcccgtagacaatatagtctttaatatggcggcaggctcggcaccaatgcagctccacctgcgcgctaccattcggatgaaagacggtttgtgcgtgccacgcaagtggatctatcacttaactgagggatcgaccgatcttcggactgaaggacgtccagacatgaaaacagaactcttcagttcttcatgtccggggggaattatgctgaatgaaacgggtcagggctatcagaggttcctcctatataaccgctcaccgcatccgccggaaaagtgtgtcgaggagttcaagtcactgacttcctgcctggactccaaagccttcctgctcaccccgcgcaatcaagaagcctgcgaactctctaacaactag

SEQ ID NO: 6317 - DNA, 2316 bp, Artificial Sequence
  Description of Artificial Sequence: Synthetic coding sequence
atgggctggctgaccaggatcgtttgcctgttttggggcgtgctcctcactgcccgcgccaattaccagaatggaaaaaacaacgttccacgactgaagctttcttacaaggaaatgctcgaatcaaacaacgtcatcacctttaacggattggcaaattcgtcctcctaccatacctttctgctggatgaagaacgttcaagattgtatgtcggtgccaaggaccacatcttcagttttgatcttgtgaatataaaagattttcagaagatcgtgtggcctgtgtcctacacacgaagggatgagtgtaaatgggcgggtaaagacatcttaaaggaatgcgccaacttcataaaggtgctgaaagcttacaaccaaacacatctgtatgcttgcggaacaggggccttccaccctatttgtacatacattgaaatcgggcaccacccagaggacaatattttcaaacttgagaactcccacttcgagaacggccggggcaagtccccctatgatccgaagctgctgacagcttctctgctgatcgacggggagctctactctggtacagctgctgacttcatgggcagggacttcgccattttccggactttgggccaccaccaccctatcaggaccgagcagcacgatagccggtggcttaacgatccaaaatttatcagcgcacacctcatctcagaatctgacaacccagaagatgacaaagtgtactttttcttccgagaaaatgcgattgacggggagcacagcgggaaggccactcacgctaggattggtcagatctgtaaaaacgacttcggaggtcacaggtctctggtgaataagtggaccacttttctaaaagccagattgatctgcagcgttcccggaccaaacggcatcgacacccacttcgacgaactccaggatgtatttttgatgaactttaaagacccaaaaaacccagtcgtgtatggagtttttacgactagcagcaatatctttaagggttctgccgtctgcatgtactccatgtcggacgtgcgacgggtgttcctaggtccatacgcccatagagacggccctaattaccaatgggttccgtatcagggccgagtgccttatccccggcccgggacctgtccatccaagacctttgggggttttgattctactaaggacttacctgatgacgttatcacattcgcccggagccaccccgccatgtacaatccagtctttcccatgaataatcgccccatcgttatcaaaaccgatgtgaactaccagttcacccagatagtcgtcgatcgagtggacgcagaagatggccaatatgatgttatgtttatcggaaccgacgttggcacagtgctaaaagtcgttagcatccctaaggagacgtggtatgaccttgaagaggttctgctggaggaaatgaccgtgtttcgagagccaacggcgatttccgctatggaactgagtaccaagcagcagcagctttacattggctctactgccggggtagctcaattgccattacacagatgtgacatttacggcaaagcatgcgccgagtgttgcctggccagagatccgtactgtgcctgggacgggagcgcatgcagtaggtacttcccaaccgccaaacgccggacacggcggcaggatattcgtaatggagaccccttgactcattgttccgatctgcaccacgacaaccatcacgggcattctcctgaagagcgaatcatctacggggtggagaacagtagcacatttttggaatgcagccctaaaagtcagcgggccttagtatattggcagtttcagaggagaaacgaggaaaggaaggaagaaatccgcgtggacgaccatattatcaggaccgatcagggactgctgctgcgttctctccagcaaaaggattctgggaattacttgtgtcatgcagtcgaacatggcttcatacagaccctattgaaggtgacacttgaggtgattgacacagagcacttggaagagctgcttcacaaggacgacgacggggacggttccaaaactaaagaaatgagtaactccatgactccctctcagaaagtgtggtatagagatttcatgcagctgataaatcacccaaacctgaataccatggatgagttttgcgaacaggtttggaagagggatcgcaaacagcgccggcagcgtcctggacacactccaggaaattccaacaaatggaagcacctccaggagaacaaaaaagggcgaaaccgtcggactcatgaattcgagcgagctccgagatctgtctag

SEQ ID NO: 6318 - DNA, 1014 bp, Artificial Sequence
  Description of Artificial Sequence: Synthetic coding sequence
atggcaaggccaatgatcaaagaggccaggatggcctcacttctattagagaacccctattatgggtgccgcaaaccaaaagaccaagtccgcagttccttgaagaacgtcagcgatttgtttgtaatgggtggagcgctggtgctggaatcggccgctcttctgcattggctggaacgggaagggtacggcccactcgggatgactggaatatccatgggaggccacatggcatcactggcagtctccaactggcccaagcccatgcctctgatcccatgtttgagctggagcacggcatcaggcgtgtttaccaccggggtgctgtctaaatccattaattggagggaactggaaaaacagtattatactcaaaccgtgtacgaggaagagatcatccatatgcttgaatactgtggaaccgatagctttaagatggggcaggagtttgtgaagcactttacctcctccgcagacaagttgaccaatctaaacttagtatctagaactcttaacctcgatatctctaatcaagtggtgtcgcagaaacctgccgactgccacaattcctccaagacgtccgtatctgcgactagcgaaggcctgctgctccaggatactagcaaaatgaaacgtttcaaccagacgctttcaacaaacaagtctggctataccagcagaaatcctcagtcataccacctgttatcaaaggaacagtccaggaattcactgcgcaaggaaagcctcatattcatgaagggggtaatggatgagtgcacccacgtcgctaacttctccgttcccgtagatccctctctgatcatcgtagttcaggccaaggaggacgcctatattccacgtactggggtgcgctcgttgcaggagatatggccaggttgcgagattagatacctagaagggggacacatctccgcttatctgtttaagcaagggctattccggcaagcaatctacgatgccttcgacaggttcctgcataagtacgctaactag

SEQ ID NO: 6319 - DNA, 462 bp, Artificial Sequence
  Description of Artificial Sequence: Synthetic coding sequence
atgggtccggaagctctgtcatccctccttttgcttttactggtcgccagcggagatgctgatatgaagggtcatttcgatcccgcaaaatgccgctatgctctcgggatgcaggatcggacgatccctgattcggacatcagcgcctctagtagctggtccgactcaactgccgcccgacatagtcgccttgaaagctcggatggcgacggggcgtggtgtcccgcggggtccgttttcccgaaggaggaggaatatctgcaagtagacctgcaacgtttacatcttgtagctctggtaggtacccaaggaagacacgccggaggcctgggtaaagagtttagccgatcgtaccggctcagatacagcagggatgggagaaggtggatggggtggaaggaccggtgggggcaggaggtgattagcggaaacgaagatcccgaaggtgtggtactgaagtag

SEQ ID NO: 6320 - DNA, 345 bp, Artificial Sequence
  Description of Artificial Sequence: Synthetic coding sequence
atggacaaaagcctgctactggagcttccgatattgctttgttgcttccgagcacttagcggtagtttgagcatgcgcaacgacgcagttattgaaatcgtgcagtgccgaatgtgtcatctccagtttcctggagagaaatgtagcagagggcgggggatctgcactgctactacggaggaggcatgtatggtggggcgcatgtttaagcgagacggaaacccatggttgaccttcatgggctgtctcaaaaattgtgccgatgtgaaggggattaggtggtccgtctacctcgtgaatttcagatgctgtcgttcccatgacctgtgcaacgaagatctctag

SEQ ID NO: 6321 - DNA, 630 bp, Artificial Sequence
  Description of Artificial Sequence: Synthetic coding sequence
atgggcccggaggcattgtcctccctgctgctactcttgttagtggcctccggtgacgccgatatgaagggacacttcgaccctgccaaatgtaggtacgcccttggaatgcaggaccgaactatacctgattctgatatcagcgcttcctcctcatggtccgactccactgccgctcgacatagtagattggagtcgtctgatggcgacggagcctggtgcccagctggttccgtgtttcctaaagaggaggagtatctgcaagtcgacctgcagcgcctgcatctcgtagcactggtgggaacccaaggcaggcacgctggaggactaggaaaggaattcagccgcagttacagactccgatattcccgcgacgggagaagatggatgggctggaaggaccgatggggccaggaggtgatctctggtaacgaggacccggagggcgtggttctcaaagatctgggaccgccgatggtggcacgcctggtacggttttatccccgcgcagaccgggtcatgtccgtgtgtctgagggtcgagctctacgggtgcctttggcgcgacggtctgctctcttacactgcgccagtgggccagaccatgtatttgagcgaagccgtgtactag

SEQ ID NO: 6322 - DNA, 639 bp, Artificial Sequence
  Description of Artificial Sequence: Synthetic coding sequence
gattttgggtactgtccacgcgtgtattgtgaaaatcagcccatgttgccaattggtgtactcgtcatggtggggtttacggtgggcaaagtgccagtgcccgatattagaacttgtcacttctgcctcgtcgaagatccatccgtcggatgcatatccggaagcgaaaaatgcaccatctcttcatcctctctgtgcatggtcatcacaatttactatgatgtgaaagttcgttttattgtccggggatgtggacagtatatatcatatcgctgccaggagaagcgaaatacctacttcgctgagtattggtaccaggcgcagtgctgtcagtatgactactgtaattcttggtcttcaccgcagctgcagagctcattgcctgagccccacgaccgtcccctcgccctgccgttatccgactcacaaatccagtggttctatcaggccctcaatctgagcctgcctttgcctaactttcacgctgggaccgagcctgacggcctggatcctatggtgacactctctttaaacctgggtcttagttttgccgaactcaggaggatgtacctgtttctcaactccagcggccttctcgtactgccccaagccggccttttaactccacacccctcttag

SEQ ID NO: 6323 - DNA, 240 bp, Artificial Sequence
  Description of Artificial Sequence: Synthetic coding sequence
atgaagctgcattcactgatttctgtgctgctcctctttgtcaccctgatccctaagggtaaaactggcgtgatccccggccagaagcagtgtattgctctcaaaggagtctgtagggacaagttgtgctccacacttgatgacacgatcggaatttgtaacgaagggaaaaaatgctgcaggaggtggtggatcctcgagccttatcccacgcctgttcccaaaggtaagtcgccttag

SEQ ID NO: 6324 - DNA, 1620 bp, Artificial Sequence
  Description of Artificial Sequence: Synthetic coding sequence
atgtcagagccacaagagaagaagctgtcggagaacaccgatttcctggctccaggagttagcagttttactgattcaaaccagcaggagtctattacaaagcgcgaagaaaaccaggaacaacctcgtaactattcccaccatcagctcaatagatcctccaagcattctcagggtctgcgcgatcagggaaaccaggagcaggatcccaacattagtaacggagaggaggaagaagagaaggagccaggagaagtcggcacccataacgacaaccaggagcgaaaaactgaactgccacgtgagcatgccaactccaagcaggaagaggacaatacccagtccgacgatatcttggaggagtccgatcagccaacacaggtgtctaagatgcaagaagacgagttcgaccaaggtaaccaggagcaggaagacaattctaatgccgaaatggaagaggaaaatgcttcaaacgtaaacaagcacatccaggagacagaatggcagagccaggaggggaaaacaggactcgaggccatcagcaatcataaggaaacagaggagaagacagtttccgaagcccttctgatggagccaacagacgacggcaacacgacgccaaggaatcatggcgtagatgatgacggtgacgacgatggggacgatggtggcaccgatggaccgcgccatagcgccagcgacgattactttattccaagtcaagcgttcctggaggccgaaagagcccagtctatcgcttaccatctgaagatcgaagagcagagagaaaaagtgcatgaaaatgagaacattggcacaaccgagcccggtgagcaccaggaggctaaaaaagcagaaaattcgtccaatgaggaggagacctcatcggaaggcaacatgagagttcacgctgtggatagctgcatgagctttcaatgcaagcgagggcacatttgtaaagcagaccagcagggcaagccccattgcgtatgtcaggaccctgtgacgtgtccacctacaaagccgttagaccaggtctgcggaaccgacaatcaaacgtatgcgtcttcatgtcacctgttcgcaacaaagtgtaggctagagggcactaaaaagggacaccagctgcagctcgattattttggggcttgcaagtccatccccacatgtactgattttgaggtcattcagttccccctgagaatgcgcgactggctgaagaatatcctcatgcagctgtacgaagcgaactcggaacatgcaggctacctgaatgaaaagcagcgaaacaaggtcaaaaaaatatatttagacgaaaaacgactgctggctggggaccatcccatcgacctgctgttgagagacttcaaaaaaaactaccacatgtatgtctaccccgtgcattggcagttctctgagctggatcagcatcctatggatagggttctgacccactccgaactggcacccctgcgcgcatccttagtgcccatggagcactgtatcaccagattctttgaagaatgtgaccctaataaggataaacacattaccctcaaagaatggggtcactgcttcggaattaaggaagaggatatcgacgaaaacctgcttttttag

SEQ ID NO: 6325 - DNA, 2535 bp, Artificial Sequence
  Description of Artificial Sequence: Synthetic coding sequence
atgggtcccggtgctccatttgcccgcgtggggtggccactgccactgctggtggtgatggcggccggagtcgcgcccgtgtgggcatcccattccccacatctcccaaggccacactctagagtgcctccccacccctcatccgaacgtagagccgtgtacattggtgccctgtttccgatgtccggaggttggccagggggacaggcttgtcagcccgcagtagagatggccctcgaagatgtcaactcccggcgggatatcctgcctgactacgagctcaagttgatacatcatgactctaaatgtgaccctggccaagctactaagtatctgtacgagctgctttataacgatccaataaagataatcctgatgcctggatgctcctcagtgtccaccctggtggccgaagccgcacgaatgtggaacctgatcgtgctttcctatgggtcctcgagtcccgcactttctaatagacagagattccctaccttctttcggactcacccctctgccaccttacacaaccctacacgcgtgaaactgttcgagaaatggggttggaagaagatcgccaccattcagcagacaaccgaggtgtttacgagcaccctggacgaccttgaggagcgcgtaaaggaggccgggatagaaattactttccgacaaagctttttttccgatcccgccgttcctgtgaagaacctgaagcgacaagatgctaggataatcgtgggcttgttctacgagacagaggcccgcaaagtgttctgtgaggtgtataaagagcggctcttcggcaagaagtacgtttggttcctcataggatggtacgctgataactggtttaagatttatgaccctagcataaattgcacagtggatgaaatgactgaggccgtggaggggcatatcacaaccgagattgtaatgcttaatcctgcaaatacgcggtcaatctccaacatgacctctcaggagttcgtcgaaaaacttactaagagactgaagagacacccagaggaaacaggcggcttccaggaggcgcccctcgcttacgatgctatctgggccctagccctggcactaaataaaacctcaggggggggcggacggagcggggtgagattggaggactttaactataataatcagacaattaccgatcagatctaccgggcaatgaactcaagcagcttcgagggcgtgtcagggcatgtggtgttcgatgcctcaggctctaggatggcatggaccttgatcgaacaacttcagggaggcagctacaaaaaaatcggatattacgacagcactaaggatgatctcagttggtccaagactgataaatggataggaggtagcccccctgcagatcagacactggtgatcaagacattccgtttcctcagccagaagttattcatttctgtctcagtcctgagcagccttggcattgttctggccgttgtgtgcctcagtttcaatatctataactcccacgtgcggtatatccagaactcccagccaaatctgaataacttaactgcagtaggctgtagcctggcactggctgctgtgttcccgttaggtctggacgggtatcatataggcaggaaccaattcccattcgtttgccaggcaagactctggctgctgggcctggggttttcactgggctatggctccatgttcactaaaatctggtgggtgcacaccgtttttaccaagaaggaagagaaaaaagaatggagaaagaccctcgaaccctggaaactttacgccacagtgggcctcctggtgggcatggacgttctcactcttgccatttggcagatagtagaccctctccatcgaaccatcgagactttcgccaaggaggagcctaaagaggatatcgatgtctctatcttgccacagctggaacactgttcgtcaaggaagatgaacacatggctgggaatcttctacggttacaaggggctcctactgctccttggaatctttctggcatacgaaactaagtctgtatcaactgagaagattaacgaccacagggctgttggcatggccatttacaacgttgcagttttgtgtctaattactgcccccgtcaccatgatcctgtctagtcagcaggacgccgcctttgccttcgctagcctggctatcgtcttcagctcttacataacactggtcgtgctgttcgtgccaaagatgcgacggcttatcacaaggggcgagtggcagtcagaggctcaagacactatgaagaccggttcttcaactaataacaatgaggaagagaaatccaggcttttggagaaagagaatcgggaactggagaaaattattgctgagaaggaggagcgggtgtccgaactccgtcatcagttgcaaagtcggcagcagctgaggtctaggaggcatccaccaacgccaccagagcctagtggcggccttcctaggggcccccctgaacccccagatcgcctgtcttgcgatgggtccagggttcatctgctgtacaagtag

SEQ ID NO: 6326 - DNA, 993 bp, Artificial Sequence
  Description of Artificial Sequence: Synthetic coding sequence
atgcagctgtttctcttgctgtgccttgtcttgctgtccccacagggggccagcctccaccgtcaccaccccagagagatgaaaaagcgagtagaggacctccacgttggggcaaccgtggccccgtccagccgaagagactttacttttgatctgctaggcaatgctctgttcacggatctagttgtggacttacaggatacgtttgtctctgccatgaaaaccttgtacctggcagatactttccctacaaatttcagggatagcgcaggcgcaatgaaacagataaacgactacgtagcgaaacagacgaaggggaaaatagtggacctcctgaagaatttagactctaatgcggttgtcatcatggtgaactatatcttttttaaagctaaatgggaaactagcttcaaccacaagggtacccaggagcaagatttctatgttacgagcgagacagtggtccgcgttcctatgatgtctagagaggatcagtaccactacttactggataggaacttgtcatgcagagttgttggcgtgccataccaggggaatgctactgccctctttattctcccctccgagggaaaaatgcaacaagtggagaacggcctttccgagaagacactaaggaagtggcttaagatgtttaaaaaacgtcagctggaactttacctgcctaaatttagcatagagggatcctaccagctggagaaggtgctaccctcgttaggtattagcaacgtcttcacctcacacgccgatttgtccggcatctctaaccactctaatattcaggttagcgaaatggtccacaaagctgttgttgaggttgatgagtctgggacacgcgccgccgcagcaaccggaacgattttcaccttcaggagtgctcgactgaatagtcagcggctggtctttaataggccgtttctgatgtttattgtcgataataacatcctgtttttggggaaggttaatcggccctag

SEQ ID NO: 6327 - DNA, 2676 bp, Artificial Sequence
  Description of Artificial Sequence: Synthetic coding sequence
atgctccccactgaggtgcctcagtctcatcccgggccttccgctctcctgttgctgcagctcctcctcccccctacctcagcattcttccctaacatctggagcctactggccgccccaggcagcattacacaccaggatttaacagaggaggctgccctgaacgttactctccagctatttctcgaacagccgccgcctggccggcccccgctgaggctggaagatttcttgggtcgcacgctactggccgatgatctattcgccgcctactttggccccggctctagccgacgcttccgcgcagccctgggcgaggtgtcgcgcgctaatgcagcccaagactttttgcccacctcccgcaacgacccagacctacacttcgatgctgaacggttagggcaagggagagcacgcctggtgggcgcccttagagaaacagttgtagctgcacgagcgctagatcacactcttgcccgacagagactaggcgcggccctgcatgccttgcaggatttctactcccatagcaactgggtggagctgggggagcagcaaccccacccacacctgttatggcccagacaggagctccaaaatctggcccaggttgctgacccaacttgcagcgactgcgaggagctttcttgcccccggaactggctggggttcaccctgttgactagtggctatttcggcacacaccctcctaagccaccagggaagtgttcccatggtggccactttgatcgatctagctcacagccacctcgtggagggatcaacaaagacagtacttcacctggcttttcaccccaccacatgctccatctgcaggccgccaaactggctctgctggccagtatccaggcattctcccttttacggtccaggctgggtgacagggacttcagtcggttactcgacatcactcctgccagcagtctaagctttgtgctggacaccacagggtccatgggtgaggaaattaacgccgccaaaatccaggccaggcatctggtggagcaacgccgtggatccccaatggaacctgtgcactatgtcctagttcccttccatgatcccgggttcggacccgtgttcactacttccgacccagacagcttctggcagcaattgaatgagattcacgcgcttggaggaggcgacgaaccagaaatgtgcttgtctgctcttcaattagctctgctccatactccacctttgtcagacattttcgtgttcacagacgcctcacccaaagatgcgttcctgacaaatcaggttgagagtctgacccaagaacggaggtgtagggtgacctttctcgtgactgaggatacctcccgcgtgcagggcagggcaaggcgtgaaattctgagtcctctgcggttcgagccctacaaggctgtagctctggcttcaggcggtgaggtgatattcaccaaggaccagcatattcgggacgtggccgccattgtcggggaatccatggctgccctggtgacgttaccgttggatccacccgtggtggtaccaggccagcctctcgtatttagcgtcgatggattgctgcaaaagatcacggtgcgtattcatggagacatatcctccttttggattaagaacccagccggcgtgtctcagggacaagaggagggggggggacccctgggccataccagaagatttggtcagttctggatggttaccatggacgatccgccccagactgggacctgggagatccaagtgacagctgaggacacaccgggtgtgcgcgtgcaggctcagacatcactagactttctattccactttggaatccctatggaagacggcccccatccgggcctatatcccttgacccaacccgtggccgggcttcagactcaattgctcgtggaagtcactggcctgggttcacgcgcgaacccaggcgatccccaaccacatttttcccatgtgatactgaggggggtccccgagggggcggagcttggtcaggtcccgctggagccagtgggaccccctgagcgcggactgctagccgcctccctgtcgccaacattactgagcactcccagacccttctctctggagctgattggccaggatgcggctggccgcagattgcaccgcgctgctccccagcctagcactgtcgtccctgtcttgctcgagttgagcggtccatctggctttctggccccaggaagcaaagttcccttgtccctgagaatcgcctccttttcaggcccacaggacctggatctccggacttttgtaaatcctagcttttcccttacctccaatttaagccgggctcacctcgagttgaacgaatctgcctggggacgcttatggctggaggtgcccgacagcgcagcccccgacagcgtagtgatggtaacagtcactgcaggtgggcgggaagccaatcctgtgccaccaacacatgcctttttgagactcctggttagcgcccccgcaccacaagaccgccacactactccaacagggtcgtccgacccgattctgactacagccactcccgccttcagtcccttcaccctggtcacacagggccgcgccggagccgggcttgcggctggatcaccctggtggggtacagtgggcggcgttttactcctgcttggactagcgtcttggtag

SEQ ID NO: 6328 - DNA, 708 bp, Artificial Sequence
  Description of Artificial Sequence: Synthetic coding sequence
atgaagtacgtgttctacctgggcgttctggcagggacatttttcttcgcagattcatccgtgcagaaagaggatccagcaccctaccttgtgtacctgaagtcacacttcaacccgtgcgtgggcgtgctgatcaagccctcatgggtgcttgcaccggcacattgttatctccccaatctcaaagtgatgttagggaacttcaaatctcgcgtgcgtgatggaacagagcagaccataaaccctatccaaatcgtcaggtactggaactactcacactccgccccacaggacgatttgatgctcattaagttagcgaaacctgcaatgttaaaccctaaagtgcagccactgactctggcaaccacaaatgtgcggcctggaactgtttgtctactgagtggcctcgattggagccaggaaaatagcgggcgacaccccgacctccgacagaaccttgaagcacccgtgatgtctgacagggaatgtcagaagactgagcagggtaagtcccaccggaacagcctctgtgttaaattcgtgaaagtgtttagccggattttcggtgaggtcgcagtggctacagtcatttgtaaagacaaacttcagggaatagaggtcggccactttatgggcggggacgtgggcatctatactaacgtctacaagtatgtgtcatggattgaaaacactgcaaaggacaagtag

SEQ ID NO: 6329 - DNA, 1386 bp, Artificial Sequence
  Description of Artificial Sequence: Synthetic coding sequence
atgtcgctagacatccaatccttggatatccagtgcgaggagctctctgatgcgagatgggccgagctgctgccgctcctgcaacagtgtcaggtggtacgccttgatgactgcgggctgacagaagcacggtgtaaagatatttcctctgctctacgggttaaccccgccctggctgagctcaacctgaggtccaacgaactcggcgatgtgggtgtgcactgcgttctgcagggactgcagaccccaagttgcaagatacaaaaattgtctcttcagaattgctgcctgaccggagctggatgcggagtccttagcagcacactgcgcaccttgcccacactgcaggagctgcatctgagcgataatctgttgggcgacgctgggctgcagctgttgtgtgagggcctactggatcctcaatgtcgtctggagaaacttcagctagaatactgcagcttgtctgcggcctcctgtgaacccctggccagcgtactccgggccaagcccgattttaaagagttaaccgtgtcaaataacgacatcaatgaggccggagtgagggtgctatgccaagggctgaaagattccccgtgccagctggaggcccttaagctcgaatcatgtggtgtgacgtctgacaattgccgagacctgtgtggtattgtggcctccaaggcaagtttgagggaactggccctaggaagtaataaacttggcgacgtcggcatggctgagctgtgtcctggtcttcttcacccgtcctctcggttaaggactctgtggatctgggagtgcggcatcacagcgaaggggtgtggcgatctgtgccgagtgttaagggctaaggagtctctcaaagagctttcactggccgggaacgagttaggggacgagggcgcccgtctgttgtgcgaaacgttgttggagcccgggtgtcagctcgaaagcctgtgggtgaaatcttgtagcttcactgccgcctgctgctcccatttcagctccgtgctggcccagaaccgtttcctcttagaattgcagatctctaacaatcgtttagaggacgccggcgtgagggagctttgccagggtctcggtcagcccgggtcagtccttagagtcctttggctggccgattgtgacgtgagcgattcctcttgctcctctctggcagctaccctccttgccaatcacagcttgagagaactcgatctctctaataactgcctcggtgacgctgggattctccagttagtggagtcagttcgccaacccggatgcttactcgaacagttggtgctttacgatatatactggtccgaagaaatggaggaccgattacaggccctcgaaaaagataagccatctctgagggttatctcatag

SEQ ID NO: 6330 - DNA, 2676 bp, Artificial Sequence
  Description of Artificial Sequence: Synthetic coding sequence
atgctgcccactgaagtccctcagtcccatcccggacctagtgccctcttgctgctgcagctcctgctgcccccaacatcagctttcttccctaatatctggtcattactggctgcacctggttccatcacccatcaggacttgacagaggaggcggcccttaacgtgaccctccaactattccttgagcagcccccccctggacggcctcctctacgactcgaggactttctcggacggaccctgctggccgacgacctctttgccgcctattttggaccaggaagtagccgaaggtttcgggcagctcttggagaagtgagccgcgctaacgcagctcaggacttcttgcccacgtcacggaacgaccctgacctgcacttcgatgctgaacgtctgggccaggggcgggctaggctggtgggggcactgcgggaaaccgtcgtggccgcacgggctctagaccacactctggcccggcaacgattgggagccgcactgcacgcccttcaggatttttacagtcattccaattgggtcgaactaggagaacagcagccacacccacacctcttgtggccacggcaggaattacaaaacctggcacaagttgcagacccgacatgtagtgactgcgaagaacttagttgtccccggaattggctaggtttcacccttttaacaagtggctacttcggcacacaccccccaaagcccccaggaaagtgtagccatgggggccatttcgatcgctcctcatcccagccccctcggggaggtataaacaaggatagcactagcccgggcttctctccacatcatatgttacacctccaggctgctaaactggccctgctggcatccatccaggcctttagcctgctcaggtctcggctgggcgatagggactttagcaggctgctggacatcactcccgccagttcgctctctttcgtgttagatacgactggttctatgggggaagagattaatgctgcaaaaatccaggcacgtcatttagtggagcagaggagaggatcccctatggaacccgtgcattatgtccttgttcctttccatgatcccggcttcggaccagtctttacaacttctgatccagattcattctggcaacagctgaatgagatccacgccttagggggaggagacgaaccggagatgtgcctctcagctctacagctggccctccttcacacgccgccactgagtgacatcttcgtctttactgacgcttcgcctaaggacgcatttcttactaaccaagtagagtctttgacccaggaaagacggtgcagagtcacctttctggttactgaagacacttccagagtccaaggccgggccagacgcgagatcctgagtccccttcgcttcgagccttacaaggctgtggctctcgcttccggtggagaagtgatctttaccaaggaccagcatattagagatgttgctgcaattgtgggggagtcaatggctgctttggtcacattaccgctggacccccctgtggtggtccctggccaaccactggtgttctcagtggacggactgctccagaaaataactgtgaggattcatggcgacatctccagcttctggatcaagaatcctgcgggagtctcccagggacaggaggaagggggcggacccctcggccatactaggagatttgggcaattttggatggtgacaatggacgacccaccccaaacaggcacttgggagatccaagtcaccgcggaggacacaccaggagtccgcgtgcaggcccaaacatccctggacttcttgttccatttcgggattccaatggaggacggacctcatccagggctctaccccttgacccagccggtggccggactccagacgcaactgctggtggaggttaccggcctggggtcccgcgccaaccctggcgatccccaaccacatttttcccacgttatcctaaggggcgtgccagagggggctgagcttggccaggtgcccctggagcccgtaggtcctcccgagcgtggccttcttgctgccagcctgagtccaaccctcctaagtacaccccgacccttcagtctcgaacttattggccaagacgccgcaggtagacgcctgcacagagctgcgcctcagccctctacagtggtgccggtgctgttggagctcagcggtcccagtggattcttggcccccggatcaaaggttccattgtccctccggatcgcgtcttttagcggcccccaagacttggacttgcgaacgtttgtgaacccgtccttcagtctgacctcgaacctgtctagggcgcatctggagctgaatgagagtgcctgggggcggctctggttggaggtgcccgacagcgcagccccggacagcgtggtgatggtcacagtgaccgccggcggccgagaagccaatcctgtgccccccacccacgccttcttgaggttattggtgagtgcccctgctccacaggatcgtcacactacacccactggctcctccgaccccattcttaccaccgctacaccggcttttagccctttcaccctggtcacccagggcagggcaggcgccggtttagccgccgggtccccatggtggggtacggttggcggagtgctacttttactcggcctcgcttcatggtag

SEQ ID NO: 6331 - DNA, 501 bp, Artificial Sequence
  Description of Artificial Sequence: Synthetic coding sequence
atggggccggaggcactcagctcactcctcttgctgcttctggtggcctccggcgatgctgatatgaagggtcacttcgaccctgctaaatgcagatatgctctggggatgcaggataggacaatccccgattctgacatcagcgccagcagctcttggagtgacagcacggccgcccggcacagccgccttgaaagtagtgatggcgatggtgcttggtgcccagccggtagcgtgttccccaaagaggaagagtatttgcaggttgaccttcaaagactgcaccttgtggctctggtgggtacccaaggccgtcacgccgggggcctcgggaaggagttcagcagaagttatcgactgaggtactcccgggatggccgtcgctggatgggctggaaggatagatggggtcaggaagtcatcagtggtaatgaagacccggagggggtggtcttgaaagacttagggccaccgatggttgcgcgattagtacgtttctag

SEQ ID NO: 6332 - DNA, 420 bp, Artificial Sequence
  Description of Artificial Sequence: Synthetic coding sequence
atgcaggcagcctgttggtatgtgttatttctgctgcagcccaccgtttacctggtcacctgtgctaatcttacgaacggaggaaagagcgagcttctgaagtctgggtcttctaaatccaccttgaagcacatctggacagaaagtagcaaggacttgagcataagtcggttgctgagtcaaacatttcgagggaaagagaatgacacggacctggaccttagatacgacaccccagaaccctattccgaacaagatctctgggactggctgaggaacagtacggatcttcaggagccacgcccccgagccaagaggagaccaatcgtgaaaacagggaagtttaagaaaatgttcggttggggtgacttccactctaatatcaagaccgtgaagttgaatctgttgattacaggatag

SEQ ID NO: 6333 - DNA, 2412 bp, Artificial Sequence
  Description of Artificial Sequence: Synthetic coding sequence
atggccgctgccggcctggtcgctgtggctgctgcagcggagtactcaggaacagtggcctccggaggcaatctccctggggtgcactgcggaccatcctctggagccggccctgggtttggtcccgggagctggtctcgatcactggacagggccctcgaggaggccgctgtgacaggagtgctatccctgtccggacgcaagctgcgcgagtttccaaggggtgctgctaaccatgatttgacagatacaacacgcgccgacctctctagaaacagattgagtgagatcccaatagaggcgtgtcatttcgtttctctggaaaaccttaatctatatcagaactgcattagatacatcccagaagcaatactcaaccttcaggcattgacatttctcaatatttcacggaatcagctgtcaaccttgccagtccatttgtgtaacctgcccctgaaagtgctgattgcctccaataacaagctcgtgtctctgcccgaggagatcggccatctccgtcacttaatggagttggatgttagctgtaatgaaatacaaaccattccctctcaaataggcaatctcgaagctttacgtgatcttaacgtgcgccgcaaccatctcgtacatctccctgaggagctcgctgaactgcccctgatcagattagacttctcatgcaataagatcaccacaatacccgtatgctatcgcaaccttaggcacttgcagactatcacactggataataatcctctccaaagccccccagcgcagatttgcatcaaagggaaagtgcatatctttaagtatttaaacatacaggcttgtaagatcgctcccgacctaccagactacgaccgacggcctctcggttttggctcatgtcacgaagaactctactcaagtcggccttatggagcactagacagcggatttaattcggttgactcaggggacaagaggtggtctggaaatgaaccaacagatgagttttctgatctacctctcagggtagctgaaatcacgaaggaacagcgcctccgtagggagtcacagtaccaggagaacagagggagtctggtcgtgaccaatggaggagtggaacatgacttggatcagatcgactatatcgatagctgcaccgcagaggaggaggaagcggaagtcagacagcccaagggccctgacccagattctttgtcctcacagttcatggcatacatcgaacagaggaggatcagtcacgaagggtccccagttaagcctgtcgcaattcgggagtttcagaagacagaggatatgcgtagatatctgcatcagaaccgcgttccagccgagcccagctcacttttaagcctgagcgcctctcacaatcagctttcccatacagacttggagttgcatcaacgacgagaacaattggtggagagaaccaggagggaggctcagctggccgctctgcagtacgaagaggagaagataaggactaagcagatccagagagatgctgtcttggattttgttaagcagaaggcatcccagtctccccagaagcagcatccattgttggacggcgtggatggagaatgcccatttccctccaggagaagccagcatacagacgactcggccctctgcatgagtttgagcggcctgaaccaagttgggtgtgctgccacactgccacatagcagcgcgtttacgccacttaagagcgacgatagaccaaacgccctgcttagttctcctgcgaccgaaactgtgcatcattctcccgcttactcctttcctgccgctatccagcggaatcaacctcaaagacccgagagtttcctgttccgcgccggtgtgcgggccgaaactaacaagggacatgcgtcacctctgcccccgtccgcagcgcctactaccgattctacagactccatcactgggcagaacagccgtcagcgggaagaagagttggagctgatcgaccaactgaggaagcatattgagtaccggctgaaagtcagcctaccttgtgacctcggggctgctctgactgacggagtagtgttgtgccatcttgctaatcacgtgagaccaagaagtgtgccctctattcatgttccatcacctgccgtcccgaaattgacaatggcgaagtgtcggcgtaacgtggaaaattttttggaagcctgccgcaagataggcgtaccgcaggacaacctgtgttctccatctgacatcctccagcttaacctgtcggtgaaaaggactgtggaaacactgctttcgctcggcgcgcattctgaagaatctagctttgtgtgtctctcactgcaactcttaggctttgtggcgttttactgtacagtgatgctgacgttgtgtgtactatactattggcttttccctgcccgttag

SEQ ID NO: 6334 - DNA, 633 bp, Artificial Sequence
  Description of Artificial Sequence: Synthetic coding sequence
atgtacaaagccagaccgcctgccggctcaggcggcccgggtgctgagcctcctgcaatggcggccccaagaggtcgcgcggcgccctggacaaccgctctactgcttctcttagcatcccaggttctctctccaggttcctgtgcagacgaggaagaggtaccagaagagtgggtgctgctccacgttgttcagggccagataggtgctggcaactatagttacctgcgcctgaatcatgagggcaaaattgttttacgcatgcgatccctgaaaggagacgctgatctctatgtcagtgcctcatcactgcacccttccttcgacgactatgagcttcagtctgccacttgcgggcctgacgctgtctccattcctgcccactttcgccgtccagttggcatcggcgtgtacggccatcccagccatctggagtccgaatttgagatgaaagtatactacgacggcaccgtcgagcagcatccgttcggagaagccgcttacccggccgatggagccgatgccgggcagaagcacgcgggagcaccagaagacgcctctcaagaggaggaatccgtgctgtggacgatcctcatatcaatcctgaagttggtgctggagattctgttttag

SEQ ID NO: 6335 - DNA, 486 bp, Artificial Sequence
  Description of Artificial Sequence: Synthetic coding sequence
tgatgtcccacagagataatagccttcggcgataggctcgaggaattccgatccatcaacaccgaggtggttgcgtgtagtgtcgattctcagtttactcacctggcctggataaatacgccccgaaggcagggtggacttggccctatccgtatccccctactgtccgacttgacacaccagatcagcaaggattacggagtgtacctggaggactctggccacacccttcgtggcctgttcattatcgacgataaaggcatcctcaggcagattacactcaacgatctccctgtcggccgctctgttgacgagacccttaggttggtacaggccttccagtacacagataagcacggcgaggtgtgtcctgccggctggaagccagggagtgaaactatcaagcccgaggacaccatgaaagcgtggtggcctcgcgaaagctataaccccaggtcatcctggaaggctgaggtctttcggtag

SEQ ID NO: 6336 - DNA, 2886 bp, Artificial Sequence
  Description of Artificial Sequence: Synthetic coding sequence
atgctcctgctgctcctgctggccccattgtttctaagaccccccggcgctggcggagcccaaacacccaacgctacctcagagggctgtcagataatccatccaccctgggaagggggcatacggtacagggggctgacacgcgatcaggtgaaggccataaatttcctgcccgtggattacgaaatcgaatacgtgtgtagaggtgagagggaggtggtgggcccaaaggtgaggaagtgtctggctaatgggtcttggactgatatggacaccccctctaggtgcgtgaggatatgtagtaagtcttacctgacactcgagaacggaaaggtctttcttactggcggagaccttccagctctagacggagcgcgggtggattttaggtgcgacccagacttccatctcgtgggtagcagcaggagtatttgttcccagggacaatggagcacccccaagccccattgccaggtgaataggactccacactccgagcgacgtgctgtttatattggtgccctatttccaatgagtgggggatggcccggaggtcaggcatgccaacccgctgtggaaatggcactggaagatgtcaacagcaggcgggatattctgcccgattatgagctgaagctgatacatcacgattcgaagtgcgatcctgggcaggcgaccaagtatctgtatgagttattgtacaacgaccccatcaagattatcctgatgccaggctgttcttctgtcagtactcttgtggccgaggccgcgcgcatgtggaacctaatcgtgttatcgtatggcagctcttccccagcactgtcgaataggcagcggtttcccacctttttccgaacccacccatctgcgaccctgcacaaccccactcgcgtgaagctgttcgagaaatggggctggaagaaaattgcaaccattcagcaaacaactgaggttttcacctcaaccctggatgacttagaggaaagggtgaaagaggcaggcattgaaattaccttcagacagtcgtttttctctgatccagccgtaccagtaaagaatctcaagcgccaggacgcccgaatcatcgtgggccttttctatgagacagaggcacggaaggtgttttgtgaggtttataaggagagactgtttggtaagaaatacgtatggtttctcattggatggtatgctgataactggttcaaaatatacgaccctagcattaattgcaccgttgacgagatgaccgaagctgtggaaggccatatcacaacagaaatcgtcatgctcaacccagccaacacccggtcaatttctaacatgacatctcaagagtttgtcgaaaaattgaccaaacgcctcaaacggcatcccgaggagaccggcggcttccaggaggcacctctggcatacgatgctatctgggctctggcacttgcgctgaataagacatcaggcggggggggcagaagtggagtgagattagaggacttcaactataataatcaaaccatcacagaccagatctatcgagccatgaatagctcaagcttcgaaggggtgtcaggtcatgtggtgttcgatgcctccggatccaggatggcttggacactgatcgaacagctgcagggtggaagttataagaaaattggctattatgactccacaaaagatgacctgtcttggtcaaaaactgataaatggatcggtggtagtccccccgctgatcaaactctggtaatcaaaacgttccgtttcctttctcaaaagttgttcatctctgtatcagtcctctcctctctcggcattgtcctagctgtggtctgtctaagctttaatatttacaactctcatgtgagatacattcaaaattcacaaccaaacctcaacaatttaaccgcagtggggtgctcgctcgccctggctgccgtgttcccactgggcctcgacgggtatcacattggacggaatcagttccctttcgtttgtcaggcacgtctgtggctgttgggattagggttctctctgggatacggtagcatgtttacaaagatctggtgggtgcacactgtctttaccaagaaagaagaaaagaaagaatggagaaaaaccttagagccctggaagctatacgctacagtaggattactggtgggtatggacgtcctcacactagctatatggcagatagtggaccctctgcatcgaacaattgagacatttgccaaagaagaaccaaaagaggacatcgatgtctcaatcctgcctcagctggagcactgctccagtcgaaaaatgaatacttggctaggtattttctacggctacaaagggctgctgctgctgcttggcatattcctcgcatacgaaaccaagtccgtgtctaccgagaaaataaatgaccaccgagccgttgggatggccatttataacgtggctgtgctgtgcttaatcacagccccagtaactatgattctgtctagtcagcaggatgccgcatttgcttttgcatctctcgcaattgtcttctcctcctatatcacccttgtggttttgttcgtccccaagatgagaaggctgatcactcgcggcgagtggcagagtgaggcccaggacactatgaagactggttcctccactaacaataacgaagaggagaaatcaagacttttagagaaagagaatagggagctggagaagatcatagccgagaaggaggagagagtttccgagcttcgacaccaacttcagtcccgccagcagctgaggtcacggagacacccccctacaccaccagaaccgtctggggggctccctaggggaccaccagaacctcccgacagactgtcatgtgatggctctcgcgtgcatctgctgtataagtag

SEQ ID NO: 6337 - DNA, 2853 bp, Artificial Sequence
  Description of Artificial Sequence: Synthetic coding sequence
atgacttggcggatggggccccggtttacaatgctgctcgccatgtggctggtgtgtggatctgagcctcacccgcacgccaccattagggggtctcacggtggaaggaaggtcccgctcgtcagccccgatagctccagacccgcccgcttccttaggcacaccggacgatctcgtgggatcgaacgatccacacttgaggaaccaaatctccagcccctgcagcggaggaggtctgttcctgttctaaggctggctagacctaccgaacccccagccagaagcgacatcaacggcgccgctgtgcgtcctgagcagagacccgccgcacgcggaagcccaagagagatgatcagggacgagggctcatccgcgcggagccgcatgctccggttcccttccggcagctcttcaccaaatatactcgcctctttcgcaggcaagaaccgggtttgggtgatatccgcaccccatgcaagcgaggggtattaccgcttaatgatgagcctgctcaaggatgacgtgtactgcgaacttgctgagcgccatattcagcagatagtgctgttccatcaggcgggggaggaaggaggaaaggttagaaggatcacctccgagggccagatcctggagcagcctctggaccctagcttaattccaaagctcatgtccttcctgaagctggagaagggtaaattcggaatggtgctccttaaaaagaccctgcaggtggaggagcgctacccctacccagtccggcttgaggctatgtacgaagtcattgaccagggcccgatccgacggatcgaaaagataaggcaaaagggatttgttcaaaaatgcaaggcctctggcgttgaaggtcaggtggttgccgagggcaatgacggggggggtggcgctggccggccatcacttgggtccgaaaagaaaaaggaggaccctcggagggcacaggttcctcctacacgcgagtcccgcgtgaaagtgctgagaaaactcgcagccactgcccccgcactacctcagcctcccagcacccctcgcgctactacattgcccccagcacctgcgaccacagtaacgcggtctaccagccgcgccgtgacagtagcagcccgccctatgacaaccacagccttccctacgacgcagaggccctggaccccgagcccctcccacagacctcctaccactacggaagtgataacagcgcgccgtcctagcgtgtccgagaacctctaccccccaagtcgcaaggatcagcatcgggagagaccacagaccacccggagaccttctaaggccacatcactggagagcttcacgaatgccccaccaactacgatctctgagcccagtacaagagctgcaggacctgggaggtttcgcgataaccggatggaccgacgggaacatggccatcgtgatcctaacgtcgtaccagggcccccaaaacccgctaaagagaaaccgcccaaaaagaaggcacaggacaaaatcttgagtaacgagtacgaggagaaatacgacctgtcaaggcctaccgccagtcagttggaagatgaattgcaggtggggaacgtccctctaaaaaaggctaaagagtccaaaaagcatgagaaactggaaaagcccgaaaaagaaaagaaaaagaaaatgaagaatgagaatgcggataaactattgaagagcgaaaaacaaatgaaaaagtcggagaaaaaatctaagcaggagaaggaaaagagcaagaaaaagaagggcggaaagacagagcaagacggctaccagaagcctacaaataagcacttcacccaatctccaaaaaagagtgttgctgatctgctcgggagcttcgagggcaaaagacgccttctgctgattacagctcccaaagctgagaataacatgtacgttcagcagagagacgagtatctcgaatctttttgtaagatggccacgagaaagatctcagtcatcactatctttgggccagttaataacagtactatgaagatcgatcacttccagttagacaatgagaagcctatgagagtggtggacgatgaggacctagtcgatcaaagactcatctccgagctgagaaaagagtacggcatgacctacaatgacttcttcatggtcctgaccgatgtggacttgagggtcaagcagtattatgaggtgcccattacaatgaaaagcgtgttcgacttgatcgacaccttccagagccgtattaaggacatggagaagcagaagaaagagggcattgtctgtaaagaggacaagaaacagtcccttgaaaatttcctcagcaggttccgatggcggcgaagacttctcgtgatctcggcacccaatgacgaggattgggcttactcccagcagctgtccgccctctctgggcaggcatgtaatttcgggcttcggcacattaccatactgaaactccttggggtaggggaagaagtcgggggcgttctcgaactctttcccatcaatgggagctccgtggtggagcgggaagatgttcctgcccatttagtgaaagacatacggaattacttccaggtatctccagagtacttcagcatgctgttagtgggtaaagatgggaatgttaaatcgtggtatcccagccccatgtggtccatggtgatcgtgtacgacctgatcgactccatgcaactcaggcggcaagagatggctatccagcagtccctgggcatgagatgcccagaggatgaatacgctggatacggatatcacagttaccatcagggataccaggatggctatcaggacgattaccggcatcacgagtcctaccatcatggctacccctactag

SEQ ID NO: 6338 - DNA, 351 bp, Artificial Sequence
  Description of Artificial Sequence: Synthetic coding sequence
atggctgccggtagtgcacctatgcaactgcatcttagagcaaccatccgaatgaaagacggcctgtgcgtaccccggaagtggatctatcacctaaccgaagggagtactgaccttcgcacagaagggcggcccgacatgaaaacggagctgttctcctcctcatgcccggggggcatcatgctgaatgaaacaggacagggctaccagcggttcctgctctataatcggtcaccccaccctccagagaaatgtgtggaggagtttaagtccctgacctcttgtttagattccaaagctttcctcctgacaccacgaaaccaggaagcttgtgagctgtccaataattag

SEQ ID NO: 6339 - DNA, 1251 bp, Artificial Sequence
  Description of Artificial Sequence: Synthetic coding sequence
atgaagtttcagggccccctcgcttgtttgctgctggctttatgcctgggcagcggcgaagcaggaccccttcagtcgggtgaggagagcacaggaacaaatatcggggaagctctgggccacggtctgggggatgccctttcagagggggtaggcaaagccatcggaaaggaggccggcggggcagccggctctaaagtaagcgaggccctgggacaggggacccgggaagctgttgggactggagttcgacaggtgcccgggtttggggtggctgacgcccttggaaatcgtgttggggaggctgcccacgcactgggcaacactggccacgagatagggcggcaggcggaggacgtgatcaggcacggcgcagacgctgtaagagggtcatggcagggggttcccgggcataatggtgcgtgggaaacttccggggggcatggcatttttgggagccagggcggtctcggtggccagggccagggcaatcctggtggcctgggaacgccctgggtacacggatacccggggaattccgcaggaagctttggaatgaatccacaaggagccccttgggggcaggggggaaatggaggacctccaaatttcgggacaaacacacaaggagccgtggcccagcccggatacggttctgtgagggcatcaaatcaaaacgaagggtgtactaatcctccccctagtggatccgggggtgggtcctccaactccggcgggggttcagggagtcagtcaggctccagcggctccggttccaacggcgataataacaacgggtcttctagtggtggttcctcatctggcagcagcagcggcggatcatctggcggcagcagtggcgggagctctggtaatagtgggggatcgcgcggcgactctgggtccgagtcatcttgggggagcagcacagggtcatcgtcaggtaaccacggcggcagtggggggggcaacggtcataaacccggttgtgagaagcctgggaacgaggcccggggctccggcgagagcggcatacaaggcttccggggccaaggagtaagctcaaatatgcgagagatcagcaaggaaggtaaccgtctccttggagggagcggtgacaattaccgcaattcggagacatccccaggcatgtttaattttgacacgttctggaagaacttcaaatcgaagttaggctttatcaattgggatgctattaataaagatcaaaggtctagtcgcatcccttag

SEQ ID NO: 6340 - DNA, 933 bp, Artificial Sequence
  Description of Artificial Sequence: Synthetic coding sequence
atggtggataaggacaccgagcgggacattgagatgaaaagacagctgcgcagacttcgggaacttcatctttattccacttggaaaaagtaccaggaggcaatgaaaacctcactgggggtccctcagtgtgaacgggacgagggcagtctcggaaaacccttatgtcctccagaaattctttctgaaaccctccccggaagtgtgaaaaagcgggtgtgcttcccatctgaggatcacctggaagaatttatcgccgagcatcttcccgaggcatccaaccagtccctgttgacagtggctcacgctgatgccggtacacagacaaatggggatctcgaggatctagaggaacacggccccgggcagaccgtgtccgaggaggctaccgaggtgcatacaatggaaggggatcctgatactttagcagaatttctgataagggatgtgctgcaggaattgtcctcttataacggtgaggaagaggaccccgaggaggtgaagacatccttaggcgtgcctcagcggggggatcttgaggacctcgaggaacacgtgccgggacaaacagtgtctgaagaggccacaggggtgcatatgatgcaagttgacccagcaacactggctaaatcagatctcgaagacctggaggagcacgtcccggagcagactgtgtccgaagaagcaactggagtccatatgatgcaggtggaccccgccacgttggccaagcagctggaggatagcactataaccgggagtcaccaacaaatgagtgcctctccaagctccgcccccgctgaagaggccaccgagaaaaccaaggtagaggaagaagtgaaaaccaggaaaccgaaaaagaagactcgaaaaccatctaagaaaagtcgttggaatgtgctgaaatgctgggacatttttaacatcttttag

SEQ ID NO: 6341 - DNA, 150 bp, Artificial Sequence
  Description of Artificial Sequence: Synthetic coding sequence
atggctcccccttcagtgccactcgtgctcctgctcgtcttgcttttgtccctcgccgaaactccggctagcgcccccgctcaccggagttccactttccctaaatgggtgaccaagaccgaacgagggcgtcagcctcttcggagctag

SEQ ID NO: 6342 - DNA, 978 bp, Artificial Sequence
  Description of Artificial Sequence: Synthetic coding sequence
atgcagggaagagtcgcaggtagctgcgcccctttaggactacttcttgtgtgcttgcacctccccgggcttttcgctagaagcatcggtgttgttgaggaaaaggtttcccagaatctcggcactaatcttcctcaattggggcagccatcatcaacaggtccttcaaacagcgaacatccccagcccgccctggaccctcggtccaatgacttagcccgcgtgcctctcaaactttccgtgccagcctccgacgggtttccccccgctggaggatcagccgttcagcgctggccgccttcgtggggcttacctgctatggactcttggccacccgaagacccctggcagatgatggcagctgctgccgaggaccgactcggtgaagctctcccggaggaactgagttatctctccagcgcagcagccctcgctcctggcagcggcccgttgcctggtgagtccagcccagatgctaccggcctgagccctaaagcttcactactgcatcaggactcagagtcccgcaggctgcctcggtctaattctctgggcgctggtggaaagatcctgtcacaaaggcccccatggtctctgattcatcgtgtcctgcccgatcacccttggggtaccctgaacccttctgtgtcatggggaggggggggcccgggcaccgggtggggcactaggccaatgccccaccctgagggaatttggggcatcaacaatcagccccctggcacatcctgggggaacattaatagatatcctgggggttcatggggtaacattaataggtaccccggcggttcttggggcaacatcaaccgatacccaggtggcagctggggtaatatccacctgtatccagggatcaataatcctttcccacctggagtgctcaggcctcccggcagctcatggaatatcccagcaggtttccctaatcccccctcaccgaggcttcaatggggctag

SEQ ID NO: 6343 - DNA, 390 bp, Artificial Sequence
  Description of Artificial Sequence: Synthetic coding sequence
atggcagcaggctctgcaccgatgcaactccatctcagggcaaccattcggatgaaggacgggctgtgtgtgcccaggaaatggatctatcatctaaccgagggtagcactgacctaaggaccgaaggccgccctgacatgaaaacagagttgtttagttcttcatgccctggtgggatcatgctgaatgaaactggccagggataccaaagattcttactgtacaaccggtccccacaccctcctgaaaagtgcgtggaagagttcaagtctctcaccagctgtcttgattcgaaggcctttttattgacgcccaggaatcaggggaaggggctcaaaagccataagacaggactcgggctcaccaaatcttcaggggtgacaggatag

SEQ ID NO: 6344 - DNA, 1056 bp, Artificial Sequence
  Description of Artificial Sequence: Synthetic coding sequence
atggcgggtattcctggcctgctgttcctgttgttttttctgttgtgcgccgtcgggcaggtatcgccatactccgccccttggaagccaacctggccagcttaccgtttgcctgtagtgctccctcagtcaacccttaacctcgcaaaacagtacttatcatacgagacattgtacgcaaatggctcacggacggagacccaggtgggcatctacatcttatccagcagtggggacggtgcacagcaccgggactcgggctcatcaggcaaatcaaggcgcaagagacagatttatggatatgactcgaggttttccattttcgggaaggattttctgctgaattacccgttctccaccagtgtgaaactgagtacggggtgcacaggaactctggttgccgaaaagcacgtcttgaccgcagcgcactgtatacatgacggtaagacttacgtgaagggcacccagaagctgagagtcgggttcctgaaacctaaatttaaggacggcggtagaggtgccaatgatagtacctcggccatgccagagcagatgaaatttcaatggattagagtgaaaagaactcatgttcctaagggatggataaagggaaatgccaacgacattggtatggattacgactacgctctgttggagctaaaaaagcctcacaagagaaagttcatgaagataggtgtttcgccacctgccaagcagttgcctggcggtcgtattcatttcagcgggtatgataacgatcggccagggaacctggtctaccgcttctgcgatgtgaaggatgaaacctatgacctgctgtatcagcagtgtgacgctcagccaggtgccagcggtagcggggtgtacgtgaggatgtggaaaaggcagcagcagaagtgggagcgaaaaattatcggtatcttttcagggcatcagtgggttgatatgaatggtagtccacaggatttcaacgtggctgtcagaatcacacccttaaaatatgcacagatttgctactggataaaaggcaattaccttgactgcagggagggctag

SEQ ID NO: 6345 - DNA, 345 bp, Artificial Sequence
  Description of Artificial Sequence: Synthetic coding sequence
atggaaagaggggcaggggctaagctgctgccactactcctgctgcttcgtgctaccgggttcacatgtgcgcagacggacggccggaacggctataccgctgtcatcgaggtcacctcaggtgggccgtggggcgactgggcttggccagagatgtgtccagacggtttctttgcttctggattttcgctgaaggtggagcctcctcaagggatccctggcgacgatacagccctcaatgggatccggttacactgtgcccgaggcaacgtgctggggaatactcatgtggtggaaagtcagtcaggaaggtggggcgctggcgtcgaagatcccctcggttag

SEQ ID NO: 6346 - DNA, 825 bp, Artificial Sequence
  Description of Artificial Sequence: Synthetic coding sequence
atgtggcggtgccctctagggttgcttctgttgttacctcttgctgggcaccttgcacttggcgcccagcagggcagaggtaggagggaactcgctcctggcctccacctgcggggtatcagagatgccggggggagatattgtcaggagcaggatctctgttgccgcggaagggcggacgattgcgctttaccctacctgggtgcaatttgctactgtgaccttttttgcaataggactgtgtctgattgttgccctgacttttgggacttttgccttggcgtaccgcctccctttcctccaattcagggctgcatgcacgggggtaggatttatcctgtcctcgggacttactgggataactgcaaccgatggcctcccttagagtgctgggatctgctcccccccgcgctcccagggccggtctgggcagcgttaggcgccaaagaagaaatggctgggaaggatcggaccgtctactgcccattgctcatgaaggccctcggcgcccgagtgggtgagtgcccaggctgccagtcaccccagcgcatgctgcccgaatcctcgagggtgcttcttccaaggtgcgcagagggcgagcagcccggcgtgcagcgcggcaagggcagaatgaggaaagcatttccagcactgcagacaccactggccctcccgtcaagcgcacccgctagcccaggggcgggtaagcccagccacacaggcagctggctgcctctgcggctcctgaagcggcagcactggcggtgggagccctggactgcgtgtaaggaggccgtgcagcatctggtgattacggagttgtag

SEQ ID NO: 6347 - DNA, 438 bp, Artificial Sequence
  Description of Artificial Sequence: Synthetic coding sequence
atggctcaattgtttctgccattactagcagctctggtcctggcccaggcccctgctgctttagctgatgtgcttgagggcgattccagtgaggaccgggccttcagggtgcggatcgctggagatgcacctctccaaggagtactgggaggggcccttacaatcccctgtcacgtgcattatctgaggccacctccctcacgaagggccgtcctcggctcgccccgggtcaaatggacattcctgtctcgtggccgcgaggcggaagtactcgtggcacgcggagtaagagtcaaagtaaatgaggcttatcgctttcgggtggctcttcccgcttatcccgcttccttgacggacgtgtctttagcactgtccgaactgaggccaaacgattccggcatctatcgctgtgaggtgcagcatggaattgacgattag

SEQ ID NO: 6348 - DNA, 567 bp, Artificial Sequence
  Description of Artificial Sequence: Synthetic coding sequence
atgtttcatcaaatttgggccgccttattatacttctatggtatcattctgaatagcatctaccaatgtccagagcattctcagctgacgacacttggagttgacgggaaagagtttccagaagtccacttaggccagtggtacttcatagcaggggccgcccccaccaaggaggaactggccactttcgatcctgtggacaatattgtttttaatatggcagcaggttctgccccaatgcaactgcacctgcgggctacaatacgcatgaaagatggtctgtgtgtccctcgcaagtggatctaccaccttactgaaggctccactgacctgaggaccgagggtcgcccagatatgaagactgaactattcagcagctcctgccccgggggtattatgctgaacgagaccggacaaggatatcagcgattcctcctgtacaaccggtctccacaccctcccgagaaatgcgtcgaagaattcaagtctctgacctcttgcctggatagcaaggctttcctgctcacacccaggaatcaggaagcttgcgagttgtccaacaattag

SEQ ID NO: 6349 - DNA, 558 bp, Artificial Sequence
  Description of Artificial Sequence: Synthetic coding sequence
atggggcctgccgggtgcgcctttacactgctgttgctgctcggcatatccgatcgggactaccactctgccttgcaggaggcggaggtgcctatcatcgacaggcaggcctgcgagcagctgtataacccgattggcatcttccttcctgcactggaaccagtcatcaaggaggacaaaatttgtgcaggtgacacacagaatatgaaagattcatgcaagggcgacagtggcggcccgctgtcttgtcatattgacggtgtctggatccagaccggcgttgtttcatggggactggagtgcggcaagtccctacctggggtttacaccaacgtcatttattatcagaaatggattaacgccactatttctagggctaacaatttagattttagcgatttcctcttcccaattgtgctgctgtcccttgctctcctacgaccatcatgtgccttcggtccaaacacaatacacagagtgggaacggtggcagaggccgtagcctgcatccaaggctgggaggagaatgcctggcggttttcccccagggggcgctag

SEQ ID NO: 6350 - DNA, 1653 bp, Artificial Sequence
  Description of Artificial Sequence: Synthetic coding sequence
cccgcccccgccagcagaaaactgttaccacgacgccatttgtctgagaagtcccaccacatatctattccgtcaccagatataagtcataagggcctgaggtcaaaaagaacccaaccgagcgaccctgagacctgggagtccctgccccgacttgacagccaaaggcatggagggccagaattttcctttgacctgttgcctgaagccagggcaattagggttaccattagttctggaccagaggtgtccgtgcgcctgtgccaccaatgggcattggaatgcgaagaactttcaagcccatatgacgtacagaaaatagtgagcggcggccacaccgtcgagttaccatacgaattcctcttaccatgcctgtgcatcgaagcctcttacttacaggaggacaccgtaagacggaagaagtgtcctttccagagctggcccgaggcttatgggagcgatttttggaaatctgtccatttcacagattacagccagcatacccagatggtgatggcactgaccctacggtgtcccttgaagctggaagcagccttatgccagagacacgattggcatacgttgtgcaaggatctccccaacgctacggcacgcgagtccgatgggtggtatgtgttggaaaaggtcgatcttcatcctcagttgtgctttaaattctcattcggcaacagttctcatgtggaatgtccccatcaaacaggatcactgacatcctggaatgtatcgatggatacgcaggctcagcagctcattctgcacttttctagcagaatgcacgctaccttctcagcagcatggagtctccccggcctcggacaggataccttggttccccctgtgtatacagttagccaggccagggggagctccccagtgagcctagatctgattatcccgttcttgaggcccggttgctgcgtgctggtgtggcgttctgacgttcagtttgcctggaaacacttgttgtgcccggatgtctcttaccgtcacctcggactactgatccttgctctgctcgcactgctgactttactgggtgtcgtcctagcgttgacatgtcggaggcctcagtctggcccaggcccagcacggcccgtcctcctactgcatgcagccgactcagaagcccagcgtaggttagttggcgcactggctgagttgctgagggccgcactgggcggcggaagggacgtcatcgtggacctgtgggaagggcgccacgtggccagagtagggcccctcccctggctctgggccgcccggaccagggtcgccagggagcaaggtacagtgttattgctatggagcggcgctgacctccggccagtatccggacctgatccaagagccgcaccgctcctggccctgctgcatgccgctcctcggcctttgttgctgcttgcttacttcagtagactgtgcgctaaaggagacatcccccctccactccgagctctaccacgctaccggctcttgcgagatttgcctaggctcctccgggccttagatgcccgcccttttgccgaggctacaagttgggggaggctaggggcccggcagagaaggcagtcaagattggagctttgctcgaggcttgaacgggaggccgctcgactcgcagacctgggctag

SEQ ID NO: 6351 - DNA, 816 bp, Artificial Sequence
  Description of Artificial Sequence: Synthetic coding sequence
atgggtattgtatgtgcccagtgttctttcatactgttgctgtccattattagagccagaccgccacctttcctcttttgcccgttgagcagtcagcgcactgagtccccctacaagcccgtgcacttaggccttgggcccacggataaagtggcagccattgccatggcccggattatcgacctggtgccttgggacgacggatctactcatgtttacgcttctcctgcgatcttgttgcccatggagagacagagaaaccagctggccggcgtgaagcaacagctgtaccatcctgccctccccacgctaaggcatatggaccgggacaccgtgaaagcatgtctcccggatgaacattgccagtcgacaacctactgtcgcaaggatgaatttgataatgctcattttaccttgctgggggtgcctaacaaaccccttcagtgtctcgacataaccgcaaccggccagaaactgcgcaatcgataccatgagggcaaactagctccaatagccccagggatcaacagggtggattggccctgtttcactagagccatagaggattggtctcacttcgtgagctccgccggagaatttaaactgccatgtctccgaaagcgcgcggaagggctttcgggctacgccgttcggtatctgaagcctgatgttacgcagacctggcgatactgtctgtcacagaatcccagtctggatcgctacggccagaaacccctccctttcgattcactcaataccttcaggtcattcggatcctcatactcccgagtgaattatctcaccccttggcattag

SEQ ID NO: 6352 - DNA, 1743 bp, Artificial Sequence
  Description of Artificial Sequence: Synthetic coding sequence
atgcatctgtccgccgtgttcaacgccctattggtgtctgttttggctgctgtcctatggaaacacgtacggttgcgtgagcacgccgcgaccttggaagaagagctagcactctcacgtcaagcgaccgaacctgcaccagcattaagaatcgattacccaaaggccctgcagatactgatggaaggaggcacgcacatggtttgcactggaaggactcatacagaccggatctgccggtttaaatggttgtgctactccaacgaggccgaggaattcattttcttccatgggaacacatccgtgatgttgccaaatcttggctccagacggttccagcccgccttgcttgatttgtcaactgtggaagatcacaatactcagtactttaatttcgtggaactgccggcagccgcgctgcggtttatgcccaaacccgttttcgtgccagatgtggcactgatcgcaaacagatttaatcccgataacctgatgcatgtgtttcacgacgacctgctgcctctcttctacacactgcgtcaattccccgggctggcacatgaggctagactttttttcatggagggatggggcgaaggcgctcattttgacctgtataagttactttctccaaaacaacctctcctgcgcgcccaactgaaaactctcgggcggctcctctgcttcagtcatgcttttgtgggcctaagcaagatcaccacgtggtatcagtacggctttgtgcaacctcagggccccaaggccaatatcttggtgtcaggtaacgaaatacgccagtttgccagattcatgacagagaaacttaacgtttcccatacgggagttccacttggggaagagtacatcttagtcttttcgaggacccagaacagactgattctgaacgaagcagaactcttgttggctctcgctcaagagtttcagatgaagaccgtgactgtatcattagaagaccatacatttgccgatgtggttaggcttgtttctaacgccagtatgttagtcagtatgcatggagcccagttagtaactaccctgtttctccctcgcggcgccaccgtcgtcgagctgtttccttatgctgtgaatcccgaccactacactccatataaaacgctggccatgctccccggcatggacctacagtacgtggcctggaggaacatgatgccagaaaataccgtaactcatccggagagaccttgggatcaaggcgggatcactcacttagatagggccgaacaagctaggattctacagtccagggaggtgccacggcacctttgttgtagaaatcccgagtggctgtttcgcatttaccaagataccaaagttgatataccctctctaatccagacaatccgtcgcgttgtgaaaggaaggcccggcccacgtaagcaaaagtggactgtcggactgtacccaggcaaagtgcgcgaggcacgttgtcaggcctctgtccatggagcatccgaggctcgcctgaccgtgtcatggcagatcccttggaatctaaagtatttgaaagtaagggaggtaaaatacgaggtttggttgcaagaacaaggggagaacacctatgtaccgtatatcctcgctctccagaatcacactttcaccgagaacattaagccgttcaccacttacctggtttgggtgagatgcattttcaacaaaatcctgctcggacccttcgctgacgtcctggtgtgcaacacctag

SEQ ID NO: 6353 - DNA, 513 bp, Artificial Sequence
  Description of Artificial Sequence: Synthetic coding sequence
atggagtttgttgatgtgacagaaagtaacgcgcgctgggtgcaagatttcaggctgaaagcctacgctagcccagcaaagctggaatccattgacggagctcgttaccatgcactgttgatccctagctgccctggtgcgctgaccgacttggccagctccggatcactggctcggatccttcaacacttccacagtgaatccaaacccatttgtgctgtgggccacggggtggctgctctatgttgtgcaaccaatgaagaccggagctgggttttcgattcgtacagtctgactggaccttctgtctgcgaactcgtgcgtgccccagggtttgcccggctgcccctcgtcgtggaagactttgtcaaggatagtggcgcctgtttcagtgcgtcggaacccgatgcagtgcacgtcgtcttggacaggcacctggtgacggggcagaacgccagcagtaccgtcccggccgtccagaatctcctctttttgtgtgggtcaaggaagtag

SEQ ID NO: 6354 - DNA, 1041 bp, Artificial Sequence
  Description of Artificial Sequence: Synthetic coding sequence
atgaggctgctgtttctggccgtgctgagaccacacaccggcaatgctgtaacagcacagcgggtccgagcccatctggaggcggccggccacgtgtgtgtgctgaaggacgcgtttgactttgagagtagatccgagattgcaaatttgattctcgctgagaattgcgaagccgccctcgctctccacctctaccgaggcggtcgccttctccaggggcaccgaattcctttcggggtgatcttcggcggcacggacgtcaacgaggacgccaaccaggccgagaagaatacagtcatggggcgagtgctggaggaagcgagattcgccgtcgccttcactgaatctatgaaggagatggcacaggcccaatggccccacgcaaagggaaaagtgtacgtgcagtcccagggcatcgccacaacacctaacgcggccttcaactggaacactttccttcagcgctcagagatcaatcagtccgcggacaatctccatatcttcctgctgatctgcgggctccggcaggtgaaagatcccctgtatctggtggacgcgttctcggcctggcaccaggaggagcccaatgttcacctggtaatcgtgggacctgaggttgatccggtcttcacccgggaggtgaaggctaaggtaaagcgggcagctggggtccggctgatcggagagatgccccaagaagacttacacgccgtggtgaaaaattgcttcgccgtggtgaattcctccgtgagtgaggggatgagcgcagcaattttggaagcaatggacctggaggtccctgtgttagccaggaacatccccggcaatgctgccgtggtcaaacatgaggttaccggattacttttttctaacccacaagagtttgtacatttggctaagcgtttagtatctgatcctgcattagagaaggagatcgtggtgaatggaagggaatacgttagaatgtatcacagctggcaggtcgagcgcgatacttatcaacaactgatccgaaagttggagggctccacagaggactag

SEQ ID NO: 6355 - DNA, 1482 bp, Artificial Sequence
  Description of Artificial Sequence: Synthetic coding sequence
agcgaggcagtgtatctgaacgatagcacctatgacgggcacacagtgggcggcctgcagtacggcggtctgggacagcttgctgacggcgtggtgggcctggacgactttcgaaagagtcaggaattacgcgtgtggcccggttacgactatgttggttggagtaatcacagcttttcttctgggtacgttgagatggaattcgagtttgatcgactgcgggcgtttcaggctatgcaagtgcattgcaacaatatgcacaccctcggcgcgcgcctcccagggggcgtggagtgtcgatttagacggggaccagccatggcatgggagggcgagcctatgaggcataacttgggagggaaccttggagacccacgagctcgtgcagtaagtgtgccattggggggtcgagttgctaggttcctgcagtgcagattcctcttcgcaggtccctggctcttatttagcgaaattagctttatctctgacgtagtgaataactcatctccagccctgggtgggacctttcccccggcaccctggtggccacctggccctcctcctaccaacttcagctcccttgagttagaaccaaggggacagcaacccgtggcgaaggctgaggggtcacctacagctatcttgataggctgtttggttgcgattatactgttgttgctcctaattatcgcccttatgttgtggcgacttcattggagaaggttactttccaaggtactcgaaagccatccacggacccggagccctggcttggtaggaatccgccctacaccattaccggtttcccctatggcactccgctgttgctcaccgatccagccaacagcctccttttggccgcttacccctgtgcctctggaggctagagcaccacctcatcccccaggaccgaaccccccaactccgcgtggcgttaccggcggaaacacatacgcggtgcccgccctgccgcctggggctgtgggagacggacccccgagagttgactttccacgctctcgtctgcggttcaaggaaaaattgggagagggacagttcggcgaagttcatttgtgtgaggtggattcccctcaggacctggtctccttggactttccactgaacgtgcgaaagggacaccctctgttggtagccgtaaaaatcctgcggccagacgcaacgaagaacgctcgcaacgactttcttaaggaggtgaaaatcatgtctcgcctgaaggatccgaacattatccgcctgcttggggtctgtgtgcaggacgatcctctgtgtatgattactgactatatggagaacggagatcttaatcagttcctgtctgctcatcaactggaagataaagccgccgagggagcccccggagatggccaggctgcccaaggtcccacaatctcttaccccatgctcctgcatgttgcagcccagatagctagcggcatgcgctacctggctaccctgaattag

SEQ ID NO: 6356 - DNA, 354 bp, Artificial Sequence
  Description of Artificial Sequence: Synthetic coding sequence
atgttaatcttctggactattactctcttcttgcttggcgcggccaaaggcaaggaagtctgctacgaagacctcgggtgctttagtgacaccgaaccgtggggtggcacagctattcggcccctcaaaatactcccttggtccccagagaagatcggaacccggtttttgctttacactaacgaaaaccccaacaactttcagatactgcttctgagcgacccgtcaactatcgaagcttcgaactttcagatggatagaaagactagattcatcatacatggatttatcgacaagggagatgagtcttgggtgaccgacatgtgcaaacccggcgcttcccccagggcctag

SEQ ID NO: 6357 - DNA, 1581 bp, Artificial Sequence
  Description of Artificial Sequence: Synthetic coding sequence
atgcaggggcctctcctgctcccaggcctctgcttcctgctcagcctgttcggggctgtgactcagaaaacgaaaacctcatgtgcaaagtgcccaccaaatgcaagctgcgtaaacaacactcactgcacgtgcaatcatggctacacttccggctccggccagaagctctttactttccccctggaaacctgtaatgccatcgagacacaggccatcaccgacaactgctcagaggaacgcaagacatttaacttgaacgtccagatgaattccatggacatccgctgtagtgacattattcagggagatactcagggaccctctgctattgcctttattagctactcatctttgggtaatattatcaatgcaaccttcttcgaggaaatggacaagaaggatcaggtgtatctgaatagccaggtggtgagcgccgcaattggccctaaacgcaatgtgtccctgagcaaatctgtcacgctcactttccaacacgtaaagatgacacccagcaccaaaaaggtcttctgcgtgtattggaagtccaccggccaaggcagtcagtggtcaagggacggttgttttctcattcatgttaacaagtcacacaccatgtgcaattgtagccatctttcctccttcgctgtactcatggccctgacctctcaagaagaggacccagtcctgaccgttattacatacgtaggattatccgtgtccttactatgtctgctgttggccgcgcttaccttcctgctgtgtaaagctataaggaacactagtacctcactgcacctacaattaagcttgtgtctgttcctggctcacctcctgttcctggtggggattgaccgaacagaaccgaaagtactgtgctctattatagctggtgccctacattacctctatcttgcggcttttacttggatgttactcgaaggggtgcatttgtttcttaccgcgaggaatctcacagttgttaactattcatctatcaatcgcttaatgaaatggattatgtttccagtcggctatggagttcctgccgtaactgtcgcaataagcgccgcctcctggccacatttatatggtacagcggatagatgttggttgcacctagatcagggttttatgtggagcttcctgggaccagtttgcgccatcttttcagcgaacctggtgctctttatcctagtgttttggatcctgaagcgcaagctgagcagcctcaatagcgaagtgtctacaatccagaatactaggatgctggctttcaaagctacagctcagctgttcattctggggtgcacttggtgcctcggcttattgcaggtgggccccgctgcccaggttatggcgtacttgtttacgatcatcaattccctccagggattttttatctttctcgtgtattgcctgctgtcccaacaggtccaaaaacagtatcagaagtggttccgagagatcgtcaagagcaagtccgaatctgaaacatatacactgtccagcaaaatgggcccagattccaaaccttccgaaggcgacgtgttcccaggacaagttaaacgtaagtactag

SEQ ID NO: 6358 - DNA, 5832 bp, Artificial Sequence
  Description of Artificial Sequence: Synthetic coding sequence
tgaccgagtctcgcgggcagaggagctggacgaatggctccaggggccctgagggggggctgcgaacaaagagctccaggcgggggagcccgaaccgcagccctgggcccgtggccgtggccaagcccaggcccagcgcctagtcctggcgctgctcccccccggagccggaaaatgagcggcgctctgctgtggccactgcttccactcctccttctgctgctctccgcgagggacggcgttagggccgcacaaccccaggcccccggttacctgatcgcagcacctagtgttttccgggcaggcgtggaggaagtgattagcgtaacaatattcaattcacctcgtgaggtcactgtgcaagcccagctggtcgcacaaggggaacctgtggtgcagtcgcagggtgctatcctggacaagggcacaatcaagctgaaggtcccaactggcctgcgcggacaagccctcctgaaggtctggggcagaggatggcaggccgaagaaggtccactgtttcacaaccagacatccgtcaccgtagatggccgtggagcctctgttttcatacaaaccgataagcctgtgtaccggccacagcacagagtgctgatcagtatctttaccgtatcacctaacctgagaccagtcaatgagaagcttgaggcgtatattcttgatcctagggggtcacggatgatcgaatggcgccacctcaaaccattttgctgtggcatcactaacatgtcattccctctctccgaccagcctgttctgggggagtggtttatcttcgtggagatgcagggacatgcttacaataagtccttcgaggtgcaaaagtacgtcttacccaagttcgaactgctcatcgaccccccacgctacatccaagacctcgatgcctgtgagactggcacagtcagagctagatatactttcgggaaaccggttgctggcgctctgatgatcaatatgactgttaacggagttgggtattacagtcatgaggttggccgacccgttctgaggaccaccaaaatactcggaagtagagacttcgatatctgcgtcagagacatgatacccgctgacgtacctgagcactttagaggcagagtctccatttgggccatggtgacttcagtcgatgggtcacagcaggtggccttcgatgactcgactccagtgcagaggcaactggtcgatatccggtattctaaggacactagaaaacaatttaagccagggctggcatacgtgggtaaagtcgaactcagctaccccgacggttcacccgccgaaggagtcacagtgcaaattaaagccgaactcaccccgaaggataatatttataccagcgaggtggtttctcagcggggactggttggcttcgaaattccttcaatacctaccagcgcacagcacgtgtggctggagacaaaggtgatggctctgaacggtaagcccgtaggtgctcagtatctgccttcatacctgagcttggggtcctggtactcgccgtctcaatgttacctccagctgcagcccccaagccacccacttcaagtcggcgaggaagcttatttcagtgttaagtccacatgtccctgtaatttcacactgtattacgaagtggctgctagggggaacatcgtgctttccggtcaacagcctgctcacaccactcagcagcgttctaaaagggctgctccagctctcgagaaacccattcgactcacccacctgagtgagacggaacctcctcccgctcctgaagctgaagtggatgtgtgtgttacttccctgcatctcgccgtaactccttcaatggtgcctctggggcggctgttagtcttctatgtgcgggagaacggcgaaggagtggcagattccctccagttcgccgtggaaacctttttcgagaatcaggtttctgtaacctattcagcaaatgagacccagccaggcgaggtggtggacttacgcattagggccgccagggggtcatgcgtgtgcgtcgccgcggtcgacaaaagtgtctacctgttgcgctcagggtttcgactcacacctgcccaggtgttccaggagctggaggactacgacgtcagcgactccttcggggtcagtcgcgaagacggaccattttggtgggctggactaacagcccagagaagacggaggagctccgtgttcccttggccctggggtataacaaaggattccggcttcgcctttaccgaaaccgggctggtcgtaatgaccgaccgggtctccctcaatcatcgacaggacggtggtctgtacacagatgaagccgtacccgcgttccagccacacaccggttctctggttgccgtagctccctctagacatcctccacgcacggaaaaacgcaagagaactttcttccctgagacctggatatggcactgcctcaatattagcgatccaagcggtgaagggacgctgagcgtgaaggtgcctgacagtattacatcatgggtgggcgaggccgtggcgctaagtactagtcagggcttgggcattgccgaaccaagtctcctgaaaacttttaagccctttttcgtggacttcatgctgccagcgctgatcatcagaggagagcaggtcaagatccccttgagcgtgtataattatatgggtacatgtgccgaggtgtatatgaagttaagtgtaccgaagggaatccagttcgttggccacccaggaaagagacatgtgacaaagaaaatgtgcgtcgcacccggggaggccgaacccatttgggtggtcctgtctttttctgacctaggcttgaataatatcacggcgaaggcactggcttatggagatactaattgttgccgcgatgggcggtcatcaaagcatcccgaagagaaccacgcagaccgacgggtacccattggcgtggaccacgtaaggagatcagtgatggtcgaagccgaaggcgtgcctagagcatacacttacagtgccttcttttgcccctctgagcgggtgcacatctctacgcccaacaaatacgaattccagtatgtgcaaaggcctctccggcttacccgctttgatgtggctgtgcgcgcccataacgatgctagagtggctctaagctctggaccacaggataccgctggaatgatcgaaatcgtactcggaggccatcagaatacccgctcctggatctcgacaagcaaaatgggtgagccagtggccagtgcccacactgctaaaatcttgtcctgggacgagtttcgtacattttggatttcgtggcgaggggggttaattcaggtcgggcatgggccggaaccaagtaacgagtctgtcatcgtagcttggacccttcctcgtccacctgaggtccagttcatcggcttctctaccggctgggggtcaatgggcgaatttcgaatctggcgtaagatggaagtggacgagtcttactcagaagcctttaccctgggggtgccccatggcgctatcccaggaagcgaacgcgcgaccgcttccatcattggggatgttatgggcccgacccttaatcacttgaacaatctgttgagattaccctttgggtgtggggagcagaatatgatccactttgccccaaatgtgtttgttctcaagtatttacagaagactcaacagctctctcccgaagtggaacgagagaccacagattaccttgttcagggctatcagaggcagcttacctataagcgacaggatggctcttacagtgcttttggagagcgcgacgctagcgggagcatgtggctcaccgctttcgtcctgaaatcgtttgcacaagcccgatcttttatcttcgtggacccccgtgagctcgccgccgccaagtcttggatcatccagcaacagcaagctgacggaagctttctagctgtcggacgtgtcttaaacaaggacattcagggcggtattcacggtaccgtacctctcactgcatatgttgtggtggcgttgctcgagaccgggaccgcctctgaggaggagcggggatctactgataaggccagacactttctggaatcagctgccccgctggcaatggatccttatagctgcgccttgacgacgtacgctttgacactacttcggtcaccagcagcccctgaagcgctgaggaagttgagatccctagctatcatgcgggacggcgtgacccactggagcctctccaattcttgggatgttgacaaggggacattcctctcgttttccgatagagtatcacagagcgtggtctccgccgaggtcgaaatgacggcatacgctctgttgacctacaccctcctcggtgacgtggccgccgctctcccggtcgtgaagtggttaagtcaacagcggaacgcgctcggtgggtttagtagtacacaagatacgtgcgtggcacttcaagcattagcagaatatgctatcctaagctatgctggagggattaacctgaccgtgagcctagcgtctacaaatctggattatcaagagaccttcgagctgcatcggaccaaccagaaagtactgcagacagccgccatccctagcctgcctacaggactgtttgtctctgctaagggggacggatgctgtctgatgcagattgatgtgacatacaatgtccccgatcctgtggctaagccagccttccagctgttagtctctctccaggagcctgaggcgcaggggcggccaccacctatgcccgccagcgcagccgagggtagccggggcgattggccgcccgctgacgatgacgatccagccgcagatcagcaccatcaggagtataaggtcatgctggaagtctgtacaaggtggctgcacgccggcagctcaaacatggccgtgttagaagtccctcttctgagcggattccgagccgatatagaatctttagaacagctcctattagacaagcatatgggaatgaagcgctatgaggttgccggacggcgggtcttgttttacttcgacgaaattcctagccgttgcttgacctgcgtgagattcagagcactgcgtgagtgcgtcgtggggaggactagtgcccttcccgtgtccgtgtacgattactacgagcccgcttttgaagcaacccggttctataacgtctccacgcactctcccctggcgagagaactgtgtgctggccccgcctgcaacgaagtggaacgcgctccggctaggggccccgggtggttccctggtgaaagcggccctgcggtggctcccgaagagggcgccgccatagctcgctgtggatgcgatcacgattgcggcgcccagggtaatcccgtgtgtgggagtgatggagtcgtgtacgccagcgcctgtcgactgagagaagccgcttgtcgccaggcagcacccctggagcctgctccaccgtcgtgctgtgcactggagcagaggctgcctgcgtctagcagctctacttacggagacgatctagcatccgttgcacctggacctctgcaacaggacgtgaagcttaatggcgccggtctagaggtggaagacagtgaccctgagccagagggggaggctgaggaccgggtgactgctgggcctagacctccagttagtagcggcaacctggagagctcgacacagtcagcatcacccttccaccgctgggggcagacgcccgcaccgcaaagacattccggtcgcgtggtaggcgcacatcggcctgggctcctgtcccctgtgttcgtttattctcccgccttccagtctgggggggaggagggcctctggatgagtaacacatgcactttgcgctag

SEQ ID NO: 6359 - DNA, 456 bp, Artificial Sequence
  Description of Artificial Sequence: Synthetic coding sequence
atggaggccacagggacagatgaggtggataaactgaagaccaagtttatctcggcctggaacaacatgaaatattcctgggtgctcaaaacgaagacatatttcagccgcaatagccccgtactgcttctgggcaagtgctaccactttaaatatgaagacgaggataagactcttccagctgagtccggatgtactattgaagaccatgtgatcgccggaaatgttgaggagtttagaaaggactttataagtaggatatggctaacataccgggaagagtttccccagatcgagggttccgcattgacgaccgattgtggctggggatgtaccctgagaaccggacagatgctgctggctcagggattgatactccattttctgggtagagcctggacctggcccgacgcgcttaacatcgaaaattctgattcggaaagctggacttcgtag

SEQ ID NO: 6360 - DNA, 2616 bp, Artificial Sequence
  Description of Artificial Sequence: Synthetic coding sequence
atgcgcaagccgaggagaaaatcccgccagaatgcggagggccggaggagcccgtctccttactcacttaagtgctcacctacacgtgaaaccctcacctatgcacaggcacagagaattgtggaggtcgatatcgacggaaggctgcaccgtatctccatctacgatccattaaaaatcatcaccgaggatgaattgactgcccaggacattaccgagtgcaactccaataaagagaattcagagcagcctcagtttccagggaagagcaaaaaaccaagttccaaggggaagaagaaagagtcatgttcgaagcacgccagtggaacaagctttcatctgccccagcccagctttcgaatggtagatagtggtatccagcccgaagcgccacccctccccgctgcatattataggtatattgagaagccacctgaagatctggacgcggaggttgagtatgacatggacgaagaggatctcgcgtggcttgacatggtcaacgagaaacgaagggtggacggacactcactcgtgagcgccgatacctttgagttattggtcgataggctggaaaaggagagctacctagagagtaggtctagcggcgcccaacagtcgctcatcgacgaagacgcgttttgctgtgtgtgtctcgacgatgagtgtcacaattcaaatgtgatcctgttttgcgacatttgcaacttggccgtgcatcaggagtgttatggcgtaccatatatccctgaaggccagtggttatgcaggtgctgcctacagagccctagtcgccccgtggattgcatactctgccctaacaaaggaggagccttcaaacagacctccgacggacattgggcccacgtggtctgcgccatttggatcccagaggtgtgctttgcaaacacagtgtttctggagcctatagaaggaatagacaatatccctccagcccggtggaagctaacctgctacatttgcaagcagaaggggctgggggcagccatccagtgccacaaggtcaactgctacacagcctttcacgtcacctgtgctcagagggcaggcctgtttatgaagatcgagcctatgcgagaaacctccctgaacggcactatttttactgtccgtaaaacggcttattgtgaagcacactccccccccggtgccgcaactgcacgaaggaaaggggatagtcctagatccatttccgaaactggagacgaagagggcctgaaggaaggtgatggcgaagaggaggaggaagaggaagtcgaggaggaagagcaagaagcacaagggggtgtgtctgggtcactcaaaggcgttcccaaaaaatctaagatgtccctgaagcagaagattaagaaagaaccagaagaagctggccaagacacacccagcaccctcccaatgttggcggtgccccagatcccatcttacagattaaataagatctgtagcggcctgagtttccagagaaagaatcagtttatgcaacgcctgcacaactactggttactgaagcgccaggccaggaatggagtgccactgattcggagactgcactcacacttgcagtcccagaggaatgcagaacagagggagcaagacgagaaaactagcgctgtaaaggaagaattaaaatactggcagaaattacgtcacgacctggagagagcccggctcttgatcgagttgatcagaaaacgggaaaagctcaaacgtgagcaagtgaaggttcagcaggcagcgatggagctggagctgatgccctttaatgtactgctgaggacgactttggatttgctgcaagagaaggatcccgctcacatattcgctgaacccgttaatttgtcagaagtgcccgactacttggaatttatcagtaagccgatggactttagcaccatgcggcggaaattggagtcccatctctaccggacactagaggaattcgaggaagacttcaatcttatcgttactaattgtatgaaatacaatgccaaggatacaattttccatcgggcagcagtcaggcttcgggacctgggaggggctatactcaggcacgccagacggcaagctgagaacatcgggtatgatccagaaagaggtacacacttgccagagagtcctaagttagaagacttctaccgtttttcttgggaggacgggcgcagccttctgctgcccttcgaggatcggggcgatttggaaccattggagcttgtatgggccaaatgtaggggatacccttcatatccagcccttatcatcgaccccaagatgccccgagaggggcttctgcacaacggtgtcccgattcctgtcccacctctggacgtgttgaaacttggggagcagaagcaggctgaagccggagaaaaattattcctggtcctgttctttgataacaagcgaacctggcagtggcttccgcgggacaaggtgctacctctgggcgtcgaagataccgtggacaaactgaagatgttagaagggcgcaaaacaagcatcagaaaatccgtgcaggtggcctatgacagagcaatgatccatctgagcagagtaaggggaccacactcatttgtaacatcctcttacctctag

SEQ ID NO: 6361 - DNA, 2700 bp, Artificial Sequence
  Description of Artificial Sequence: Synthetic coding sequence
atgctgctactgctgcttctggcccccctgtttctgcgacccccaggtgccggcggcgcgcagaccccaaatgccaccagtgaaggatgtcaaatcatccaccctccttgggagggcggcataaggtatcggggcctcactcgggaccaggtgaaggccattaattttctgcctgtggactacgagattgaatacgtctgcagaggcgagcgggaagtcgttggtccaaaagtgcgcaagtgcctcgctaatggaagctggactgatatggacacacctagtcggtgtgtgaataggaccccacattcagaaagacgggccgtatatataggagcccttttccctatgagcggcggttggcccggtggtcaggcctgtcagcctgccgtggagatggccctggaggacgtgaattctcgccgtgacattcttccagattacgagcttaagttgatccatcatgactccaaatgtgatccaggtcaagcgaccaaatacctgtacgagctgttgtacaatgaccccattaaaattatccttatgccaggatgctcatcagtttcgacactggtggccgaggccgcccggatgtggaacctcatagtcctttcatatggttcatcttcacccgccctgtccaataggcagcggtttcccacgtttttcagaacacaccccagtgcaaccttacataaccccacaagggtgaaactgtttgagaaatgggggtggaagaagattgctaccattcaacagacaacagaggtgtttactagcactctggatgacctcgaggagcgagttaaagaagctggcattgaaatcacttttagacagtcgtttttttccgaccctgcagtgcctgtcaagaatcttaaaaggcaggacgcaagaatcatcgtggggctcttctatgagacagaagcccgaaaggtgttttgtgaggtgtacaaggaaaggttgtttggcaagaagtacgtgtggtttctgatcggctggtacgctgataactggttcaaaatctatgaccctagcatcaactgcacagtggacgagatgaccgaggccgttgaggggcatattactactgaaatcgtgatgctaaatcccgctaatacccgctccatctctaacatgacatctcaggaattcgtcgagaagctgactaaaagactgaagcgccaccccgaggagaccggcggctttcaggaggctcctctcgcctatgacgccatttgggctttggctcttgctctgaataagacatcgggagggggtgggcgctcaggtgtccggctggaggacttcaactataataaccagaccataacagaccagatctaccgcgcaatgaactctagcagcttcgaaggtgtgagcggccacgtagtgtttgacgcctcaggatcgcgcatggcttggactctcatcgaacagttacagggggggtcttataagaagattggctattacgacagtaccaaagacgatctgagctggagtaagaccgataagtggatcgggggctcgccaccggctgatcagacattagtcattaaaaccttccgttttctgtcccagaaattgtttatctccgtgagtgtactcagctcccttggtatagtactcgctgtcgtgtgcctgtcttttaatatttacaactcacacgtgcgatacatccagaactcgcagccaaaccttaacaatctcacagctgtgggttgtagcctcgccttggctgcagtctttccacttggcctcgacgggtatcacattggcagaaaccagtttccctttgtctgtcaggctagactgtggttgctgggcctaggcttctcattaggctatggatcgatgtttacaaagatttggtgggtgcatactgtgttcactaaaaaggaagaaaagaaagaatggaggaagaccctggaaccttggaaactctatgccacagtggggctgttggtcggaatggacgtactgacactcgctatctggcagattgtggacccccttcatcggacaatcgaaacttttgccaaagaggaacccaaggaggatattgatgtaagcatcctaccacaactggagcattgcagctccaggaagatgaatacctggctcggtatattttacggctacaaggggctgctgttgcttctcggcatttttctcgcttatgaaacaaaatctgtgagcacggagaagattaatgatcaccgggcagtcgggatggctatctataacgttgcagtattgtgtcttatcacggcccccgtgaccatgattctgagctcacagcaagacgcagctttcgcgttcgctagcctggccatagtcttctcaagctacatcaccctagtcgtactgtttgtgcccaagatgcggcggcttataacacgcggtgaatggcagagcgaggcacaggacaccatgaagaccggttccagtaccaacaacaatgaagaagaaaagtcccgcctcctggaaaaagagaatcgcgagctggaaaagatcatagccgagaaggaagagcgggtctctgaactgaggcaccagctgcagtcccgacaacagctgcgctcccggcggcaccctccaactccccccgagccatctggtgggctcccccgcggtcctcctgaacctcccgaccgcctttcgtgcgacggctctcgggtgcatcttctatataagtag

SEQ ID NO: 6362 - DNA, 537 bp, Artificial Sequence
  Description of Artificial Sequence: Synthetic coding sequence
atggaaacatttccgctacttctcttatccctgggcctagtgctggctgaagcttcagaatccactatgaagatcattaaggaggagtttaccgacgaggagatgcagtacgatatggccaagtcaggacaggagaaacaaacgatcgagatactaatgaatccgattctcctagtgaaaaacacatccctatcaatgtctaaggatgatatgtctagcaccctgttaactttcaggtcccttcattataacgaccctaaagggaactcttctgggaatgacaaggagtgctgcaatgacatgaccgtgtggcggaaagtgagtgaagcaaacggatcttgtaaatggtcgaataatttcatccgctcttccacagaagtgatgcgccgggtgcatagggctccaagctgtaaattcgtgcagaaccccggcatctcctgttgtgagtcactggaattggaaaacaccgtctgtcagtttacgacgggcaagcaattccctcgctgccagtaccattccgtgaccagcctggaatag

SEQ ID NO: 6363 - DNA, 2184 bp, Artificial Sequence
  Description of Artificial Sequence: Synthetic coding sequence
atgatcttgtccctattattctcactaggaggacctctcgggtggggcctactcggcgcatgggcgcaggccagctctactagcctctcagaccttcagtctagtcgcaccccaggggtgtggaaagccgaagccgaggacactggcaaagaccccgtggggcgcaactggtgtccctaccctatgtctaagctggtaacactgctcgctctgtgcaagacagaaaagttcctaattcactcccaacaaccctgtccccagggggctcctgactgccagaaagtaaaggtgatgtaccgcatggcccacaaacccgtgtaccaggtgaaacagaaggtgctcacctctctggcttggaggtgctgccctggctacactggccccaactgcgagcatcacggccccatggccgtgtggtgttggcctgagcctgactcattgcaagcccgcctcggtcagctgcaacggaacttaagtgagctgcacatgacgacagctagaagagaagaagagctgcaatacaccctcgaggatatgcgcgctacactaacacgtcatgttgacgaaatcaaagaactgtacagcgagtcagatgaaacttttgaccagataagcaaagttgaaagacaagtggaggagctccaggtcaatcatacggctctacgggagctgagagtcatacttatggaaaagagtctaataatggaggaaaacaaggaggaagttgaacgccagctgcttgagctgaacctgactctgcagcacctgcagggcggtcatgcagatctcattaaatacgtgaaagattgcaattgccaaaagttatatttagacctcgacgtgattagggagggccagcgcgatgctacacgtgcccttgaagagacccaggtttctcttgacgagagacgtcagttggacggatcgagcctgcaagctttgcagaatgctgtggacgccgttagtctggcagttgatgcccacaaggccgaaggcgaaagagcgagggccgccacctccaggctgcgctcccaggtgcaggcccttgatgacgaagtaggcgcactcaaggcagcggcagctgaggcaagacatgaagtgcgacagctgcattccgccttcgcagccctgctcgaggatgccttgcgccatgaggcagttttggctgcactgttcggtgaagaggtcctggaggagatgtcagagcaaacccccgggcctctgcctctgtcatacgaacagattcgagtcgctctgcaagacgccgctagtggcctgcaggagcaggccttaggatgggacgagctcgcagcacgtgtcactgccctcgagcaagcctcagaacctccccggcctgccgagcatctcgagcctagccatgatgccggacgcgaggaagccgccacaactgcactcgctgggctcgcacgtgaactccagtctctctccaacgatgtgaagaacgtgggtagatgctgtgaggcggaggccggagcaggcgcggccagcttgaatgccagtctgcatggactgcacaacgcattattcgccacccaaagaagcctggagcagcaccagagactgtttcacagtcttttcgggaattttcaaggtctaatggaagctaatgtctcactcgacctgggcaagttacaaacaatgctgagccgaaagggaaaaaagcaacagaaagacctcgaggccccaaggaaaagagataagaaagaggctgagccgttggtggacatccgtgtgaccgggccggtgcccggggctctgggagcagccctctgggaggccgggtcacctgttgcgttctacgcgagcttcagtgagggcaccgctgcactgcagaccgttaaattcaacactacctatattaatattggtagctcatattttcccgaacatggttactttcgggctcctgagcggggagtatacttattcgccgtgagcgtggagttcgggcctggcccaggcaccggccagctcgtgtttggtgggcatcacaggactccagtgtgcactaccggccaggggtcaggttcaaccgcgaccgtctttgcgatggcggagctccagaagggggagcgcgtgtggttcgagctgacacagggaagcattacgaagcggagcctgagcgggaccgctttcggcgggtttttgatgtttaagacctag

SEQ ID NO: 6364 - DNA, 828 bp, Artificial Sequence
  Description of Artificial Sequence: Synthetic coding sequence
atgggcagtgccccatgggctccagtgctattgctcgcactcggactgcgtgggctgcaggcagggggtgagtggcgaagacctcctgcgcattcccctgtacctgcccccccgctgcgttttgcatcaccacactccccacagggacccggacccagactgcccggggccctgctcccagccgccagcggccccttgcagctgcgcgccctgaggcagcaggatctgccatccgcactgcccggagtggggcaagtgctcggccctggtcgcggcgcacatcttctgcttcactgggaaaggggacggcgggtcgggctgcgccagcagttggggctgaggagaggtgccggaggccgggctggtggtagcacaggattacggggcgcgccccttttacgcgaggtggccgctgtgaggtgtgccgtccatgccgctcgcgcccacggggccgcggacggcggggctgggccaggtcggctgaggagagccgccccccgcgccacaacccgcccacgcggcccgggttgtccgcgccacaggctgcggtggaaattgtggggggatgcacaatgcctgcccgaagacgaagtctcacctcccgggggggggggagccggggggcagagggctagaagttcctgtggcaggccacgaagacttcaacctgtgctgcccggtagacatggtggatctctcaggcacggtccgctcggggtccggcacctgcccgcggctgtgcggcgggaggggcctgatcccgcactgcacgtcagaccagagtgcctccaccgcgccggccacgacggactcccactgcctcactag

SEQ ID NO: 6365 - DNA, 351 bp, Artificial Sequence
  Description of Artificial Sequence: Synthetic coding sequence
atggctgctggctccgctccgatgcagctccacttacgcgcgaccatcaggatgaaggatggtctttgtgtgccccgcaagtggatatatcatcttacagaggggagcactgacctcaggaccgaaggtcggcccgacatgaaaaccgaacttttctcgtctagttgccccggtggcataatgcttaatgaaaccgggcagggctaccaacggttcctgctgtacaatcgttctcctcaccccccggagaagtgcgtggaggagtttaaaagtctcacatcctgtctggattccaaggcatttctgcttaccccaaggaaccaggaggcatgtgagttgtccaataactag

SEQ ID NO: 6366 - DNA, 522 bp, Artificial Sequence
  Description of Artificial Sequence: Synthetic coding sequence
atgcattggaaaatgttgctgctcctgctcctgtattataacgctgaggccagcatgtgccataggtggagccgtgccgtgctgttcccagctgcccaccgccccaaacggtcatctagcttgcccctgaaccctgttctgcagacgagcctggaagaggtcgaactgctgtatgaatttctgcttgccgaactcgaaatatccccagacctgcagatatccattaaagatgaggaattagctagtctgcggaaggccagtgactttcggactgtttgtaacaacgtgatccccaagagcattccagacatacgacgcttaagcgcatcgctttcgtctcatccaggcattctcaagaaagaggactttgagcgcactgttttaacattggcatataccgcgtacagaaccgccttgtcacacgggcatcaaaaggatatatgggcgcagtcgctcgttagtctgttccaggctctgcgccacgacctgatgagatcctcacaaccgggcgtacccccctag

SEQ ID NO: 6367 - DNA, 1482 bp, Artificial Sequence
  Description of Artificial Sequence: Synthetic coding sequence
agcgaagccgtctacctcaacgatagcacttacgacggccataccgtgggaggcctgcagtacggcggccttggacagctggcagacggcgtggtgggcctcgacgacttcaggaagtcccaggaactgagggtttggcccggctatgattacgtcggctggtcgaaccatagcttttcatctggttacgttgagatggagttcgagtttgatcggctgcgggcttttcaggcaatgcaggtgcactgtaataacatgcatactctgggtgctcggttgccaggtggggtggaatgcagatttcgcagaggccccgccatggcctgggagggcgagccaatgagacacaatctgggcggtaatttgggagatcctcgtgcccgcgccgtgtccgtgcccttgggaggacgcgtcgcacgttttcttcagtgccgttttctctttgccgggccctggctgctattttcagagatcagtttcatctcagatgtggtcaacaatagcagtcctgccttgggtggaactttccccccagcaccatggtggcctcccgggccgcctcctaccaatttcagcagcctggagctggagccccgcgggcaacagcccgttgccaaagccgagggttcccctacagccattctcattggttgtctggtggccatcatactgctcctgttgctgattatcgccctgatgctgtggcgcttgcattggcgccgcttgctgtctaaggtgctcgagtcccaccctcgaaccagatccccaggactggtcggaattagacccactctcttgcccgtatccccgatggcattgcgatgctgctcccccatccagccaactgcttctttttggcccctgactcctgtgcccctggaagctcgggccccacctcaccccccggggccaaaccctccgacccctaggggcgtgaccggtggaaacacatatgccgttcccgctttgccccctggggccgtcggagacggaccaccccgagtggacttccctcggtctcggttaagattcaaagagaaactaggggaggggcagtttggcgaagtgcacctttgcgaagtggatagcccacaggacttagtgagtttagactttccccttaatgtacgaaaagggcatccactgctggtggcagtcaaaatcctgcgccccgatgccactaagaatgcacgaaatgattttctgaaggaagttaagattatgtctagattaaaagatccaaacatcattcgtctgctaggggtctgtgtgcaagacgatccactgtgtatgataaccgattacatggagaacggcgatctcaaccaatttctatcggcgcaccagttggaggataaagcagctgagggggcccctggggacgggcaggccgctcagggacctacaattagctaccccatgctgctacatgtggctgcccaaatagcttcgggcatgcggtacctggctactctgaactag

SEQ ID NO: 6368 - DNA, 639 bp, Artificial Sequence
  Description of Artificial Sequence: Synthetic coding sequence
atgggcctgcacctccgcccttatcgcgtaggtctcctgcccgacgggctgctctttctgctcctgctactcatgctccttgctgatccggcccttcctgcagggaggcatccaccggttgtcctgggagataataatcgaattcccgtgatagggcccctcaagatcagggagcagcagagatcagcagtgagcacttcctggctgctgccgtataactacacatggagccccgagaaggtttttgtgcaaacgcctactatcaattacaccttgcgtgactacaggaagttcttccaggacatagggtttgaagacggatggcttatgaggcaagacactgaaggactggtggaagcgactatgccccccggcgtgcagttgcattgcctatatggcaccggcgtacccacccccgattccttttattacgagtcctttccggacagggaccccaaaatctgtttcggagacggtgacggtactgtgaatctcaaaagcgcattgcagtgccaggcttggcaatctaggcaagagcatcaggtgttgctccaagagttgcccggctctgaacacattgagatgctcgccaatgcaacgaccctcgcctatctgaagcgggtgttgcttgggccgtag

SEQ ID NO: 6369 - DNA, 654 bp, Artificial Sequence
  Description of Artificial Sequence: Synthetic coding sequence
atgtcagatctactcctgctgggacttatcggcggacttacattgcttcttcttcttacgctgctcgcatttgccgggtatagcggtctcctagccggtgtagaggtctctgctggatccccacccattcgcaatgtgacagtggcttacaaattccacatgggactctatggagagaccggaagattattcacggagagttgctctatctcccccaagcttcgctctatcgccgtgtactatgacaatccacatatggtgccgcctgataagtgccgttgtgccgtcggaagcattttgtcggaaggggaggagtcacctagtcctgaactgattgacctctaccagaagtttggattcaaggtattttcctttcctgcgccgtcccacgttgtgacggctaccttcccgtacacaaccatcctgtccatttggctcgccaccagacgcgtgcaccccgcactggatacctatattaaagaaagaaagctgtgcgcctaccccaggcttgagatctaccaggaggaccagattcacttcatgtgccccctcgccaggcagggcgatttttatgtgcccgaaatgaaagagaccgaatggaagtggcggggccttgtggaggcaatcgacacccaggttgatgggactggttag

SEQ ID NO: 6370 - DNA, 345 bp, Artificial Sequence
  Description of Artificial Sequence: Synthetic coding sequence
atgaagacattcacctggacgttaggcgtactgttttttcttttagtggacacagggcactgtagaggtggtcagttcaagataaaaaagatcaatcagcggcgctatccccgggcaacggacggcaaggaggaggccaaaaagtgcgcctacacattcctcgtccccgaacagcgcattactgggcccatctgcgtgaatacaaaaggacaggatgctagtactatcaaagacatgataactcgcatggatttggagaatcttaaagatgtgctctcaaggcagaagcgcgaaatcgatgtgctgcagctggtggtcgacgtggacgggaatatcgtgaactag

SEQ ID NO: 6371 - DNA, 870 bp, Artificial Sequence
  Description of Artificial Sequence: Synthetic coding sequence
atgtttgtgctgctgtatgttaccagctttgccatatgtgctagcggtcagccacgagggaaccagctcaagggtgaaaactattcccccaggtacatatgtagcattccagggttaccagggcctcccggcccccctggagccaacggttctcctggtccccatggcagaatcgggctcccggggcgagatggccgggatggaaggaaaggagagaaaggcgaaaagggaacagccggtctgaggggaaagacaggacccttggggctggcaggagaaaagggggaccaaggcgagacgggcaaaaaaggcccaattggacccgaaggcgagaaaggcgaggttgggccaattggaccccccggacccaaaggtgaccggggcgagcagggagaccccggcctgcccggcgtatgcagatgcgggtccatcgtcttaaagagtgccttctccgtaggcattaccacgtcataccctgaggagaggctccctattattttcaataaggtcctcttcaacgagggcgaacactacaatccagcgacgggaaagtttatctgcgcctttcctggcatatactatttttcttatgacattacacttgccaataagcacctcgccattggactggtccataacggacaataccgcatcaaaaccttcgatgctaacactgggaatcacgacgtggcttcaggatccacagtgatttatctgcaacccgaagacgaggtttggctcgagatcttcttcacagaccagaatggtttgttcagtgaccctgggtgggccgatagtcttttcagtggcttcctattatacgtcgacactgattatttagacagcatatctgaagatgacgagctgtag

SEQ ID NO: 6372 - DNA, 1002 bp, Artificial Sequence
  Description of Artificial Sequence: Synthetic coding sequence
atggtctccaagtcacggtggaagctgctggcaatgctcgctttagtgttggtagtgatggtttggtattccatcagtagggaagatcgctacattgagctgttctacttccctatccctgagaaaaaagagccatgcttacagggcgaggcagagtccaaagccagcaagctttttgggaactactctagagatcagcccatcttcctccggttggaggattatttttgggttaaaacaccttccgcctatgagttgccgtacggcaccaaggggagtgaggacctgctgctccgagttctggccataacttctagttcaatccccaagaacattcagagccttagatgccgtcgttgcgtagtggtgggaaacgggcacaggttgagaaactcctccctcggagacgccattaataagtacgacgtagttatcaggctgaataacgcccctgtggctggatatgagggcgacgtgggaagcaagaccacaatgcgactcttttacccggagagtgcccacttcgatcctaaagtggaaaacaatcccgacaccttgctggtgctggtggccttcaaggccatggactttcattggatcgaaaccatcttatcagacaaaaagcgcgtgaggaaggggttttggaaacaacccccgctgatatgggacgtgaatcccaaacaaattcgcatcctgaacccttttttcatggagatcgctgctgataaactgttgagcctgccgatgcagcaaccccgcaaaataaagcagaagcccactactggcctactcgccattaccctggctctccatctgtgtgacctcgtgcatatagctggattcgggtacccagacgcctacaacaagaaacagacaattcactactacgagcagattacgttgaaatccatggctggcagcggccacaacgtcagtcaggaggcactcgcaatcaaacgcatgctggaaatgggggcaatcaaaaatctgacctctttttag

SEQ ID NO: 6373 - DNA, 531 bp, Artificial Sequence
  Description of Artificial Sequence: Synthetic coding sequence
atgcggctgcttatcctgacctgtttagtggccgtcgcactcgcaagaccgaaactgccactgcgctacccagaacggctgcagaatcccagcgagagttctgaaccgattcctctggagtcacgggaagagtacatgaatggaatgaaccgaagaaatatcttgagggaaaagcagaccgacgagattaaggatacaaggaacgagtctactcagaactgcgtggtggcagaacccgaaaagatggagtcgtcgatatcgagctcttcagaagaacaattttgtagactgaacgaatataatcagctccagttgcaagcggcccacgcccaggagcagattagaaggatgaatgaaaacagtcatgttcaggtgccatttcagcagctgaatcagctggcggcatatccttacgccgtctggtactacccacagattatgcaatatgtgccatttccccctttctcagacatctccaacccaacagcccacgagaattacgaaaaaaataacgtgatgcttcaatggtag

SEQ ID NO: 6374 - DNA, 279 bp, Artificial Sequence
  Description of Artificial Sequence: Synthetic coding sequence
atgaaactatgtgtgactgtgctctcattactagttctggttgctgccttctgcagtctggccctctcagcacccatgggatcagacccaccaacggcatgctgttttagctacaccgccagaaaattgccacggaacttcgttgtcgactattacgagacgtcatccctgtgttcccaacctgccgtggtgtttcagactaaacgaggtaagcaagtctgtgcggatccttcagaaagttgggtacaagaatacgtatacgatctggaactgaattag

SEQ ID NO: 6375 - DNA, 1656 bp, Artificial Sequence
  Description of Artificial Sequence: Synthetic coding sequence
atgacctggagaatgggccctcggttcaccatgctgctggcgatgtggcttgtttgtggttccgagccccatccccacgctacaattagagggtctcatggcgggagaaaggtccctctggtcagtcccgatagctcacgacccgctaggtttcttaggcacactggcaggtccaggggcattgaaagatcaaccctggaagaaccgaacctgcaacctctccaaagacggaggtcagtcccagttttacgcctcgcgcggcccagcagattccgagacaatcgcatggacagaagggaacatgggcatcgggaccccaacgtcgttcccggcccccctaaacccgccaaagaaaaacctccgaagaaaaaagctcaggacaaaatactctctaatgaatacgaagagaagtacgacttgagtcggcctacagccagccagctcgaggacgaacttcaggtggggaatgtgccactgaagaaagcaaaagaaagtaagaagcacgaaaaactggaaaaacctgagaaagagaaaaaaaagaagatgaagaacgagaatgcagataagctgctaaaatcagagaaacagatgaagaaatcggagaagaagtccaaacaggaaaaagaaaagtccaagaagaagaaagggggaaaaacggaacaggacggctatcaaaagcctactaacaaacacttcacccagtcacccaagaagtctgtcgccgatttactcggttcttttgagggcaaacggcgtttgcttctcatcacagccccaaaggcggagaacaatatgtatgtgcagcagcgcgacgaatatctggaaagcttttgcaaaatggcaacacgaaaaatctcagttatcaccatattcggacccgtcaacaatagcacaatgaagattgaccacttccagctggacaacgaaaaacccatgagagtcgtggacgacgaggatctcgttgaccaacggttgatttccgaactccgaaaggagtatgggatgacatacaatgatttctttatggtgcttactgacgtagatttgagagttaagcaatattacgaggtacccatcacgatgaagagcgtgttcgatctgatcgatacctttcagagccgtattaaagatatggaaaaacagaagaaagaggggatagtgtgcaaagaggataaaaaacagagccttgagaactttctgtctcgattcagatggaggaggagattgcttgtgatcagtgcacccaatgatgaagattgggcatacagtcagcaactgagcgctctttctggccaggcatgcaactttggttctagcgtcgtggagagagaggacgtccccgcacacctcgtgaaggacatccgcaattatttccaggtttcacctgagtattttagcatgctgctggtcggaaaggatggtaatgtgaaatcctggtaccctagcccaatgtggagcatggtgatcgtttacgacctcatcgattctatgcagctgaggcgccaggagatggcaattcaacaaagtcttgggatgcgttgtccagaagacgaatatgctggatacggctaccattcttatcaccaggggtaccaggacggctatcaggacgattaccgtcaccacgaatcatatcatcatgggtacccatactag

SEQ ID NO: 6376 - DNA, 1245 bp, Artificial Sequence
  Description of Artificial Sequence: Synthetic coding sequence
atgggggtgagtaagctcgacattttatatcggcggctgctgttaactaagttgttcatccggggatggggacggccagaagatctcaagagactgtttgagttccgaaagatgattggcaaccgggaacgctgtcaaaacttagtgtcttctgactatccagtgcacattgacaagatcgaagagcaatccgactgtaagattttagacggccacttcgtctcaccgatggcacactatgtccctgatatcatgccaattgagagcgtgatcgcacgtttccaattcatcgtacccaaggagtggaatagtaagtaccgcccagtctgtatccacctggccggcacaggtgaccaccactattggagacggaggaccctgatggcccgaccaatgatcaaggaggcccgcatggcctctctgctgcttgaaaatccttattacggatgtcgcaagcccaaggaccaggtgaggagtagtctcaaaaatgtcagcgatctgttcgtgatgggcggcgccctggtcctcgaaagcgcagctctcttgcactggctcgagcgggaaggttatggcccactggggatgaccggaatctcaatgggaggccacatggcttctttggccgtctccaactggcccaagcctatgccactgataccatgtctgagctggagtactgcatctggcgtgttcactacaaccgatagttttaagatgggacaggaattcgttaagcatttcacttccagtgcagacaagctgaccaacttgaatctcgtttctcgcacccttaacttagatatttccaatcaggttgtgagtcaaaaacctgctgactgtcataattccagcaaaacatccgtgagcgccacaagtgagggacttttattgcaggatacctcaaaaatgaagagatttaaccagaccctgtccacaaacaagtccggctataccagccgcaacccacagagctaccacttattatctaaggagcagtcccggaacagtctgaggaaggaaagcctgatcttcatgaagggggtgatggatgagtgcacccacgtggcaaatttttccgtaccggtggatccatcactgataatcgtggtacaggccaaagaagacgcttacatcccacggaccggggttcggagccttcaggagatttggccaggttgtgagatcaggtacctggagggcgggcacatttccgcctatctttttaagcaagggctgtttaggtag

SEQ ID NO: 6377 - DNA, 300 bp, Artificial Sequence
  Description of Artificial Sequence: Synthetic coding sequence
atggagaggatctccgcatttttcagttccatctgggatacgatattgacaaaacatcaggaggggatttacaatactatttgcttgggcgtgctgctcggattgcccctattggtgatcatcaccctgctgttcatttgctgtcactgctgttggagcccaccaggcaagagaggacaacagccggaaaagaataagaagaaaaagaagaagaaaaaaaaaaaggacgaagaggacttatggatttcagcccagcctaaactcctacaaatggaaaagcggccgagcctgcccgtgtag

SEQ ID NO: 6378 - DNA, 912 bp, Artificial Sequence
  Description of Artificial Sequence: Synthetic coding sequence
atgagcgagcctcaacctgatcttgagccgcctcagcacggactgtacatgttgtttttgttagtgctggtgttcttccttatgggcttggtgggtttcatgatatgccacgttttaaagaaaaaggggtacaggtgtcgtaccagtagagggtcagagcctgacgatgctcagcttcagcctcctgaggatgacgacatgaatgaggataccgttgaacgaatcgtgcgctgtattatccagaatgaggccaatgccgaggccctgaaagaaatgttgggcgacagtgaaggggagggcactgtccagctgagctcagtagacgcaacttccagccttcaggacggtgcaccttctcatcaccacacggttcatctgggcagcgccgccccatgcttgcactgttcgcggtctaaacgccccccgctcgtgcggcaggggagatctaaggagggaaagagtcgccccagaactggcgaaactaccgtgttctcggtgggcagatttcgcgtgacacatattgaaaagaggtacggcctacacgaacatcgcgatggcagcccaaccgataggagttggggcagcgggggcggccaggaccccggtggtggtcaaggctctggcggcggacaaccaaaagcaggtatgcctgccatggagcgtctgccgcctgagcggccccagccccaagtgcttgccagtccccccgtgcagaacggagggctccgggatagctcactgacgccaagagccctggaaggaaatcccagagccagtgccgaaccgacacttagggcggggggccggggtccctccccaggtctcccaacccaggaagctaacggacagccttcaaagcctgacaccagtgaccaccaggtaagtttgccgcagggcgccggctccatgtag

SEQ ID NO: 6379 - DNA, 444 bp, Artificial Sequence
  Description of Artificial Sequence: Synthetic coding sequence
atgggccctgaggccttatcttccctgctgctcctgctactggtggcttcaggtgacgccgatatgaaaggccacttcgatccagccaagtgtcgctacgcgctcggaatgcaagatagaacaattcccgacagcgatatctcagcttcctcaagctggtctgatagcactgccgcccgccactcgagattggaaagctctgatggagatggcgcatggtgccccgcaggcagtgttttccctaaggaagaggaatatttgcaagtcgaccttcagagattacacctggttgctctggtgggcacccaaggtcgacacgccggcggacttgggaaagaattcagcaggtcttaccggcttcggtatagcagagacgggcgcagatggatgggatggaaggataggtggggtcaggaggtgatctcagggaacgaggatccttag

SEQ ID NO: 6380 - DNA, 1173 bp, Artificial Sequence
  Description of Artificial Sequence: Synthetic coding sequence
atgggggctacaacgatggatcagaaatcactttgggcaggggtagtcgttttgttactcctgcaaggaggatcagcttacaagctggtgtgctatttcacaaattggtcccaggataggcaggaacccgggaagtttacaccagagaacattgaccccttcctgtgttcccacttgatctactccttcgcgagcatcgagaataataaagtgattatcaaagacaaaagtgaagtcatgctgtatcaaactatcaatagcctcaaaactaagaaccctaagctcaagatcctcctttctatcggcggttacctgtttgggagcaaggggtttcaccctatggtggactcgtctacgtcccgcctcgagttcatcaactcaattatcctattcctccgaaaccacaatttcgacggtcttgatgtctcgtggatctaccctgatcagaaggagaacactcactttacggtcctgattcatgagctggccgaagcgtttcagaaggactttaccaaaagcaccaaggagagattgctgttaaccgccggtgtttccgcggggaggcagatgatagataattcttaccaggtggaaaaactagctaaggatctggacttcattaatctgctgtcttttgacttccacggaagctgggaaaaaccacttatcaccggccacaattctccgctctcaaaaggctggcaggatcgagggccatctagttattacaatgtggaatacgcagtgggatactggatacacaagggtatgccctccgagaaagtggtgatgggtattcctacatacggacactctttcactttggccagcgcagaaaccacggtgggggctcccgcatcaggacctggcgcagctggcccaattaccgaaagctctggttttctggcttattacgaaatttgccagtttttaaaaggagctaagataaccagactgcaagatcagcaggtcccttatgccgtgaaagggaatcagtgggtgggatatgacgacgtgaaaagcatggagactaaagtgcagtttctgaaaaaccttaacctgggcggcgccatgatctggtccattgacatggatgacttcaccgggaagagttgcaatcaggggccctacccactggtccaagcagtaaaaagatctctcgggtctctttag

SEQ ID NO: 6381 - DNA, 297 bp, Artificial Sequence
  Description of Artificial Sequence: Synthetic coding sequence
atgaacaaacattttctgttccttttccttttgtactgtctcatcgtagcagtcacaagcctacagtgcatcacctgtcacttacgcaccagaacagatcggtgtagaaggggtttcggtgtttgcacggcccaaaaaggcgaagcttgcatgttgcttagaatttaccagcgcaacacactgcaaatctcatatatggtatgtcaaaagttttgtagggatatgaccttcgacttaaggaaccgcacttatgtccacacatgctgcaactataattattgcaatttcaagttgtag

SEQ ID NO: 6382 - DNA, 600 bp, Artificial Sequence
  Description of Artificial Sequence: Synthetic coding sequence
atggcttggggcggggttcacacctgctgttttcatttgtgttgttgttgcagctggcctcaaggggccgtccctgaagaattgcataaacatccgggccaaactctgctgctgcagtgtcagtacagcccaaaaagggggccctaccagcctaagagctggtgccagcagacctccccctccaggtgtaccctgctggttacatcatccaaaccatggaccgccgtgcagaagtcacattacactatctgggacaagccgaacgctggcttttttaacatcaccatgattcagctcacccagaacgattcgggattttactggtgtgggatctacaacgcatctgaaaatattatcaccgtccttcggaacatttccctggtggtgagtcccgctccgacaactagtcccatgtggaccctgccttggctgccaacttctacggcctgggagccccagatccaagagattaagttcagagcccctaccgactctacactttggaagtctagagccccagcctgtctggggtccggtggaccaagatttcttgtacttgtactatgtgggttgctgctggcaaaagggctgatgctgtag

SEQ ID NO: 6383 - DNA, 2025 bp, Artificial Sequence
  Description of Artificial Sequence: Synthetic coding sequence
atgacaaccgacgacaccgaggtgccagcaatgactctcgccccggggcacgcggctctggaaacacagactctctccgctgagacatccagtcgagcttcgaccccagccggcccaatccctgaggccgaaacaaggggagccaaaagaatatctccagcacgggagactagaagcttcaccaagacatcacctaactttatggtgctaatcgctacaagcgtagaaacaagcgccgcctcaggctcacctgaaggtgccgggatgacaaccgtgcaaactatcacgggaagcgatccccgtgaggctatcttcgacaccctgtgcacagatgacagcagcgaagaagcgaagaccctgactatggacattcttacccttgcacacaccagtacagaggctaaggggttgtcttctgagtcttcggccagctccgattccccacatcctgtcattactcctagccgggccagcgagtcatcagccagctcagatggcccacaccccgtgatcaccccctcacgagcctcagagtcatctgcttcttctgatggtcctcacccagtgataacgccatcacgtgcatctgagagctcggcctcaagtgacggaccacacccggtaattacacctagtcgcgccagtgagagttcggcctctagcgacggccctcatcctgttatcaccccctccagggctagcgagtcttcggcgtctagtgacgggccacatcctgttataacaccgtctcgcgcatcagagagcagtgcaagtagcgatggtccgcatccagtgatcaccccttctcgagctagtgaatcaagtgccagcagtgatggcccccacccggtgatcactccgtcgagggccagcgaatctagcgcttcctcagatgggccacatccagtgatcaccccgtcacgagcatccgaatcgtctgcttcatcagacggacttcaccctgttatcaccccctcgcgtgcctcggaatcctccgcaagctccgatggccctcacccagtcatcacaccatctagagcatcagaaagcagtgccagtagtgatggtcctcacccggtgattaccccttcttggtcccccggatccgatgtgacgctgctagcagaggctcttgtaactgtcaccaatatagaagtcattaattgttcaataaccgaaatcgagacaaccactagttcaatccctggcgcctcagatacagatctgattcctaccgagggcgtcaaagccagttccaccagcgatcctccggctcttccagacagtactgaagctaagcctcatattaccgaggtgactgcttccgccgagactctcagcactgctgggactacagagtctgctgcgcctgacgcgactgtagggacgcccttacccaccaactccgccacagagagagaggtcactgctcccggagctactaccctaagtggtgcactggttacagtctccaggaaccccctggaggagacatctgcattgagcgtcgagacgcctagttacgtgaaggtgagtggcgctgccccggtgtctatcgaggctggcagtgccgtgggaaaaaccacctcatttgccggctcatctgctagctcctacagcccctcagaagccgcattgaagaactttaccccttccgaaacacctactatggatatagccactaagggacctttcccaacatctcgtgaccccctgccaagcgtcccgccgaccacaactaacagtagcaggggaaccaactccacactggccaaaattaccacaagtgcaaagacaacaatgaagccgccaacggcgacccctacgactgccagaacaaggcccacaacagatgtcagcgctggtgagaatggcgggtttctgctgttgcgcctgagcgttgctagccccgaagacctcaccgacccacgtgtagcagaaagattaatgcagcagttgcaccgagaactgcatgctcatgcaccccattttcaggtctctttgcttcgcgtgagacggggttag

SEQ ID NO: 6384 - DNA, 738 bp, Artificial Sequence
  Description of Artificial Sequence: Synthetic coding sequence
atgcaggccgcgtggctattaggagctctagtggtaccacagctcctgggtttcggccacggtgcacgcggagcagagagggagtgggaggggggctggggcggggctcaggaagaagaacgggagcgggaagcactaatgttgaaacatctccaggaggccctcggactgccagccggaaggggcgacgagaaccctgctggcaccgtggaggggaaagaagattgggaaatggaagaggaccagggggaggaggaagaggaagaagcgacacctaccccctcttcagggcctagcccatctcccacccccgaagacatagtgacatacatcttggggcgccttgcaggacttgacgcgggcttgcaccaactgcatgtaaggctgcacgctttagacacccgggtggtcgaacttacacagggtctgcgccagctgcgcaatgcagccggggacacccgggacgcagtgcaggccctacaggaggcgcagggccgagccgaacgcgagcacggaaggctggagggatgtttgaagggtctccggttgggacacaagtgtttcctcctttctcgggattttgaagcgcagccttcagcctctccccaccccttgagcccagatcagcccaacggaggaacgttagagaactgcgtggcacaggcctctgatgacggcagctggtgggaccacgactgccagcgacgcctgtactacgtatgcgaatttccgttctag

SEQ ID NO: 6385 - DNA, 279 bp, Artificial Sequence
  Description of Artificial Sequence: Synthetic coding sequence
atgatttggaggtccagggcaggagcggagcttttctccctgatggcgctgtgggaatggatcgccctcagcttacactgctgggttctggcagtcgcggcagtgagcgatcaacacgcaacatctccgtttgactggctcctcagtgataaggggccctttcaccggtcccaggagtataccgactttgtcgacaggagtaggcaggggttcagcacgcgttacaagatttatcgtaacatgggtcacatctcatgttaccttctgctctgggaatag

SEQ ID NO: 6386 - DNA, 177 bp, Artificial Sequence
  Description of Artificial Sequence: Synthetic coding sequence
atggctgacatgcagaacctagtagaaagactggagagggcagtcggaagactggaggccgtgagccacaccagcgacatgcaccgcggctatgccgacagccccagcaaggcgggcgctgcgccatatgtgcaagccttcgactctctccttgcaggacccgttgcggagtattag

SEQ ID NO: 6387 - DNA, 732 bp, Artificial Sequence
  Description of Artificial Sequence: Synthetic coding sequence
atgggtccagaggctttgtcatcactgcttctgctgctcttggtcgcatcaggtgatgctgacatgaaaggtcattttgacccagcaaagtgtcggtatgcgctcggtatgcaggatcgcacaattcccgattcagatatcagtgcctccagctcctggtctgacagtactgccgcacgccactcccgactggaatcctcggatggcgatggcgcctggtgtccggcaggctccgtgtttcctaaggaggaagagtacctgcaagtggatttacagcgtctacatctggtcgcactggtcgggacccagggcagacacgcagggggactcggcaaggaattctcccggtcctatcgtttgcgctactccagggatggcaggagatggatgggttggaaggaccgatggggccaagaggtaattagtggtaacgaggatcccgagggtgtcgttctgaaggacttggggccccctatggtggcaaggctcgtacggttttaccctagggccgaccgggtgatgtctgtgtgcctgcgggttgagctgtatggatgtctttggcgggactgttccatgggggtatgggcttcgtggcagatggtgtggtggggctggatgactctgggtagagtcaggtcttgtggctctggccaagctatgacaatgtgggatggcgctacgactgcatcacccgtcgcaatgtggcgatggtccctcagcctgaccggctag

SEQ ID NO: 6388 - DNA, 2535 bp, Artificial Sequence
  Description of Artificial Sequence: Synthetic coding sequence
atgggaccaggagctccctttgctcgtgtgggctggccgctgccactattggttgtgatggctgccggagtggctcctgtctgggcaagtcactcgccacaccttccgaggcctcactcaagggtcccacctcatccaagcagtgagagaagagccgtatacatcggggctctgtttcctatgtccggaggatggccgggaggccaagcctgtcaaccagccgtcgaaatggcacttgaagatgtgaactccagaagagatatccttcccgattacgagcttaaactgatacaccacgattcaaaatgtgatcccggacaggcaaccaagtacctttacgagttactgtataatgatccaatcaagattatccttatgcctgggtgctcgtctgttagcacgctggtggcagaggccgcacggatgtggaatttaatcgtgctctcttatggaagcagcagtccagccctatccaaccggcagcgtttccctacgtttttccgcacccacccatcagccaccctacacaaccctacaagagtcaagcttttcgaaaaatggggatggaagaagatcgcaaccattcaacagaccacagaagtgtttacttctaccctggatgacctggaagaacgggttaaagaagctggtatcgagattacctttcggcagtctttctttagtgacccagcagtgcccgtcaagaatctgaaaaggcaagatgctagaatcattgtcgggctattttacgagactgaggcccgcaaggtcttttgcgaggtctacaaggagaggctgtttggcaaaaaatacgtttggttcctgataggatggtacgccgataattggtttaaaatatacgatccctccatcaactgcacagtggatgaaatgacggaggcggtggaaggacatatcactacagaaatcgttatgctgaatccagctaatacccgcagtatcagcaacatgaccagccaagaatttgtcgagaaactcaccaagcggctcaaacggcaccccgaggaaaccggaggctttcaagaggctccccttgcttacgacgctatttgggctctggcccttgcactcaacaagacctccggggggggcggccgtagcggcgttcgcttagaggattttaactacaataaccagacaattacagaccagatttaccgagctatgaattcttcttcattcgaaggagtgagtggccacgtagtgttcgatgcatcgggttccaggatggcctggaccctcattgaacagctccaaggtggcagttataaaaagattggctattacgactccacgaaggatgatctgagctggtctaagaccgacaaatggatcggagggagccctccagctgaccagactctagtaatcaaaacatttaggttcctcagccagaaactgttcatttctgtgtcagtgctatcctcccttgggatcgtgctcgccgtggtctgcctgtctttcaatatttataatagccacgtgagatacatccaaaatagccaacccaacctgaacaatctgacagccgtaggttgcagccttgcactggccgccgtgttcccactgggactcgatggttatcatattggcaggaatcaatttccctttgtctgccaggctcgcttgtggctattgggccttggctttagccttggctacggcagtatgttcactaagatatggtgggtccacaccgtttttaccaagaaggaagaaaaaaaagagtggcgtaagactctggagccctggaaactgtatgctactgtcggtttactggtcggcatggatgtactgacattggccatctggcaaatcgtggaccccctacacagaaccattgagacttttgccaaggaagaacctaaggaggacatcgacgtcagtatcctacctcagctggaacattgctcttcaaggaaaatgaatacctggcttggcattttctatggttacaaaggccttttattactgctgggtatttttctggcctatgagacaaaaagcgtgtccaccgaaaaaattaacgatcacagagcagtggggatggctatttacaatgtggcagttttgtgtctgatcaccgctcccgtaacaatgattctgagctctcaacaggatgccgcattcgcttttgcatccctcgccatcgtcttctcatcttacatcaccctggtggtcctcttcgtccccaaaatgcgcaggctcatcaccagaggcgagtggcaaagtgaagcccaggacaccatgaagactggcagtagtaccaacaacaacgaagaggaaaaatcccgcttgcttgaaaaggaaaacagagaactcgagaagatcattgcggagaaggaggagagggtgagcgaacttcgccatcaactgcagagtagacaacagctgaggtcccggaggcacccacctactccaccggagccctcaggaggcctcccccgggggcccccagagccccctgaccgtttaagctgtgatggatcgcgagtccacctgctttacaaatag

SEQ ID NO: 6389 - DNA, 921 bp, Artificial Sequence
  Description of Artificial Sequence: Synthetic coding sequence
aggcgcacatgcgccggtccgggccgcgcaggcggcgctcggagcgcatcatggatgtctagattgcgggccctgcttgggctaggactcctggttgccggatcacgagtgccccggatcaaaagtcagacaatcgcatgccgatccggccctacttggtgggggccccaacgcctcaattcaggggggcgctgggatagtgaggtgatggcttctaccgtggttaaatacctgagccaagaggaggcccaagctgtggaccaggaactgtttaatgaataccaattttccgtagatcagctcatggaacttgctggactgtcttgtgccactgcgatcgccaaggcttatccaccaacctcaatgagccggagtcccccaaccgtgttagtgatctgcggtccaggcaacaacgggggagacggtctggtgtgtgccagacacctgaagttatttggatatgagccaactatttactaccccaaacgcccgaataagccgctcttcacagcccttgtaactcaatgtcaaaagatggatatccccttccttggcgaaatgccagccgaacctatgaccatcgatgagctgtacgagttagtggtggacgccattttcggattcagtttcaaaggggatgtgcgtgagcctttccactctatcctatcggtcctgaagggtctgactgtgcccatcgcttcaatcgatattccaagcggatgggatgttgagaagggcaacgcgggcggcatccagccagaccttttgatttccctgacagccccaaaaaagtccgctacccagttcactgggagataccattacttgggcggcaggttcgtgcccccagccctggagaaaaagtaccagttgaaccttcccccttatcccgatacggagtgtgtttatcggctgcagtag

SEQ ID NO: 6390 - DNA, 1137 bp, Artificial Sequence
  Description of Artificial Sequence: Synthetic coding sequence
taatatagtggggattacatggagccagagaagcccggcgcccctctgctgccacctccaccacagaactctgtgcctcattacgctgaggctgatatcgtgaccttgcagggcgtgaccggtggtaacacatacgccgtgcccgcattaccacccggcgcggtgggtgacggtcctcctagggtggactttcctagaagcagactaaggttcaaggagaaacttggagaggggcagttcggtgaagtgcacctgtgtgaggtggattcaccacaggacctggtgtcgctggacttccccctgaatgtgcgaaagggacatccactgctggtggccgtgaaaatccttcgccctgacgccactaaaaatgccagtttcagtctgttctccagaaatgactttttgaaggaggtcaaaattatgtcccgattgaaggatcccaacatcatcagattgctgggcgtgtgtgtacaggatgatcctctgtgcatgattacagattacatggagaacggcgacttaaatcagttcctgtccgcccaccagctggaggataaggccgccgagggagcccccggtgacggacaggctgcacaaggcccaaccattagctaccccatgctcctgcacgtggccgctcagatcgcttcaggaatgcgctatctggccaccctcaatttcgtgcaccgtgatctcgctacccgaaactgtctggtgggagaaaactttacaataaaaattgcagactttggcatgtcccggaacctatacgcgggggactactacagggtgcaagggcgggcggtgctgcctatccgttggatggcatgggaatgtatcttaatgggcaagtttactactgccagtgacgtttgggcatttggtgtgactctctgggaggtgttgatgttgtgtagggcccagccttttggacaactaacggatgaacaggtgatcgagaacgccggagaattttttagggatcagggtaggcaggtttacctctctaggcctcccgcttgtccccagggactttacgagttgatgttgcgttgttggtcacgggagagtgagcagcggccgcccttctcacaactgcaccgcttcctggctgaggatgctctcaacacagtttag

SEQ ID NO: 6391 - DNA, 762 bp, Artificial Sequence
  Description of Artificial Sequence: Synthetic coding sequence
atggctccttggtctcaccccagcgctcagctccagcctgtgggaggcgacgccgtgagcccggccctgatggtgctcctctgtctgggtaatctgtcgaaagctacgttgtgggctgagcctgggagcgtcatttctaggggaaacagtgtgacgattagatgccagggtacgctcgaagctcaggagtacagattggtgaaggaaggcagtcctgaaccctgggacacccaaaacccactggaacctaagaataaggccagatttagcatcccatcaatgactgagcaccatgcaggcagataccggtgctactattactctcccgctggttggtcagagccctctgatccactggagctggttgtgaccggcttttataacaagccaactctctccgctcttcctagccctgtggtgaccagcggcgagaacgtcactctgcagtgcgggagcaggctccggtttgatcgcttcattctaactgaagaaggagaccacaagctgtcctggacactggactctcagctgacacccagtgggcaatttcaggccttgtttcctgtggggccagtcaccccgtcccacagatggatgctcaggtgctacggaagccgtaggcatattttgcaggtgtggagtgagccttccgacctgcttgaaatccccgtgagcggcgaggaggccacggtgttcagttccaccattcagggatctcagaccggctgtggcgaattatatcggcaggggtccccatgctag

SEQ ID NO: 6392 - DNA, 288 bp, Artificial Sequence
  Description of Artificial Sequence: Synthetic coding sequence
atgagaaagccaaggagaaagtctcgccagaacgctgagggccgccgaagcccctcaccctattcactgaaatgcagtccaacccgcgagaccctgacctacgctcaggcccagaggatagtcgaggtcgatatcgacggaaggcttcaccggatatcaatctatgacccactgaagatcattacggaggatgaactcactgcccaagacattaccgagtgcaatagtaacaaggagaattccgagcaaccgcagtttcccggcaaatcaaaaaaacctagcagctag

SEQ ID NO: 6393 - DNA, 1311 bp, Artificial Sequence
  Description of Artificial Sequence: Synthetic coding sequence
atgaagttccagggacccctcgcctgcctgcttttagccctgtgtttaggctccggcgaagccggccctcttcagtcaggggaggaatccaccgggaccaatattggggaggctctaggtcacggtcttggagacgcgctctccgagggagttgggaaggccatcgggaaggaagcaggcggcgcagccggcagcaaggtctctgaggccctcggccaaggcacccgtgaggctgtggggactggtgtgagacaggtcccaggttttggggtcgctgacgccctcggaaaccgggtaggtgaagctgcacatgccctgggtaacacaggccatgagatagggagacaggctgaggacgtgatccgccatggagcagacgccgtgaggggctcatggcagggagtgcctgggcataatggcgcctgggaaacgtccggaggtcatggcatttttggatcccaggggggcctcggaggtcaggggcaagggaatccgggtggtctcgggactccttgggtacacggctatcccggaaacagcgctgggtcattcggtatgaatccacagggggccccttggggacagggcggcaatggcggaccccctaactttgggaccaacactcaaggagcggtagctcaacctggatatgggtccgtccgtgccagcaatcagaatgagggctgcacaaatcccccaccatctggttctggcggcgggtcgagcaattctggcggtggttcaggttcacagagtggctcctcaggttctgggtcgaacggcgacaataataatgggtccagtagtggcggatcctcctcagggtcgagttcagggggatcaagtgggggttcttcgggcggcagttcgggtaattccgggggctcacgaggtgactcagggtccgagagttcgtgggggagctctaccgggagcagcagtggaaaccacggcggcagtgggggagggaacgggcacaagccaggctgtgagaaacccggaaatgaggccagagggagtggcgagagcggcatccagggctttaggggccagggcgtctcaagcaatatgagggaaattagcaaggaggggaataggctactggggggttccggagataattaccgcgggcagggctcctcctggggttccggtgggggggatgcagtgggcggggtgaacacagtaaacagcgagacctcccccggaatgtttaattttgatacgttctggaagaattttaagagtaaactggggttcataaactgggatgctataaataaggaccagcgctcttcaagaataccctag

SEQ ID NO: 6394 - DNA, 240 bp, Artificial Sequence
  Description of Artificial Sequence: Synthetic coding sequence
atgcccgcttgccgtctgggaccactggcagccgcactcctgcttagtcttctgctgtttgggttcaccctcgtttccgggactggcgcagagaagactggagtgtgtcccgaactgcaggctgatcagaattgcactcaggaatgtgtaagcgacagtgagtgcgcggataacctgaagtgttgtagcgccggatgcgccactttttgtagccttccaaacgggcagctggccgagtag

SEQ ID NO: 6395 - DNA, 2130 bp, Artificial Sequence
  Description of Artificial Sequence: Synthetic coding sequence
atgggatgcctgtggggactcgctctgcccctcttctttttttgctgggaggttggcgtgagtggctctagcgccgggccaagcacccggagggcagatacggccatgactacagatgacaccgaagtgcctgctatgacattggcccccggtcatgccgccttggagacacaaacactgagtgctgagacctcctccagagcctcaactccagctggacctatccctgaggccgagactcgcggagccaagcggatttctcccgcacgcgagacacgatcattcactaagacttcccctaattttatggtactgattgcaacgtctgtagagacttccgcagcatcaggaagtcctgagggcgctggaatgactactgtgcaaactatcacaggtagcgatcctcgcgaggctattttcgatactctgtgtaccgacgactcttcggaggaagccaaaaccctgaccatggacatcctgactctggcccacacttccacggaggccaaaggcctgagcagcgaatcttctgccagttctgattcgcctcacccagtaattacaccctcacgggcatctgaaagcagcgcgtctagcgacggccctcaccccgttatcactcctagtcgcgcctctgagtcttccgcttcaagcgatggaccacaccctgtcatcacaccctctcgggcctccgagtccagcgcaagcagtgatggaccacaccctgtgatcactcctagccgggcttctgaaagtagtgcatcttccgacggccctcaccccgtaataacccctagtcgagcgagcgaatcatctgcttcatccgatggaccccatcctgtcatcacccccagtcgtgcttccgaatcatctgccagctctgacgggccccatcccgtcatcaccccgagtcgtgcttcagaatcatctgcctcttcagacggcccgcaccctgtcatcacccctagccgcgctagcgagagttccgcaagctcagacggccctcaccctgtgatcaccccgagtcgggcatcagagagcagcgcgtccagtgacgggctccatcctgtgatcactcctagccgtgcatctgagagctctgcctcgtcggatggcccacaccccgtaatcacacccagtagagcttcagagtcttccgccagttccgacggaccacaccccgtgatcaccccgtcctggtcccccggctcagatgtgaccctgctggcagaagctctcgtgacagtgacaaacatcgaggttattaattgctctattacagagattgagacgacgaccagctctataccaggggccagcgacactgatttgatcccaactgaaggggtaaaggcctcaagcacctccgacccgcccgcattacccgactcgacagaagcaaagccacatatcacggaagtgaccgcctcagccgaaacactgtccactgccggtaccaccgagtctgccgccccggacgcaactgtcggcaccccccttcccaccaactccgcaacggagagggaggtgacagccccgggggccacgaccctctccggagcacttgtcaccgtgagccgcaacccactcgaggagaccagcgctttgtccgtggagactcccagctacgtcaaggtgtcaggggccgccccagttagcattgaagcaggctcagcagtgggtaagactaccagcttcgccggctcctccgcaagcagctactccccctcggaagccgcactgaaaaactttaccccttctgagacccctaccatggacattgcaaccaaaggacctttcccaaccagccgtgaccctttgccatctgttcccccgacaactacgaactcctctcgaggtactaacagtactctggcaaaaattactacctcagccaagaccaccatgaaaccgccgactgctacccctacaacagctaggactagaccaaccactgacgtttcggcgggtgagaatgggggattcctgctcttgcgtttaagtgtggcatccccagaggacctgacagacccgcgggtggctgaacgtctgatgcagcagctgcacagagagctccacgcgcacgccccacactttcaggtttccctgctcagagtgcgtcgaggctag

SEQ ID NO: 6396 - DNA, 2067 bp, Artificial Sequence
  Description of Artificial Sequence: Synthetic coding sequence
atgttgcctacagaggttccccagtctcaccctggcccatccgcattgctcctactgcaattgttattacctccaacctccgcatttttccccaacatctggagtctgttggcagctccaggaagcattacgcaccaggatctgactgaagaagctgcactgaacgtaactcttcagctgttcctggaacagcccccccccggtaggccccccttgagactagaagacttcctggggaggacactactcgcagacgacctatttgccgcatactttggacctgggagtagccgccgcttcagggctgcgctgggtgaggttagtcgagcaaacgcagcccaggacttcctacccacgtcccgaaacgatccggacctgcactttgatgccgaaagattaggccaaggaagagccagactagtcggggcattacgggagactgtcgtggccgcacgggcgctggaccatactctagcgaggcagcggctcggtgccgctttgcacgccttacaggacttttattctcattccaattgggtggagctaggtgagcagcagcctcacccgcacctcttgtggccacggcaggagttacagaacttggcccaggtggcagacccaacctgcagcgattgtgaggaactttcctgtccgcgaaattggttaggctttaccctgttgacttcgggttattttgggactcaccccccaaaacccccaggaaagtgctcacatggcggacactttgatcgctcctcgtctcagccccctcgaggagggatcaacaaggattctacctcccccggattctctccgcaccatatgcttcatttgcaagcggccaagcttgccctactggcctctatccaggcgttcagtctcctgcggtctagactcggagacagagatttttcgcggctgctggatataaccccagcttccagcctttccttcgtcctggataccaccggttctatgggggaagagatcaatgccgccaagatccaggcacgccacttggtcgagcagaggcgtggctccccgatggagcccgtacactatgtgctggtcccatttcacgacccgggttttggaccagtatttactacttcagatcctgacagcttttggcagcagctgaacgagattcacgccctaggcggcggcgatgaaccggagatgtgccttagcgcgctccaactggcgctcctccataccccccccctgtccgacatttttgtgtttaccgacgcgagtcctaaggacgcttttctgacaaaccaggttgagtctctaactcaagagcgccgatgtagagtgacctttctggtgactgaggatacatctcgggtgcagggaagggcaaggagagagatactgagccccttaaggttcgagccgtacaaagccgtggccctggcctcaggcggcgaagtgattttcacaaaggaccagcacattagggacgtcgcagccatagtcggcgagtctatggccgccctagtcacccttcccctggatccccctgtggttgttccaggtcaaccactggttttcagcgtggacggattgctgcagaagataacagtgagaatacatggcgatatttccagcttctggattaagaaccctgccggggtgagccaaggccaggaagaaggagggggacctctggggcacacacgtcgctttggacagttctggatggttactatggacgacccgccgcagacaggtacctgggagattcaggtgacagctgaagacacccccggagtccgagtgcaggcccagactagtctggatttcctcttccactttggcattcccatggaggatggaccacacccgggtctgtaccccttgacccagccagtcgcaggcctgcaaacacagttgttggtcgaatctcagtcatggggcagcagcgcggcgtttctgcccagacatccgtcacgcggaccaagggggtgccgcacacggccaggcgctctaggcgcccgcggcacttcaggtgctaggagcccacgatccctcgccgtggcccatgccgcagtacacccttag

SEQ ID NO: 6397 - DNA, 1257 bp, Artificial Sequence
  Description of Artificial Sequence: Synthetic coding sequence
aataacctgaacgtcggctctgatactacttcagagacatcattcagcttatcaaaggaagccccgcgagagcacttagatcaccaggccgcacaccaaccctttccccggccccgattcagacaggaaaccggacaccccagcctgcaacgggactttcctcgaagcttcttgctcgaccttcctaatttcccagatctgtctaaagcggatattaatgggcagaaccctaatatccaggtgactatcgaagtggtcgatggacctgattccgaagccgataaggaccagcatcccgagaacaagccaagttggtccgtacccagcccagactggagggcttggtggcagcggagtctgagtctggccagagccaacagcggcgaccaggactacaagtatgactccacctccgatgacagcaacttcctcaatccccccagggggtgggatcataccgcacctggccatcggaccttcgagacaaaggatcaacctgaatatgatagcactgacggagaaggggattggtccttgtggtctgtgtgctctgtgacgtgtggaaacggcaaccagaagaggaccaggtcatgcgggtatgcctgcaccgccacggaatcccgcacgtgtgataggccgaattgtccaggcattgaagatactttccggactgccgcgaccgaggtcagccttctcgcagggtccgaagagttcaatgctactaaactgttcgaagttgatactgatagttgtgaacgttggatgtcctgtaaatccgaattcttgaaaaaatatatgcataaggtgatgaatgatcttccctcctgtccatgctcctaccctaccgaagtggcgtactccacagccgacattttcgatcgaattaaaagaaaggatttccggtggaaagatgcttccgggccgaaagaaaaattagaaatctataaaccaaccgcaagatactgcattagatccatgttaagcctcgaatccaccaccctggctgcgcagcactgctgttacggcgacaacatgcagctcattacacggggaaaaggtgccggcaccccaaatttaatatccactgaattctcagccgagctgcactacaaggtcgatgtcctgccctggattatctgtaagggcgattggagtcgatataacgaggcacgtccacctaacaacggtcagaagtgcacagagtcccccagcgatgaggattatatcaaacagtttcaggaggccagagaatattag

SEQ ID NO: 6398 - DNA, 693 bp, Artificial Sequence
  Description of Artificial Sequence: Synthetic coding sequence
atgagattggctggccccctgaggattgtcgtactggtcgtgtccgtcggcgtgacctggattgtcgtgtccatcctgctggggggacccggaagtggatttcctcggatccagcagctctttacttcacctgagagtagtgtgacagccgcccctcgtgcccgcaaatataaatgtgggcttcctcagccatgtcccgaagaacatctggccttcagggtggtttctggagctgccaatgttattgggcccaaaatttgtcttgaagacaagatgctcatgagttctgtgaaggataatgtgggcaggggactgaatattgcactcgttaacggcgtgtcaggagaactgatcgaagccagggctttcgacatgtgggcaggggatgtgaatgatttgctgaaattcattcgccctctgcacgaaggaacattggttttcgtcgccagctacgacgaccccgctacgaagatgaacgaggagacccggaaactgtttagcgagctgggctctagaaatgccaaggaactggcttttcgagactcatgggtatttgtgggagcaaagggcgtgcagaataaatccccgtttgagcagcatgtgaagaactccaagcattctaacaagtacgaagggtggccagaggctcttgaaatggagggatgtattcctcgtcgaagtactgccagttag

SEQ ID NO: 6399 - DNA, 192 bp, Artificial Sequence
  Description of Artificial Sequence: Synthetic coding sequence
atgggtcccgaggcgttatctagccttttgctcctgctgctggtcgcgtcaggggacgccgatatgaagggtcacttcgaccccgccaagtgtcgttacgcactaggcatgcaggataggacgattcccgatagtgatatttctgcgagttccagctggtctgattcaacagcagcacgtcattcacgatag

SEQ ID NO: 6400 - DNA, 1014 bp, Artificial Sequence
  Description of Artificial Sequence: Synthetic coding sequence
atgctgagcctcggggctcactccgtcaccaagacgcagattctgcagggactcggcttcaacctgactcatacccctgagagcgccatccaccaggggttccaacacctagtccattctctgacagtgcccagtaaggacctgacgctgaagatgggcagtgctttgttcgtgaagaaggaattacagcttcaggctaactttctggggaatgtcaagcgcctttatgaagcagaggttttttccactgacttttctaatcccagcatcgctcaagcccgcattaatagccacgttaaaaaaaagacccagggtaaggtggtggatataattcagggcttagatctgctaactgctatggttctagtaaatcacatttttttcaaagctaaatgggagaaacctttccacccagaatacacaaggaagaattttccatttctggtgggagaacaggtcaccgtgcacgttccaatgatgcatcagaaggagcagtttgcattcggagtggataccgagctcaactgtttcgtgctgcagatggactacaagggcgacgccgttgcctttttcgtacttccttcaaaaggaaagatgcgccagttagagcaggctctaagcgctaggactctgaggaaatggtcccacagcctccagaaaaggtggattgaagtgtttattccccggttcagtattagtgcctcttacaatctcgagactatcctgccaaagatgggaatccaaaatgtgttcgataagaacgccgatttttctggcatcgctaagcgcgactcccttcaagtgtcaaaagcaacccacaaggccgtcttggatgtttctgaggaagggactgaggcaacagccgcaaccacgactaagttcatcgtgagaagtaaagatgggccttcttatttcaccgtcagctttaaccgcacattcctgatgatgatcactaataaagctaccgacggaatcctgtttttgggcaaagtggaaaatcccacaaagtcttag

SEQ ID NO: 6401 - DNA, 336 bp, Artificial Sequence
  Description of Artificial Sequence: Synthetic coding sequence
atgtttttcactatctccaggaagaatatgtcccagaagttgtctttattgttgctggtgttcggcctaatatggggccttatgctcctgcactatactttccagcagcctcggcatcaatcatcagtgaaactgcgggagcagatactggatctgagtaagcgttacgtgaaggcactagcggaggaaaataaaaataccgtcgacgtggagaatggggccagtatggctggttatgctgatctgaagcgcaccatcgctgtcctcctggatgacatccttcagaggctcgtgaaattggagaacaaagttgactacattgtggtgaatggctag

SEQ ID NO: 6402 - DNA, 498 bp, Artificial Sequence
  Description of Artificial Sequence: Synthetic coding sequence
atggagatgttccagggtctcttgcttctcttattgctgagcatggggggcacctgggcatcaaaagaaccactgagaccaagatgccgccctattaatgctactctggcggtggaaaaagaggggtgcccagtgtgcattactgtcaataccaccatctgtgccgggtattgtccaaccatgacccgcgtgctgcagggagtgctgcctgccctcccccaggtggtttgtaattacagggacgttagattcgagagcattcgcttgcccgggtgcccacggggcgtcaatcccgtggtatcctacgccgtagcactgtcctgtcaatgtgcattatgcaggcggtctacaactgattgtgggggccctaaagatcaccccctaacatgcgatgaccctaggttccaggattcatcaagcagtaaagcccctcctccttcactgcctagcccctccagactcccagggccttccgatacacctatcctgccacaatag

SEQ ID NO: 6403 - DNA, 699 bp, Artificial Sequence
  Description of Artificial Sequence: Synthetic coding sequence
atggtcctgcttttagtgattctgatccctgttttagtgtcttctgctgggacaagtgcacactatgaaatgctgggtacttgtcgcatggtgtgtgacccctacggcggtacaaaagccccttccactgccgctacaccagatcgtggcctgatgcagagtttgcccaccttcatacaaggtcctccaatgggcccccctggagaaaaaggagagccaggtagacagggactgccaggcccacctggagccccaggattgaatgctgcaggtgcgattagtgccgccacctactccacagtccctaaaattgccttttacgccggccttaagagacagcatgaggggtacgaggtacttaaatttgacgatgtggtgaccaacctgggaaatcattatgacccaaccactggaaagttcacatgttctatccccggcatttacttcttcacttatcacgtattgatgagaggaggtgacggcacttctatgtgggccgacctgtgtaaaaacaatcaggtgagagccagcgctattgcccaggatgcagatcaaaattacgattatgcctccaacagcgtcgtgcttcatctcgagccaggcgacgaagtatacattaagctggacggcggcaaggcccatggggggaataataacaagtactctaccttttccggcttcatcatctatgctgattag

SEQ ID NO: 6404 - DNA, 501 bp, Artificial Sequence
  Description of Artificial Sequence: Synthetic coding sequence
atggggcctgaggccttgagcagcctcctgctccttcttctcgtggccagtggggacgcagacatgaagggacatttcgacccagccaagtgtcggtacgccctaggtatgcaagatcgcactatcccggattctgacatctcagctagttcatcatggagcgattccacagcagctcgacattcacgcctggagtccagcgacggggatggagcttggtgtccggccggaagtgtttttccaaaggaagaagagtacctccaggtcgatctgcagcgactgcatctggtggccctcgtgggcacccaggggcggcacgcaggcgggctgggaaaggaattttcccgaagttacaggctgaggtactcaagggacggacggcgctggatgggctggaaagaccgctgggggcaggaagtcatttcaggcaacgaagaccccgagggggttgtcctgaaggatttagggcctcccatggtggcgcgcctggtccgcttttag

SEQ ID NO: 6405 - DNA, 627 bp, Artificial Sequence
  Description of Artificial Sequence: Synthetic coding sequence
atgattattaaacactttttcggaaccgtgctggtgttgctggcttcaacaactattttttccctggacttgaaactgattatattccagcagagacaggttaatcaagagtcattgaagcttctgaataagctgcagactcttagcattcagcagtgcctgcctcaccggaagaattttctgctcccacaaaaatccctgagtcctcagcagtatcaaaagggacacacactcgcaattttgcatgagatgctgcaacaaattttctccctgtttagggccaacatctctctcgacggctgggaagaaaaccacacggagaaatttctgatacagctgcaccaacaactcgaatacctggaagctttaatggggctcgaagcagaaaaattgagtggaactttggggagcgataacctgcgcctccaggttaaaatgtatttccgccgtatccacgattatctcgagaaccaggattatagcacttgtgcatgggctatcgtccaggtcgaaatctccaggtgcctgttcttcgtattcagtctaacggagaaactgtccaagcagggcaggcccctgaacgacatgaagcaagaacttactaccgaattccgatcccctagatag

SEQ ID NO: 6406 - DNA, 2241 bp, Artificial Sequence
  Description of Artificial Sequence: Synthetic coding sequence
atgccctttaggcataagcctggcagcgttttctctgtcgagggtgaaaacctcgatctggccatgtctaaggaagaagtagttgcaatgataggcgatggcccctgcgtggtcaaaacattaactcgtcatcatctgtattgtgagccgcccgtggagcagcccctgccccgacaccacgctctgagagaggcccccgacagcttaccggaattcaccgtgcagatgggtaacctcaggttttccctggggcatgtgcagtacgacggtgagtctccgggagcttttcctgttgccgcacaagtcggacttggcgtcggcacgagtctgctggctttgggcgtgataataattgtcctcatgtacagaaggaagtcgaagcaggctctgagggattataagaaggtacagatccaattggagaacttagagagttctgtgcgcgaccggtgcaagaaagagttcaccgatcttatgacagagatgactgatctcacctcagacctattaggctcaggaatcccgtttctcgattacaaagtatacgcggaaaggatcttcttccctggccaccgggagtctccattgcaccgcgatctaggcgtgccagaatctcgcagacctaccgtggaacagggactgggccagctgagcaaccttctcaactccaaacttttcttaacgaaattcatacatactctggagtcccaacgaacattctcagccagagatcgagcgtatgtggcaagcctgttgaccgtggcgctacatggaaaactggagtatttcacggatattctcagaaccctgctgtctgacctggtggcacagtacgttgcgaaaaaccccaaactaatgctccgcagaacagagaccgtggtggagaagttactgaccaactggatgagtatctgtctttatactttcgtaagagacagtgtgggggaacctttgtatatgctgtttcggggcatcaagcatcaagtggataaaggacctgtggacagcgttacggggaaagctaaatacaccctgaatgataatagacttctgcgtgaagacgtcgagtataggcctctgactttgaatgcgctgctggcagtgggaccgggcgcaggagaggcacagggcgtccccgtaaaggtcctggactgtgataccatctcccaggccaaagaaaaaatgctcgaccagctgtataagggcgtgcccttaacccagcgccctgaccctagaacactagacgtagagtggaggtctggagtggctggccatcttattctatccgatgaagatgtcacaagcgaggtccaagggctgtggcgccgcctgaatactctccagcattacaaggtccccgacggcgcaacagtagccttggttccttgcctcacaaagcatgtgctgagagagaatcaagactatgtgcctggagaacgtactccaatgctcgaggatgtcgacgaaggtggcattcggccctggcaccttgtcaagcccagcgacgaaccggagcctcctcggccccgaagaggcagcctccgtggtggcgagcgggagcgcgccaaggcaattcctgagatctacttaacccggctcctatccatgaaaggcacactgcagaagttcgtggacgacctttttcaagttatcctgtctacctcccgccccgtccctttagctgtaaagtatttcttcgatctcctcgacgaacaggcacagcagcacggcatctctgatcaggataccatacatatttggaagacaaactccttgccgctccgcttttggataaatattattaagaatccacagttcgtgtttgatgtccagacaagcgataatatggacgctgtgctgctcgttattgctcagacattcatggatgcatgcacactcgctgatcataaattggggcgggacagtcccatcaacaaactcctgtatgccagagatatcccccgctataaacgcatggtcgagagatactacgccgatattagacaaacagtaccagcctccgaccaggagatgaatagtgtgctagcggaactgtcatggaactactctggcgacctgggggcccgagtcgccctgcacgaactttacaagtatataaacaaatattacgatcagatcattactgcactggaggaggacggaaccgcccagaagatgcagcttgggtatagacttcagcagatcgctgccgcagttgagaataaggtcaccgacctctag

SEQ ID NO: 6407 - DNA, 603 bp, Artificial Sequence
  Description of Artificial Sequence: Synthetic coding sequence
atggcttggggtggggtccacacttgctgctttcacctttgctgttgttgctcttggccccagggagccgtcccagaagaactgcataagcacccgggccagaccctcctgctccagtgccagtactccccaaagcgaggcccataccagcccaaatcctggtgccaacagacatccccctcccgttgtactctcctagttacatctagcaagccatggactgccgttcagaagagtcactataccatctgggataagcctaacgccggattttttaacatcaccatgattcaactcactcagaacgactccggtttttactggtgtggtatctacaacgccagtgagaatataattaccgtccttagaaacatctctctggttgtctcccctgcccccacaacatctcccatgtggacccttccctggctgcctacttctacagtattgatcacatcaccggagggaacctctggccatcccagtatcaacggtagcgagacccgtaaatcgagagcacctgcttgtctgggatctgggggcccgcgtttcctcgtattggttctgtgcggccttctcctagccaagggcttgatgctttag

SEQ ID NO: 6408 - DNA, 114 bp, Artificial Sequence
  Description of Artificial Sequence: Synthetic coding sequence
atgggttggttaacacgcattgtctgcctgttctggggcgtactgctgaccgcgcgggccaattatcagaatgggaagaacaatgttcccagactcaagctgtcatacaaatag

SEQ ID NO: 6409 - DNA, 525 bp, Artificial Sequence
  Description of Artificial Sequence: Synthetic coding sequence
atgcgcttactggcctttctttctttgctggcgctggtgctccaggagacggggacagcaagcctccctcgaaaggagcgcaaacgccgtgaggagcaaatgccccgcgagggggacagtttcgaggtcctgccgctccgaaacgacgtccttaaccctgataattacggcgaggttattgatctgagcaattatgaggaactgaccgactatggagaccaactgccagaagtgaaggtgacaagtttggctcccgccaccagcatcagcccagccaaatccacgaccgccccagggacacccagctcaaacccgacaatgaccagacctacaaccgccggactgttactgtcctcacagcctaatcacgaagacatccctcctctgccgcgccggacagcgtatctttatgccagattcaaccgcatctctcggattagagctgaggacttcaagggtttaactaaactgaagcgcatagatctcagtaataatctgattagctccatcgacaatgatgcctag

SEQ ID NO: 6410 - DNA, 657 bp, Artificial Sequence
  Description of Artificial Sequence: Synthetic coding sequence
atggggcgggtcttccttactggcgaaaaggcgaatagtattctgaaacggtatcctagggcaaatgggtttttcgaggaaattcggcaggggaacatcgagcgggagtgcaaagaagaattttgtacattcgaggaggctcgtgaggccttcgaaaacaacgagaagactaaggagttctggagcacctatacgaaggcccagcagggggagtcgaatcgcgggtcagactggtttcagttttatctcacttttcccctaatttttggcctcttcattatattgctcgtaatattcctcatatggcgttgcttcctgcgaaacaaaactcggcggcagacggtgactgaaggccacatcccttttccacagcacctaaacatcataacgcccccccccccgcctgacgaggttttcgattcctcaggactgagccctggatttctgggctacgtggtgggcagaagcgattccgtgagcaccaggctatcaaactgtgaccctccccccacctacgaagaggctacagggcaggttaatctgcagcgaagtgaaacagaacctcatctggacccaccccctgaatatgaagatattgtcaactctaactcggcctcggcaatccccatggtgcccgtggtgactacaatcaaatag

SEQ ID NO: 6411 - DNA, 2535 bp, Artificial Sequence
  Description of Artificial Sequence: Synthetic coding sequence
atgggccctggagccccttttgcacgggtagggtggccattgcctctgctcgttgtgatggctgctggcgtggccccagtgtgggcatcccactctccccacttacctaggccgcatagccgggtgcctccccatccctctagtgagcggagggctgtgtatattggagcgttatttcccatgtccggtggttggcccggaggacaagcatgccagccggctgtggagatggccctggaggatgtgaacagcagaagagacatcctgccggattacgagctcaagctgatccaccacgactccaaatgtgatcccgggcaggctactaaatacctatatgagctcctgtataacgatccgatcaagatcatcctgatgcctggctgttcctcggtcagcaccctggttgctgaagctgcacgtatgtggaatctcattgtgctgagctacggcagttctagccccgctctgtcaaaccgccagagatttcccacattctttaggacacaccctagtgccacactccacaacccaaccagggtaaagctctttgagaagtggggctggaagaaaattgccaccatacagcagacaactgaggtgtttacatctacactcgacgacttggaagaacgggtcaaagaagcaggcatagagattacattcagacagtcattcttttcagatccggctgtgcccgtgaagaacttgaaaagacaagacgccagaatcatcgttggactgttttacgagacagaggctaggaaggtgttctgtgaggtgtacaaagaaaggctgtttggcaagaaatacgtgtggtttctaataggatggtacgcggataattggtttaagatctatgaccctagtataaattgtacggtggacgaaatgacagaggctgtcgaaggacacataacaaccgagatagttatgctgaatcctgccaacaccaggagcataagcaacatgactagccaagagtttgtagagaaattgactaagcggctgaaacgccatccagaagagacaggtggctttcaggaggcgccactggcatatgatgccatatgggcacttgctctggccttgaacaagacatccggcggcggggggaggtcaggagtacgacttgaggattttaactataacaaccagactataacagaccagatttacagggctatgaatagcagctctttcgagggtgtcagcgggcatgtcgtgttcgatgcttccgggagccgcatggcttggacactgatcgagcaattgcaggggggctcatataagaaaataggctattacgactctaccaaagacgatctcagttggagtaaaactgataaatggatcggcggcagcccccccgctgatcaaaccctggtcattaagacctttaggtttctttcccaaaaactgtttatctctgtatccgtgcttagcagcttgggcattgtgttggcagtcgtctgcctctcgttcaatatctataatagccacgtacgatacatccagaattcacaacctaatctgaacaatctcaccgcggtcgggtgctctcttgccttggccgccgtgtttcctctgggcctggatggctatcacatcggtagaaaccaattcccattcgtctgtcaggcgaggttatggctgctcggactgggcttttccttggggtacggcagtatgtttaccaagatctggtgggtgcatactgtttttacaaaaaaggaggaaaagaaggagtggcgtaagacccttgagccctggaagctttacgctacagtggggctcctggtggggatggacgtactgactcttgccatttggcaaatcgtggaccccctccatagaactatcgagacatttgctaaagaggagccaaaggaggacatcgacgtaagcattctgccgcagcttgaacactgctcatcgcgcaaaatgaacacttggctgggtatcttttatggatacaaaggcctcctgctgctattgggcatcttcctggcttatgagaccaagtccgtttccacggagaagattaacgaccaccgtgccgtgggaatggccatctataacgtagccgtgctgtgcttgatcacggcaccggtaaccatgattttgtccagccagcaggacgccgcgttcgctttcgcgtctcttgccatcgtattttcctcatatattacattagtagtgctgttcgttcctaagatgagacgcttgattacaaggggcgagtggcagtccgaggcccaagatactatgaagactgggagtagcaccaacaacaatgaagaagaaaagagccgactcttggagaaagagaaccgggagctggagaaaattatcgcagagaaggaggaacgggttagcgagctcaggcatcagttgcagagtagacaacagctgcgcagccgccgtcacccccctaccccccccgaaccttctggagggctgcctagaggccccccagagccccctgatcgactctcttgcgatgggtcaagggtccacctgctgtacaagtag

SEQ ID NO: 6412 - DNA, 2007 bp, Artificial Sequence
  Description of Artificial Sequence: Synthetic coding sequence
atggacctggtgctgaagaggtgtctgcttcatctggctgtcattggggccctgctagccgtgggcgccacaaaggtgccccgcaaccaggattggctcggggtgagccgccaattgcgtacgaaagcttggaacagacagctgtaccccgagtggacagaggcccagcgactagactgttggaggggggggcaggtttctcttaaggtgtctaacgatggacctaccttgatcggcgcaaacgctagcttctccattgctctcaatttccctggatcacagaaagtgctcccggatggtcaagttatttgggttaataacaccattatcaatggctcacaagtctgggggggccagcccgtgtatccacaggaaactgacgacgcttgtatctttcccgatggtggtccatgcccatcaggtagctggtcccagaagagatcgttcgtatatgtgtggaaaacttggggccagtactggcaggttctgggtggccctgtgtccggactcagcatagggacaggccgggctatgctcggcacacatacaatggaggtgacggtgtaccacagacggggctcgagaagctatgttccattggcccatagttcatccgctttcacaatcactgatcaggtgcccttcagcgtctccgtgtctcagttacgggccttagatggcggaaataagcactttcttcgcaaccaacctctgactttcgctctacagttacacgatccctcgggctacctggctgaagccgatctcagctatacctgggattttggcgattcctcaggaaccttgatctctagggccctggtggttacccacacgtacctggagcccggacctgtgacagcccaggtggttctgcaagctgctataccccttacaagctgtgggagttcaccagtgcctggtactacggacggacatcgccccaccgccgaggcacccaacaccaccgccggtcaggtcccaaccaccgaagtggtgggcacaaccccgggccaggcccccactgccgagccgtcaggcacaacttcggtccaggtgcctaccaccgaagttatttctactgcaccagtgcaaatgcccactgcagagtctactgggatgacacctgagaaggtgcccgtgtctgaagttatggggaccacactcgcagagatgagtacacctgaggctactggtatgactcctgccgaggtcagcatcgtggttctatccggaacgaccgcagcacaggtaactactaccgaatgggtagaaactacagctcgcgaattaccaatacctgagcccgagggacccgatgcttcatcaattatgagcaccgaatcgatcaccgggtcccttgggcccctcctagacggaacggctacactgcggctcgtgaagcggcaggttccactagattgcgtactgtatcgttatggcagcttctccgtgactcttgacatcgtccaaggtatcgagagcgccgaaattctgcaggcagtacctagcggagagggcgatgcattcgagcttacagttagctgccagggcgggctccctaaggaggcctgcatggagataagttcacctggctgtcagcctcctgctcagcggctctgccagcccgtgctcccctcccctgcctgccagctggtgttacaccagatcctcaagggtgggtctggtacatattgcctgaatgtgagtttggcagacaccaacagcttagccgtcgtcagcacacaactgatcatgccagtgccaggaatccttctcacaggacaggaggccgggttgggacaggtgccactgatcgtgggcattctgttggttctcatggctgtagtactggcatccctgatttacaggaggcgactgatgaagcaggatttttctgttccacaactgccccacagttcttcacactggctcagacttccaagaattttttgcagctgccctattggcgaaaactccccactactgtcgggccaacaagtgtag

SEQ ID NO: 6413 - DNA, 525 bp, Artificial Sequence
  Description of Artificial Sequence: Synthetic coding sequence
atggcggatatgcagaacctggtggaaagactggagagggctgttgggcgattggaggctgtctcgcacacctctgatatgcatcgcggctacgcagactccccgagcaaagcgggtgccgccccctacgtgcaggcatttgatagcctgctggctggacccgtggccgagtatctgaagatcagtaaagaaatcggcggggatgtccagaaacatgctgaaatggtgcacaccggcttgaagctggagagggctctgttagtgacagccagtcagtgtcagcagccagcagagaacaaactgtcagacctcttggccccaataagcgagcaaataaaggaggtgattaccttccgcgaaaaaaatagggggtccaaattgtttaatcacctcagtgctgtctccgaatcaatacaggctttggggtgggtggcgatggcaccgaagcctgggccctatgtgaaagaaatgaacgatgccgctatgttttatactaaccgcgttctgaaggagtacaaagactag

SEQ ID NO: 6414 - DNA, 1368 bp, Artificial Sequence
  Description of Artificial Sequence: Synthetic coding sequence
atgcttcaccccgaaactagtcccggaaggggacatctcttggcagttctcctggccctgctggggacagcttgggctgaggtgtggcctccgcagctgcaggaacaggcgccgatggcgggcgcactcaacaggaaagaatcctttctacttctgtcccttcataaccggctccggagttgggtacaacctccagctgccgacatgcgtcgccttgattggtccgattccctggcccagcttgcgcaggcccgggctgctctttgcggtactcccacacctagcctagcatcaggcctgtggcggacactgcaggtgggatggaacatgcagctgctacccgctggcctcgtctctttcgtcgaggtggttagtttgtggttcgcagaaggccagagatactcccatgccgcaggggagtgtgcgcggaatgcaacatgcacgcactacacacaactcgtttgggcaacaagctctcagctgggatgcggacgccacctgtgtagcgcaggccaggctgcgatagaggcctttgtgtgcgcttatagccctagagggaactgggaggtcaatggaaaaacaatcgttccctacaaaaagggcgcttggtgttctctgtgcactgccagcgtgtccgggtgttttaaagcctgggaccacgccgggggcctgtgcgaggtgcccaggaatccctgccggatgagctgtcagaaccatggacgcctcaacattagtacatgccactgccactgcccacccggctatacaggtagatactgtcaggtgcgttgttccctccagtgtgtgcacggcaggttcagggaggaagagtgttcctgtgtgtgcgatatcggatatggcggggcccagtgtgcaacaaaggtgcacttcccattccatacctgcgacctccggatcgatggcgattgctttatggtgtccagtgaagccgacacttactatagggcccggatgaagtgccaaagaaaggggggcgttctggcacagataaaatctcaaaaagtgcaagatatactggccttctatctcggccggttggagacaaccaacgaggtgattgacagtgacttcgagacccgcaatttttggattgggctgacgtataagaccgccaaagactcctttagatgggcgactggcgagcaccaggccttcacatcttttgctttcggccagccagacaatcacgggctggtttggctttcggccgccatgggtttcggcaattgcgtggagctccaagcctctgccgcatttaactggaacgaccaaagatgcaagaccagaaataggtacatctgtcagttcgcgcaagaacacatctctaggtggggcccaggctcgtag

SEQ ID NO: 6415 - DNA, 297 bp, Artificial Sequence
  Description of Artificial Sequence: Synthetic coding sequence
atggtgttggcgatgttgggggcattacacccccgagctggactctctttgttcctccatttgattttggccgtggcattgctgcggtctcagcccctgaggtctcaacggagcgttccagaagccttttccgcccctttagagctgtctcagcccctcagtggactggtcgacgactatggtattctgcccaagcacccacgcccccgtggcccacggcctttgctgtctagagcccaacaaagaaaacgggacgggcccgacctggcagagtactattacgacgcccacctgtag

SEQ ID NO: 6416 - DNA, 2742 bp, Artificial Sequence
  Description of Artificial Sequence: Synthetic coding sequence
atgggacctgaagcactctcctctctcttgttattactcctggtggcatctggggacgccgacatgaaaggccattttgatcccgccaaatgccgttacgccctcgggatgcaggatagaactatccctgattcagatatctcagcctccagctcctggtccgacagtacggcagctcggcatagcaggctggagtcttcagatggcgacggggcgtggtgcccagctgggtctgtgtttcctaaagaggaagaatacttacaggtggatttacaaagactgcatctcgtggcgcttgtggggactcagggcaggcacgctggcgggctagggaaggagttctcacgaagttatcgtctcagatacagccgcgacggcagaaggtggatgggctggaaggatcgctggggccaagaggtgatttccggaaatgaggacccggaaggcgtggtgctcaaggatcttgggcccccaatggtcgcaagattggtgcgcttttatcccagagccgatagagttatgtcagtctgccttagagtcgagctgtacggctgtctctggcgcgacggcctgttatcatataccgccccggtgggccagactatgtacctgagcgaagctgtttacctgaacgattctacctacgatggacatacagtggggggactacagtacggcggactgggccagctggccgacggggtcgtgggtttggacgattttcgtaagtctcaagagctgcgggtgtggcccgggtacgattacgtgggttggtctaatcattcttttagcagcggttatgttgagatggagttcgagttcgatcgcttacgggcgttccaggctatgcaagtgcactgcaacaatatgcacacattgggtgctaggcttcccggcggagtggagtgcaggtttcggaggggacccgccatggcctgggagggagagcctatgcgccacaatctgggtggaaacctgggcgatcccagagcaagggcggtgtctgtgcctctgggtggaagggtggctcggttcctccagtgccgttttctgttcgcagggccttggttactcttctccgaaatctccttcattagcgatgtcgtcaacaactcaagccccgctcttggagggacatttccacccgcaccctggtggccccccggacctcccccaacaaatttctcatcactcgagctcgagcccaggggccagcagcccgtggcaaaggccgaaggcagccccacggcaattctcattgggtgtctggtggctatcatcctccttctgctgttgatcatcgctctgatgctgtggcgactccactggaggagattgctgtccaaggcggagagaagggtactagaggaggaacttaccgtgcatctttccgtgccaggcgacactatactgatcaataaccgccccggaccacgggagcctcctccctatcaggagccacgacctcgcgggaatccacctcactctgctccttgcgttccaaatggctctgcccttctgttgagcaatcctgcctacaggcttctgctcgccacatacgctaggcctccccgtgggcctggcccccctacacccgcctgggcaaagccaaccaacactcaggcttattctggcgactacatggagcctgagaaacccggggcaccactgctcccaccacctccccagaatagcgtgcctcattacgccgaggcagacatcgtgaccctgcaaggagtcacgggagggaatacatatgcggtcccagccttaccccctggtgcggtcggcgacggtccacctcgagtcgattttcccagatctcgtctcagatttaaggaaaagctgggagagggacagttcggcgaagttcacttgtgcgaagtggacagccctcaggacttggtgtcccttgacttcccacttaacgtcagaaaagggcacccactcctggtcgcagttaaaatcctgcggccggacgccaccaaaaacgcccgaaacgatttcctgaaggaagtcaagataatgtccaggcttaaagatcccaatatcattaggcttctgggcgtatgcgtgcaggatgatccactgtgcatgatcactgactacatggaaaatggcgatctaaatcaatttctgtcagcacatcagctggaggacaaagccgccgaaggtgcacccggcgacgggcaggccgctcaagggcccacgatcagctaccctatgttgcttcatgtagctgcgcagatcgcctcgggaatgaggtacctggctactctaaactttgttcatagagacttagcaactcggaactgcctcgtgggcgaaaactttacaatcaagattgcggactttggcatgtctagaaacttatacgccggcgattactatcgagtacagggtcgtgccgtgctgccaataagatggatggcatgggaatgtattttgatggggaagtttacaactgcctccgacgtgtgggcttttggcgtgactctatgggaggtactgatgctctgtagagcccagccctttggacagctcactgacgagcaggtgatcgagaacgcaggggagttcttccgagaccagggccggcaagtgtatttaagtaggccacccgcctgccctcagggactgtacgaactgatgctgagatgctggagcagagaatccgaacagcgcccacccttcagtcagcttcaccgctttctggccgaagacgctctgaacactgtgtag

SEQ ID NO: 6417 - DNA, 678 bp, Artificial Sequence
  Description of Artificial Sequence: Synthetic coding sequence
tgagcagacttgcccagctgttggggtgccggcccgtgctacaccggccacaaagtcggagctctgaggcgagacaccgtgatctgttgttgtcgacacggggactacagtacaccctgtctctttacacccggaaagccatcacgcaatccctcaccgtggaagaggaccctatggacgctgtctgcaccatgggcggggcctgctggttggacaggcgaggaacagaacgcaaccaagacaggcctgatcacccgcaggccgcgccctttaagaagaagacctcatccagcccccgcctctccattgccggagatcattcgcgggaatattccccggatgctcgggaagtttgttccagtgaattgggagccaccccagccactccccttccctaaatatcttcggtgttaccgctgtctacttgagactaaggaactgggatgtctgctgggcagtgacatttgcttgacaccagctggctcttcctgcattacactccacaagaaaaactcctccggttccgatgtgatggtctccgactgtagatccaaagagcaaatgagtgattgttccaacacgcggacatcacctgttagcggattctggatattcagccaatattgtttcttggacttttgtaacgatcctcagaatcgtgggctctatacaccctag

SEQ ID NO: 6418 - DNA, 405 bp, Artificial Sequence
  Description of Artificial Sequence: Synthetic coding sequence
atgccacgatgtcgttggctttcccttattcttcttaccatccccttggctctggtggcaagaaaggatcccaaaaaaaatgagacaggggtgctccgcaagctcaagccggtgaacgctagtaacgccaacgtgaagcagtgtctctggtttgcgatgcaggagtacaataaggaatccgaggacaagtacgtgttcctcgtggtgaaaaccttgcaggcacagctgcaggtcactaaccttctggagtacctgatcgacgtggagatcgccagatcagattgccgtaaacccctgagcacaaatgagatttgtgcaattcaggaaaatagcaaattgaagcgtaagctgtcttgttccttcctcgtgggtgcattgccctggaatggtgagttcaccgtctag

SEQ ID NO: 6419 - DNA, 1182 bp, Artificial Sequence
  Description of Artificial Sequence: Synthetic coding sequence
atgcggaccctattcaacttgctctggctggcactcgcatgtagccctgtgcatacaactctgtcaaagtccgatgccaagaaggcagcctcaaaaaccctgctcgaaaaatcccagttctcagacaagccggtacaggatcggggcctagttgtgactgacttgaaggctgaatctgtggtgctcgagcatcggagctactgctccgctaaggcacgtgaccgccattttgctggagacgtcctaggatacgtcactccctggaattcacacggctatgacgtgaccaaagtgtttggtagtaagttcacccagatcagtcccgtctggctgcagctcaaacgacggggcagggaaatgttcgaggtgaccggcctgcatgacgtagaccagggttggatgagagctgtcagaaaacatgctaaagggctgcacattgtcccacgtctcttgttcgaggattggacctatgatgatttcagaaatgtgctagatagcgaagacgagattgaggagctgagcaagactgtggtccaagtggccaagaaccagcattttgatggttttgtcgtggaggtgtggaatcagctcctgtctcagaaaagagtcggactgatccacatgctgacccaccttgccgaggccctgcatcaagcccggttattggcactgttggtgattcctccagctattactcctgggacagaccagctggggatgtttacacataaggagttcgagcaacttgccccagtgttggacggcttcagtttaatgacctatgattattcaactgctcatcagcctggccctaatgcccccctcagctgggttagggcttgcgtccaggtcttggacccaaaaagcaaatggcggtcaaagattctcctggggctcaatttctacggaatggattacgccacaagcaaagatgcacgcgaaccggtcgttggcgcccgctatatccagacacttaaggatcatcgacctagaatggtgtgggattcacaggcgtctgagcattttttcgagtacaagaagtccagatctgggcggcacgttgtcttttaccccaccctcaagtctttacaagttagactggagctcgccagggaactaggggtgggcgttagtatctgggagctcggccaaggcctggactacttctatgaccttctgtag

SEQ ID NO: 6420 - DNA, 678 bp, Artificial Sequence
  Description of Artificial Sequence: Synthetic coding sequence
taagctgatctgccgtcttgttggggcgcaggtccatgttataccggtcacaaagtgggcgccctgaggcgtgacaccgtgatctgttgctgccgacatggtgattatagtacaccctgcttatttacacccggcaaaccaagtagaaatccttcgccctggaagcgaacactttggacattgagtgctccatgggccggacccgccgggtggacaggcgaggagcaaaatgccacgaaaacaggtcttatcactagaagacctaggcctctcagaagacgtcctcaccccgccccagccagtcctctcccagagatcattcgagggaacatccctaggatgctgggcaaattcgtgccagtgaactgggagcccccgcagccgctgcccttcccgaaatacctgcggtgctaccgatgcctgctggagactaaggagttgggatgtctgcttggctcggacatctgtctgacacccgcgggatcatcatgcatcacgctgcacaaaaagaactcttccggatcggacgtcatggtgagcgattgcaggtctaaggaacagatgtctgattgctcaaataccagaacatcccctgtttctggcttctggatcttttcgcagtactgctttctagacttttgcaatgacccccagaaccggggcctgtacaccccatag

SEQ ID NO: 6421 - DNA, 1410 bp, Artificial Sequence
  Description of Artificial Sequence: Synthetic coding sequence
atgatgagactcggagggcgactagttctgaacacaaaagaggaacttgccaacgaaagactgatgaccctgaagatcgctgagatgaaagaggccatgaggactctgatctttccgccttccatgcacttctttcaggccaaacatttgattgagagatcccaggtctttaatattttaagaatgatgccaaaaggtgccgcactccacctgcatgacattggcattgtgaccatggactggctagtgagaaatgttacttaccggccacactgccacatctgcttcaccccgcgcggtattatgcagttcaggtttgcccacccgacaccccggcccagtgagaagtgctcaaagtggattctcctggaagattaccggaaacgagttcagaacgtgaccgaatttgatgattcactgcttaggaattttacgctcgttactcaacatccagaagtgatttatactaaccagaatgtggtatggagcaagttcgagactatcttcttcactatatcgggtctgattcattatgcccctgtgttccgggactacgtcttccggagcatgcaggaattttatgaagacaacgtattgtacatggagattcgggctcgccttctgccagtgtatgagctgtcaggagagcatcatgacgaggagtggtccgtgaaaacctatcaagaagtcgctcagaaatttgtcgaaacgcaccccgagttcataggcatcaagataatctactccgaccaccgttccaaagacgtggctgtgatcgccgagtcaattaggatggcaatgggtctcagaataaaattcccaacggtggtcgcgggtttcgatctggtgggacacgaagacaccggccacagtctacacgactacaaagaggcgctcatgatccccgcaaaagacggggtgaagctgccttacttctttcatgcgggagaaacagattggcaggggacctctatcgatcggaatatactggacgcactaatgctgaacacgactcgcattggccacggatttgccctaagtaaacaccccgccgtacgaacttactcctggaaaaaggatattcccatcgaagtatgcccaatttccaatcaggtgctcaagttggtatcagatctgcgcaatcaccccgttgctacactgatggcaacgggccaccccatggtgatttcctcagacgatcctgccatgtttggcgcaaaggggctctcatatgatttttacgaggtgttcatggggataggcggtatgaaggccgacctgagaacgcttaaacagctggccatgaactcgatcaaatacagcactctgttggaaagtgagaaaaacacttttatggagatatggaagaaacggtgggacaaatttattgccgacgttgccacaaagtag

SEQ ID NO: 6422 - DNA, 1137 bp, Artificial Sequence
  Description of Artificial Sequence: Synthetic coding sequence
tagtatagtggcgactacatggaacctgagaaacctggcgcccctctcttgcctcctccccctcagaactccgtccctcattacgctgaggctgacattgtgaccctacaaggcgtgacgggcggaaatacatatgccgtgccagcccttccgcccggcgccgtgggagacgggcctcccagggtagacttcccccgatctcggctccgcttcaaagagaaactgggggagggacagttcggcgaagtgcacctgtgcgaagtggactcccctcaggacttggtctcactagatttccctctcaacgtcaggaaaggccatccactcctggtagcggtgaaaatccttcggcccgatgcaactaaaaatgcaagcttctcactgttcagccgaaacgactttttaaaggaggtgaaaatcatgagccgcctgaaagaccctaacataatcagactcctgggcgtatgcgttcaggacgaccccctgtgtatgatcaccgattatatggagaatggtgatctcaatcagtttctgtccgctcaccagctggaggataaggctgcggaaggggccccaggcgacggacaggcagcacaggggcctacaatctcgtatcctatgttgcttcacgtggctgctcagatcgcatctggaatgaggtacttggcaaccctgaattttgtgcaccgtgaccttgcgacacgtaactgtctcgtcggtgaaaattttactatcaagatagccgacttcggcatgtctagaaatctgtatgctggggactactaccgtgtgcaggggagagctgtgttgcctatcagatggatggcctgggaatgcatcctgatggggaagttcaccactgcgagcgatgtctgggctttcggagtgactctgtgggaggtgctcatgctttgccgggcacagccgttcggtcagttgaccgatgagcaggtgatcgaaaacgcaggggagttttttcgcgatcagggtcggcaggtgtatctgtcccgcccaccagcctgtccgcagggcctgtatgagctgatgctgagatgctggtctagggaatcagaacagcgccctccattcagtcagctgcatcggttcctggcagaagatgcgctgaacaccgtgtag

SEQ ID NO: 6423 - DNA, 678 bp, Artificial Sequence
  Description of Artificial Sequence: Synthetic coding sequence
tgagcggacctcccctcttgttggggagcggggccatgttacacaggccacaaggtgggagcccttagacgggacactgttatttgctgctgtcgccatggagactacagcactccttgcctgtttactccaggcaaaccttcgcgtaatcccagcccatggaagcgcactctctggaccctttccgccccctgggctggcccagccggctggacgggcgaggagcagaacgctacaaagacaggactgataactcggcggccccggccactaagacgcaggccacaccccgcccctgcaagccctctgcccgagattatccgggggaatatacctcgcatgttaggcaagtttgtcccagtcaactgggagcctcctcagccactaccatttccgaaatacctgcggtgttacaggtgcctgctagagactaaggagttgggatgccttctaggaagtgacatttgcctaacacccgctggctcctcatgtatcacactccataagaagaatagcagcggctccgatgtgatggtatccgactgcagatcaaaggagcaaatgtctgattgcagcaatactagaacttcccctgtgtcaggattctggatcttttcccagtactgcttcctggacttctgtaatgacccacagaacagagggctgtacaccccctag

SEQ ID NO: 6424 - DNA, 846 bp, Artificial Sequence
  Description of Artificial Sequence: Synthetic coding sequence
atgctgccaaagtctcgcagagccctcacaattcaggaaatcgccgcgctcgcacggagttcacttcatgggataagccaggtggtgaaggaccacgtaacaaaacctaccgccatggcacagggacgagtggcccatctgatagagtggaaaggttggagcaagccttctgacagccccgccgccctggaatctgccttttcttcctactcagacctatcagaaggggaacaggaggcccggttcgccgctggagtggcagagcaattcgcgattgccgaagccaagttgcgcgcctggtcctctgttgacggcgaggacagcactgatgattcttacgacgaggatttcgccggggggatggacactgatatggccggccagctccccctcggaccccaccttcaggatttgtttaccgggcatcgcttctctcgacctgtcagacagggcagtgtcgaaccagaatcagactgcagccagaccgtcagccccgatacactgtgcagtagcttgtgctctctcgaagatggccttttggggagcccggcacgtttggcctcccaactgctcggagatgaactcttgctcgctaaactgccaccctccagagagtctgcctttaggagtctcggaccactcgaagcgcaagactcactttacaattccccgctcaccgaatcgtgcttgagccccgccgaggaggagcctgccccttgcaaggattgccagccgttatgccctcctctcactggctcttgggaaagacagaggcaggcttcagacctagcttcatccggggtagtgtcacttgacgaggatgaggctgaacccgaagaacaatag

SEQ ID NO: 6425 - DNA, 1110 bp, Artificial Sequence
  Description of Artificial Sequence: Synthetic coding sequence
atgaagtttcagggccctctggcttgtctgctcctggctctttgtctggggtcaggtgaggccggaccgctgcaaagcggggaggagtccactggcactaacataggcgaagccctgggccacgggctaggggacgccctgagtgaaggcgtaggaaaggccattggcaaggaagctggtggggcagccggaagcaaagttagcgaagccctcggacagggcaccagggaggccgtgggaacaggagtaagacaggtcccagggttcggtgtggctgatgcgctgggcaatcgcgtgggcgaagctgcacacgccttgggaaacactggccacgaaattggtagacaagccgaggatgtcattaggcatggggccgatgccgtccggggatcatggcagggggtgcctgggcataatggtgcctgggagacatcgggtggccacggaatctttggctcccagggtgggttgggcggtcaaggacaggggaatcctggagggctcggtaccccctgggtgcatggctaccccggaaactccgccggcagtttcggtatgaacccacagggcgctccgtgggggcaaggagggaatgggggtcccccaaattttggcaccaacacccagggcgccgtggctcagccgggatatgggagtgtgagggcctccaatcagaacgaaggttgtacaaacccccccccaagcggctccggaggtggcagcagtaattccggagggggcagtgggagccaatcaggcagctctggttcaggctcaaacggtgataacaataacgggagctccagcggaggctcatcgagcgggagcagttccggagggagctctggcggcagttcaggaggatcttccggtaacagcgggggatctaggggcgattccggctctgaatcatcttgggggtcttccaccggtagcagtagcggcaatcatgggggttccgggggcggaaacgggcataagccaggcaattccgaaaccagcccgggaatgtttaatttcgatacattctggaaaaactttaagtcaaagctgggatttataaattgggacgctattaacaaggaccaacgctcctctcgaattccctag

SEQ ID NO: 6426 - DNA, 420 bp, Artificial Sequence
  Description of Artificial Sequence: Synthetic coding sequence
atgggcccagaagccttaagcagcctcctgctgctgctgctggtagccagtggcgatgccgatatgaagggccatttcgaccccgctaagtgtcgctatgccctagggatgcaggacaggacaattccagatagcgatatctccgcttcgtcttcttggagcgatagtaccgctgctaggcactcaagactagaaagcagcgacggggacggtgcctggtgccctgccgggtcagtttttcccaaggaggaggagtaccttcaggtcgacttacagcgcctccatctggtggccttagttggcacccaagggcggcacgctggtggactgggcaaggagttctctcgatcatataggttaaggtacagcagagacgggaggcggtggatgggttggaaggaccggtggggtcaggaatag

SEQ ID NO: 6427 - DNA, 516 bp, Artificial Sequence
  Description of Artificial Sequence: Synthetic coding sequence
atgagacataatctggggggcaatctaggggatccaagggcgcgggcagtgtcggtccccttagggggaagagtagcccgctttctacagtgcaggtttctgttcgcagggccttggctgctgttctccgagatttcatttatatccgatgtggtaaacaatagtagccccgctcttgggggtacatttcccccagcaccctggtggccccctggccctcctcctacgaattttagttccctggagctcgagccaagggggcagcagcctgttgccaaagcagaaggctcccccacagctatcctgattggttgcttagtggccatcatacttttactacttttgatcatcgccctgatgttgtggaggctgcactggcggcggctgctgtccaaagtcctggaatcgcaccctagaacccggtcccccggcctggtgggaatcaggcctacaccattgcccgtcagccccatggcacttgttcacctctgtgaggtcgactcaccccaagactag

SEQ ID NO: 6428 - DNA, 192 bp, Artificial Sequence
  Description of Artificial Sequence: Synthetic coding sequence
atgggacctgaggcactgtctagcctccttttgctgctgctggtggctagtggcgacgccgacatgaaaggtcacttcgatcccgcgaagtgtaggtacgcattgggcatgcaggaccggacgattcctgattcagacatctctgcctcatccagttggtctgattctacagctgcccgacattcccggtag

SEQ ID NO: 6429 - DNA, 1137 bp, Artificial Sequence
  Description of Artificial Sequence: Synthetic coding sequence
tgatacagtggcgattacatggaacccgagaagccgggggcacctctcctcccaccaccaccgcagaactctgttccacactatgctgaggccgatatagtaactctgcagggtgtgacaggcggcaatacatacgctgtcccagccctaccaccaggcgcagtgggtgacgggccacctcgcgtggactttcctagatccaggctgcgctttaaggagaaattgggagaaggtcagttcggggaagtgcacctttgtgaggtcgacagcccccaggacctcgtgagccttgattttccactcaatgttaggaaaggccatccgttgctggtcgctgtcaaaattctccgccccgacgcgaccaagaatgcttctttctcactatttagcaggaacgactttctgaaagaagtgaagatcatgagtagactgaaagatccaaacatcatccgtctcctcggcgtttgtgtccaggacgatcctctctgtatgattacagactatatggaaaacggagacctgaatcagtttctgtccgcccaccagctggaagataaggcagccgaaggggctcctggagatggacaggcagcacaggggccaacaattagctaccccatgctgctccacgtcgccgctcagattgcctccggcatgagatatctggcaactctaaactttgtccatagggaccttgccacccggaactgccttgtgggcgaaaactttactatcaagatagccgattttggtatgtccagaaacttgtacgcaggcgattactatagagtgcaggggagggctgtcctgcccattcgctggatggcctgggagtgcatcttgatgggcaagttcaccacagcctcagatgtgtgggctttcggcgtgactctctgggaggtgctaatgctgtgccgagcccaaccgtttgggcaactgaccgacgagcaagtaatagaaaacgccggagaattttttagggaccagggtcgtcaggtttacttgtcccggccccccgcctgccctcagggcctgtacgagctaatgctgcgctgctggtcccgcgagtccgagcagcgacctccatttagtcagttgcacaggttcctcgctgaggacgctttgaataccgtgtag

SEQ ID NO: 6430 - DNA, 2535 bp, Artificial Sequence
  Description of Artificial Sequence: Synthetic coding sequence
atgggccccggagccccgtttgcgagagtcggatggcccttgccgctgctggtcgtaatggcggctggagtcgcgccagtatgggcctcacattccccacatttgcctagaccccactcccgagtccctcctcaccctagttcagagagacgagcagtatatatcggggccttatttcctatgtctggtgggtggcctggcggccaggcctgtcagcctgcggtcgagatggctttagaggacgtgaacagtagacgagacatactgccggattacgagctcaagctgatacatcatgattcaaaatgtgacccggggcaggctactaagtatctgtatgaattactctataatgaccctatcaagatcattctgatgcccggatgtagcagtgtgagtaccctggtcgccgaagcagcacgcatgtggaatctgatcgtgctcagttatggcagctcttctcccgcactatctaaccgccaaagattccccacattttttcgcactcatccatccgcaacgctccataatccgaccagagtgaagctcttcgagaagtgggggtggaaaaaaatcgccacaattcagcagaccacggaggtgttcacctccacactggacgatcttgaggaaagggtgaaggaagccggtatcgagatcacctttcgccagagcttcttttcagaccccgcggtgccagtgaaaaatttgaagcggcaagacgccaggataatagtgggacttttttatgagacagaagctcggaaggtgttctgcgaggtctacaaggaacggctttttggcaaaaaatacgtttggttcctcataggctggtacgccgataactggttcaagatctacgatccctcaatcaattgcacagtagatgagatgaccgaggctgtggagggccatatcactacagaaattgtcatgctgaatccggcaaacactcgctctatcagcaacatgacaagtcaggaattcgtcgagaagctgacaaagaggctcaaacgacatcccgaagagaccggaggtttccaggaggcccccctggcttacgacgccatttgggcactggccctagcgctgaacaagacctctggcggcggtggtcggagtggcgtcagacttgaagacttcaattacaacaatcagacaattaccgatcagatctatagggccatgaacagcagttcattcgagggcgtttcaggtcacgtagtcttcgatgcctccgggtccaggatggcctggacattgatcgaacaattgcaaggaggaagctacaagaagatcgggtactatgacagcaccaaggacgacttgagctggagcaagacagacaagtggatcggcggcagtcctcctgccgaccagactctggttattaagacattcagattcctctcacagaaactgttcatttctgtatccgtcctgtcatctttgggaattgttctggccgtggtttgtctcagctttaatatatataattcacacgtgcggtacatccagaacagccagcctaatctcaataacctcacagctgtcgggtgttccttagccctggcagccgttttcccactagggttagatggatatcacattggacgtaaccagttccccttcgtctgtcaggctaggctttggctgctgggactggggttttccctggggtatgggtccatgtttaccaagatttggtgggtgcacacagtgtttacaaagaaagaagaaaagaaggagtggcggaaaacccttgaaccttggaaactttatgctacagtaggtctgctggtcggaatggatgtcctcacactcgctatttggcagatcgtggaccccttacaccgaacgatcgagacttttgccaaagaggagcctaaagaggatatcgatgtgtccattctgccacagctagaacattgttcatcccgcaagatgaacacctggctcggtatattctacggctataagggcctactcctgttacttggaatatttctggcttacgaaacaaaaagcgtgtcgacagaaaaaataaacgatcatcgggcagtggggatggcaatctacaacgtggcagtactgtgccttatcacagcaccggtaacaatgatcctgagcagccaacaggacgccgctttcgcttttgcaagtcttgcgattgtcttctcctcttatataactctggtcgtgttattcgtccctaagatgaggaggcttattacgcggggagagtggcagagtgaagcgcaggacaccatgaaaacagggtcatccaccaataacaatgaggaggagaaaagcagactcctggaaaaagagaatcgcgagctcgagaagatcatcgccgagaaggaagaacgagtctcagaactcagacaccagttgcaatctcggcaacaactgcgcagcagaaggcatcctcccactccgcctgagccttctggcggattaccacgaggtccccccgagcctcctgatcggctgtcatgcgatgggagtcgcgtacacctcctgtataaatag

SEQ ID NO: 6431 - DNA, 339 bp, Artificial Sequence
  Description of Artificial Sequence: Synthetic coding sequence
atgctgaccgccgccctggccccgggtgctgccaactcccctacgacaaatcccgtgattttaattgtcgataaagtgctggaaacccaagacttgaatggagacggattaatgaccccagctgagcttattaatttcccaggagtagccttacgcccctacccgccctacatcggtgtggggcctaactctaacatgtgcagcagatctgatctgcccgaggattctaacacactgtacccaggaagtcatctgtggcttcgccacgccctcaacagtaagggcaacctggatgcacggctcgacggcggcgagaaggctatgcagcctcagtggtag

SEQ ID NO: 6432 - DNA, 2676 bp, Artificial Sequence
  Description of Artificial Sequence: Synthetic coding sequence
atgctgcccactgaagtgccacaaagccacccgggcccatctgcgctgttgctgctgcaattgctgctgccccccacatccgctttctttcctaacatctggagcctgctggccgctccaggcagtataacacatcaggatctgaccgaggaggcagctctaaatgtgacactgcaattgttcttggagcaaccaccacccggcaggccccctctccgcttagaggatttcctcggccgtaccctgctggctgacgaccttttcgccgcctacttcggacccgggagttcaagacggtttagagcagctctgggggaggtgtctcgcgcaaacgccgcccaggattttttaccgacatcaaggaacgatcctgacctacattttgatgctgagcgcctgggccaggggcgggcgcgactagtgggtgcactgcgcgagaccgtcgttgcagctagggccttagaccacactctcgcaagacagagactgggagccgccttgcacgccctacaagatttctactcacatagcaactgggtggagctaggtgaacagcagccgcaccctcacctgctgtggcctcgccaggagctgcagaatttagcgcaggtggctgatcccacatgctccgattgtgaggagctgagctgtccacgcaactggctcggattcacgctactcacatctggttactttgggacccaccccccaaagccgcctggcaaatgttctcacggcggacatttcgatcgaagctcaagccagccacctcgcgggggaattaataaggattctacatcccccggcttttccccgcatcacatgctgcatttgcaagctgcaaaactggccctcctggctagcattcaggctttctcgctgctaaggtcacgcttgggcgatcgggacttttctagactgttagacatcacacccgcctcttccttgagcttcgtgctggatacaaccggtagcatgggcgaagaaattaacgctgccaaaatacaggccaggcatttagtggagcagcgtagagggtctcccatggaaccggtccattacgtgctggtgccctttcacgatcctgggtttgggcccgtgttcactacatccgaccctgactccttttggcagcagctaaatgagatccacgcgctcgggggaggcgacgagcctgagatgtgtctttctgctctgcagctggcactgctgcacacaccacccctcagcgatatatttgtgtttaccgatgcatcccctaaagacgcgtttctaactaatcaggttgaatctcttacccaagagagaaggtgcagagtcacttttctcgtcacggaggatacgagtagggtgcagggcagggcccgtcgggagatcctgtctccccttcgcttcgagccttacaaggctgtcgctttggccagtggtggcgaggtgattttcacaaaagaccagcatatccgggacgtggcagctatcgttggcgagtcgatggcagcgttggtgactttgcccctcgaccctcccgttgtggtgcccgggcagccactggtgttttccgtggatggcctattacagaagataacggttcgtattcacggggacattagctcattctggataaaaaacccagccggtgtgtctcagggccaagaagagggagggggccccctgggccatacgagaaggtttggccagttctggatggtgactatggatgacccgcctcagaccggaacatgggagatccaagttacagccgaagataccccaggcgtgcgtgtgcaggcccagacaagtttggatttcctgtttcatttcggcatcccaatggaggacgggccacatcccggtctttaccccctcactcagcccgtggccggtttacagactcagctgctggtcgaagtgacggggctcggaagcagagcaaacccaggggatccccagccccatttcagccacgtgatcctgcgcggagttcccgaaggagcggagcttgggcaggttcctctcgagccagtaggccctccggaacgtggcttgcttgcggctagcttatcaccaaccctgctgagcactccgcggcccttttcactcgagctcatcggacaggatgcagcgggcagacggctgcatagagccgccccccaaccttccaccgtggtgccagtgcttctggagctgtcggggccctccggattcttggccccgggcagcaaagtgcctctgtccctgcgtatcgcctccttttctggccctcaggacctagacctccgaacttttgttaatccatcattcagcctgacgtcaaacctgtcgcgggcgcacttagagctgaacgagtctgcttggggacgcttgtggttggaagtgcctgactcagctgcccccgacagtgttgtaatggttactgttaccgctgggggtagggaagctaacccagtgcctcctacacacgctttcctgaggctccttgtcagcgcacctgccccacaggatcgacacacaacgcccacaggaagctccgatccaatcttaacaaccgctaccccagccttttcaccgttcaccttggtgacccagggtagggcaggagccgggctggccgcagggagtccttggtggggcacagtgggtggcgttctgttactgttgggcctggcttcatggtag

SEQ ID NO: 6433 - DNA, 2742 bp, Artificial Sequence
  Description of Artificial Sequence: Synthetic coding sequence
atgggaccggaggccttatcatcactccttttgctgttattagtggcctcaggagatgccgatatgaaaggtcactttgatccagccaaatgccggtacgcgctgggcatgcaagaccggaccatcccagatagtgacatctccgctagttctagctggagcgatagtaccgccgcacggcactcccggctggaatctagtgacggagacggagcctggtgtcctgccggcagtgtattcccgaaggaggaagaatacctgcaggttgacctccagagactgcatctggttgctctggtcggaacacagggcagacatgccggcgggctgggcaaggagtttagtcgcagttataggctcaggtacagcagagacggtcgcagatggatgggatggaaagatcgctggggacaggaggtaatatccggaaacgaggaccctgagggagtggtcctgaaggacttgggcccccccatggtggccagactggtcaggttttacccacgggctgatagggtgatgagcgtgtgcctgcgtgtggagctgtacggttgtctatggcgcgatggactgctatcctacactgccccagtggggcagacaatgtaccttagtgaggctgtctatctgaatgatagtacatatgatggtcataccgtgggcgggttgcaatatggcggtttgggacagctggctgatggcgtagttggcctggacgactttagaaagagccaggagttgagagtgtggcctggatacgattacgtgggctggagcaatcacagtttctcatcgggttatgtcgagatggagtttgagtttgacagacttagagcttttcaggccatgcaggtgcattgtaataacatgcataccctaggggcccggctgcccggaggtgtcgagtgcagattccgtcgcggccccgcaatggcttgggaaggcgagcctatgcggcataaccttggcggcaacctcggagatcctcgggcccgcgctgtgagcgtacctctcggggggagagttgcaagattcctgcaatgccgattcctgttcgctggtccctggctactcttcagcgagatctcattcatatccgacgtagtaaataattcctctcccgcactcggaggcactttcccaccagctccctggtggcctcccggcccacctcccacgaacttcagcagcttagaacttgagccacgggggcagcagccagttgccaaagccgagggaagtccgaccgcaatcttgatcgggtgcctggtggccatcattctgctactgcttctcatcattgccctgatgctgtggagacttcattggagaaggctgctcagcaaagccgaacgccgggtgcttgaggaagaattgactgttcacctgtcagttcccggggatactatcttaattaataaccgccccggccccagggagccgcctccgtatcaggaacccagacccaggggtaaccccccacattctgccccatgcgtgccaaatgggtcagctcttctattgagcaatccggcatacagattgcttctggccacatacgcccgtcctcccagaggcccagggcctcctacccccgcatgggccaaacccaccaatacccaggcctactccggcgactatatggagccagagaaaccaggcgcccccctgcttccaccccctccacagaatagcgtgcctcattacgccgaagccgacattgtaactctgcagggggttactggtgggaatacctatgcagtccctgcgctccccccgggtgcagtcggtgacgggcctcctcgcgtcgactttccccgtagtcgactgcgctttaaagaaaagttgggggaaggacagttcggcgaagtgcatctgtgcgaggtcgacagcccacaagatctggtttccctagacttcccgcttaatgtgcggaagggtcatcccctgctggttgcagtgaaaatcctccgaccggacgcgaccaagaacgcccgaaatgacttcctgaaagaggtcaaaataatgtctcgtctgaaagacccgaatataattcgtctgttgggagtgtgcgtgcaagacgaccccttgtgcatgataaccgactatatggaaaacggggacttgaaccagtttctgagcgcccaccagctggaggataaagccgccgaaggcgcccctggtgacggccaggccgcacaggggccaaccatctcttaccccatgctgctccacgtagctgcccagatcgcctccggtatgaggtatctggcgacactgaactttgttcaccgagatctggccacccggaattgtcttgtcggcgaaaatttcaccatcaaaattgccgactttgggatgtctcggaatctgtacgctggagactactaccgggtgcaaggccgagctgtgctaccaatcaggtggatggcgtgggagtgcatactcatggggaagtttactactgctagcgatgtgtgggcattcggagtgactctgtgggaggtcctcatgctctgccgggcccagcctttcgggcagctcacggatgagcaagttatagaaaacgcaggagagttctttagggatcaggggcgtcaggtttacctctctaggcctccagcctgcccacagggcctgtatgagctgatgctgagatgctggagtcgagagtccgaacaacgccctccttttagtcagctgcacaggtttctggcagaagatgccctgaacaccgtgtag

SEQ ID NO: 6434 - DNA, 390 bp, Artificial Sequence
  Description of Artificial Sequence: Synthetic coding sequence
atggcggccggaagtgcaccaatgcagctccaccttcgggccactataaggatgaaggacgggctgtgtgtaccccgtaagtggatttaccatttaaccgaggggtcaaccgaccttaggacagagggtcggcctgacatgaagacagagctgttctcctcatcatgccctgggggcattatgctcaatgagaccggtcaagggtaccagcggttcctcttgtacaatcgcagccctcacccccccgaaaagtgtgtggaggagtttaagagtcttacatcatgtctggacagtaaagcctttttgctgacaccaaggaaccaaggaaaaggactcaagtcccataagacagggctcggcctaacaaaaagctcgggcgttaccggatag

SEQ ID NO: 6435 - DNA, 846 bp, Artificial Sequence
  Description of Artificial Sequence: Synthetic coding sequence
atgctgcccaagagtagacgggctctgacaatccaggaaatcgcagcactggcgagatctagcctccatggcatcagccaggtagtcaaagaccatgtgaccaagcccacagcaatggcccagggtcgcgtagcccacttgatagagtggaaagggtggtcaaagccctccgatagcccagctgcactcgaatcagctttctcctcatactcggatttaagcgaaggcgagcaagaggcccgcttcgcggcgggtgtagcggaacagtttgcaattgcagaggctaagctcagagcttggagctcagtagacggcgaggattccaccgatgatagctacgacgaggatttcgccggggggatggatactgacatggcaggacagctccccttgggaccacatctgcaggatctgtttacagggcaccgcttttcccgtcccgtgcggcagggcagcgttgagcctgagagcgattgctcacagacagtctcccccgataccctgtgctcctccctgtgcagcctggaagatggactcctgggctctccagcgcggctcgcaagccagctcctcggagacgaacttctgttggctaaactgccccctagcagagaaagcgctttccgaagtctgggacccttggaagcccaggatagcttgtacaattctcctctgaccgaatcatgtctgagtccagcggaagaggaaccagctccatgtaaggactgtcagcctttgtgccctccactgactgggtcttgggaacggcagagacaggcctcagacttggcttcttctggtgtggtgtcgctggatgaagacgaagcagagccagaggagcagtag

SEQ ID NO: 6436 - DNA, 444 bp, Artificial Sequence
  Description of Artificial Sequence: Synthetic coding sequence
atgggcccagaagctctctcaagtctgctccttttactcttggttgcaagcggtgatgccgacatgaagggccacttcgatcccgctaaatgccgctacgcactgggcatgcaggataggaccatacccgattcagacatttctgcaagtagctcctggtctgacagcactgcagcccgtcattcccgcctggagagctccgacggcgatggtgcttggtgccctgcaggctcagtctttccgaaagaagaggaatacctgcaggtggacctccagagactccatctggtggcactggtcggtacccagggacgacacgctggcggtctgggtaaggagttctcgaggtcgtacaggctgaggtattctagagacggcaggagatggatgggttggaaggaccgatggggccaggaggttatttctggtaatgaggatccgtag

SEQ ID NO: 6437 - DNA, 2631 bp, Artificial Sequence
  Description of Artificial Sequence: Synthetic coding sequence
atgggcccagaggccctgtcatctctgctgctgctcctgttggtagctagcggagatgccgacatgaaaggacacttcgaccctgccaagtgcaggtatgcgctgggtatgcaggatcgcactatccccgattcagacatatcagcctcctcgagctggagtgattccacagcggcacgtcattcacgcttggaatccagcgacggtgatggtgcctggtgtccggccggtagtgtcttccccaaggaggaggaatacctgcaggtggacctgcagaggttgcatctcgtcgcactggttggcacccaggggagacacgccgggggactcggcaaggaatttagtaggtcctaccgactgcgctattcccgggacgggaggaggtggatggggtggaaagatcgctggggacaggaagtcatatccggcaatgaggatcccgagggcgtcgtgctgaaggatcttggtcctcctatggtcgccaggctggtaaggttctaccctcgagctgatagggttatgtccgtgtgcctgcgcgtcgagttatatgggtgcctgtggagagatggcttgttatcgtacactgcccccgtcggccagacgatgtatctctcagaagcggtctacctgaatgattctacgtatgatgggcacaccgtgggcgggttgcagtacggaggcctgggccagcttgccgacggggttgtggggctggatgactttcgcaagtctcaggagttacgggtatggccaggctatgactatgtggggtggagcaatcactcctttagctccggctatgtggaaatggagttcgagtttgaccggctaagggcttttcaggccatgcaggtgcattgcaacaacatgcataccctgggggctcggctgcccgggggcgtggaatgcaggtttcgtcggggtccagctatggcctgggagggagaaccaatgcgtcacaacttaggaggtaatcttggagatccgcgggcccgagcggtctccgtcccactgggtgggcgcgtagccagatttctgcagtgccgctttcttttcgctggtccctggcttctgttttcagagatcagcttcatctcagatgtggtaaataactcaagtccagccttggggggaacattcccccccgccccatggtggccaccgggaccaccccccacgaacttctcgtcactggaactcgagccgcggggccagcagccagtcgctaaagccgagggaagcccgacagccatcttaatcggctgtttggtggccatcatcctgcttctgttgttaatcattgccctgatgctctggcgactccattggcgccgccttctgagcaaggctgagcgcagggtgttggaggaggagttaactgtgcacctgtctgtcccaggggacactatcctgattaataatcgcccaggtccaagagaaccacctccctatcaggaacccagaccccgcggtaaccccccccatagtgccccgtgcgtgcctaatggttctgcctactctggcgactatatggaacctgaaaaacccggcgccccactcttgccaccgccaccccaaaactccgtaccgcattatgctgaggctgatatcgtcaccctgcagggcgtcactgggggcaatacctacgctgtgcctgccctgccacccggcgccgtgggggacggcccccctcgagtggattttccgcgctcacggctgaggttcaaggaaaaattaggagaggggcagtttggagaggtgcacctttgcgaggtagattctccgcaggacttggtctctctggatttccccctcaacgtgcgcaaggggcatcccctgctggtagcagttaaaatactgaggcctgatgcaactaaaaacgctcgtaacgatttcctcaaagaagtcaagatcatgagcagactcaaggatcctaatatcattcggctgctgggcgtgtgcgtacaggacgaccccttatgtatgataaccgactatatggagaatggcgatttgaatcaattcctaagtgcacatcagcttgaagacaaagcggccgaaggcgcgcctggagacggtcaagccgcacagggacctaccatatcatatcccatgttactgcatgtagccgcccagatcgcttcaggcatgagatacctggcgaccctcaacttcgttcacagagatctagccaccagaaactgcctggtgggcgagaatttcactataaagattgctgatttcgggatgagcagaaatctctacgctggagactactatcgggttcaggggcgcgctgtgctgcctatcagatggatggcctgggaatgtatcctgatgggaaaattcaccacagcttcagatgtctgggcattcggggtgacactttgggaagttctgatgttgtgcagggcgcaacctttcggacaactgaccgacgaacaggttatagaaaacgccggcgaattcttcagggatcaaggtcggcaagtctatctgagccggcctccagcctgtccccagggcttgtacgaactcatgctcaggtgctggagtagggaaagcgaacaacgaccgcctttcagtcagttgcaccgtttcctggccgaagatgctctgaatacagtttag

SEQ ID NO: 6438 - DNA, 1749 bp, Artificial Sequence
  Description of Artificial Sequence: Synthetic coding sequence
atggacttcctactggcactggttctggtttcttctttatacctgcaagctgcagcagaatttgacggaagatggccgcggcaaatagtgtcaagtattggactgtgcagatacggtgggagaatcgattgctgctggggatgggccagacagagttggggtcaatgtcagcccttttatgtgctccggcagagaattgctagaatcagatgtcagctcaaggccgtgtgtcagccaaggtgtaagcacggagagtgtatagggcccaataaatgtaaatgccaccctggctacgcggggaagacttgtaaccaagatttaaatgagtgtggtttgaagccaaggccttgtaagcaccgctgtatgaacacgtacggctcttataaatgctactgtttgaatggctacatgctgatgcccgacggctcatgttcttctgccctcacttgctctatggcgaactgccaatacggttgtgatgtggtgaaagggcagataagatgccagtgcccaagtcccggcctccaacttgcccctgatggacgaacatgcgtcgacgtggatgagtgcgcgacaggcagagccagctgtccacggttccggcaatgtgttaacaccttcggtagctacatatgcaagtgtcataaaggattcgatctcatgtacattggaggaaaatatcagtgtcacgacatcgatgaatgctcacttggtcagtaccaatgcagttctttcgcacggtgttacaatatccgtggatcttacaaatgtaagtgcaaagagggctaccagggggatggattaacttgcgtctatatcccaaaggtcatgatcgagccatctggccccatccatgtgccgaaggggaatggaactattctaaaaggggacacaggcaacaataattggattccagatgttggttccacatggtggccacccaagaccccttacattccccctattatcacgaatcggccgacatccaagcctacaacccgcccaaccccaaaacccacaccaattccgactccacctccccctcctcccctcccaactgagctgagaaccccactgccacctaccacacctgagaggcccacaacaggcctgacaactatcgccccggctgcatctactccccctggaggaatcacagtggacaatcgggtgcagacagatcctcaaaaacctaggggcgatgtgttcattccccggcagccttccaacgatttgttcgagatcttcgaaatcgagcgcggggtgtcagctgacgatgaggcgaaggacgaccctggcgtcctcgttcattcatgtaatttcgatcacgggctttgtggctggattagggagaaggacaatgacctgcattgggagcctatacgcgaccctgcaggcggccagtatctcacagtcagcgcagcaaaggccccggggggcaaggctgccaggctggttttacccctgggcagattgatgcatagcggggatttgtgtttgtccttcaggcataaggttacaggtctgcattctggtacactccaggtctttgtgcggaaacatggggcccatggtgccgctctctgggggcgcaacggcggtcatggttggagacagactcagattactctccgcggcgccgatataaagtcagtcgtatttaaaggcgaaaaacgtcggggacataccggcgagatcgggctggacgacgtctccctgaagaaaggtcactgttccgaggagagatag

SEQ ID NO: 6439 - DNA, 1602 bp, Artificial Sequence
  Description of Artificial Sequence: Synthetic coding sequence
atgggctctagtcgactggccgctctcctattgccccttcttctgattgtgattgaccttagcgactctgcagggatcgggttccgacacttacctcattggaataccaggtgtcccctcgcgtctcacacagatgattcgttcaccggctccagtgcctatatcccttgcaggacttggtgggccctgttttctacaaagccctggtgcgtgcgtgtgtggcactgctcccgctgtctctgtcaacacctcctgtcaggaggttccggcttacagaggggtctttttcaccttctggtccagaagtcgaaaaagtcttccacatttaagttctaccggagacacaagatgccagcacccgcccaaaggaaactgctgcccaggcgccacctgtcagagaaaagccatcacatctccatcccgtctcccgacataagtcataaaggcttacggagtaaacgcacccagccttccgaccctgagacatgggagtccctgccacggctggactcacagcggcatggtggacccgagttctcttttgacctgttgcccgaggcaagggccatcagagtgaccattagcagcgggccagaggtgtcagtacgtctgtgccaccagtgggcactggagtgcgaggaactgtcaagcccatacgatgtgcagaaaattgttagcggggggcatactgtagagttgccctacgagttccttctcccatgcctttgcattgaagcttcttatctgcaggaagacactgtgcgccggaaaaagtgcccctttcagtcgtggcctgaagcctatggctcagacttctggaagtcagtacacttcaccgactattcacaacatacccaaatggtcatggccctaactcttcgctgcccactgaagctggaagccgcgctttgccagcgtcatgattggcatactctgtgtaaagatctcccgaacgctaccgcacgggagagcgacgggtggtatgtgttagaaaaggtggacctccacccacagctgtgcttcaaattctctttcgggaacagtagtcacgtcgagtgtccccatcagactggatcattgacaagttggaatgtcagcatggacacacaggcacagcagctaatcctgcatttcagtagcagaatgcatgccacatttagcgcagcttggagccttcccggtctgggccaagatactctggtgcctccggtatacacagtgagtcaggcccgcggctcatcccccgtatccttagaccttatcatcccatttctgaggcctggttgctgtgtcttgctccatgctagcttgagctcacccggcggcgaagatgcgtggttgataggtgttggaggttccgtgccctccggggtggctgtcagatgtcccgtttgcctcgaggcccctctagtctccgggtgcttactacagaccccaggtgccctggaccctgggaccgcagggccaccacatccaaccgggtgttgttcaggcccccacttacctgcccccaccgtcagacctgggccttctgccgcaagcgcccctccagccaggggaggtctgggcggcgccgcagcgcccggcggtagtgcgggttag

SEQ ID NO: 6440 - DNA, 1293 bp, Artificial Sequence
  Description of Artificial Sequence: Synthetic coding sequence
atgggcgtaagcaagttagacatactgtaccggcgactgctgctgacgaaactcttcatccgcgggtggggccgtcccgaggacctgaagcgcttatttgagttccgaaagatgattggcaaccgggagcggtgtcagaatcttgtgagtagcgactatcctgtgcacatcgacaagatcgaagaacagtctgactgcaaaatcctggatggtcacttcgtgtcgccgatggcccactatgtccctgatataatgcctatagaatcagtcatcgcgcggttccagtttatcgtaccaaaagaatggaatagtaaataccggcccgtgtgtatccatctggcaggcacaggagaccaccactattggcggagacggacactgatggctcgtccaatgattaaagaggccaggatggccagcctccttcttgaaaacccctattacggctgtcgtaagcctaaagaccaggtgaggtccagcctcaagaatgtgtctgatctgttcgtcatgggcggcgcgttagtgcttgaatctgcagcacttttacactggttggaacgggaaggctacggcccactgggtatgaccggtatcagtatgggtgggcatatggccagcctggccgtctccaattggcccaaaccaatgcctttgatcccatgtttgagctggtcgactgctagcggcgtgttcacaacaacagacagctttaagatgggccaggagttcgttaagcatttcacctccagtgccgataagctcacaaaccttaacctggtgtcaaggactctgaacttggatatatcaaaccaggtagtttcacaaaagcctgcagactgtcacaactccagcaaaacctccgtatcagcgacttcagagggcctcctgttacaggacaccagtaagatgaaaagattcaaccagaccttatctactaataaatcaggctacacctcccgcaacccgcagtcataccacctgctgtctaaagaacaatcccgcaactctttaaggaaagagtcactgatatttatgaagggagtgatggacgaatgcacacatgtcgctaacttctccgttccagtggacccttcactgattattgtggtgcaggctaaagaggacgcatatatcccacgaacgggcgtgagatcgcttcaggagatctggccggggtgtgaaataaggtacctggaaggcggccacatttccgcatatctgtttaaacagggcctctttcgtcaagccatctacgatgcatttgaccgctttttgcacaagtacgcaaactag

SEQ ID NO: 6441 - DNA, 2631 bp, Artificial Sequence
  Description of Artificial Sequence: Synthetic coding sequence
atgggtcctgaggcactgagtagcttactactattgttgctggtggcttcaggggacgcagacatgaagggacactttgaccccgccaagtgccgttacgccctcggcatgcaggatcggacaattccggacagcgatatcagcgcttccagttcatggtcagactcaacagccgcacgccattccagactcgaaagtagtgatggtgatggggcatggtgcccagccggcagcgtgttcccaaaagaagaagagtatttgcaagtcgacctgcagcgcctgcacctcgtcgccctcgtggggacacagggccggcatgcagggggcctcggcaaggaattttcccgctcatataggctgaggtactcacgggacggacgcagatggatggggtggaaggataggtggggccaggaggtgatctctgggaatgaagatcccgaaggcgtcgtcctgaaggacctaggaccacccatggttgcccgcctggttagattttatcctcgggcagatcgggtgatgagtgtctgtctgcgcgttgaactgtacggctgtttgtggagggatggactcctctcttataccgcccccgtaggacagacgatgtatctgtctgaggccgtgtacctaaacgactccacttacgatggacacactgtaggcggcttgcaatacggcggacttgggcaacttgccgatggcgtggtggggttagatgatttcagaaaatcccaggagctccgcgtttggcccggttacgactacgtcgggtggagtaatcattctttttcaagcggttatgtggaaatggagtttgaatttgaccggcttagggccttccaagctatgcaagttcactgtaataacatgcacaccctcggagctaggctgcccgggggagtggaatgccgtttccgccgtgggccagcgatggcatgggaaggagagcccatgaggcataacttgggcgggaatctcggtgaccccagggctcgagccgtcagtgtccccctcggaggccgtgtggcccggttcctccagtgccgattcttgtttgctggaccatggctgctattttctgaaatctccttcatttccgatgtcgttaataattcctcacctgcactaggcggtacatttccaccagccccgtggtggcccccgggccccccaccaaccaacttcagttccctggagctcgaacctagaggccagcagcccgtggcgaaggccgaggggagccctaccgccattctaattggatgcttagttgccattatcctgctgctcctcttgatcatcgccctgatgctttggcggctgcactggagacggctactcagcaaagctgagcgtcgtgtcctggaggaagaactgacggtgcatttaagcgtcccgggggacacgatcctaataaataatagaccaggcccacgagagcctcccccatatcaggagccccggccacgaggcaatccacctcattctgcaccctgcgtgcctaacggctccgcctatagcggtgactatatggaacccgagaaaccaggagctccactcttgcccccccccccccaaaatagcgttccccactacgctgaagccgacatcgtcaccctgcagggagtcacgggcggaaatacttatgccgtgccggcgctgcccccaggagctgtgggcgacgggccccctagggtcgacttcccccggagccggttgaggttcaaggaaaagctaggggaaggccagtttggagaagtgcatttgtgtgaggtggactcccctcaggaccttgtatctcttgacttccctctgaatgtacggaaggggcatcccctgttagtagccgttaaaattctgagaccagacgccactaaaaacgcccggaatgattttctgaaagaagtcaaaattatgtcacggctgaaggacccaaatatcatcagacttttaggagtgtgcgtccaggacgacccactctgtatgattactgactacatggaaaacggtgatttgaaccagttcctgtccgcccatcagctcgaggacaaagcagctgagggcgcacccggagacgggcaggcagcgcagggacccacaattagctaccccatgctgcttcatgttgccgcacaaatcgcctctggtatgaggtacttggcaacactgaacttcgtccaccgcgatctcgccacgcgaaattgcttggtgggggaaaatttcactatcaaaattgctgacttcggtatgagccgcaacctctacgccggagactactaccgggtccaaggacgagcagttctgccaatacggtggatggcttgggagtgtatcttaatgggtaagtttactacagcgtctgatgtctgggcgttcggcgtcaccctatgggaggtgttgatgctttgcagagcgcagcctttcggccagctgacggacgagcaagttatcgagaatgcaggggagttttttagagatcagggccggcaggtctacctgtcgcgcccacctgcatgtccccaaggactatatgaactgatgcttaggtgctggagtcgggaatcagaacagaggcctcctttcagtcagttacatagattcttggctgaggacgccctgaacacagtctag

SEQ ID NO: 6442 - DNA, 237 bp, Artificial Sequence
  Description of Artificial Sequence: Synthetic coding sequence
atggggtccggtttacctctggtattgctgctaactctcctggggtccagtcacggaaccgggccgggcatgacactccagcttaaactcaaagagagcttccttactaattctagctacgagtctagcttcctggagttgctggagaaactctgtctgcttctccatctcccctccggaacctccgtgacactccaccatgctcgctctcagcatcacgtcgtctgcaacacttag

SEQ ID NO: 6443 - DNA, 2631 bp, Artificial Sequence
  Description of Artificial Sequence: Synthetic coding sequence
atgggtcctgaagccctgagtagtttgctgctgctgctgctggtggcaagcggcgacgctgatatgaaaggacactttgatccagccaaatgtcggtacgctctgggtatgcaggaccgaaccattcccgatagcgacatttccgccagttcatcgtggtcagattccacggctgccagacactcgagactggagtcatccgatggcgatggggcctggtgtcccgcgggttctgtgttcccaaaagaagaggagtacctgcaggttgatctccagcgactgcacctggtggccctggtcggtactcagggcaggcatgctggaggactgggcaaagagttcagcaggagctatcgccttagatatagtcgggacggaagaagatggatggggtggaaagacagatgggggcaggaggtaattagcgggaatgaagatccagagggagtagttctcaaagatctcgggccgcccatggtcgcccgcttggtcaggttttacccccgcgccgacagagtgatgtccgtatgtctgcgggtagaactgtacggatgcttatggcgcgatggactcctgtcgtacacggctccagtcggccagaccatgtatttatctgaggcggtctacttaaacgacagcacctacgacggccatacagtcggaggccttcagtacggaggcctcggtcagctcgcggacggagttgtaggtctggatgactttaggaaaagtcaggaactcagggtgtggcctggctatgattacgtcgggtggagcaatcatagtttttctagcggctatgtggagatggagttcgaattcgatcgtctgcgagcgttccaagccatgcaggtccattgcaacaacatgcataccctgggggccaggctgcctggcggcgtggagtgtagattcagacggggaccggctatggcgtgggagggtgaaccaatgaggcacaacctcggtgggaatctgggggacccaagggcacgggccgttagcgtgccattgggaggaagggtagcccggtttctgcaatgcagatttctgtttgccggcccttggctgttattcagcgaaatctcttttatcagcgacgtggtgaataactcgtcaccggcactgggcggaacattccctcccgcaccgtggtggccgccgggacctcctccgaccaacttttcatctttagaactggaacctcgtggacaacaacccgtcgcaaaggccgagggttctccaacagcaatacttattggctgtttggtcgccattatcttgcttctgctcttaatcatcgcactcatgctctggcggctgcattggcggaggctcctgtccaaagctgagcgccgggtgctcgaagaagagcttacagtgcatctgtccgtacctggcgacactatccttatcaataataggccgggaccacgggaaccgcctccctaccaggagccccgtcccaggggcaacccaccacactccgcaccgtgtgtacctaatggaagtgcttactccggtgactatatggagccagaaaaacccggtgcgcccttgcttcctccaccgcctcagaactcagtgccccattacgcagaggccgacatagtcacactccaaggtgtcaccggcgggaacacttacgccgtccccgccctccctcccggcgccgtgggcgacggccctccgcgcgtggactttccccgtagccgccttcggttcaaagagaagctaggcgaaggccagtttggggaggtgcacctgtgtgaggtcgacagtccgcaggacctggtgagccttgactttcctctgaacgtccgcaaaggccacccgctgctcgttgccgtcaaaattcttcggccggacgctactaaaaacgctaggaacgacttcctgaaagaagtcaaaatcatgagtcgcttaaaggacccaaacatcatcagactgctaggcgtgtgcgttcaggacgatccactctgcatgattactgactatatggagaatggagacctgaatcagttcctgtctgcccaccaactggaagataaagccgctgagggggcccccggagacggacaggccgcacagggccccaccataagctaccctatgcttctgcacgtagccgcccaaatcgcaagtgggatgagatacctcgccacccttaacttcgtccacagagatttggccacacgtaattgcttagttggcgaaaacttcactattaagatcgcggactttggcatgtctaggaacctgtatgctggcgattattatagggtgcagggcagagctgttttgccaatacgatggatggcatgggaatgcatactaatgggtaaatttactacagctagtgacgtctgggctttcggtgtcaccctttgggaggtcctgatgctttgtcgggctcagcctttcgggcagctgaccgacgagcaggtgattgagaatgccggcgagttttttcgtgatcaaggtaggcaagtatacctgtctcgccccccagcctgccctcaggggctctatgagctgatgctgcgatgttggagccgggaatccgaacagagaccgcccttctcccagctacatcgcttccttgctgaagatgctcttaacaccgtgtag

SEQ ID NO: 6444 - DNA, 1257 bp, Artificial Sequence
  Description of Artificial Sequence: Synthetic coding sequence
atgaggacattattcaacctcctgtggctggctctggcttgcagccctgtgcatactaccttaagcaaaagcgacgctaagaaagcggcatctaaaactctcctggaaaaggtcaaattttgctcctgttgccccggatggagtgccatggctcggagctggcttaccgccacttccgccacccagagccagtttagcgataagcctgtgcaggacagagggctcgttgtgactgacctgaaggccgagtccgtcgtgctggagcataggagttactgctcggccaaggcccgtgatcggcactttgccggtgatgtgctgggatatgtgaccccctggaacagtcacggctacgacgtcactaaggtctttggatccaagttcacccagattagcccagtgtggcttcagctcaagcggaggggccgggaaatgttcgaggttacaggcctccatgatgttgaccaaggctggatgcgcgccgtgcggaaacacgccaaagggcttcatatcgtgcctcgcctgctctttgaagactggacctacgatgattttcgcaatgttctcgattccgaagacgaaatagaagagctctctaaaacagtggtgcaggtggccaagaatcagcactttgacgggttcgtggttgaggtatggaatcagctgctgtcccaaaagagggtaggcctgatccacatgctgactcaccttgccgaggccctgcatcaggctaggctgttggccttgctcgtcataccgcccgctattactcccgggactgatcagctcggaatgtttacccacaaggaatttgagcaattagccccagtactagacggcttctccctgatgacttacgattacagcacggcccaccagcccggccctaacgctcctctctcttgggtgagagcgtgcgtgcaggtgctcgacccaaagagcaagtggaggagcaagattttgctgggactcaacttctacggcatggattacgctaccagtaaagacgccagagagccagtggtcggagctcggtatatccaaaccctgaaggaccatagacccagaatggtctgggacagccaagctagtgaacactttttcgagtataaaaaatccaggtcagggcgacatgttgtcttctacccgacattgaaaagcctgcaggtgcggctggagctggccagggaattgggggtgggcgtgagcatctgggagttgggccaaggcctcgactatttctacgatcttctgtag

SEQ ID NO: 6445 - DNA, 390 bp, Artificial Sequence
  Description of Artificial Sequence: Synthetic coding sequence
atgcgcaagccacgcagaaagtcgaggcaaaatgcagaaggaagaaggagtccaagcccttacagtctcaagtgcagcccaacaagggagactctaacctatgcccaagctcagcgcatagtcgaggtcgatatcgatggccgactgcacagaatctctatttatgatcccctgaaaatcatcacagaagacgagctgaccgcccaggacattacagaatgtaactcaaacaaagagaactcagaacagccccaattccctgggaaatctaagaagccctcctctaaaggtaagaaaaaggaatcctgctcaaaacacgcttctggcacgagttttcacttgcctcaaccttccttcaggatggtcgacagcggaatccaacctgagtag

SEQ ID NO: 6446 - DNA, 315 bp, Artificial Sequence
  Description of Artificial Sequence: Synthetic coding sequence
atgcgcgtggttacaattgtcatcttgctgtgtttttgcaaagccgcagagctcagaaaagccagtcccggctccgtccggagtcgggtaaatcatggacgcgccggaggggggaggcgcggctctaacccagttaagcgatacgcaccagggttgccttgcgacgtgtatacataccttcatgaaaaatacctggactgccaggaacgaaaactggtttacgtactgccaggatggcctcaggatctgcttcatatgcttctcgcaagaaataagatccgcacgctcaaaaataacatgttttctaaattctag

SEQ ID NO: 6447 - DNA, 639 bp, Artificial Sequence
  Description of Artificial Sequence: Synthetic coding sequence
gacttcggctactgtccacgggtgtactgcgaaaaccaacccatgttgcctatcggggtgctggttatggttggatttaccgtgggcaaagtcccagtccccgatataaggacttgtcacttctgccttgttgaggatccttcggtaggatgtatctctggtagcgaaaagtgtaccatctcatcaagcagtctgtgtatggtgattaccatttactatgatgtaaaggtaaggttcattgtgaggggatgtgggcaatacattagctacaggtgccaggagaagcgcaatacatactttgcagagtactggtatcaggcacaatgttgccagtacgactactgcaattcctggtccagcccccagctgcagtcatctctcccagaacctcatgacaggccactggcacttcctctcagcgattcccagattcagtggttttatcaggctttgaacttatccttacctctaccaaactttcacgccgggacagagccggatggcctcgacccgatggtcaccttaagtttgaaccttggattaagttttgccgagctgcggcgaatgtatttgttcttgaacagttccggtttacttgttttgccccaggcgggcttgctaaccccccatccaagctag

SEQ ID NO: 6448 - DNA, 1005 bp, Artificial Sequence
  Description of Artificial Sequence: Synthetic coding sequence
atgctggcccttgcaaagatactactgatatccaccctgttttactctctcctgagtggttcacacggaaaagagaatcaagatattaataccacacagaacatcgcggaagtctttaagaccatggagaacaagccaatatcccttgaatcggaagcaaatcttaactcagacaaagaaaacatcacaacctcaaatcttaaagcctcgcactcaccccctctgaacctgccaaacaattcacacggcattaccgatttctcttcgaactctagcgctgagcatagcctcggttcattaaagcccacctcaactatatctacctctcccccgcttattcattcgttcgtgtccaaagtgccatggaatgctcctattgccgacgaagacctcttacctatctccgcccatcctaatgccaccccagcattaagctcagagaactttacttggtcactcgtgaacgacaccgtgaagactcctgacaattcttctatcactgtgtccatcctgtctagcgagcccacttcacctagtgtaacccctcttatcgtagaaccctccggctggctgacgactaactccgatagctttacaggatttaccccataccaagaaaaaactacattacagccaactctgaaatttacgaataacagtaaactctttccgaacacctcagatcctcagaaagaaaaccgaaatacgggaatagttttcggcgccatattaggagctatccttggtgtgagcctgctgacacttgtcggctatctgctctgtggtaagcggaagacagacagtttctctcatcgtaggttgtacgacgacaggaacgagcccgtgctcagactggacaatgcacctgagccttacgacgtgtcttttggcaactcgtcgtattacaatcccactctcaatgactccgcgatgcccgaatccgaggagaatgccagagacggtatccctatggacgacatacccccactgcggacaagcgtatag

SEQ ID NO: 6449 - DNA, 987 bp, Artificial Sequence
  Description of Artificial Sequence: Synthetic coding sequence
atggggcctgctggatgtgctttcacactcttgcttcttctgggtatttctgtctgcggacagccagtgtacagctcacgtgtggtgggcgggcaggatgctgcggcgggcaggtggccctggcaggtctccctgcacttcgaccacaatttcatttgcggcggctctctggtatctgaaagattgatcctgaccgccgctcactgcatccagcccacctggacaacattctcttacacagtgtggctcggttccatcacagttggcgattctcgcaagcgcgtgaagtattatgtgtccaaaatagtgatccaccccaaataccaggacactacggctgacgtggccttgctcaaactatcatcccaggtgacattcacgtccgctatcctgccgatctgtctccctagtgtgacgaagcagctcgccatacccccattctgttgggtgacgggttggggtaaggtgaaagaatcctcagatcgggattatcactccgctcttcaggaggcagaagtcccaatcattgatcgccaggcctgtgagcagctatataacccaatcggaatttttctgcccgcccttgagcccgtcatcaaagaggacaaaatatgcgcgggcgacacacagaacatgaaggattcatgtaaaggggactccgggggaccactgagctgtcacatcgacggcgtttggatccaaacaggcgtggtgtcatggggactggagtgtggcaagtccttgccgggtgtgtatactaacgttatctactaccaaaagtggattaacgctacgataagcagagcgaataatttggacttctccgactttctgtttccaatcgtgttactgtctttagcacttttgaggccatcttgcgctttcgggcccaatacaattcacagggttggaacggtggcggaggcggtcgcttgcattcaggggtgggaggaaaacgcgtggagattttccccgagggggcgctag

SEQ ID NO: 6450 - DNA, 453 bp, Artificial Sequence
  Description of Artificial Sequence: Synthetic coding sequence
atgcggttcatggcagggcccgcgggctctcagagtctaggaccgctgtgtttccattcatcaccccaggcgctatataccgttctccttatcgtcctagtgatgatgtccctcgtcttcggtaaattcgtgcctgtgaactgggagcctccgcagcctttgcccttccccaagtacctgcgatgttaccggtgtctactagagacaaaggagctgggctgtctgttgggctccgatatttgcctcacccctgccgggtctagctgcataacccttcacaaaaagaactccagcggctcagacgtcatggtgtctgactgccggagcaaggagcagatgagtgactgttcaaatactcgcaccagccccgtaagcggcttctggattttcagtcagtattgttttctagatttttgtaacgatccccagaaccggggtctgtacacaccctag

SEQ ID NO: 6451 - DNA, 234 bp, Artificial Sequence
  Description of Artificial Sequence: Synthetic coding sequence
atgcgcgttgcaggcgccgcaaaactggtagtggctgttgcagtcttcttactgactttctatgttatctcccaggtgttcgaaattaagatggacgccagcctcggcaacctgtttgctcgcagtgcgcttgacaccgctgcacgcagcaccaagcctccgcggtacaaatgcggaataagcaaggcttgccctgagaagcactttgcatttaaaatggcatcaggggcttag

SEQ ID NO: 6452 - DNA, 1143 bp, Artificial Sequence
  Description of Artificial Sequence: Synthetic coding sequence
atggccttaacaccgggctgggggtccagcgcaggcccggtgaggcccgagctctggctcctactgtgggctgcggcctggcgcctcggcgcatctgcctgtcccgccctgtgcacttgcactggtactactgtagattgccacgggacagggctccaggcaattcctaagaacatcccccgcaacactgagagattagagttaaacggaaataacattacccgcatccataaaaacgattttgctgggctgaagcagctgagggtgttgcagctgatggaaaaccagatcggcgctgtcgaaagaggagcctttgatgacatgaaagagttagagcgcctcgatctgagtgagaacgccatccaagccattcctagaaaagcctttcgcggagcaacagatctgaaaaaccttcagcttgacaagaaccagataagttgtattgaggagggcgctttcagagccttgagaggtctggaggtgctaaccctcaataacaataatatcactactatcccagtgtcgtcatttaatcacatgccaaaactgagaacgtttagattacatagcaatcaccttttttgcgactgccatctggcctggctttctcagtggttaaggcaacgacccacaatcggcctgttcacacagtgttcaggacctgcctcactgagaggcttaaatgtcgcagaagtgcagaagtccgaattctcctgttccggccagggagaagccgggcgcgtaccaacttgcaccctgtctagtggatcctgtcctgctatgtgtacttgctccaacggaattgtcgactgtcgcggtaagggccttacagccattccagccaatctgcccgaaaccatgactgaaatccgcctggagctgaacggaatcaagagtatcccccctggcgcattttcaccctatcgcaagctcaggcgtattgacctgagcaataaccagattgccgagattgcgccagatgcctttcaagggttacgctcgcttaactccctggtgctctatggcaacaaaatcaccgatttgccgaggggcgtgttcggtggtctgtataccctgcaactgctcctgcttaatgccaataagattaactgcattcgcccagatgcctttcaggacttatag

SEQ ID NO: 6453 - DNA, 558 bp, Artificial Sequence
  Description of Artificial Sequence: Synthetic coding sequence
atgcctggatggctgactctccccactctttgcaggttcctgctgtgggcattcacaattttccacaaggcacaaggcgaccccgcaagccaccccggacctcattatttgctgccacccatccatgaagttatccactctcacaggggagccaccgccaccctgccatgcgtcctgggaaccactcccccatcctacaaagttaggtggagtaaggtcgagccgggcgaattgcgagagaccctgatcctgattacaaacggactccacgcaaggggttacggacccctaggcgggagggctcgaatgcgccggggccatcggctggacgcatctctggtgatcgccggagtgcggttggaggacgaaggaagatacagatgcgagctgattaatggcatcgaggacgagtctgtcgctttgaccctgtcactggagggtgtggtctttccttatcagccttcgagaggccgttaccagttcaattattacgaagccaagcaggcctgtgaggaacaggatggtaggctggctacttattctcagctgtaccagtag

SEQ ID NO: 6454 - DNA, 375 bp, Artificial Sequence
  Description of Artificial Sequence: Synthetic coding sequence
atgctgatgctgttcgttttcggcgtcttgctacatgaggtgtctctaagcggccagaatgaagctccgcctaacacccatagtatcccaggcgagcctctctacaactacgcttctattcgcttgccagaggagcacatccctttcttcttgcataataatagacacatcgctaccgtctgccgaaaggactccttgtgcccctacaagaagcatttggagaagctgaaatactgctggggttacgaaaaatcctgtaagccagaatttagatttgggtatccggtctgttcctatgtggacatgggttggacagataccctcgaatccgcagaggacattttttggaagcaggccgatttcggctatgcgtag

SEQ ID NO: 6455 - DNA, 5859 bp, Artificial Sequence
  Description of Artificial Sequence: Synthetic coding sequence
atgcctgcgctgggccccgcccttcttcaagccttgtgggcaggctgggtgttgaccctgcaaccacttccacccaccgctttcaccccaaatggaacatatctgcagcacctcgcccgcgacccaacgtctggaactctatacctgggcgctacaaacttcctgttccagctctccccagggctccagttggaggctacagtgtccactggcccagtcctggattcaagggactgccttccacccgtcatgcccgatgagtgcccccaggcccagcccaccaacaatccaaaccaattgctcttggtgtcccctggggctctcgttgtttgtgggtccgtccatcagggcgtgtgcgagcagcgtaggctgggtcagctggagcagctcctactgagacccgaacgcccaggcgacacccagtacgtagcagcaaatgaccctgctgtttctacagttggacttgttgcccaggggctagccggtgaacccctacttttcgtgggccgcggttatacaagcagaggcgtgggggggggcatccctcccattaccacacgcgcactgtggcctcctgaccctcaggccgccttctcctacgaggaaactgcaaagcttgcggtgggccgactctcggaatactcacaccacttcgtgtctgccttcgccagaggcgccagcgcctatttcttgttccttcggcgggacctgcaggcccagtcccgcgccttcagagcctacgtctcccgagtttgccttcgagatcagcattactattcctatgtagaactgcctctggcatgcgaaggtggaagatacgggctaatccaggctgccgccgtcgccacaagcagagaggtggcccatggtgaggtgctgtttgcggctttctcaagtgctgcgcctcctaccgtgggtagaccaccatccgcagccgctggagcgtccggagcctctgccctctgtgcgtttccgttagatgaggtcgacaggctggcaaataggacccgagatgcctgttacactagagaaggccgggcagaggacggcaccgaggttgcttatattgagtatgatgtcaattctgattgcgctcaactgccagtggataccctggatgcctatccttgtggctctgaccacactcccagccctatggcctctcgagtaccactagaggccactcctatactcgagtggcctggcatccagttgaccgcggtggccgtcaccatggaggacggccatacaatcgcctttctcggagactcccaaggacagctgcacagagtatacctgggccccggaagtgatggtcacccttattcaacccaatcaattcaacagggcagcgccgtgagtagggatttgacatttgatggaacattcgaacatctgtatgtgatgacccagagcaccctgctgaaggtgcccgtggcgagctgcgctcagcatctggattgtgctagctgcctcgcccacagggacccttactgtgggtggtgcgtgctcctgggcagatgttcaagacgatccgagtgctctagagggcaggggcctgagcagtggttatggtcttttcagccagagcttggatgtcttcaggttgccgcaatgtcgcccgccaatatatctcgggaagagaccagggaggtgttcctgagcgtgccggacctaccaccactctggccaggagaaagttacagctgccacttcggagaacaccaatcacctgccttgctgacaggcagcggtgtaatgtgtccttccccggatccgagcgaggcccctgtcctgcctcgaggcgctgactacgtgtcggtgagcgtggaactcagattcggagccgtggtgattgctaagacctccctgtcattttatgattgcgttgcagttaccgagcttagaccatctgcccaatgtcaggcatgcgtatcgagcagatggggctgcaattggtgcgtgtggcaacatctgtgcactcacaaagcctcctgcgacgcaggaccaatggttgcctcccatcagtcccccctggtgtcccctgatcctcctgcaagaggcgatggagactcggccgagctggagggaccccctgcgccattgattctccctagctcccttgattaccaatatgacacccccgggctatgggaactagaggaagccaccctgggcgcgtcctcctgcccctgcgtggaatccgtccaaggctcgactctgatgcctgttcacgtagagagagagataagactgcttggacgaaatctccacctgtttcaagacggccccggagacaatgaatgcgttatggagctcgaggggctggaggtggtggttgaggcacgggttgagtgtgaaccacctcccgatactcagtgccacgtcacttgccaacagcatcagctgagctacgaggccttgcagcccgagctacgagtggggcttttcctgcgacgcgctggccggctgcgtgtggatagtgccgaggggcttcacgtagttctttatgactgctctgtaggtcatggtgattgtagtaggtgtcagaccgccatgccccagtacgggtgcgtgtggtgcgagggggagcgcccacgttgtgtgaccagggaggcctgcggcgaagccgaagccgtggctacacagtgtcccgccccgcttatccatagtgtcgagccacttacaggccctgtggacggaggcactcgagttacgatacgagggtccaatcttggacagcatgtgcaagacgtcctgggcatggtcaccgttgctggcgtgccgtgcgccgtggatgcccaggaatatgaggtgtcctcctcactggtgtgcattacaggcgcttccggggaggaggtagccggggccacagccgtcgaggttcctggccggggaagaggggtgtccgaacacgactttgcatatcaggaccctaaggttcattccatcttccccgcacggggcccaagagccggcggcacaaggttgaccctgaatgggtccaagctgctgacaggcagactggaggacatacgtgtagtggtcggcgaccagccgtgccatctgctgcctgagcagcagtctgagcagctgcgatgtgaaacctcccctcgccctacaccagccactctgccagtggcagtgtggttcggtgcaacagagaggagactacagagagggcagttcaaatacactctggaccccaatattaccagcgctggcccgaccaagtctttcttgagtggcggccgggagatttgcgttcgtggccagaacctggacgtagtccaaacgccacgtatccgggttactgtcgtatctagaatgcttcagcccagccagggcctgggtcgaaggagaagagtggttcccgagacagcttgttccctggggccaagctgttcctctcagcaattcgaggaaccatgccatgtgaatagcagtcaactcatcacctgtaggacgcccgccctgcctggactgcccgaagacccctgggtgagggtggagttcatccttgacaatcttgttttcgatttcgcaacactgaatccgacaccattttcttacgaggctgatccgaccttacagccattgaatccagaggacccaaccatgccgttccggcacaagcctggatctgttttttccgtagagggcgagaacctggacctagcgatgtctaaggaggaggtggttgctatgataggggacggcccctgtgttgtcaagacgctgactaggcaccacttgtactgcgaaccgcctgtggagcagccactgccccgccaccacgccttaagggaagcccccgactccctccccgagttcacagttcagatgggcaacctcaggttctccctgggacacgtgcagtacgatggtgaaagtccgggggcctttcctgtagcagctcaagtgggcctgggagtggggacatcattactggcccttggagttatcatcatcgttcttatgtaccggcgcaagagcaagcaagccctgcgcgattacaagaaggtacagatccagttggaaaatctggagagttccgtgagggacagatgtaagaaagagtttaccgatctcatgacggaaatgacagaccttacgtcagacctgcttggatccggaatccctttccttgactacaaggtatacgcggaacgcattttttttccagggcacagggaatcgcctctgcatcgggatctcggcgtacccgagagccggcgtcccacagtcgagcaagggctggggcagttaagcaatctcctgaacagcaagctgttcctgacaaaatttatacataccctggagtctcagcgaacattctccgcacgcgaccgggcctacgttgcaagcctactgactgtggccctacatggtaagcttgaatatttcactgacatcttgaggacactactgagcgacctggttgcacagtacgtagctaagaaccccaagctgatgctccggcggaccgagacagtcgtagagaagctcttgacaaattggatgtccatctgcttgtatacatttgtgagagacagtgtgggcgaacccctctatatgctgtttcgcggcatcaaacatcaggtcgacaagggaccagtggactcagtgacggggaaggccaagtacactctgaacgacaatagattgctgagggaagacgtggaatacagacccttaaccctcaacgcactacttgcagtggggccaggcgccggagaggcccaaggcgtgccagtgaaggttttggattgtgacactatcagccaggctaaagagaaaatgttagaccaactgtataagggagtcccactaacccagaggcctgaccctcggactctcgatgtcgagtggagatccggagtggcgggacacttgattctctcagatgaagacgtcacctcggaagttcagggactttggcgccggttgaataccctgcaacattacaaggttcctgatggcgcgaccgtagctctggtcccctgtctgacaaaacacgtgctgagagagaaccaggattacgtgccaggggagcggacacccatgctggaagatgtggatgaaggcggaatacggccttggcacctggtgaaaccttctgatgagcctgaaccccccaggcccagacggggatcactgcggggaggagagcgagagagggctaaggccataccagagatttatctgaccaggttgctgtctatgaaggggacattgcagaagttcgtcgatgacctgtttcaggtgatcctcagtacgagcaggcccgtgccacttgccgtcaaatattttttcgatctgctggatgaacaggcccaacagcacggcataagcgaccaggacactattcacatatggaagacaaattctctgccactgcgcttttggatcaatattatcaaaaatccccagttcgtctttgacgttcagactagcgacaacatggacgctgtcctcctggtcattgcccagactttcatggatgcctgcactttagcggatcacaagttgggaagggattcccccatcaacaaactgttgtatgcacgagacattcctagatataaacgaatggtggagagatattacgccgacatccggcagacagttccggctagtgatcaggagatgaacagcgtcttggcagagttgtcctggaactatagtggggacctcggagcccgcgtcgcactccacgagttgtataaatacatcaataagtactatgatcagatcattacagccctggaagaggatggaacggcgcagaagatgcagctggggtataggctccagcagatcgctgctgccgtagaaaataaggttaccgacttgtag

SEQ ID NO: 6456 - DNA, 612 bp, Artificial Sequence
  Description of Artificial Sequence: Synthetic coding sequence
atgagaacagtggtgctgaccatgaaagcttcagtaattgagatgttccttgtactactggtcaccggcgttcacagcaataaagaaaccgcaaagaagatcaaacggccaaaatttacggtgccccagatcaattgcgacgtgaaggccggcaagattatagatccagagttcattgttaaatgccctgccgggtgtcaggatcctaagtaccatgtctatggcaccgacgtatacgcctcatactcttccgtgtgcggtgccgccgttcactcgggagtactggataattcgggggggaagattttagttcgcaaggtagcaggccaatcaggctataagggaagctatagtaacggggtccagagcctgagcttacctaggtggagggaaagttttattgttctcgaaagcaagcccaagaaaggtgtgacatatccatctgcactgacttactctagtagcaagtcacccgctgcccaggccgggaagtgtagccgcgtcatagagagtaaaccttcagaatcgatgaacacccgccgggttttgggcgactccggtgaaattaacatacttacagggcaggcgccgttagctctggccatcttttag

SEQ ID NO: 6457 - DNA, 2511 bp, Artificial Sequence
  Description of Artificial Sequence: Synthetic coding sequence
atggagactcaggaactgaggggggcactggcactcctgctgctgtgctttttcacatccgcttcccaggacctccaggttatcgacctactcacagttggcgagagccggcaaatggtggcagtggcagagaaaatcaggacggcacttctcaccgccggtgacatctatctgctctcaacatttcgattaccacctaagcaagggggggtgttgtttggcttgtattcccgccaggataacacacgttggctagaagccagcgtggtggggaagattaacaaagtaaccaatgcgctccattccattctgggagaacagacgaaagctctggttactcagctgaccctgttcaaccagatccttgtggagctgcgggacgacatcagagaccaggttaaggagatgagcctcatcagaaacaccataatggaatgtcaagtttgcggctttcatgagcagcggtctcattgcagtcccaatccgtgcttccgcggagtggattgcatggaagtctatgaatatcccggctatagatgcggaccatgccctcccggactgcagggaaatggtacacattgcagcgacatcaatgaatgcgctcacgctgacccatgttttccaggctcttcatgcattaataccatgccaggtttccactgcgaagcatgccctagaggttacaagggcacgcaggttagtggggtgggcattgactacgcacgggctagtaagcaggtttgtaatgacatcgacgaatgtaacgacggcaacaacggcggatgtgaccctaactccatctgcacaaatactgtcggatccttcaaatgtggaccatgtcggctgggctttctgggaaaccagagtcagggatgtctacccgctcgcacctgccatagccccgcccacagtccctgccacattcatgcacactgcctgttcgagcggaatggggctgtgagctgccagtgtaacgttggctgggccggcaatggaaatgtttgcggtactgacaccgacattgatggatatcctgaccaagccctcccctgcatggataataataaacactgcaaacaagataactgtctgctgacccctaacagtggccaggaagatgccgacaacgatggcgtgggggatcaatgcgacgatgatgccgacggggatggtattaaaaatgtggaagataattgtcggctatttcccaacaaggaccagcagaacagcgacacagattcatttggtgatgcttgcgacaactgccccaacgtgcccaacaacgatcagaaggatacagacggcaacggtgagggcgacgcctgcgacaatgacgtagatggcgacgggattcctaacgggctcgacaattgcccaaaggtgccaaacccactacagaccgatcgcgacgaggatggcgtcggggatgcctgcgactcatgcccggaaatgagcaaccccacccagacagacgccgactctgacctggtcggcgacgtttgtgataccaacgaggacagtgatggtgatggccaccaagatacaaaggataactgcccccagcttccgaactcttctcaactggactccgacaacgacgggctgggggatgagtgcgatggggacgacgacaacgacgggattcccgattacgtgcctcccggaccagataattgtaggttagtcccaaacccaaaccagaaagatagcgacggcaacggtgtcggcgacgtgtgtgaagatgatttcgacaacgatgcagtggtggatcccctcgatgtctgtccggagtccgccgaggtaaccttgactgattttagggcctatcaaaccgtcgtcctcgatccagaaggcgacgcacaaattgaccctaactgggtggtgctgaatcaaggaatggagattgttcaaaccatgaattccgatccgggcctggctgtaggctacacagctttcaacggcgtcgactttgagggtaccttccacgtcaatacagtgacagatgacgattacgcagggttccttttctcttaccaagactccggccgtttttacgtcgtcatgtggaaacagactgaacaaacttattggcaggccaccccatttcgcgctgtagcccagccgggactgcaacttaaagccgtgactagtgtgtcaggacccggcgagcacctcagaaacgctctctggcacactggccacacaccagaccaggtcagactgttgtggactgacccccggaacgttggttggcgcgacaaaacctcctaccgctggcagctcctgcacaggccacaagtaggctacatacgagttaagctctacgaaggtccacagctggtagctgactctggcgtgattatcgatacatctatgagaggaggtcgtctgggtgtgttctgtttttcgcaggagaacattatctggtccaatctgcagtacagatgcaacgacacagtacccgaagatttcgagccattccgacggcagttgcttcagggccgcgtttag

SEQ ID NO: 6458 - DNA, 1311 bp, Artificial Sequence
  Description of Artificial Sequence: Synthetic coding sequence
atgtggcgttgcccacttggcctcttactgctgctgccactggcaggccacctcgctctcggagcacagcagggacgcggccgccgtgaactggctcccgggctccacctccgaggtatccgcgacgctggcggcaggtactgtcaggaacaggacctctgttgccgaggccgcgccgatgactgcgctctcccttatctcggtgccatatgctattgcgatctcttttgcaaccggactgtctccgactgttgccctgatttttgggacttctgcttaggggtgccgcctccctttccacccatccagggctgtatgcacggcggcagaatttacccagtcttgggaacctactgggataattgtaatcgttgttggcaggctggaaaccacagtgccttctggggaatgacacttgatgaaggtattcgctaccgcttgggcacaatccgcccaagctcctcagtgatgaacatgcatgagatttataccgtcctgaaccccggcgaagtactcccaactgctttcgaagccagcgagaagtggccaaacctcatccacgagccgcttgaccaaggaaattgcgccgggagttgggcttttagcaccgccgcggtggcctctgatagagtgtccattcactcattaggccacatgacccctgtcctgtcgccccaaaacctactctcttgcgatacccatcaacagcagggctgtcggggaggcagactggatggcgcctggtggtttttgaggagacgcggcgtcgtgtccgatcattgctatcctttcagtggcagggagcgcgatgaggcaggcccagccccgccctgcatgatgcattccagggccatgggtcggggtaaaaggcaggcaaccgcccactgtcccaattcatacgttaataacaatgatatttaccaggtgacacctgtgtaccggctggggagcaatgataaagagatcatgaaggagcttatggaaaacggccccgtgcaagcccttatggaagtgcatgaagatttctttttgtacaaaggtggaatctactcacatacccccgtatcactcgggcggcccgaaagatataggagacacgggacacatagcgtaaaaattaccggctggggagaggaaactcttcccgacggccgaactctgaagtattggacggcggctaattcctggggccctgcctggggcgaaagagggcattttcgcatagtgaggggtgtcaatgaatgcgacatcgagtccttcgttctgggggtgtggggccgtgttggcatggaggatatgggccaccattag

SEQ ID NO: 6459 - DNA, 942 bp, Artificial Sequence
  Description of Artificial Sequence: Synthetic coding sequence
atgtctgatctgttgctgctgggactgatcggtgggctgacactgctcctgctcctgaccctccttgccttcgctggttattctggtctcctagcgggtgtcgaagtgagcgccggctcccccccaatcagaaacgttaccgtcgcctataagttccacatggggttatacggcgagacaggcaggctgtttacagaatcgtgtagtatctcccccaaactgaggtcaatcgccgtctactatgacaatccgcacatggttccgcccgataagtgtagatgcgctgtggggagcattcttagcgaaggcgaggaatccccgtccccagagctcatcgacctctaccaaaaattcggatttaaggtgttctccttcccagcaccaagccacgtggtgacagcgacgtttccctataccaccatcctgagtatctggctggctaccaggcgcgtccatcctgccttagatacttacatcaaggaacggaagctgtgtgcctaccctcggctggagatttaccaggaagatcagatccattttatgtgccctctggcaaggcagggtgacttctacgtgcccgagatgaaggaaacagagtggaagtggcggggtctggtggaggctatagacacacaagtggacgggacaggagcggataccatgtccgacaccagcagcgtgtcccttgaggtctcaccaggtagtcgggaaacgtctgccgcgacactctccccaggcgcttcaagcagaggatgggacgatggggatactcggtccgaacacagctactccgaaagcggggcttccgggtcttctttcgaagagctggacctcgaaggcgagggccctctcggtgagagcaggcttgaccccgggaccgaaccattagggaccacgaagtggctctgggagcctacggctcccgaaaagggtaaggagtag

SEQ ID NO: 6460 - DNA, 213 bp, Artificial Sequence
  Description of Artificial Sequence: Synthetic coding sequence
atggtggcccctgccgccagggtattcttacgggccgttagggccgcgctgacttccacagtgcctgatctgctgtgtctcctggcccgcggatcccctcgagggttagccagcggacggctgcctctggccgtccattcagcccaacatgggcccggctccggtgctccgtggttgcggattgctcgccgagcgctatcccaaaggatctag

SEQ ID NO: 6461 - DNA, 642 bp, Artificial Sequence
  Description of Artificial Sequence: Synthetic coding sequence
atggcccaactgttcctacccttactggctgcactagtgctcgcccaggcccctgcagcactggccgatgtcctggaaggggactccagtgaagaccgtgccttcagagtcagaatagctggggatgctccccttcagggggtactcgggggggccctgaccatcccatgccatgtacattaccttcgtccaccgcccagcaggagagccgtattaggaagtccacgcgtaaagtggactttcctgtccagggggcgcgaggcagaagttcttgttgcccggggggtgagagtgaaagtgaacgaggcttatagattccgggtggcccttccagcttacccagcatctttgacagatgtgtccctggctttgagcgagctcaggcccaacgactctggaatttaccgctgtgaagtgcaacatggcatcgacgactctagtgatgcagtcgaagtgaaagtcaaaggcgttgttttcttgtatagggagggcagtgcacgatacgccttttccttctctggagcccaggaggcctgtgcacggataggagcacacatcgcgacccctgaacagctctacgctgcctacctgggcgggtacgaacagtgtgatgccgggtggcttagcgaccagactgtgtag

SEQ ID NO: 6462 - DNA, 237 bp, Artificial Sequence
  Description of Artificial Sequence: Synthetic coding sequence
atgggcagcggacttccactcgtgttactcctcacactgctcggatctagccacggtaccggtccaggaatgacactgcagcttaagttaaaggaatcttttcttacgaacagctcctacgagagttcatttctggaacttttggaaaaattgtgtctcttgctccacttgccctctggcaccagtgtgaccttacatcacgccaggtctcaacaccacgtcgtatgtaacacctag

SEQ ID NO: 6463 - DNA, 651 bp, Artificial Sequence
  Description of Artificial Sequence: Synthetic coding sequence
atgtctgatttgctgttattgggcttaataggaggccttacactgctgctgctcctgaccctcctcgcgttcgctggatatagcggactacttgccggagtggaagtgagtgcgggcagtcccccaattcggaatgtcacagttgcttacaaatttcacatgggactgtatggcgaaaccggacggctgttcaccgagtcctgctccattagtcccaagctgagatctattgctgtgtactacgacaacccacacatggtgccaccagacaagtgtcgttgtgcagtgggaagtattctgtcagagggcgaagagtctccttcaccagagttaatagatttataccagaagtttggattcaaagtcttctcatttcccgctccatctcacgtagtgaccgcaaccttcccctatacaactatcttatcaatatggctcgccactcgcagagtgcaccccgcccttgacacgtacataaaagagaggaagctgtgtgcctaccccaggctcgaaatataccaagaggatcagatccactttatgtgtccgctggcaaggcagggcgacttttatgtgcccgagatgaaggaaacagagtggaaatggcggggcctcgtcgaagccattgatacccaggtcgatgggacttag

SEQ ID NO: 6464 - DNA, 453 bp, Artificial Sequence
  Description of Artificial Sequence: Synthetic coding sequence
atgaggtttatggccggcccagccggatcccaatccctgggtcctctctgcttccactctagcccgcaggcgctgtacaccgtgttgctgatcgtgctggtaatgatgtctttagttttcggaaagtttgtgccggttaattgggaacccccacagccactcccttttcctaagtacctaaggtgctataggtgcctcctggagaccaaggagctgggttgtctgctaggcagcgatatttgcctgacccctgcggggagctcatgtatcacactgcataagaagaattcatccgggagcgacgttatggtttctgactgtcggtcaaaagaacagatgagtgattgctcaaacacccggactagtcctgtcagtgggttctggattttttcacaatactgcttcttggatttctgcaatgatcctcagaacagggggctatacacgccgtag

SEQ ID NO: 6465 - DNA, 171 bp, Artificial Sequence
  Description of Artificial Sequence: Synthetic coding sequence
atgaagactggcctgttctttctgtgcctgttgggaacagcggctgcaattcccacaaacgcgcgtctgcttagcgaccacagcaaacctaccgcagagaccgttgcccccgataacactgctatccccagccttcgggctgaagccgaagaaaatgaaaaagagacctag

SEQ ID NO: 6466 - DNA, 2346 bp, Artificial Sequence
  Description of Artificial Sequence: Synthetic coding sequence
atggccgtggccgaagtgagcaggacttgtctgctcacagtgcgcgttcttcaggcacatcgcctgccgtcaaaggatctcgtgacacctagcgactgttatgtaaccttatggctcccaacagcttgttcccacaggctgcagactagaaccgtgaaaaactctagctcccccgtgtggaatcagtcctttcactttagaatccatagacagttgaaaaatgtaatggagctgaaagtgtttgatcaagaccttgtcacgggagatgaccccgtactgtcagttctgtttgatgccgggactctccgagcaggcgagtttcgaagagagagttttagcctgtccccacaaggggaaggccggttggaggtggagttccgcctacagagcctcgccgacaggggtgagtggcttgttagtaacggcgtgttggtcgcccgtgagctcagctgtctccacgtccagctcgaagagactggagaccagaagtcaagtgagcaccgtgtacaactggtagtgcctgggtcttgcgaaggcccccaagaggcaagtgtgggaactgggacttttcgtttccattgccctgcttgctgggaacaggagctttccatcaggctacaggatgcccccgaagaacagctgaaggcaccactgtctgccctcccttctggacaagtagtgcggttagttttccctacctcccaggagcctctgatgagggtggaattaaagaaggaagccggtctgcgcgagctggcagtacgactgggcttcgggccatgcgccgaagagcaggctttcctctcccgccgtaagcaagtggtagccgccgcactacggcaggccctgcagcttgacggcgaccttcaggaagacgaaattccagtggtggctatcatggcaacgggcggcgggattagggctatgacctcattgtatggccagttagcaggcttgaaggaactaggtctactggattgcgtctcctatattacgggggcctccggatccacgtgggctctggcgaacttgtacgaggaccccgaatggagtcaaaaggatttggcggggccaaccgagttgctgaaaacacaggtgacaaagaataaactgggagttctcgccccaagtcagcttcagagataccggcaggagctcgctgagcgagcacggctcgggtatccatcctgcttcaccaatctctgggccctcatcaacgaagccttactccacgatgaaccccacgatcacaagctgtctgaccagagggaggctctcagccacggacagaacccactgcctatttattgtgctcttaacactaagggccagagtttaacaacattcgaattcggcgagtggtgcgagttttctccatacgaggtaggtttccccaagtacggggctttcatcccctccgagctcttcggatcagagttctttatgggccagctcatgaagcgtctgcccgagtcacggatctgcttcttggagggaatttggtctaacctgtacgcagccaatcttcaggattctctctactgggctagtgagccttcgcagttttgggatcgatgggtcagaaaccaggccaatctcgacaaggagcaggtgcccctgctgaaaatagaggaacccccatccacggccggacgtatcgcagagttttttactgatttactgacctggaggcccctggctcaggctactcacaacttcttaagaggactccattttcacaaggactacttccagcacccgcacttctctacctggaaagctaccacattggatggcctccctaaccagctcacaccatccgaacctcacttgtgcctcctggacgtgggctacctaatcaatacaagctgtttaccactcttgcaacccacacgggatgttgacctgatactgtcactggactacaatctccacggggcattccagcagctgcagctgctgggaaggttttgccaggagcaaggcatacctttcccacccatcagcccgagccccgaggagcagctgcagccccgtgaatgccacactttctccgatccgacttgtcctggagcccctgctgtccttcactttcctctggtgtctgattcttttcgcgagtattctgcaccaggtgtcaggcgcacccctgaagaagccgctgccggagaagtaaatttgtcttcaagcgatagcccatatcactacacaaaagtaacctattcacaggaagacgtggacaagttactacatttgacacattataacgtctgtaacaatcaggagcagctcctggaggccctaagacaggcagtccagaggcggaggcaacgccgacctcattag

SEQ ID NO: 6467 - DNA, 219 bp, Artificial Sequence
  Description of Artificial Sequence: Synthetic coding sequence
atggcagccgcaactcgtgggtgtagaccttggggctctctgctgggactgttaggccttgtcagcgcggccgctgccgcctgggatcttgctagcttacggtgcacccttggggccttttgcgaatgtgacttcaggcctgatctgcctgaggggagtgaagaactcggcccacgggaaccccactgtctgtggcccctgccattgccgttgcggtag

SEQ ID NO: 6468 - DNA, 243 bp, Artificial Sequence
  Description of Artificial Sequence: Synthetic coding sequence
atgaaagtctttttccttttcgcagtgcttttttgtctggtgcagactaactctggagatgtcccacccggcatccggaatactatctgccacatgcagcaagggatttgtcgcctgttcttttgccattccggggaaaaaaagcgggatatctgtagcgatccatggaaccggtgctgtgtcagcaacactgatgaggaagggaaggagaagccggagatggacggaagatctggcatctag

SEQ ID NO: 6469 - DNA, 861 bp, Artificial Sequence
  Description of Artificial Sequence: Synthetic coding sequence
atggggcccgaagctctgagtagcctcctgcttttgctgctggtcgccagtggcgacgcagacatgaaggggcactttgacccagcgaagtgccgatacgcactgggcatgcaagaccgtaccatcccagattctgacattagcgcttccagctcttggtcagattcgacggcagcacgacacagccgtttagaaagctccgatggcgatggcgcgtggtgccccgccggaagcgtgttcccaaaggaagaagagtacctccaggttgatctccagcggctccatcttgtcgctctggttggaacacaaggtcggcatgcaggcgggctgggcaaggaattctccagatcctatagattgcggtatagcagggatgggcggcgttggatgggttggaaagacagatgggggcaggaagttatctcaggtaatgaggaccccgagggggtagtcctaaaagacctcggccccccgatggttgccagactcgtcagattttatcctagggcggatagggtcatgagcgtgtgtctgcgggtcgaactctacggctgtctgtggcgcgacggccttctcagctacaccgcaccggttggccagacaatgtacctcagtgaagcagtgtacctgaatgatagcacatacgacggccacacagtgggcggactgcagtatggcggcttgggtcagctggctgatggcgtagtcggccttgacgacttccgcaaatcccaagagttgagggtatggcccggatacgattatgtaggctggagcaaccactctttttcctcagggtacgtcgagatggaatttgaatttgatcgattgcgcgcgtttcaggcgatgcaagtccattag

SEQ ID NO: 6470 - DNA, 858 bp, Artificial Sequence
  Description of Artificial Sequence: Synthetic coding sequence
atgaggggccagggaagaaaagaatccttgtccgacagcagggacttagacgggtcttatgatcagctgacggggcacccaccaggacctaccaagaaagcactaaagcagaggttcttgaagctgctgccttgctgcggcccccaggcgttaccttccgtgagcgagataggccgtgtcttccgttttttgggtgattcctcgctcccatctgccctcgccgctcctgcttcgctacggcctcaccgacctaggctgttagatcctgattccgtggatgacgagttcgaactctccacagtgtgtcatcgaccagaaggactggagcagttgcaggaacagactaaatttacccggaaggaactccaggtgctctatcgcggatttaagaatgaatgtcctagcggaatcgtcaatgaggagaactttaagcaaatctactcccagttctttccacagggagactcatccacatacgccacgtttctcttcaacgcatttgatacaaatcacgatggaagcgtctccttcgaagattttgttgccggcctgtctgtcattctccgcgggactgtggacgatcgactaaattgggcatttaacctttatgatctgaataaggatggttgtattacaaaagaggagatgctggatatcatgaaatcaatttatgatatgatgggcaagtacacctatcctgcattgcgcgaagaggcccctcgcgagcacgttgagagcttctttcaaaagatggaccgcaataaggacggcgtcgtgaccatcgaagaatttattgaatcatgtcagaaggacgagaatatcatgcggtccatgcagttattcgataacgttatatag

SEQ ID NO: 6471 - DNA, 1311 bp, Artificial Sequence
  Description of Artificial Sequence: Synthetic coding sequence
atgcagggaactcccgggggcggcacaaggccaggaccaagtccagttgatcggcgcacattgctggtcttcagtttcattctggccgcagcactgggccagatgaacttcactggagaccaggtgcttagggtcctggccaaggatgaaaaacagctgagtctgcttggcgatttggaaggtctgaaacctcagaaggtcgacttttggcggggccccgcccgccccagcctccccgtggacatgcgagttccgtttagcgagctcaaagatataaaggcctacctggagtcacacgggctggcctattcaattatgattaaagacattcaggtcttgcttgacgaagaaaggcaagccatggcaaagtctcgcagactggaaaggtcaaccaactctttctcctactcttcctatcacactctggaggagatctacagctggatcgataacttcgttatggaacactcagacattgtttccaaaatccaaatcgggaacagcttcgagaatcagtcgatcctggtgctaaagttttccactggcggatcacgacacccagcaatctggattgatacgggtatacacagtagagagtggatcactcacgccaccggtatttggactgcgaataaaattgtatctgattacgggaaagacagggtgctgactgatattcttaacgcaatggatatctttatagagctggtaactaatcccgatggctttgcgttcacacacagtatgaacaggctgtggagaaagaacaagtccatccggcccgggattttttgtatcggagtggacctgaatcggaattggaagtcaggattcgggggcaacgggagcaactccaatccgtgcagtgagacttaccacggcccaagcccccagtctgagccggaagttgctgctatcgtcaactttattacagcacacggaaacttcaaggccctcatcagcattcacagttactcccagatgcttatgtacccgtacggacgccttctggaacctgtttccaaccaaagagaactttacgacttggctaaggatgccgtagaagcgttgtataaagtacacggtatcgagtatattttcggaagtattagcaccacgctgtatgtcgctagcggcatcaccgtcgactgggcatacgatagcggtatcaaatacgccttcagtttcgaactcagggacaccggacagtacggattcttgctgccagctacccaaatcattcctactgcccaggagacatggatggctctccgcaccattatggagcacactttgaaccatccctactag

SEQ ID NO: 6472 - DNA, 1218 bp, Artificial Sequence
  Description of Artificial Sequence: Synthetic coding sequence
atggacacaatattcttatggtcacttctgttactctttttcggcagccaggcatctcgatgcagcgctcaaaaaaataccgagttcgctgtggatctctatcaggaggtgtccctcagtcacaaagataatatcatcttctcaccactggggatcactctggtcctcgagatggttcagctcggcgcgaaaggcaaagctcaacaacagattcgccagaccctgaagcaacaagaaacctccgcaggtgaggaattctttgtattgaaatctttcttcagcgctatctccgaaaaaaagcaggaatttacatttaacctcgcaaacgccctctatttgcaggaggggtttactgttaaagagcagtacctgcacggaaacaaggagttcttccagtctgcgataaaactggtggattttcaggatgcaaaagcctgtgctgagatgatcagtacctgggtagagcgaaaaactgacgggaaaatcaaggacatgttcagtggagaagaatttggcccattgacccggctcgttttggtgaatgccatctactttaaaggggactggaagcagaaattcagaaaggaggatactcagctaattaattttactaaaaagaacggctcaactgtgaagattcccatgatgaaagccttgctgagaaccaaatatgggtattttagtgagtcttctctcaattatcaggtactggaacttagctataaaggagacgagttctcactcatcattatacttccagctgaaggtatggatatcgaggaagtggagaagctgattacggcccagcagatattaaaatggctcagcgagatgcaggaggaagaggtggagatcagccttccaagatttaaggtagaacagaaggtggattttaaggatgttctgtatagcttaaacattacagagatcttctcaggagggtgtgatctgagcggcattactgattcctccgaagtgtatgtgtcgcaggtgacacagaaagtattctttgagatcaacgaggacggttccgaggccgctacgtctacgggtatccatatacctgttattatgagtctcgcccagtcacagttcattgccaaccatccctttctatttattatgaaacacaatcctaccgagtcaatattatttatgggaagagttaccaatcctgatacacaggagatcaaggggagagacctcgactccctctag

SEQ ID NO: 6473 - DNA, 300 bp, Artificial Sequence
  Description of Artificial Sequence: Synthetic coding sequence
atgctggcccttctggtcctggtgacagttgctcttgcttccgcccaccacggcggcgaacacttcgaaggagagaaagtcttccgggtgaatgtagaggatgagaatcatattaacatcatcagggaactggccagcaccactcagattgacttttggaaaccagattcagtaacacaaattaagccccatagtaccgtggattttagggttaaggcagaggacacagtgacagttgagaacgtgcttaaacaaaatgaactccagtacaaagtgctcatttccaacctgagaaactag

SEQ ID NO: 6474 - DNA, 471 bp, Artificial Sequence
  Description of Artificial Sequence: Synthetic coding sequence
atgctcttgctccttctcctggccccgttgtttctgagacccccgggggccggaggcgcacagacaccaaatgccacgtcagaggggtgccagatcattcatccaccttgggagggtggaatccggtacaggggattgacccgcgatcaggttaaggcgatcaacttcctccctgtggactacgagatcgaatatgtgtgtagaggtgagagggaagtggttggaccgaaggtgcgcaagtgtcttgccaatgggtcctggaccgatatggacacaccctcaaggtgcgtgaggatttgtagcaaatcatatctgaccctggaaaatggaaaagtttttcttacgggtggcgacttgccagctctagacggtgcacgagtggattttcgctgcgatcccgatttccaccttgtcggaagcagccgatctatctgttctcaggggcagtggtccacacctaaacctcattag

SEQ ID NO: 6475 - DNA, 249 bp, Artificial Sequence
  Description of Artificial Sequence: Synthetic coding sequence
atgggccgggtttttctcacgggcgagaaggccaattctatcctgaagcgttaccctcgggccaacggttttttcgaagagatccgccaagggaacatcgagcgggaatgtaaggaagaattttgcacattcgaagaggcacgcgaagcctttgagaataatgagaagaccggcttggttttgctacccagactggagtgctcttgcgaacatggcagtctgcaaccccagttacccgtgcccaaatag

SEQ ID NO: 6476 - DNA, 372 bp, Artificial Sequence
  Description of Artificial Sequence: Synthetic coding sequence
atgcaggggaccccaggaggtggaacacgaccaggtccttccccagtggacagaaggacattattggtcttttccttcatcctggcagcagcccttggccagatgaacttcaccggagatcaagtactaagagtcctggccaaggacgagaaacagttatccctgctgggggacctggaggggctaaagcctcagaaggttgacttctggcgaggacctgcgcggcccagtctgccagttgatatgcgagtgcccttcagcgagctcaaagacattaaagcctaccttgaatcccatggtctggcatacagcatcatgatcaaggatatccaggttctgctggacgaggaacgtcaggccatggccaagtag

SEQ ID NO: 6477 - DNA, 840 bp, Artificial Sequence
  Description of Artificial Sequence: Synthetic coding sequence
atggggcgcgtatttctgaccggtgaaaaggccaattcaatccttaaacgttatccacgcgcgaacgggttttttgaggagatccgccagggtaatatcgagcgtgaatgcaaagaggaattctgtacttttgaggaggctcgggaggccttcgaaaataatgagaaaaccatcacaggggtgattctcctcgccgttggggtctggggaaaactcaccctgggcacttacatttctttgatagccgagaattccacgaacgccccatacgtgcttattgggacagggaccaccattgtagtgttcgggctgttcggctgcttcgctacgtgtcggggatccccgtggatgctgaagctctatgctatgtttctgagcctggtctttttggcagaactcgtggccgggatatctggcttcgtgttccggcatgaaatcaaggacacgttcttaagaacttacactgatgcgatgcagacatacaacggcaacgacgagcgaagcagggcggttgatcatgtccagcggagtctcagttgttgtggggtgcagaactataccaattggagcacatcgccctattttcttgagcacggtatacccccttcgtgttgcatgaatgagaccgactgtaacccccaggacctgcataaccttactgtcgccgcaactaaggtaaaccagaagggttgttacgatctggttaccagttttatggagactaacatgggcatcattgctggcgtggcctttggcatcgcatttagtcagctgatcgggatgctcctcgcatgttgtctcagtcgtttcataactgctaatcagtatgaaatggtttag

SEQ ID NO: 6478 - DNA, 564 bp, Artificial Sequence
  Description of Artificial Sequence: Synthetic coding sequence
atgtggtgcgcctcccctgttgccgtcgttgctttctgtgcaggcctgctggtttcccaccctgtgctcacccagggtcaggaagctggggggcggcctggtgctgattgcgaggtatgtaaggagtttttgaaccgattttacaagagcctcatcgatcggggtgtgaatttttcgctagacacaatcgagaaggagctgatcagcttctgcttggatacaaaaggaaaggaaaatcgcctatgctactacctgggagccacaaaagatgctgccactaaaattcttagcgaggtcacacggccaatgagtgtgcatatgccagctatgaaaatatgtgaaaaacttaagaaactggatagccagatttgtgaactgaaatacgaaaaaacacttgacctggcttctgttgacctccgcaagatgcgcgtagctgaattgaaacagattttgcactcgtggggagaggaatgccgggcatgcgcggagaagaccgactacgtgaatcttattcaggagctggctcctaagtatgctgcaacccatcccaagaccgagctgtag

SEQ ID NO: 6479 - DNA, 1311 bp, Artificial Sequence
  Description of Artificial Sequence: Synthetic coding sequence
atgcaagggacccccggtggcgggacacgacccggaccctcacccgtggacagacggactctgttagttttcagctttattttagccgctgcactagggcaaatgaacttcactggtgaccaggttctgagagtccttgctaaggacgaaaaacaactgtccctccttggggacctggagggactcaagcctcagaaggtcgatttttggcgcggcccggctcgtccctccttgccagtggacatgcgtgtgccctttagtgagctgaaagatattaaggcttatctggagtcacacggcctcgcttattccatcatgattaaagatatacaggtattgctggacgaggaacggcaggcaatggcaaagtcaagaaggctagagagaagtaccaatagcttcagctattcatcataccatacgctcgaagagatctatagctggattgacaatttcgtgatggagcactcagatatagtgtctaagattcagatcggaaatagcttcgaaaatcaaagcattctcgtgctgaagttcagtacaggcggatccaggcaccctgccatctggatagataccggaatccactctcgcgagtggattacccacgcaacggggatctggacagccaacaagatcgttagcgactatgggaaggacagggtccttacagacatactcaatgctatggatatctttattgaattggtaacaaatcccgacggtttcgcttttacacactccatgaacaggctgtggcggaagaataagtcaatacgtcccgggatcttctgcataggagtcgaccttaatagaaactggaaatctggctttggagggaatgggtctaattcaaacccctgttcggaaacataccacgggcccagcccccagagcgaacctgaagtggccgccatcgtgaattttataactgcccatggcaactttaaagccctcatttccattcactcgtacagccagatgctgatgtacccctacgggcgtttattggagcccgtgtcaaatcagagagagctgtatgacttggctaaggatgcagtggaagccctctataaagtgcatgggatcgagtatatcttcggcagcatctcaacaaccctatacgtcgcttccggaattactgtggattgggcctacgatagtggcattaagtacgctttttccttcgaactgagagatacaggacagtacggatttctcctccctgccactcagatcatccctacagcccaggagacctggatggccctgagaacaatcatggaacacacattaaatcatccttattag

SEQ ID NO: 6480 - DNA, 450 bp, Artificial Sequence
  Description of Artificial Sequence: Synthetic coding sequence
atgggacgggtcttcctcactggagagaaagctaatagcattctaaaacgatatcccagggccaacggttttttcgaggagattcgccaggggaatatcgagagggagtgcaaggaggaattctgcaccttcgaggaagctcgcgaagctttcgaaaacaatgagaaaactaaggaattttggtctacttatacaaaggctcagcagggcgaaagcaatcgtggctccgattggtttcagttctatctgacgttcccgctgatcttcggcctctttatcattctcttggtaatctttctgatatggagatgcttcctccggaacaaaacaaggagacagaccgtgaccgagggccatatccctttcccccagcacctgaacattattactccgcctcccccgccagacgaagtgtttgatagtagcgggctcagtcctggattcctctag

SEQ ID NO: 6481 - DNA, 936 bp, Artificial Sequence
  Description of Artificial Sequence: Synthetic coding sequence
atgctctatcagactatcaatagtttgaaaaccaaaaatcccaagctcaagattctgctgtccattggcggctatctatttgggagcaagggattccatcccatggttgatagcagcacatcccggctggagttcatcaactctatcatcctgtttctgcggaaccataactttgacggattggacgttagttggatttacccggaccagaaggagaatacacacttcacggtccttatccacgaactagccgaagcttttcagaaggattttacaaagtcgacgaaagaacgactcctgttgacagctggagtgtcagcaggccggcagatgattgataattcctaccaggttgaaaaactggcaaaagacctcgacttcattaatcttctcagttttgattttcacgggagttgggagaagcccttgataaccggccataatagcccactctctaagggatggcaggatcgcggcccgtcaagttactataacgtggagtacgctgtcgggtattggattcacaaaggcatgcctagtgagaaagttgtgatgggtattcccacgtatggccacagtttcaccttggctagcgctgagacaacggtgggtgcccctgcctcaggccccggcgccgctggacccatcaccgaaagctctggcttcctcgcctattacgagatatgccagtttttgaagggtgccaaaataactcgcttgcaagatcagcaggtcccctacgcggtgaaggggaaccagtgggtgggatatgatgacgtaaaatcaatggaaactaaggtgcagtttctgaagaatctcaacctcggcggagcaatgatttggtcaatcgacatggatgacttcacaggtaagtcatgcaatcagggaccatatcccctagttcaggccgtgaagcgctcactgggctctttgtag

SEQ ID NO: 6482 - DNA, 621 bp, Artificial Sequence
  Description of Artificial Sequence: Synthetic coding sequence
atggatactattttcctctggtcgttactcctcctgttctttggttctcaggcttcacggtgctctgcccagaaaaacaccgaatttgccgtcgacctataccaagaggtgagcttgtcccacaaggacaacattattttttcccctctgggtattactttggtcctggagatggttcagctgggggccaaggggaaagctcagcagcagattcgtcagacattgaagcaacaggagacctctgccggggaggaattcttcgtattgaagtccttctttagcgccatctcggagaaaaagcaggaattcacttttaacctcgccaacgcactctatctgcaggaaggcttcaccgtcaaagaacagtaccttcacggaaataaggagtttttccaaagcgccatcaagttggtggactttcaggacgccaaggcgtgtgccgaaatgatctctacatgggttgagaggaagacagatggtaaaataaaggatatgtttagtggcgaagagtttggtcctcttacccgtctcgtgctcgtaaacgctatctacttcaagggagactggaaacagaaattccgaaaggaggacacccagctgatcaactttacaaagaagtag

SEQ ID NO: 6483 - DNA, 1218 bp, Artificial Sequence
  Description of Artificial Sequence: Synthetic coding sequence
atggatacaatatttctctggagtcttcttcttctgttttttgggtcacaggcctcaaggtgcagcgcgcagaagaacacagaattcgctgtggatctgtaccaggaagtaagcctgtcccataaggacaacattatattcagtccactgggcataacgctggtgctggagatggttcagctgggcgctaaggggaaggctcagcagcagatcagacagaccctgaagcagcaggagacgagtgcaggcgaagagttcttcgtcctaaagtccttttttagcgcaataagcgagaaaaagcaggagtttacatttaatctagccaatgccttgtatctccaggaggggtttaccgtgaaagagcagtacctgcacggcaataaagagtttttccagtccgcaatcaagctggtggacttccaggacgctaaagcctgcgccgaaatgatcagtacttgggtcgaaaggaagactgacggaaagatcaaggacatgttcagtggtgaagaattcggacctctgactaggctggtgctcgtgaacgctatttacttcaagggcgactggaagcaaaagttccgtaaggaagatacacagttgatcaattttacaaagaagaatggaagtactgtgaagatcccgatgatgaaggctctgcttaggactaagtacggctatttctccgagtcctcactcaactaccaggttctcgagctttcctacaaaggagatgaattttcactcatcattatcctgcctgcagaaggaatggacattgaggaagtggaaaaattgataacagctcaacagattttaaaatggctttccgagatgcaggaggaggaggtcgagatcagcctgccgcgcttcaaagtggaacagaaggttgatttcaaggatgtgttgtacagcctcaacatcaccgaaattttttcggggggctgtgatctgtcgggcatcacggactcttctgaagtatacgttagccaggtgacacagaaggtattctttgaaatcaatgaagatgggtcagaggccgccacttccacgggaattcacatacctgtgatcatgtctttggcccagagccagttcattgcaaaccacccattcctgtttatcatgaaacataaccccactgagagcattctgtttatggggcgcgtgactaacccggatacccaggaaatcaagggacgtgatctggattcactatag

SEQ ID NO: 6484 - DNA, 399 bp, Artificial Sequence
  Description of Artificial Sequence: Synthetic coding sequence
atgctcatcttctggacaattaccctgtttctgcttggcgcagcaaaaggaaaagaggtatgttatgaggatttggggtgcttctctgatacagaaccctggggaggaactgcaatccgcccacttaagatcctgccatggagcccagagaaaatcggcactaggttccttctctacaccaatgaaaacccaaataatttccagatcctgcttctaagcgacccatccactatcgaggcttccaattttcagatggacagaaaaacacggttcataatccacgggttcattgacaaaggagatgaatcctgggttaccgatatgtgcaaaaagttgttcgaggtagaggaagttaattgcatctgcgtggattggaagaagggaagtcaggccacatag

SEQ ID NO: 6485 - DNA, 606 bp, Artificial Sequence
  Description of Artificial Sequence: Synthetic coding sequence
atgaaggtccatatgttagtaggtgtgctagtgatggtaggatttaccgtcggaaaggtgccggttcccgatattcgtacatgccatttctgcctggtggaggatccaagtgtcggttgcataagcgggtcggaaaagtgcacaattagctcttccagcctgtgtatggtgatcaccatctactacgatgtgaaggttaggtttatcgtcagaggatgtggccaatacattagctataggtgtcaagagaagcggaacacatactttgcagagtactggtaccaggcgcagtgctgtcagtacgactattgtaatagctggtccagcccgcaactgcagagcagtttgccagagccccacgaccgcccactcgcacttcctctctccgactcacaaattcagtggttttatcaagcactcaatctctctcttcctctgccaaattttcatgccgggaccgagcccgacggccttgatcccatggtgactctatccctgaacctaggcttgtcatttgcagaactgcggcggatgtacttattcttaaactccagtggacttcttgtgctgccacaggcaggccttcttacacctcacccatcctag

SEQ ID NO: 6486 - DNA, 1086 bp, Artificial Sequence
  Description of Artificial Sequence: Synthetic coding sequence
atggccagcctcgggctgctccttttgctgctcttaaccgcgctaccacccctctggtcctcttcattgccaggtttagacactgccgaatctaaggcgactatcgccgacctaattcttagtgctctcgaaagggccaccgtttttctggaacagaggctgccagagatcaacctcgatggtatggtgggcgtgagggtcctcgaggagcagctgaaatctgtgcgcgaaaaatgggcccaggaacccttactacagccgctgtcattaagggtggggatgctcggggagaagctggaagccgcaatccagcgtagtcttcattacctgaagctgtccgacccaaagtacctgagagaatttcagttgacgctgcagcccgggttttggaagctgccccatgcgtggatacataccgatgccagtttagtctatccaacattcggaccccaggactccttctctgaggaaaggtctgatgtctgtcttgtgcagttgctcgggaccggcactgactctagtgaaccttgtggcctaagcgacctgtgccgaagtttaatgactaagccaggatgctccggctactgtctcagccaccaactcctgttcttcttatgggcacggatgcgcgggtgtactcagggacctcttcagcagagccaggactatatcaacctattttgtgccaacatgatggatctgaacagaagggccgaggcaatcgggtacgcctaccctaccagggacattttcatggagaacatcatgttttgtggaatgggtggattctccgacttctataaactgagatggctggaggccatcctttcttggcagaagcagcaggagggatgttttggggagcccgacgccgaagacgaggagctgtccaaagccatacagtaccagcagcacttctctcgccgggtgaagcgccgcgagaaacaatttcctgacggatgttcttcacataatacggccaccgccgtggccgcgctgggtgggtttctgtatatcttggccgaatacccccccgccaaccgcgaacctcacccttctaccccgccacctccctcaagtcgatag

SEQ ID NO: 6487 - DNA, 162 bp, Artificial Sequence
  Description of Artificial Sequence: Synthetic coding sequence
atgtggacgaacttcttcaaattaaggctgttttgctgtcttcttgcggtgctgatggtagttgtgctggttattaacgttacacaggtcgaatacttggaccacgaaacagtttctgcgacgtttatcgattcctcgggccaattcgtatccagccagtag

SEQ ID NO: 6488 - DNA, 1305 bp, Artificial Sequence
  Description of Artificial Sequence: Synthetic coding sequence
atggcatcgcttggccttctgctgttgctcctccttaccgccctcccccctctctggtcaagcagcctgcccggccttgatacggccgagtctaaagcaaccattgctgatcttattctgagtgccctggagagggccacggttttcctggagcagaggttgcctgagataaatttagacgggatggtgggagttagagttctggaggagcagctgaaatcggttagagagaagtgggcgcaagagcctctgctccagccattatccctgagggttggcatgctgggggaaaagctcgaggccgccatacagagatctctgcactatcttaaactatcagaccctaaatatctccgcgaatttcaattgacactccaaccaggtttttggaaactgcctcacgcctggattcacacagatgcgagcctagtgtacccaacttttggtcctcaagattccttctccgaggagcggtctgatgtgtgcttggttcaacttctgggcactgggaccgactcatcggaaccctgtggcctctcggacctttgtaggagcttaatgaccaaacctgggtgtagcggctattgcttgtcacaccagcttctttttttcttatgggcccggatgcgaggttgtacgcagggacctcttcagcagagtcaagattacatcaatctcttttgcgcaaacatgatggacttgaatcgcagagcggaagctatcggctatgcataccctacgcgggatatcttcatggaaaacagtgtgacgggccaccccgtgttctacctgcccctttgcgactcttttctgccacctaaagctgcaccagtaaccgagttgtatacggatggtcctgtcatgttctgcggcatgggcggcttctcagacttctataaacttagatggttggaggcaattctatcatggcagaaacagcaggaagggtgtttcggcgaacccgatgcagaagatgaagagctgtcaaaggccatccagtaccagcagcactttagtagacgtgttaagagaagagaaaaacaatttcccgattctagatccgtggcccaagccggggttcaatggagaaatctcggctcgctgcaaccccttcccccaggcttcaagcaattcagctgtctgattcttcctagttcttgggactaccggtccgtccccccatacctagccaacttctacatcttcctggtggagaccggctttcatcatgtggcccatgcaggacttgagctgctgatctcaagagatcctccaacgagcggctcacaatctgtaggcttatag

SEQ ID NO: 6489 - DNA, 1311 bp, Artificial Sequence
  Description of Artificial Sequence: Synthetic coding sequence
atgcagggaacacctggcggcggcaccaggcctggtccgagtccagtagataggaggactctactcgtgttttcttttatattagcggctgcattaggtcagatgaactttactggcgaccaggttctccgcgtgctggctaaggacgagaaacaattgagcttgttgggcgacctggagggtctgaagcctcagaaggtggacttttggcggggccccgcccgacccagcttgcccgttgatatgagagtgcccttttctgaattgaaggacattaaggcctatctggagtcgcatgggctagcttattcaataatgataaaggacattcaggttctgctggacgaggagaggcaagcgatggctaagagtaggagactggagcgaagtacaaattcattttcatacagttcctaccacaccctggaagagatctactcatggatcgacaatttcgttatggagcatagcgacattgtgagcaagatccaaatcgggaacagcttcgagaaccagtccattctggtcctcaagttcagcactgggggatctcgccaccctgccatttggattgatacaggcatccactccagagaatggatcacacacgcaacaggcatctggacagcgaataagattgtgtcagattatggcaaagatagagtgctgaccgatatacttaatgcaatggacattttcattgagctggtgactaatccagacggctttgcgttcacccattccatgaaccggctgtggagaaaaaacaagagtatcagacctgggatcttttgtataggcgtggacctgaaccgaaactggaaatcaggatttggaggtaacgggagcaatagcaacccgtgctccgagacctaccacggcccatcacctcaaagcgagcccgaagtcgctgccatagtgaatttcatcactgcccacggcaacttcaaagccctgataagcattcatagttactcccagatgctcatgtatccctatgggcgacttcttgagcctgtatccaatcaacgggagctgtacgacctcgcaaaggacgcagttgaggctctgtacaaggtgcacggcattgaatacatcttcgggtccataagtaccaccttgtatgtggctagtggaatcacagtggactgggcttacgacagtggcatcaagtatgctttctcatttgaactacgggatacaggccaatacggttttcttttgcccgcgactcagatcatccctaccgcccaggaaacatggatggcgctgaggacaataatggaacacacgctcaatcacccttactag

SEQ ID NO: 6490 - DNA, 1218 bp, Artificial Sequence
  Description of Artificial Sequence: Synthetic coding sequence
atggacactatctttctgtggtcactcctgctacttttttttggaagccaggcatcacgttgctctgctcaaaaaaatacagagtttgctgtggatctgtaccaggaggtttctttgtcccacaaggataacatcatattcagccccctcggtataacactggttctggagatggtccaactgggcgctaagggcaaggctcaacagcagattcgacagactctcaaacaacaggaaacttccgccggggaagagttcttcgtgctgaaatcttttttctccgccatcagcgaaaagaagcaggaatttacgtttaatctagccaacgctttgtacttgcaggaaggtttcactgttaaggagcaatacttgcacggtaacaaagagttcttccagagcgccattaagctggtcgactttcaggacgcaaaagcatgcgctgaaatgatctcaacttgggtggaaagaaagactgacggaaagattaaggacatgtttagtggggaagagtttggaccactgacgcgcctggtgctggtcaatgcgatctatttcaagggggactggaagcaaaaattcagaaaagaagacacgcagcttatcaacttcaccaagaaaaacggatctactgtcaagatccccatgatgaaagctctgcttagaactaaatatggctacttctcagaaagctctttgaattaccaggtgcttgagttatcatacaaaggagacgaattctcgctgataataatactccctgccgagggaatggacattgaggaggttgagaagctgatcaccgctcaacagattctgaagtggctatctgaaatgcaggaggaagaggtggaaatctccctaccacgttttaaagttgagcagaaggtggactttaaggacgtactctattctctaaatatcacagagatattttctggaggctgtgatctctccgggattaccgactcaagtgaagtttatgtcagtcaggtgacacagaaagtgttcttcgagattaatgaagatggatccgaggccgcaacttctacaggcatccatatacccgtaattatgtccctcgcgcagagccagttcattgccaatcaccctttcctttttattatgaagcacaatccaactgagagcatcctgttcatgggaagagtgacaaacccagatactcaggagatcaagggcagggatctcgatagcctctag

SEQ ID NO: 6491 - DNA, 510 bp, Artificial Sequence
  Description of Artificial Sequence: Synthetic coding sequence
atgctgtaccagacaataaacagcctcaagacgaagaatccgaagcttaagatattgctgtccattggaggatatctgttcggaagcaaaggctttcatcccatggttgattcctcaacaagtagactcgagttcattaatagtataatacttttcctgcgcaatcataactttgatggcctagacgtttcctggatctacccagaccagaaagagaacacacactttacagtgctgatccatgagttggcagaggcctttcagaaagacttcacgaagtccacaaaggagcgactcctgctcacggccggcgtctccgccggacgccaaatgatcgataactcttatcaggttgaaaagctcgccaaagatttggacttcatcaatttactgtcctttgacttccacgggagctgggaaaagcccctgataaccgggcacaatagccctttaagcaaagggtggcaggatcggggtccttctagctactataacgtggaatatgcgtag

SEQ ID NO: 6492 - DNA, 1209 bp, Artificial Sequence
  Description of Artificial Sequence: Synthetic coding sequence
atggcctccctgggactgctattgctgttgttgctgacagcattgccaccgctatggtccagcagtttgccaggcctggacactgctgaatccaaggcgaccatcgcggatttgattttaagcgcactcgaaagggccacggtattccttgagcagcgcttaccagagatcaacttggatggcatggtgggcgtgagagtactggaggaacagctgaagagtgtaagggaaaagtgggcacaggaacctctgctgcaacccctgagtctccgtgttgggatgctaggcgagaaactcgaggccgccatccaacggtcattacactaccttaaattgtcagaccctaagtacctacgcgagtttcaactcacactccagcccggattctggaaactgcctcacgcgtggatccatacagacgctagcctcgtctacccaacttttggcccccaagactcattctctgaggaacgtagcgacgtgtgtctggtacagttgctgggaactggcaccgattcaagtgagccttgcggactcagtgacctctgcaggagccttatgactaaaccaggctgtagcggctactgcctgtcacaccagctcctgtttttcctgtgggcccgcatgaggggctgcacccagggtcccctgcagcagagtcaagactatatcaatctgttttgcgccaatatgatggatctcaatcggagagccgaagccatcggctatgcctaccctactcgggatatctttatggagaatatcatgttttgcgggatggggggatttagcgatttttataaattaaggtggttagaggctattctatcttggcagaagcagcaggagggttgcttcggcgagcccgatgcggaagacgaagaactgtctaaagccattcagtatcagcaacatttcagcagaagagtgaagcgacgggagaagcagttcccagattcgagatctgtggcccaggctggcgtacagtggaggaatctaggctcattgcagcctttacctccaggatttaaacaattctcatgtctgatcctgcctagctcatgggactaccggtcagttccgccctacttggcaaacttctatatatttttagtcgaaaccggcttccatcacgtcgcacatgccggcctcgaactgttgatctctcgggatccaccaacctctggctcgcagtcggtgggcctttag

SEQ ID NO: 6493 - DNA, 1680 bp, Artificial Sequence
  Description of Artificial Sequence: Synthetic coding sequence
atgtggacaaacttttttaaattaaggctattctgttgtcttctggctgtcctgatggtggtggtcctggtaatcaatgttactcaggtggaatatctggaccatgagacagtgagcgccacattcatcgactcaagtggccagttcgtctccagtcaagtcaccggtatctcacgaaatccatattgcggctacgaccagcagaccctttcgagccaggagaggatggaggaggactcactgctggccgctttgcatcgacaagttcctgacgtgggccccgtgccctttgtgaagagcactgaccccagtagttcctactttgtcatcctcaacagcgctgcattctttaaggtcgggagtcagctagaagtgttggtgcacgtgcaggactttcaacggaaaccgaaaaaatacggaggtgattacctgcaagcaagaattcactccctcaaactccaagcgggggccgtgggccgggtagtagactatcaaaacggattttataaggtattttttacactgctgtggccaggcaaagtcaaggtctccgtcagcctggtgcatccttcggaggggatcagggtgctgcagcggctacaggaggataagccggaccgggtctactttaagagcttatttcggtccggccggatctcagagaccactgagtgcaatgtgtgtcttcctggaaacctgcctctgtgtaactttacggacctttacaccggtgagccctggttttgttttaagccgaagaagctgccatgctccagtcgaattacacactttaaaggtgggtaccttaaaggactcttgaccgccgccgagtccgctttcttccagtctggggtgaatattaagatgcctgtgaactcttctggcccagactgggttaccgtaattccacgccgcattaaggagacgaattccctcgagctgtctcaaggctctggaacatttccgagtggttattactataaggaccagtggcgtccgagaaagttcaaaatgcggcagtttaatgacccagacaatatcacagaatgcctgcagcgtaaagttgtgcatctcttcggggatagcaccatcaggcagtggttcgaatacttgaccactttcgtccccgaccttgtggagttcaatctcggtagtcctaagaacgtgggaccctttctcgccgttgaccagaagcacaacattctgctcaagtatcggtgtcatggaccccctattcgattcacaaccgtattttctaacgagttgcactacgttgccaacgaactgaatggaatcgtgggtgggaagaatactgtcgtggctattgccgtgtggtcgcacttctcaacattcccactggaagtgtatattagacgcctgcggaacatcagacgggccgtggtccgcctgttagaccgtagtccaaaaacggtggttgtgattcggacagcgaatgctcaggaactgggccctgaggtgagtctgttcaactccgactggtacaactttcagttggacacgatcctccgtcgtatgttttctggagtcggcgtgtatctggtggacgcatgggaaatgaccctagctcactacctgcctcataaactgcatccggacgaagtgattgtaaaaaatcaactcgacatgtttttatcatttgtttgccctcttgagacatag

SEQ ID NO: 6494 - DNA, 402 bp, Artificial Sequence
  Description of Artificial Sequence: Synthetic coding sequence
atggccatggtgtccgctatgtcttgggtcctttacttatggataagtgcatgcgccatgctactttgccacggctcgctccagcatacattccagcagcatcacctccatagaccagaggggggcacctgcgaagtcatagccgcacatcggtgctgtaataaaaaccgaatcgaggagcgcagtcagacagtgaaatgcagttgcctacccggaaaggtggctggaacgacaagaaacaggccttcctgtgtcgacgcatctattgtgatcggcaaatggtggtgtgaaatggaaccatgcttagaaggcgaagagtgcaagacgctgcctgataattcgggatggatgtgtgcaaccggcaacaagatcaaaaccacaagaattcaccctagaacttag

SEQ ID NO: 6495 - DNA, 606 bp, Artificial Sequence
  Description of Artificial Sequence: Synthetic coding sequence
atgaaagtgcatatgctggtcggagtgctagtgatggtgggattcaccgtggggaaggtgccggttccagatatccgaacctgtcacttttgtcttgtagaggaccctagcgtagggtgtatcagcggctccgaaaagtgcacaattagtagtagttcactgtgtatggtgataaccatctactacgatgttaaagtgcgcttcattgtgcgcggctgtggacaatatatctcatatcggtgccaggagaaaagaaacacttactttgcggaatactggtaccaggcacagtgttgtcagtatgactactgtaattcatggtctagcccacaacttcaaagctccttacctgaaccccatgatcggccgctggcactgcccctgtccgactcccaaatccaatggttttatcaggccctaaatctatctctcccactgcccaatttccacgccggcacagaacccgatggactcgacccaatggtaaccctcagtctgaacctcggcctgtcctttgcggagttgcggcgtatgtatctcttcctgaactcttccggacttcttgtgctgcctcaggccgggctcttgacccctcatccctcctag

SEQ ID NO: 6496 - DNA, 606 bp, Artificial Sequence
  Description of Artificial Sequence: Synthetic coding sequence
atgaaggtccatatgctcgtaggtgtcctcgtaatggtggggttcactgttggaaaagtgcccgtgcccgacatcagaacctgccacttctgcctggtggaggatccaagtgtgggatgtatctcaggttcagagaagtgcacaatctcaagcagcagtctgtgcatggttataactatatactatgatgtaaaagtgcgattcatcgtccgcgggtgtggccaatacatcagttataggtgtcaggaaaaacgcaatacctattttgcagagtattggtatcaagcacagtgttgccagtacgactactgcaacagctggtcctccccccagctacaatcgtcacttccagaaccccacgatagaccactggctttaccgctatcagacagtcaaattcagtggttttatcaggccctcaacttgagcctgccccttcccaatttccacgcagggactgagccagatggcctcgacccgatggttacgcttagtttgaatcttggtctgtcttttgctgagctgcgccggatgtatttatttctgaattcttccggcttactggttcttccccaagctggactcctcacgcctcacccttcttag

SEQ ID NO: 6497 - DNA, 732 bp, Artificial Sequence
  Description of Artificial Sequence: Synthetic coding sequence
atgggcccggaggcactgtcgagtttgttgctgttgcttctcgtggcctcgggggatgcagatatgaaaggacacttcgaccctgcaaaatgccgctacgccctggggatgcaggacaggaccatacctgactctgacataagtgcctctagttcctggtctgacagcactgcagcacgtcactccagactcgagtcgagtgatggagacggggcatggtgtccagccggttctgtgtttcctaaggaagaggagtatctgcaggtggacctgcaaaggctgcacctggtggcccttgttggcacacaaggccgccatgccggcggtcttggaaaagagttcagccggagttatagactgagatacagcagagacggcaggcggtggatgggatggaaggacaggtggggtcaggaggttattagcggcaacgaagaccctgagggtgtggtacttaaggacctggggccacctatggtggcccgccttgttcgattttaccctcgcgccgaccgcgtgatgtctgtgtgcctgagagtggaattgtatggctgtctttggagagactgttcgatgggcgtatgggccagctggcagatggtgtggtggggatggatgacgctcggccgggtgcgctcctgtgggagtgggcaggcaatgacgatgtgggatggtgcaacaacggcctcacccgtcgcgatgtggcgctggagtctctccttgactggatag

SEQ ID NO: 6498 - DNA, 258 bp, Artificial Sequence
  Description of Artificial Sequence: Synthetic coding sequence
atgaaaatacctgtgttaccagcagtggttctgctttccctcctcgtgctgcacagtgcccaaggagcaaccctggggggcccggaagaagaatccacgatcgagaactatgcctcccggcctgaggcttttaaagctgacgagttcttaaactggcacgctttgtttgagagcatcaaaaggaagctcccgtttcttaactgggacgcctttcctaagttgaagggccttaggagtgccactccagacgctcagtag

SEQ ID NO: 6499 - DNA, 348 bp, Artificial Sequence
  Description of Artificial Sequence: Synthetic coding sequence
atggggcgggtgttcctgaccggtgagaaggccaatagtatcttgaagagatatccaagagctaatgggttcttcgaagagatcaggcaagggaacattgaaagggagtgtaaggaggaattttgcacgttcgaggaggctcgagaggcattcgaaaataacgagaaaaccaaggaattctggtccacctatactaaggcacagcagggcgaaagcaatcggggcagcgattggttccagttctatttgaccttccccctgatcttcggactgtttattatcctgttggtgatctttctgatctggcgctgcttcctgcgcaataaaacccgacgacagacggtttag

SEQ ID NO: 6500 - DNA, 606 bp, Artificial Sequence
  Description of Artificial Sequence: Synthetic coding sequence
atgaaagtgcacatgttagtgggggtactcgtgatggtcgggttcactgtgggcaaagtgccggtccctgacataaggacttgtcacttttgcctggttgaggatccatccgtgggctgcatcagcggctcagaaaaatgtactatttcatcgagcagcctgtgcatggtgattactatctactacgacgtgaaggtgcggtttatcgttcgagggtgcggacagtacatctcctaccgatgtcaagaaaagcggaatacctatttcgccgaatattggtatcaggctcagtgttgtcagtatgactattgtaacagctggagttccccgcaattacagtcttcactccccgaaccccacgaccgtccactggctttaccattatccgattcccaaattcagtggttttatcaggccctcaaccttagtttgcctctgcccaacttccatgccggcacagaaccagacgggcttgatcccatggtgactctttcactgaatctcgggctctcttttgccgagttgcgcaggatgtatctttttttgaattcttctggcctgctggtcttgcctcaagcaggcctactgacaccccatccctcctag

SEQ ID NO: 6501 - DNA, 1311 bp, Artificial Sequence
  Description of Artificial Sequence: Synthetic coding sequence
atgcagggtacgcctggcggcggcacaagacccggaccgagcccagtggacaggcggacactcctggttttctcctttatcctcgccgcagctctggggcagatgaacttcaccggagatcaagtcctgcgggttttagctaaagatgagaaacagttatctctcctcggcgatctcgaaggccttaaacctcagaaggttgacttctggcggggccctgctcgtccctctttacctgtggatatgcgtgtgccattctcagagcttaaggatatcaaagcatatttggaatctcatggactggcttatagcatcatgattaaagacatccaagtcctgctcgacgaggagcgtcaagcaatggctaagtcaaggcgactcgagcgatctacaaattctttctcttacagtagttatcatacactggaagagatttactcctggattgacaactttgtgatggaacattctgatattgtcagcaaaattcagataggtaacagctttgagaaccagtcaattctggtgctgaaattctctaccgggggctcccgtcatcctgccatctggatcgatacagggatccactcaagagaatggatcacccacgctaccgggatttggactgctaataaaatcgtctctgattacggcaaggatagagtcctcactgacatcctgaacgcaatggatatcttcatcgaactggtaacaaatcccgacggatttgctttcacccactccatgaacagactctggaggaagaacaaatccatccgtccggggattttttgcataggagtggacttgaacagaaactggaagtccggcttcggaggcaacgggagtaactcaaacccatgcagcgagacctatcacggcccaagcccccagtccgagcctgaggttgccgcaattgttaacttcattacagctcatggcaacttcaaagccctgattagcatccactcctattcgcaaatgttgatgtatccgtatgggagactgctcgagcctgttagcaatcagagggaactgtacgacctggccaaagacgccgtggaggcgctgtataaagtgcacggaattgaatatatcttcggctctatttcaactacgttgtatgtggcaagcggaataacagtcgattgggcttatgattccgggataaagtatgcattctctttcgaacttagggacaccggtcagtacggatttctgcttcctgccacccagattatacccaccgcccaggaaacatggatggctctccggactataatggaacacacactcaatcatccgtactag

SEQ ID NO: 6502 - DNA, 606 bp, Artificial Sequence
  Description of Artificial Sequence: Synthetic coding sequence
atgggcgcaacaacaatggaccagaagtcactctgggcaggcgtcgtggttctccttttactacagggcggctccgcctataaactggtctgttattttactaattggagtcaggacagacaggaacccggaaagtttacccccgagaatatcgacccctttctgtgtagtcatcttatctattcgttcgcttctatagaaaacaacaaggtgataatcaaagacaagtccgaggtgatgttatatcagactataaatagccttaaaactaagaatccgaagctcaagatccttctttctatcggcggatatctgttcggcagcaaaggatttcatcctatggtcgactcctccacctcaaggctggagtttatcaacagtatcatcctctttctgcgcaatcacaactttgatgggttggatgtctcttggatctaccccgatcagaaagaaaacactcactttaccgtactgatccacgaacttgctgaggcctttcagaaagacttcaccaagtctactaaagaacgtctgctgttaactgccggggtgtctgctggccggcaaatgatagataactcataccaggtagagaaactcgcctag

SEQ ID NO: 6503 - DNA, 75 bp, Artificial Sequence
  Description of Artificial Sequence: Synthetic coding sequence
atgcttgttgatggcccgagcgaacgtccagcattgtgtttcctactcttggccgtagccatgtcattcttctag

SEQ ID NO: 6504 - DNA, 252 bp, Artificial Sequence
  Description of Artificial Sequence: Synthetic coding sequence
atgcggccccgcgggcttccccctttgctagtagtcctgctgggatgctgggcaagtgtgagtgctcagactgacgcaaccccggcagtgaccaccgaagggctgaactccactgaggccgcactggccacatttggaacattcccttccacgcggcccccgggtacaccccgggctcccggaccatcttctggccccaggccaacccccgtgactgacgggagccattctgtgacccaggctggtgtatag

SEQ ID NO: 6505 - DNA, 1254 bp, Artificial Sequence
  Description of Artificial Sequence: Synthetic coding sequence
atgcttgcgcttctcgttctcgtcaccgtcgcattagccagcgctcaccatgggggggaacatttcgagggggaaaaagtattccgtgtcaatgtggaggatgagaaccatattaacatcattcgtgaactcgcatccactactcagatagacttctggaagcccgactccgtgacacaaatcaaaccgcactccaccgtcgacttcagggtgaaagccgaggatacagtgaccgtcgagaacgtgctgaagcagaacgaactccagtataaggtactgatctccaacttacgtaacgttgtcgaggcccagttcgatagcagggttcgtgcaactgggcatagctatgaaaagtataataagtgggagacaatcgaggcatggacccagcaggtagctactgagaacccagcactgatttcccggtcagtgatcggcacgacattcgagggaagggctatatatctattaaaagtgggcaaggctggtcagaataaacccgcaatttttatggattgcgggtttcatgccagggagtggatctcccctgccttttgccaatggttcgtgcgagaggccgtgcgaacatatgggagggagatacaagtcaccgaacttcttgataaactggacttttacgttttacctgtgctgaacatcgacggctacatctacacttggacaaagagtaggttttggagaaaaacgcgctccacccatacagggagttcctgcattggcaccgatccgaataggaacttcgacgccggatggtgcgagataggagctagcaggaatccctgcgacgagacgtactgcggtccggccgcagagagtgaaaaggagaccaaagcactcgcagacttcatcaggaataaactatcaagtataaaagcatatcttacgatacatagttatagtcaaatgatgatatacccatattcttacgcctataaacttggcgaaaacaatgcagagctgaacgccctggccaaggccactgtgaaggagctggctagcctccacggcacaaaatacacttacggtccaggagcaacaacaatttacccagcagctggaggtagcgatgactgggcttatgaccagggtatccgctattcatttacctttgagctgcgagacaccggtcgatatggcttcctactgcctgaatctcagatcagagccacctgtgaggaaacttttttggcaatcaagtacgtagccagctacgtgctcgagcatctctattag

SEQ ID NO: 6506 - DNA, 1680 bp, Artificial Sequence
  Description of Artificial Sequence: Synthetic coding sequence
atgtggaccaatttttttaagctgaggctcttctgctgcttgctcgccgtgttgatggtggtggtgctggtgatcaatgttacccaggtggagtatttggatcacgagaccgtcagcgccaccttcattgattcctccggtcagtttgtgagcagtcaggtcaccgggatcagcaggaacccgtactgtggctacgaccagcagaccttatctagtcaggagcgcatggaggaggattctttgctggcagccctccacaggcaagtccctgacgtgggccccgtgccatttgttaagtctaccgaccctagcagcagttacttcgtcatactgaactcagctgctttttttaaggtgggcagtcagctagaggtgctggtgcatgtgcaggactttcagcggaaaccaaagaagtatgggggagactacctgcaggccaggatccacagcctcaagcttcaggcaggcgctgtgggccgagtggtcgattatcagaatggcttctataaggttttcttcacccttctgtggcccggcaaagtcaaagtgtctgtgtccctcgtgcaccccagcgaaggtataagagtactccagaggctccaagaggataaacccgatagagtttactttaagtcattgtttcgatcagggcgtatcagcgaaactaccgagtgcaacgtgtgcttgcctggaaacttaccactttgtaatttcaccgatctgtacaccggagaaccttggttctgctttaagcctaaaaagctcccctgtagctcccgtatcacacattttaaaggcgggtacctgaaaggcctgctgacagccgcggagagcgcattcttccagtctggagttaatatcaagatgcccgtcaattcttccgggcctgactgggtgaccgtgatacctaggcggattaaggagactaactccctggagctctctcaggggagcgggacctttcctagcgggtactattacaaggaccagtggcgccctaggaagttcaagatgcggcagttcaacgacccagataacattacagaatgtctccagagaaaagtcgtgcatcttttcggcgacagcactatacgtcaatggttcgagtacctgactacgttcgtgccagacctcgtcgagtttaacttgggatccccaaaaaatgtgggaccattcctggccgtggatcagaagcacaacatcctgctaaaatacaggtgccacggaccacccattcgtttcacgaccgtgttttccaatgaactgcattacgtcgccaacgagctaaacggaatcgtaggtgggaaaaacacggttgtggcaatcgcagtttggtcacacttttccacattccccctggaagtgtatatccgtcgcttgaggaacattcggagagccgtggttcgactcctggatcggagccccaagaccgtcgttgtgattcggaccgcaaacgcacaggaacttggccccgaggtcagcctctttaatagcgattggtacaattttcaactggataccatcttacggcggatgttttcgggcgtgggcgtgtacttagtggacgcttgggagatgacattagcccattacttgccacataagctgcacccggatgaggtgatcgtcaaaaaccaattagatatgttcctgtcgtttgtctgccctctagaaacctag

SEQ ID NO: 6507 - DNA, 99 bp, Artificial Sequence
  Description of Artificial Sequence: Synthetic coding sequence
atgcagggcacccccggcggaggcacaagaccaggtccttccccagtagaccggcggaccctgttggtattctcctttatcctggccgcggcgctgtag

SEQ ID NO: 6508 - DNA, 180 bp, Artificial Sequence
  Description of Artificial Sequence: Synthetic coding sequence
atgctggccctcctcgtgctggtgaccgttgccctcgccagcgctcaccacggtggcgagcacttcgagggagagaaagtattccgggtgaacgtagaggacgagaatcacatcaatataatccgtgagctggcttcaaccacccagattgatttctggaagcctgacagtgtcacgtag

SEQ ID NO: 6509 - DNA, 303 bp, Artificial Sequence
  Description of Artificial Sequence: Synthetic coding sequence
atgcggccacgcggtttacccccccttctggtcgtactgctgggttgctgggcctctgtgagtgctcagacagacgcgaccccagccgtgactacagaaggactgaacagcaccgaggcagcactggccaccttcggcacatttccttcgacaaggcctcctggcacaccgagggcaccaggtcctagcagcggcccgcggcctacacccgttactgacggggggtaccatgtacctgcgccgggcgtgcatagcgaccctacaagtcgcggccagccaagatgttgttctctatgtctgtag

SEQ ID NO: 6510 - DNA, 234 bp, Artificial Sequence
  Description of Artificial Sequence: Synthetic coding sequence
atgcgctcccctcgcatgagggtgtgcgctaaaagtgtgctacttagccactggctatttttggcttacgttctgatggtttgttgcaagctgatgtccgcttcctcacagcatctcagggggcatgcaggtcaccaccagataaaacaggggacatgtgaagtcgtcgccgtgcatcggtgctgtaataagaaccgtatcgaagaaaggagtcagaccgtaaagtgttcttag

SEQ ID NO: 6511 - DNA, 12 bp, Artificial Sequence
  Description of Artificial Sequence: Synthetic coding sequence
atgtggacctag

SEQ ID NO: 6512 - DNA, 402 bp, Artificial Sequence
  Description of Artificial Sequence: Synthetic coding sequence
atggccatggtctcagctatgagctgggttctgtacctgtggatctctgcatgcgccatgcttctttgccacgggtcgctacagcacacattccagcagcaccacttgcaccggcctgagggcggcacctgtgaggtgattgcagcccaccgatgctgtaataagaataggattgaagagagatctcagacggttaagtgttcatgtttgccaggcaaagtcgccggaacaaccagaaacaggcctagttgtgtcgatgcctctatagtgattggcaagtggtggtgcgagatggaaccgtgtctagaaggggaggaatgcaaaaccctgccggataactccggctggatgtgcgctaccggcaataagattaaaacaaccaggattcacccaaggacctag

SEQ ID NO: 6513 - DNA, 600 bp, Artificial Sequence
  Description of Artificial Sequence: Synthetic coding sequence
atgacaatgaggcataattggaccccagatctcagtcccttgtgggttctcctgctctgcgctcacgtggtcactttgctggtgcgcgctacccctgtttcacagaccactacagccgctactgcctctgtccggtcaacaaaagatccttgtccctcacagccgcctgtgttccctgctgccaagcagtgccccgctctagaagtaacctggcccgaagttgaggtgccactgaacgggacgctatcactgtcatgtgtagcttgctcccgattcccaaacttttcgattctatactggttaggaaatggctccttcatagaacatctgccaggtagactatgggaaggcagcaccagcagggaacgggggtctaccggaacacagctttgtaaggctttggtgctcgagcagttgaccccggcactgcacagtacgaactttagctgcgtgcttgtggacccagaacaggttgttcagcggcatgttgtgctggcccagctgtgggtccgctccccacgtcgtggcctgcaagagcaggaggagctgtgtttccacatgtggggcggcaaaggtggcctgtgtcagtcatctctgtag

SEQ ID NO: 6514 - DNA, 1044 bp, Artificial Sequence
  Description of Artificial Sequence: Synthetic coding sequence
atgggtgtggtgcaatacggtgacaatccggcaactcatttcaacttaaaaacccacactaattctcgagacctgaagacggctatcgagaagatcacccagcgcggaggactgagcaacgtgggccgcgccatttcctttgttacgaaaaacttcttcagtaaggcaaatggaaaccgatctggagcacctaacgtagtcgtggtgatggtggatggttggcctacagacaaggtcgaagaggcctctaggttggcccgggagtctggaattaatattttcttcatcaccatcgaaggggctgcagagaatgagaaacaatacgtggttgagcccaattttgccaacaaagcagtgtgtcggacgaatggattctactccctgcatgtccagagttggttcggactgcataagaccctccagccattggtcaaaagggtatgcgataccgatcgcctagcttgcagcaaaacatgtctcaacagcgcagatataggcttcgtgatcgacggctccagtagcgtcgggactggcaatttcagaacagtgttgcaatttgttacgaatctgaccaaagaatttgagatttctgatacggatactcgaatcggggctgtgcaatacacgtacgaacagcgtctcgaattcggttttgataagtattcctccaaaccggatatcctgaacgccataaagcgcgttggctattggtccgggggcacttccaccggagcagctattaattttgcgttagaacaactgttcaagaagtccaaacccaacaagcggaagctgatgatcttaatcaccgacggaaggagctatgatgacgtgagaatcccagctatggccgctcatctgaaaggtgtgattacgtatgcaattggggtcgcttgggcagctcaggaggaactcgaagtaatcgccacccatccagcaagagatcacagctttttcgtagatgagttcgacaaccttcaccaatatgttccaaggattatccaaaacatttgcactgagtttaactcacagcctcggaactag

SEQ ID NO: 6515 - DNA, 27 bp, Artificial Sequence
  Description of Artificial Sequence: Synthetic coding sequence
atgcagggcacgcccgggggtggctag

SEQ ID NO: 6516 - DNA, 369 bp, Artificial Sequence
  Description of Artificial Sequence: Synthetic coding sequence
atgttgtatcagaccatcaactccctgaaaaccaaaaatcccaaactcaaaattctgctgtccattgggggttatctgtttgggagtaaaggcttccacccaatggtcgacagcagcacgtcgagactcgagtttattaattccattattctgttcttacggaatcataattttgacgggttagacgtgtcatggatttatccggatcagaaggagaacacccacttcaccgttttaatccacgagctggctgaagcttttcaaaaggactttaccaagtctacaaaggagcgattgttgctcaccgcgggtgtctcagctggacggcaaatgatagataatagctaccaggttgagaagctggcatag

SEQ ID NO: 6517 - DNA, 309 bp, Artificial Sequence
  Description of Artificial Sequence: Synthetic coding sequence
atgagagtgagcggtgtcctgcgcctgttggcccttatctttgccatcgtcacaacctggatgttcattaggagctatatgtcattctctatgaagactatacgtctgcctagatggctggctgcttcacctactaaagaaatccaagtgaaaaagtacaaatgcggcctgataaaaccctgccctgccaattattttgccttcaaaatctgttcaggggctgccaacgttgtcggaccaactatgtgcttcgaagatagaatgataatgtccccagtaaagaataacgtggggcgcgggctgaactag

SEQ ID NO: 6518 - DNA, 660 bp, Artificial Sequence
  Description of Artificial Sequence: Synthetic coding sequence
atgaaactgctcctgtgggcctgcatcgtctgcgtggcgttcgctagaaagcgccgttttcccttcatcggtgaggatgacaatgatgacggccacccgttgcatccatccctcaatattccatacggaataagaaacctcccccctccgctgtattacagaccagtgaatactgtcccctcctatccaggcaacacgtatacagatacaggtttgccgtcctatccatggatattaactagtccaggatttccttacgtgtatcacatcagaggatttcctctggccacccaattaaatgttccaccccttccaccccgcggatttccattcgttccaccatctaggttcttcagtgctgcagccgctcccgccgctccccccatagctgcagaacctgccgcagccgcgcctcttaccgctacaccggtcgctgcagagccagctgccggggcaccagtggccgctgaaccagcagctgaggccccagtgggagccgagccagcagccgaggctccagtggctgctgaacctgccgctgaagcccccgttggtgtcgaacctgccgctgaggagccttccccggcagaaccggccacggcgaaacccgcagcccccgagccccatccatctccctccctggaacaagccaaccagtag

SEQ ID NO: 6519 - DNA, 1869 bp, Artificial Sequence
  Description of Artificial Sequence: Synthetic coding sequence
atggggaagtctgagggcccagttggaatggtggaaagtgcgggtagagcaggccagaaaagacctggctttctggaaggagggctgttactgctgctgctgctcgttactgctgccctggtcgccctgggggtgctgtacgccgatagaagaggaaaacagttgccacgcctggcctcacgcctgtgcttcctacaggaagagcgtacgtttgtcaagagaaaacctcgaggaatacccgaagcccaagaggtgagcgaggtgtgcactactcctgggtgtgtgatcgcggcagcccggatcttgcagaacatggacccaaccacggaaccctgtgacgatttttatcagttcgcctgcggtggctggttacggcgacacgtcataccagagacaaattcccggtattcgattttcgacgttttgcgggatgagctggaagtgatcctgaaggccgtgctcgagaattccaccgccaaggcaaccgtgccccaggaagagcggcacgatgtaatcgccttgtatcatagaatgggcctggaggaactgcagtctcagttcggactgaagggcttcaactggacacttttcatccagaccgttttgagctccgttaagatcaaactgctgccagatgaggaagtcgtagtctatgggattccctatctgcagaacctagagaacatcatcgacacttactcagctcgcacaatccaaaattaccttgtgtggcggctcgtgctcgaccggatcgggtctttgtcacagcgtttcaaggacactagagtcaactacaggaaggccctcttcggaactatggtggaagaagttcgctggagagagtgcgtcggctatgtgaacagcaacatggaaaacgcagtgggctctttatatgtcagagaagcttttccgggggattcaaagtctatggtgcgagagctaattgacaaggtgcgtacagtgtttgtggagaccttggacgagctgggatggatggacgaggagtccaagaaaaaggctcaggaaaaagccatgagtatcagagagcagatcgggcaccccgattatattctggaagagatgaatcgcagacttgatgaagaatacagtaatctcaacttctcggaggatttatattttgagaacagtttgcagaatctcaaagtgggagcccagagatcccttcggaagctacgggaaaaggtcgatccaaacctgtggattattggcgcggccgtcgtgaatgcgttttattcacccaatcggaaccagatcgtatttcctgcaggaatcttacagcctccttttttctcaaaagagcagccccaggcgttgaattttggaggcatcggcatggtcatcggacacgagataacacatggcttcgatgacaacggacgcaacttcgacaaaaacggaaatatgatggactggtggagtaatttcagtacacagcatttcagggaacagtctgagtgtatgatttaccagtatgggaactattcatgggatctcgccgatgaacagaatgtgaatgggttcaataccctgggggagaatattgccgacaatggaggcgtgcggcaagcatataaagcgtatctcaagtggatggccgaaggtgggaaagatcagcagttgcccggactcgacctgacacatgagcagctattttttatcaactatgcccaggtgtggtgtggctcctaccgaccagaattcgcgatccagtccatcaaaacggatgtgcattccccactcaagtatagggtgctgggcagtctgcaaaaccttgcagcctttgccgacaccttccactgtgcccgcggaacaccgatgcatccaaaagaacgctgtcgcgtctggtag

SEQ ID NO: 6520 - DNA, 168 bp, Artificial Sequence
  Description of Artificial Sequence: Synthetic coding sequence
atggggccagaggctctgagctctctgttgctgctgctgctcgtggcaagtggagatgcggacatgaaaggccacttcgatccagctaagtgtagatacgctttgggcatgcaggacaggaccatccctgattcagacataagcgctagtagcagctggtccgattag

SEQ ID NO: 6521 - DNA, 156 bp, Artificial Sequence
  Description of Artificial Sequence: Synthetic coding sequence
atgggacctgaagcactctcttcgcttctgcttctcctcctggtggcatctggcgacgccgacatgaagggtcatttcgatcctgcaaagtgcagatatgcactaggaatgcaagaccggactattcctgatagtgatatttccgcgtctagctag

SEQ ID NO: 6522 - DNA, 1620 bp, Artificial Sequence
  Description of Artificial Sequence: Synthetic coding sequence
atgagtgagccccaggaaaagaagttgtcagagaatacggactttctcgcccccggtgttagtagctttactgacagcaaccaacaggagtccatcactaaaagagaggaaaatcaggagcagccacggaactatagccaccatcaactaaacagatctagcaagcactctcagggccttagagatcagggtaatcaggaacaagacccaaatataagcaatggtgaagaagaagaggagaaagagcctggagaggtcggtacacataatgataatcaggagcgaaaaacagaattacccagagagcatgccaactcaaagcaggaagaggataatactcagtccgacgacatcttagaggaaagcgaccagcctacacaggtatcaaaaatgcaggaggacgagtttgaccagggcaatcaggagcaggaagacaactccaacgctgaaatggaggaggagaatgcttcaaacgtgaacaagcacatccaagagaccgaatggcagagccaggaaggcaaaactggccttgaggcgattagcaaccacaaggagactgaggaaaaaacagtaagcgaggcccttctaatggaaccgactgatgatggaaataccacccctcggaaccacggggttgatgatgacggggacgatgacggagatgatggcggcacggatggcccgcgccattctgcctcggatgattattttatcccatcacaagctttcttagaagccgagagggcccaatccatagcttaccacctgaaaatcgaggaacagagggagaaggtgcatgaaaatgagaacattgggacaacggagccgggcgagcaccaggaggcaaaaaaggcagagaatagctcaaatgaagaagaaacctcttcggagggcaacatgagagtccatgctgtagacagctgcatgagctttcagtgcaagcggggccatatttgcaaggcagaccagcagggaaagccccactgcgtctgccaggacccagtcacatgtccacccaccaaacctttagatcaggtgtgcggaacagacaatcaaacttatgcttcctcttgccatctcttcgcaacgaaatgccgacttgagggaaccaagaaggggcaccaactgcagctagactatttcggagcgtgcaaaagcattcctacttgcactgactttgaagtgatccagttcccactgcgaatgagagattggctaaagaacatacttatgcagctgtacgaggcaaattctgagcacgccggatacctcaacgaaaagcagaggaataaggttaaaaaaatctatctggacgagaagagactactggcgggagaccaccccattgacctcttgctccgggactttaagaagaattaccatatgtatgtttatcctgttcattggcaattctcagaattagaccagcaccccatggatcgagtgttgacccattcggagctggcaccgttgagggctagcctggtaccgatggagcactgtattaccagattcttcgaggagtgcgatccaaacaaagataagcacataaccctgaaggaatgggggcattgtttcggaattaaggaggaggatatagatgaaaatttgctgttttag

SEQ ID NO: 6523 - DNA, 591 bp, Artificial Sequence
  Description of Artificial Sequence: Synthetic coding sequence
atgcctcatttagcctcactcttcacggcatcttctcgttgttgtccccacccacttcgacccgagggtagcggcgcgatgggcccagaagcactgtctagcctgttgctgttgttgctggttgccagcggggacgccgacatgaagggacactttgaccctgccaagtgccggtacgccctcgggatgcaggacaggaccattcccgactctgacattagcgcgtcctcgtcctggagcgattctaccgccgcgcggcattctcggctcgagtcaagtgatggggacggcgcttggtgcccagctggcagtgtatttcctaaggaggaggagtatctgcaggtcgatctacagagactgcatctggttgccctggtcggtacacagggaagacacgccggcggtctgggcaaggaattcagtcgatcctaccgcttgaggtacagcagagatgggaggagatggatgggctggaaggacagatggggccaagaggtgatttcagggaacgaggacccagaaggcgttgtccttaaggacctggggcccccaatggtggcccggctggttcgcttctatccccgcgcctag

SEQ ID NO: 6524 - DNA, 162 bp, Artificial Sequence
  Description of Artificial Sequence: Synthetic coding sequence
atgctcccttgtctggcactgctgctcctgatggaattgtccgtctgcacagtggcgggagatgggggggaggaacagacactgtctactgaggccgagacatgggttatcgtggctctcgaagtgctcctgggaagggggtcagacgaggggagaggttag

SEQ ID NO: 6525 - DNA, 126 bp, Artificial Sequence
  Description of Artificial Sequence: Synthetic coding sequence
atgggtccggaggccctaagttccttgctacttttgctcctggtcgcctccggcgatgcagacatgaaaggccattttgatcccgctaagtgcagatatgcactggggatgcaggaccggacttag

SEQ ID NO: 6526 - DNA, 222 bp, Artificial Sequence
  Description of Artificial Sequence: Synthetic coding sequence
atgggacccgaggctcttagctccctgctgctcctgctcctggtcgcatctggtgacgctgatatgaagggtcacttcgatcctgccaagtgtaggtacgccttgggtatgcaggacaggacaatacctgatagtgatatctctgccagctccagttggtctgattctaccgccgctcgacactcacgtctggaatcctctgacggagacggcgcttggtag

SEQ ID NO: 6527 - DNA, 369 bp, Artificial Sequence
  Description of Artificial Sequence: Synthetic coding sequence
atgggacccgaggccttgtcaagcctgctgctcctgttactggtggcttctggagacgcagatatgaaaggacattttgaccctgccaaatgccggtatgctctgggaatgcaggacaggaccatacctgatagtgacatctcggctagctctagctggtcagattcaacggccgcacggcattccaggctagagtcatcggatggggacggagcttggtgtccggcgggatctgtgttccccaaagaggaggagtacctgcaggtggatctgcagagactacacctcgtggcattagttggcactcaaggaagacatgcgggcggcctggggaaggaattctcaagatcgtatcgcctgagatactag

SEQ ID NO: 6528 - DNA, 483 bp, Artificial Sequence
  Description of Artificial Sequence: Synthetic coding sequence
atgggccccgaagctcttagttccttattattgctgctgttggtcgcctctggggatgccgatatgaaagggcacttcgatcccgctaaatgtcggtacgccctgggaatgcaagatcggactattccagatagcgatatctccgcatcttcaagctggtccgactccacagccgcccgacactctcgtctagagtcctcggatggagatggagcctggtgtcccgccggatcagtatttccaaaagaggaagagtacctacaggtcgacctgcaacggctgcatctcgtcgcattggttgggacacaagggagacacgcggggggcctgggcaaggagttttcgaggtcttataggttgcgctactctagggacgggcggagatggatgggctggaaggatcggtggggtcaggaggttatctcaggcaacgaagatcccgaaggcgttgtcctgaaagacttgggcccccctatggtgtag

SEQ ID NO: 6529 - DNA, 540 bp, Artificial Sequence
  Description of Artificial Sequence: Synthetic coding sequence
atgggaagtagcggactgctgtctttgctggtactgtttgtgcttttagccaatgtgcaggggccagggctcacggattggctgttcccgcgaaggtgccccaaaattcgggaagagtgtgagttccaagagagggatgtgtgcaccaaggatagacagtgtcaggataataagaaatgctgcgtgttcagttgtggaaaaaaatgcctggatctcaagcaagatgtctgcgagatgcccaaagagacaggcccatgcctcgcttatttcctccactggtggtatgacaagaaagacaacacttgtagtatgttcgtctatgggggatgtcaggggaacaacaataacttccagagcaaagctaactgtctcaatacatgcaagaacaaacagccttgtccaaagatcaaagtcgagtgtgaggtggaggaaatcgaccaatgtactaagcccagagattgcccagagaatatgaaatgctgcccttttagccggggaaaaaaatgtttggattttagaaaagcttcattgtcaacttag

SEQ ID NO: 6530 - DNA, 438 bp, Artificial Sequence
  Description of Artificial Sequence: Synthetic coding sequence
atgttgttccgcaaccgctttctcctcctgttagccttggcggcactcttagccttcgtgtccctgtctctgcagttcttccacctcatcccagtcagtacaccgaaaaacgggatgtcttcaaagtcacgcaagcgcattatgccggacccagtcaccgaacccccagttacggaccctgtgtatgaggccctgctgtactgtaacatcccatcagtggcagaacggtctatggaaggccacgccccccaccacttcaaactggtgtcagttcacgtgttcattagacacggggaccgttatcccctatacgttatccctaagaccaaacggccggagatcgactgcaccctcgtggccaatcgtaagccttatcaccccaaactcgaggccttcatctcccacatgtccaaaggcagtggcgcatcatttgaatag

SEQ ID NO: 6531 - DNA, 399 bp, Artificial Sequence
  Description of Artificial Sequence: Synthetic coding sequence
atgggacctgaggccctgtcctccttactgctgttgctgctggtagccagcggtgacgccgatatgaaaggccatttcgacccggccaaatgtcgctacgctctgggcatgcaggaccgaaccatccccgacagcgatatcagtgcttcaagttcttggtccgattccaccgctgcccgccactctagattggaatcttcagatggtgatggtgcatggtgtcccgcgggctcagtgtttccaaaggaggaagagtacctgcaagtggatctgcaaaggctgcacttggtggccctggtggggacacaggggaggcacgcaggtgggcttgggaaggagttctcccgctcttacaggctaaggtactccagggatggccgcagatggatggggtggtag

SEQ ID NO: 6532 - DNA, 306 bp, Artificial Sequence
  Description of Artificial Sequence: Synthetic coding sequence
atgggcccagaagctctaagtagcttattgctgttgcttttagtggccagcggtgacgcggacatgaaggggcacttcgatcccgcaaaatgccgttatgctctgggaatgcaggacaggacaatcccagacagcgacatctcagcttcctcctcttggagtgatagtacagcggcccggcactcacgactcgaatcaagtgatggagatggggcctggtgtccagccggatcagtgttccccaaggaggaagagtacctacaagtggaccttcaaaggctacacttggttgccctggtagggtag

SEQ ID NO: 6533 - DNA, 393 bp, Artificial Sequence
  Description of Artificial Sequence: Synthetic coding sequence
atgttggccccgttattcctgtgttgcttaaggaacctgttcaggaagttaatctccttccagccaccccagctcggcagaactaacatgcattacagcaagttgccgcggacggccattgagactgaattcaagcagaacgtcggacctcctccaaaggacctgacagcagaggtatactttccatctatcaaatctagatctcacctgcctgccgtgttttacaaccaatacttcaagcaccctaagtgtgtgggcgagtacgggccaaagaatggtgccgagagacagattgaagagaggaaagtcctgccaactaccatgatgttctccatgctggccgattgtgtactcaagtctacacccattcctatcctgggggtagctatgtag

SEQ ID NO: 6534 - DNA, 420 bp, Artificial Sequence
  Description of Artificial Sequence: Synthetic coding sequence
atgcccgccattgccgtgctcgctgctgcagccgccgcgtggtgctttctccaggtagagagcaggcatctcgacgctctggcaggtggagccggaccaaaccacgggaacttcctcgataacgaccagtggctgtctactgttagccaatacgatagggacaagtactggaataggtttcgcgacgatgattacttccgaaattggaaccctaataaaccattcgatcaggcactggatccaagcaaagacccctgcctcaaggtcaagtgcagcccacacaaggtctgcgtgactcaggactaccagactgcactctgcgtttcccggaagcatctgttaccgaggcaaaagaaaggaaatgtggctcagaagcactgggtcggcccaagcaacctggtcaaatgcaaaccttgttag

SEQ ID NO: 6535 - DNA, 510 bp, Artificial Sequence
  Description of Artificial Sequence: Synthetic coding sequence
atgcggctgttgattctaacatgtttggtcgctgttgccttagcccgcccgaagctgcccctcagatatccggaacggctgcagaaccctagcgagtctagcgaaccgattcccctcgagtcccgtgaagagtatatgaatggcatgaatcgccagaggaacatccttcgtgaaaagcagaccgatgagataaagaattgtgtggtggcagaacccgaaaaaatggaaagcagcatctcctcgtcttccgaagagcagttttgccggctgaatgaatacaatcagctgcagctgcaggccgcgcacgcccaagagcagatccggaggatgaacgagaatagccacgtccaggtccccttccagcaactgaaccaactggctgcttatccgtatgccgtttggtactatccccagatcatgcagtacgttcccttccctccattttccgatatctcaaatcctacagcacatgaaaattacgagaagaacaacgtgatgcttcagtggtag

SEQ ID NO: 6536 - DNA, 921 bp, Artificial Sequence
  Description of Artificial Sequence: Synthetic coding sequence
atgaaaaaggatgaacctcccttggattttcctgatacgcttgaaggtttcgaatacgcttttaatgaaaaagggcagcttcgtcacataaagaccggggagccctttgtgtttaactaccgggaagatctacaccgatggaaccagaaaaggtacgaggccctcggtgaaattataaccaagtacgtatatgagctcctcgagaaggactgtaacctgaagaaggtgagtattcccgagggatatggcgtaattgtgcttaaccctaatgagaactacattgaagttgaaaaacccaagatacatgttcagtcctcaagtgacagctcggacgaaccagccgagaagcgagagcgaaaagataaggtctcaaaagaaacgaagaagagaagggatttctatgaaaaataccgcaatccacaacgggaaaaggaaatgatgcaactgtatatcagggaaaacggttccccagaggaacacgctatttacgtctgggatcactttattgcgcaggccgccgctgagaacgtgttcttcgtggctcatagttacgggggcctggcatttgtcgaactgatgattcagcgagaggctgatgtaaagaataaagtcacagccgttgccctgaccgacagtgtgcacaatgtctggcatcaagaagccggcaaaactattcgagaatggatgagagagaactgttgcaactgggtgagcagctctgaaccccttgacactagtgtagagagtatgctgccagactgcccacgtgtcagcgctggaacagatagacacgaactgacgtcgtggaaatcgtttccatctatctttaagttttttaccgaagccagtgaagctaaaaccagctctctgaagcctgcagtgactcgccgctcccacagaatcaaacacgaagaactctag

SEQ ID NO: 6537 - DNA, 2862 bp, Artificial Sequence
  Description of Artificial Sequence: Synthetic coding sequence
tgacaactctgctggctgccgctcctggcaccactcctacttctgagaccgccgggggtgcagagtgccggtccaatcagagcttttgttgtcccacactcccatatggatgtgggctgggtttacacagttcaggaatctatgcgggcttacgccgccaatgtgtacacctcagtagtagaggaattggccaggggtcaacagagacgcttcattgccgttgagcaggagttctttcgtctgtggtgggatggagttgctagtgaccagcagaaatatcaggtgcgccagttgctggaggaaggccggcttgagtttgtgattggtggccaggtgatgcacgacgaagctgtgacccatctggacgatcagatcctccaactcaccgaggggcacggtttcttgtatgagacattcggcatccgtccacaattttcctggcatgtggaccctttcggcgcatctgccacaacacctactctgttcgccctggcgggctttaatgctcacctcggctcacggatcgattacgatctgaaggccgccatgcaagaagccagaggtctccaattcgtctggcgcggctctccatcactctccgagagacaagaaatcttcacccacattatggaccagtatagttactgtaccccttcacatatccccttttctaacagaagtggcttctactggaatggcgttgccgtgttcccaaagcctccccaggatggcgtgtaccctaacatgagcgagcctgtcactccagccaacattaacttgtatgcggaggcgctcgtagccaatgtcaagcagcgcgcggcctggttccggacacctcacgttctctggccttggggatgcgataagcagttttttaatgccagcgttcagtttgcaaatatggatcccctattagatcatataaacagccatgccgcagaattaggcgtgtcagtccagtacgccaccttgggcgactacttcagggcgctgcatgctctgaacgtgacgtggcgggtgcgagatcatcacgatttcctgccatattcgaccgaacctttccaggcatggactggcttctatactagtcggagcagccttaagggtcttgccagacgggcaagcgctttgctttacgccggagagtccatgtttacccgttatctgtggcctgcaccgcgtggtcacctcgatccaacttgggcactccagcaactgcagcagttgcggtgggcggtctcagaagtgcagcaccatgatgctatcacgggcaccgagagtcccaaggtgcgagacatgtatgcaacacacctggctagcggtatgctgggaatgcggaagttgatggctagtatcgttcttgatgagctgcagccacaagcaccgatggcagcaagcagtgatgcagggcctgcaggccactttgccagcgtatacaacccgttagcatggactgttactactatcgtcactctgaccgttggctttcctggagtgagagtgacggacgaagcaggccatcccgtgccttcccagatccaaaactccacagagacgcctagtgcctacgatctcttaatcttaacgactattcccggcctgagttatcgtcattacaatatacgacctacagctggcgcccaggaaggaacccaggaaccggccgcgactgtcgcgtccaccctgcagtttgggaggagattgaggcggagaacttcccacgctggaagatacctggttcctgttgccaatgactgctatattgtgttgcttgaccaagatactaacctcatgcatagcatctgggaaaggcaatccaatcgcacagtgcgtgtaactcaggagtttctagaataccacgtcaacggagacgtcaagcagggaccgataagcgataattacctgttcacgcctggcaaggcagcagttccagcatgggaggcagttgagatggaaatcgtggcaggccagttggtgactgagattcgacagtatttttatcggaacatgactgcacagaactatacatatgcgatacgctcgcgtctaacgcacgtgccccaaggtcatgacggagagcttctgtgccacagaatcgagcaggaatatcaagccggtcccctggaacttaatcgtgaggcagtccttcgcacctctaccaatctcaactcccagcaggtcatttactcggacaacaacggctatcaaatgcaaaggcggccttatgtgtcttacgttaacaactcaattgcccgcaattactacccaatggtccagtccgcgttcatggaagacggcaagtctaggctagtcctccttagcgaaagagctcacggcatctctagccagggtaacggacaggtggaggttatgcttcataggaggctttggaacaacttcgactgggatctcggatacaacctgaccctgaatgatacatccgtggttcatccggtgctgtggctcctattaggctcttggtctctcactactgcgctaaggcagagaagcgccttagctcttcagcatcgccccgttgtactctttggggacttggcaggcacagcacctaagttacccgggccccagcaacaagaggctgtaactttaccaccgaacctgcatctacagattctatctatccccggatggcggtacagctctaatcacactgagcattcccagaatctgcgcaaaggccatcgcggcgaagcccaggccgacctcagacgcgtgctactccgtctgtatcatctgtacgaagtgggcgaagacccagtgctgtcccagcccgtcacggtgaacctggaagtgaacttcccgacaccgattcagacgatttcccagggcagtaagccctag

SEQ ID NO: 6538 - DNA, 459 bp, Artificial Sequence
  Description of Artificial Sequence: Synthetic coding sequence
atgcggttcaaaactacagctaaggacgggttgcttctgtggcgcggcgattcccctatgcggccaaacagtgacttcatcagcttgggcttgcgggacggcgcccttgtgtttagctacaatctcgggagcggagtggcgtccatcatggtaaatgggtcatttaatgatggtcgttggcatagggtgaaagcagttcgcgatgggcagtcaggcaaaatcaccgtggacgattatggtgctcgcacaggcaaatcgcccggtatgatgaggcaactcaatatcaacggagccctttacgtgggcggcatgaaggagattgctctgcacaccaaccgtcagtatatgaggggcttagtgggctgtatctcacatttcaccttatccactgattatcatataagtctagtagaagacgccgtggacggaaagaatattaatacatgtggggcaaagtag

SEQ ID NO: 6539 - DNA, 1701 bp, Artificial Sequence
  Description of Artificial Sequence: Synthetic coding sequence
atggactttctgctggcacttgtcctggtgagctctctgtacctacaagcagcagccgaatttgatggcagatggcccaggcaaattgtgtcatcgatcgggttatgcaggtatgggggccgcattgactgttgttggggatgggcgaggcagtcttggggacagtgccagcctgtctgtcagcccaggtgcaaacatggggaatgtattggtcctaataaatgcaagtgtcaccctggttacgctggcaagacttgcaatcaggatgaacacattcctgcccccttggatcagggatctgagcagcccctgtttcagccactagatcatcaggcaacctcgctgccatcacgggacttaaatgaatgcgggcttaagcctaggccttgtaaacacaggtgcatgaacacctatggttcatacaagtgctattgtttgaatggctacatgctgatgcccgacggttcctgctcctccgctctcacatgctccatggcgaactgtcagtatggctgcgatgtcgttaaagggcagattaggtgtcagtgtccctctcctggcctgcaacttgcccccgacggcagaacttgtgttgacgtcgatgagtgtgccacagggcgtgcctcttgcccacggttccgacaatgcgttaatacattcggtagttatatatgcaagtgccataaaggattcgacctgatgtacattggaggtaaataccagtgccacgatatcgatgaatgtagtctgggccagtatcagtgcagtagctttgctcgctgttataatattagaggctcctacaaatgtaagtgcaaggaaggttatcagggggacggactgacatgtgtctatattcccaaagtcatgattgagccaagcggacccattcacgtgcctaaggggaacgggaccattctgaagggcgataccgggaataataattggattccggacgtcggaagtacgtggtggccaccaaaaacaccgtatatccctcctattataacaaaccgccccacctccaagcctaccaccagacccaccccaaagcccaccccaattcctaccccccctccccccccaccgctcccaactgagctgagaacacctctgccgcctaccacccccgagaggcccaccacagggctcactaccattgcccccgcggcgagtactcctcctggtggcatcacggtggacaaccgcgtgcagaccgaccctcagaagcccaggggagatgtattctctgtgctcgtgcactcatgcaattttgaccacggcttgtgcggttggataagagagaaggacaatgacctacattgggagcccatcagagacccggccgggggccagtatttgacagtgtctgctgctaaggccccaggtggcaaagccgcccggttagtacttcctttgggccgcctaatgcactcaggagatctgtgcctgagtttccggcacaaggtgaccggcctccacagtggcaccctgcaggttttcgtgagaaagcatggtgcccatggtgccgccctgtgggggcgcaatggtgggcatggttggcggcaaacccagatcactctccgaggagctgacatcaagtctgtggtgttcaagggagagaaacggagagggcacactggggagatcggcctggatgatgtgtccctgaagaaaggacactgcagtgaggaacggtag

SEQ ID NO: 6540 - DNA, 213 bp, Artificial Sequence
  Description of Artificial Sequence: Synthetic coding sequence
atgggtccagaagccctcagcagcttgttacttctgctcctcgtcgcatccggagacgcagacatgaaggggcacttcgacccggctaaatgccgctatgctctggggatgcaagacaggacgatcccagactcagacattagtgcttccagttcatggagcgatagtactgccgctaggcactctcgactggaatcgtccgatggcgactag

SEQ ID NO: 6541 - DNA, 237 bp, Artificial Sequence
  Description of Artificial Sequence: Synthetic coding sequence
atgggtcctgaggctttgtcctccctgttactgctgctgctggttgcgtctggcgacgctgacatgaagggccattttgaccctgctaaatgtcggtatgctcttggcatgcaggaccgtaccattcccgattccgatatatcagcaagcagtagctggtctgactctaccgccgcccggcactccaggctcgaaagtagcgatggagatggtgcctggtgccccgcaggatcctag

SEQ ID NO: 6542 - DNA, 339 bp, Artificial Sequence
  Description of Artificial Sequence: Synthetic coding sequence
atgaggtttaagacgaccgccaaggatggcctgctattatggcgcggggattcgccaatgcggccaaactctgatttcatttcattgggccttcgcgatggagcgctggttttcagttataacctcgggtcaggtgtagcttctatcatggtgaatgggagctttaacgacggaagatggcacagggtgaaggcggtgcgagacggccagtcaggaaagatcacagtggacgattatggcgctcgtacagggaagagccctggtatgatgcgtcaactaaatatcaatggggctttgtacgtggggggcatgaaggagatcgccctgcacacgaattag

SEQ ID NO: 6543 - DNA, 2685 bp, Artificial Sequence
  Description of Artificial Sequence: Synthetic coding sequence
atgtcactgccacgatgctgtccgcacccgctgcggccagagggctccggggccatggggccagaggctctaagctcactgttgctacttctgctggtggctagcggcgacgccgacatgaaggggcattttgacccggctaaatgcagatatgctctggggatgcaggatcggactatcccagactctgacatcagtgccagtagctcctggagtgactcaactgcagctaggcatagtagactggagtcttccgacggcgacggtgcttggtgtccagcaggatcagtgttccccaaagaagaagaatacttgcaggtagacttgcagagacttcatctcgttgctcttgtgggtactcaggggaggcatgccgggggcctgggaaaggagttttctagatcctaccgcctgcgctatagcagagacggacgaaggtggatgggctggaaggataggtggggacaagaggtgattagtgggaacgaggatcctgaaggagtggtgctgaaggatctgggcccaccaatggtagctaggctcgtgcgcttttatccacgagctgatcgggtaatgtctgtgtgccttagggtggagttgtatggttgtctgtggcgcgacggcctgcttagctacactgcgcccgtgggccagactatgtatctttctgaagccgtctatttaaacgatagtacctacgatggccacaccgttggaggcctgcagtacgggggtttgggacagctggccgatggcgtggtgggacttgatgactttagaaagtctcaggagctgagggtgtggcccggctacgactacgtgggatggagtaaccatagctttagttccggttacgttgaaatggaatttgagtttgacagactgcgagcatttcaggctatgcaagtgcactgcaacaacatgcacacgctgggagcccgattacccgggggtgtggaatgccgctttaggcggggcccagccatggcttgggagggagaacctatgcgacataatctcgggggtaatcttggcgacccaagggccagggctgtttcggtcccacttggagggcgggtggcacgcttcttacagtgccggtttctttttgccggaccctggcttctgttctcagaaatctcctttatatcagatgtggtaaataattcaagccccgccctcgggggcactttcccacctgccccatggtggcctcccgggcctccccctactaatttttcctccctcgagctcgaacctaggggccagcagccggttgctaaagctgaagggtctcccacggccattcttatcggttgtctcgtagccatcatcttactcctgctcctaataatcgccttgatgctctggcgactgcactggagaagattacttagtaaagccgagagacgggtcttggaagaggagctgaccgtgcatctcagcgtgcccggtgacactatcctgatcaataacagacccgggccacgcgaaccacccccttaccaagagcctcgtcctcgcggcaaccctcctcacagcgccccttgcgtcccaaatgggtccgcttactcaggtgattacatggaacccgagaaacctggagcccccctgctgccacccccaccgcagaactcggtccctcactacgcagaggctgatatcgttactctgcagggggttaccggagggaatacatatgcagtgcctgccctccccccaggagcagtgggggatggacctcctcgcgtcgatttccctcggtctaggttgcgttttaaggaaaagcttggcgaaggacaattcggggaggtccacctctgtgaagtcgactcaccccaggacctggtgtctctcgactttcctctgaatgttcgcaagggtcatccgctcctggttgctgtgaagatactgcggcctgatgcgactaaaaatgccagaaatgacttcttgaaggaagttaagatcatgtctcgcttgaaggaccctaatatcatcagactcctgggcgtctgcgtgcaggatgacccactgtgcatgattacggattacatggaaaacggtgatctgaaccagttcctctctgcccaccaactcgaggataaggcagctgagggcgcccccggagacggacaagcagctcagggcccaacgattagctatccaatgctgctgcatgtggcagcccagatcgccagtgggatgcgatacttagccacactgaactttgttcacagggacctggcgacccgcaattgccttgtgggtgaaaatttcacaatcaagatcgcagacttcgggatgtctcgcaacttatacgctggagactactatcgcgtgcaaggaagagcagtgctgccaatccgatggatggcctgggagtgcattctgatggggaaattcactaccgccagtgatgtgtgggctttcggtgtgacactgtgggaagtcctgatgctgtgccgggcacagccttttgggcagctaactgacgagcaagtaatcgagaacgcgggggagttttttcgcgatcaaggacgtcaggtatatctgagccggccacccgcatgcccacagggtctgtatgagctaatgctcaggtgctggtcgagggaatctgagcagagaccgccattcagccagctccatagattcctggcggaggatgctctaaacaccgtgtag

SEQ ID NO: 6544 - DNA, 384 bp, Artificial Sequence
  Description of Artificial Sequence: Synthetic coding sequence
atgggacctgaggctctgtctagtctactgctgttactgctggtcgcgagtggagacgcagacatgaagggacacttcgatcctgcgaagtgcagatatgctctggggatgcaggaccggacaatacctgactccgacatctccgctagttccagttggtcggacagcaccgctgcacgccattcacgtttggaaagcagcgacggggatggagcctggtgccccgctggatccgtgtttccaaaagaagaggagtacctccaggtggacctccaacggttgcatctcgtggctttggtcgggactcagggccgtcatgccggaggcctgggaaaggagtttagccgctcctaccggcttaggtatagcagggacggacggtag

SEQ ID NO: 6545 - DNA, 1113 bp, Artificial Sequence
  Description of Artificial Sequence: Synthetic coding sequence
atgaagaaggacgaaccccctttagactttcccgacaccctggaaggctttgagtacgctttcaacgaaaaggggcagctacgccatataaagacaggtgagccgttcgttttcaattacagggaagatctacataggtggaatcagaagcggtacgaggccctgggtgagatcattactaagtatgtgtacgagctgctagaaaaagactgcaatctgaagaaagtctcaattccagtggacgcaactgaatctgagccaaaatcttttatattcatgagcgaagacgctctaaccaaccctcaaaagcttatggtgctcattcacgggtctggcgtggtacgcgctggacaatgggccaggcgcttgatcattaacgaagatctcgactctggcacccagatcccattcataaaacgagcagtggccgaaggatacggagtaattgtgcttaatcctaatgagaattatatcgaagttgagaaaccgaagattcacgtccagtctagctcagacagctccgatgagcccgccgagaaaagagagcgaaaggacaaggttagcaaggagaccaaaaaacgccgtgatttctacgagaagtacagaaatcctcagagggaaaaggaaatgatgcagttatatattcgcgaaaatggatcccctgaggagcatgctatatacgtgtgggatcactttattgcccaggcagctgctgagaatgtatttttcgtggctcacagttatggggggctcgcatttgtggagctgatgatccagcgcgaagccgatgtcaaaaacaaagtcacagcagtcgctctgactgactccgttcataatgtctggcatcaagaagcaggcaaaaccatccgcgagtggatgagagagaactgctgtaactgggtgtcctccagcgaacccctggacacgtcagtggagtccatgttacctgactgtcctagagtctcagcgggcaccgatcgccatgaactgacctcctggaaatcctttccctcaatttttaaattttttactgaggctagtgaggcaaagacatcctctctgaagcctgccgtcactagacgaagtcacagaatcaagcatgaagagctgtag

SEQ ID NO: 6546 - DNA, 435 bp, Artificial Sequence
  Description of Artificial Sequence: Synthetic coding sequence
atgaagaccggcctgttcttcctatgcctccttggcacagccgcagcaatccctaccaatgcccggctcttgtccgatcacagtaagcccaccgctgaaacggtggcccccgacaacactgccataccatcattgcgtgccgaggccgaagagaacgaaaaggagactgccgtatccaccgaagatgactctcaccataaagcggagaaatcgtccgtgctcaagtcaaaagaggagtcccacgagcagtccgcagaacagggaaaaagctctagtcaggagcttggactgaaggatcaagaggactcggacggtcacctgagcgtgaatcttgagtacgctcccactgaaggaactctcgatatcaaggaggatatgagtgaaccacaggaaaaaaaactctccgagaatacagattttctggccccaggatag

SEQ ID NO: 6547 - DNA, 1341 bp, Artificial Sequence
  Description of Artificial Sequence: Synthetic coding sequence
ctgacactgcatagcttgacctgctatgaggatctggtgacttttcttcagcaatccatccatcagttcgaggtgggcccatacgggtgcatcctgctgacactttcagccatactttctcgatcaaccgaactgattcgacaggactttgatgtgccaaccagccacctgatcggcgcccatgggtactgcactcaagagctcgtaaatttgttgttgaccgggaaggctgtttcgaatgtctttaacgatgtggtagaacttgatagcggcgacggaaacatcacgcttctcaggggcatagccgctcgctccgacattggatttttatcactgtttgaacattacaacatgtgccaggtcggctgctttctcaagacgccgcgctttccaatctgggtggtgtgtagcgaaagtcatttctctatcctgttctccctccagcctggactcttgcgggactggaggactgagcggctgtttgatctatattactacgacggacttgcaaaccagcaggagcagattcgattgacaattgacaccacgcaaaccatctccgaggacaccgataatgatttggtccctcctctggagctttgtataagaactaacataggttctgcacttggattcaagtacccagttgggaacaaccaaactgccgtccaggataacgtgaaagtgagcctggcattcgggctgtctattgctacgcttgcccagtctgtcggacacatcagtggcgctcacctcaacccagctgttacactgggactactcctgagctgtcagatatccatttttcgagccctgatgtacatcatagcccagtgcgtaggggccatcgtcgccactgcaattctctctggcattacatccagcttaactggaaattcccttggaagaaatgacctcgctgacggcgtgaactcagggcagggcctgggcatcgagatcatcggcaccctgcagctggtcttgtgcgtactcgccactactgatcgtaggcggcgagacctcggaggctctgcacccttagctataggcctgagcgtggctctggggcacctgctggcaatagactacacgggctgcggcataaaccctgcaaggtccttcggatctgccgttatcacccataacttcagcaatcattggatcttttgggtgggaccattcattggaggggcacttgctgtgttgatctacgacttcatcttggctcccaggtcttccgacctgactgaccgggtcaaggtctggaccagcggacaggtcgaggaatatgacttggacgcggacgacatcaattcacgggtggagatgaagcctaagtag

SEQ ID NO: 6548 - DNA, 81 bp, Artificial Sequence
  Description of Artificial Sequence: Synthetic coding sequence
atgaagctgcttttatgggcttgtattgtgtgcgtcgctttcgcccggaaaaacgccggtcttggtttcttgtggctgtag

SEQ ID NO: 6549 - DNA, 348 bp, Artificial Sequence
  Description of Artificial Sequence: Synthetic coding sequence
atggggcctgaagcactgagcagcttgctcttgctattattggtagctagcggggacgccgatatgaaggggcatttcgacccagccaaatgccgttatgccttgggtatgcaagatcgcacaatccccgatagtgacatctccgcctcctctagctggtccgactcaaccgcggctagacacagccggttggaatcctctgacggcgatggcgcctggtgtcctgcaggaagtgtgtttcccaaggaagaagagtacctccaggtggacctgcagcggctgcacctggttgccttggtgggaacccagggccggcacgcagggggtttggggaaggaattcagctag

SEQ ID NO: 6550 - DNA, 165 bp, Artificial Sequence
  Description of Artificial Sequence: Synthetic coding sequence
atgtacattcctttagaccctgactataatgctgactgtccaaatgtaactgcaccggtgtgtgcgagcaatgggcacacgttccagaatgagtgcttcttctgcgtggaacagagagaatttcactacagaattaaatttgagaagtacggcaaatgcgattag

SEQ ID NO: 6551 - DNA, 351 bp, Artificial Sequence
  Description of Artificial Sequence: Synthetic coding sequence
atggtcctgctccactggtgcctcctgtggctcctctttcccctaagctcccgtacccaaaagctgcccacccgcgatgaggaattgttccagatgcaaatccgtgacaaagcttttttccatgattcctccgtgatccctgatggggccgagatcagcagctatctgttcagagatacaccgaagaggtacttcttcgtcgtcgaggaggacaatacccccctaagcgtcacggtgactccttgtgacgcccctctggagtggaaactgtcactccaagagctgccagaggaccggtcgggggagggctccggggatctagaacctctggaacaacagaagcaacagtag

SEQ ID NO: 6552 - DNA, 432 bp, Artificial Sequence
  Description of Artificial Sequence: Synthetic coding sequence
atgggccccgaagctctttcgtccctgctgttgctactcctcgtggcctctggggatgctgacatgaaggggcactttgatcctgccaagtgtcgttacgcccttggaatgcaggacaggactatccccgactctgacatttctgcatcatcatcctggagtgatagcaccgctgctcgccactctaggttagagagctcagacggcgacggggcatggtgtcctgccggctctgtctttccgaaggaggaggagtacctgcaggtagatttgcagaggctacacctggttgccctggtgggcacacaagggaggcatgccggggggctcggcaaagagtttagccggtcttataggctacggtactctcgcgatggcaggcgttggatggggtggaaagacaggtggggccaagaggtcatatccggatag

SEQ ID NO: 6553 - DNA, 747 bp, Artificial Sequence
  Description of Artificial Sequence: Synthetic coding sequence
atggagctgctacaagtgacaatattgttcctattgccatccatctgctcctcaaattctactggtgttcttgaagctgctaacaattctctagtagtgacaaccaccaaaccttctattactaccccaaacacagaatcattgcagaagaatgtggtgacccctactactggcacgacccctaagggtacgattaccaacgagctgttgaagatgtccctgatgagcacagcgaccttcttgactagtaaggacgaagggcttaaggctacaacaaccgatgtgagaaagaacgacagcattatttcaaacgttaccgtgaccagtgtgactctgcccaacgccgtctcaactctgcagtccagcaagccgaagtcttccgtgttacagccagacgcctctccgtcaaaaactggtaccctcaccagcattccagttacgatccccgagaacacctcccaaagccaggtgattggaacggaaggaggcaagaatgcctccacctctgctaccagcaggagctatagctcaatcatactgcccgtcgtcatcgccctgatcgtaataacactctcagtctttgtgctggtcggcctgtaccggatgtgctggaaagccgatcccgggacgcctgagaacgggaacgatcagccacagtcagataaggagagtgttaagcttcttaccgtgaagacgattagtcatgagtccggagagcattccgcccagggtaagaccaagaattag

SEQ ID NO: 6554 - DNA, 363 bp, Artificial Sequence
  Description of Artificial Sequence: Synthetic coding sequence
atgaaaactggcttatttttcctgtgcctcttgggtaccgcagccgccattccgaccaatgccagattgctctctgaccattccaagcccacagcagaaacagtcgcccccgataacacagcaattccttcgctcagagccgaagctgaggaaaatgaaaaggagacggcggtgtcaacggaggacgacagccaccacaaggctgaaaagtcatccgtcttgaaaagtaaggaagaatcacacgagcagagcgccgagcagggtaagagctcatctcaggaactgggccttaaggaccaggaggacagtgatggtcacctgtcagtcaaccttgaatacgctcccaccgaaggaaccctgtag

SEQ ID NO: 6555 - DNA, 339 bp, Artificial Sequence
  Description of Artificial Sequence: Synthetic coding sequence
atgggaccagaggctctttcttcgctcctgctcctgctgttggtcgcttctggcgacgcagatatgaaaggacactttgaccccgcgaagtgcagatacgccctgggcatgcaagatcgtacaatcccagactccgacatcagcgcaagctcatcatggtccgattccacagcggctcggcattcacgcctggaatctagcgacggtgacggcgcttggtgcccggccgggagtgtgtttcctaaagaggaagagtatctgcaagtcgacctgcagcgattgcacctggtggccctggtgggaacccagggcaggcacgcaggaggactgggcaagtag

SEQ ID NO: 6556 - DNA, 513 bp, Artificial Sequence
  Description of Artificial Sequence: Synthetic coding sequence
atgggtcccgaagccctgtccagccttctcctgctgctgttagtggcttccggggacgctgacatgaaggggcatttcgaccctgctaaatgtaggtacgccttaggcatgcaggataggaccattccggactccgatatttcggcatcttcatcttggtccgattcgaccgcagctagacattcacgcctggagtctagcgatggagacggcgcctggtgccccgctggcagcgtgtttcccaaagaagaggaataccttcaggtcgacctgcagagactccatctcgttgcactggtaggcacccagggaaggcacgctggcggcctcggcaaagaattctcacggtcttatcgcctgcgctactctcgggatggacggcgatggatggggtggaaggaccgatgggggcaggaagttatttctgggaacgaggacccagagggggtggtgctgaaggatctcgggcccccaatggttgccagattggttcgcttttatccccgagcttag

SEQ ID NO: 6557 - DNA, 417 bp, Artificial Sequence
  Description of Artificial Sequence: Synthetic coding sequence
atgggtcctgaagccctgagttcactactgcttttgcttcttgtcgcctccggggacgcagatatgaagggtcatttcgatcctgctaagtgcaggtacgcactgggcatgcaagaccgcaccatcccagatagtgatattagcgcgagcagcagttggtcggattctactgctgcccgccactccagactggaaagctccgacggcgacggtgcctggtgcccagcgggatccgtgttcccaaaagaagaggagtatttgcaggtggatctgcagaggctgcatctggtggccctggtgggtacccagggtaggcacgcaggcggcctggggaaagagttttccaggagttacaggctgaggtattctcgggatgggcggaggtggatgggttggaaggaccgctggggccaatag

SEQ ID NO: 6558 - DNA, 285 bp, Artificial Sequence
  Description of Artificial Sequence: Synthetic coding sequence
atggcagcctttcctcacaaaatcattttcttcctggtgtgctccacgctgacccacgttgctttctccggcatatttaataagagggactttacacgctggcccaaaccccgttgcaagatgtacattccgctggacccggactacaacgcagattgtcccaacgtgaccgcccctgtttgtgcttcaaacgggcatacatttcaaaatgaatgttttttttgcgtggagcagagagaattccattataggattaagttcgagaaatacggcaagtgtgattag

SEQ ID NO: 6559 - DNA, 156 bp, Artificial Sequence
  Description of Artificial Sequence: Synthetic coding sequence
atgggacccgaggctctctcctcactgcttctcttactacttgtcgcatcgggggatgctgatatgaaggggcactttgatcctgcaaaatgccgttacgctttagggatgcaggatagaacaatcccagattccgacatttctgcaagctcctag

SEQ ID NO: 6560 - DNA, 2760 bp, Artificial Sequence
  Description of Artificial Sequence: Synthetic coding sequence
atgggccccgaggctctttcatccctcttgctgctcctcctggtcgcatccggcgatgccgatatgaaagggcactttgacccagcgaagtgtagatatgcactgggaatgcaagaccggacaatccccgactccgatataagcgcttccagcagttggtctgactcaacagccgccaggcactcccggctcgaatctagtgacggcgacggcgcatggtgcccagctgggagcgtgtttcctaaggaggaggagtatctccaggttgacctgcagcggctgcacctggtcgctctcgtaggaacacaaggtaggcatgccggtgggctggggaaggaattctccagatcatatcgcctgcgttatagccgagacggccggcgatggatgggctggaaagaccggtggggacaggaggtcatctctggaaatgaagaccccgagggtgtggtgctcaaggacctgggacctcccatggtggctcggcttgttaggttctacccccgggccgacagggtgatgtccgtgtgtctgcgggtggagctgtacggttgcctgtggcgggacggactgctcagttacactgctcccgttggccagacaatgtaccttagtgaagccgtatacttaaatgattcaacctacgacggtcacaccgtcggtggtctgcagtacggcggccttggccagctagctgatggagtggtgggactggacgatttcaggaagtcccaggaattgagggtctggcccggctacgactacgtcggatggtctaatcactcattctctagtggatatgtagaaatggagttcgagtttgatagattgcgggcctttcaggctatgcaggtacactgtaacaatatgcacacactaggagccagactgcccggcggcgtagagtgccgatttagacgcggcccagcaatggcctgggaaggcgaacctatgaggcataacttgggagggaatctgggcgatcctcgagcccgggcggtgagtgtcccccttggcggaagagtcgctaggttcctacagtgtcgattcctttttgccggtccatggctcctctttagtgagatcagcttcattagcgatgttgtgaacaatagtagccctgcgttggggggcactttcccacccgctccctggtggccccccggcccgcctccaacaaattttagctccttggagcttgaacctcggggccaacaacctgtggctaaggcagaaggatcgcctactgccatcctgatcggatgtctggtcgcaatcattcttcttctgctgctcataatcgccctgatgctttggagactgcattggcgcagactcctaagcaaagctgagcgcagggtactagaggaggagctcacggtccatttgagcgtacctggcgacacaattttaatcaataatcgtccggggcccagggaaccgccgccttatcaagagccccggccgcgtggcaaccctccccacagcgcgccctgcgtaccaaatgggagcgcattgcttctcagtaacccagcctacaggttgctgctcgcaacctatgctagacccccccgagggcctggtcccccaaccccggcgtgggcgaagccaaccaatacacaggcctactccggggattatatggagcctgagaaacctggtgcccctctactcccccccccaccccagaacagtgtgcctcactacgctgaagccgacattgtgacgttgcagggggtgaccggaggaaacacctatgccgttcctgcattaccccctggcgcagtgggggatggcccaccgcgtgtggatttcccccggtcaagactacggtttaaagaaaagctgggcgagggccagttcggcgaggtgcacctgtgcgaggtcgactctccacaggatttagtgtccctggattttcctcttaacgtgcggaaaggccatcccctcctggtggctgtgaaaatcctccgccctgatgccaccaagaatgctagttttagcctcttttctcgcaacgattttctgaaagaggtgaaaatcatgtcacggctgaaggaccctaatattattcgacttctcggcgtgtgcgtccaggatgacccgttgtgtatgataaccgactatatggaaaatggcgacctgaaccagtttctgagtgctcaccagctcgaggacaaagcagcagagggagccccaggcgacggacaggcagcccaaggccccaccatttcctaccctatgttgttgcacgtggccgcacagattgcgtccggcatgagatacctagcgacattaaactttgtgcatagggatctggcgacgcgaaactgcctggtgggcgagaacttcacgatcaaaattgctgattttggcatgagcaggaatctgtacgccggcgattactaccgggtccagggccgcgcggtgctacccattaggtggatggcctgggaatgtattctaatgggcaagttcacgacggcgtcagatgtgtgggcatttggcgtgactttgtgggaagtgctgatgctgtgtcgggcccagccttttgggcaactcaccgatgaacaggtgatcgagaacgcaggagagtttttccgcgaccagggcagacaagtatatttaagtcgaccccccgcctgtccccagggactgtacgaactcatgctgcgatgttggagccgggagtccgaacagagaccacctttttcacagctgcatagattccttgcagaagatgccctcaacacggtgtag

SEQ ID NO: 6561 - DNA, 318 bp, Artificial Sequence
  Description of Artificial Sequence: Synthetic coding sequence
atgggggtttctaaactggatatcctctacagacggttgttgcttacgaaactgtttatccgcgggtggggtcgacctgaggaccttaaaagacttttcgaattcaggaaaatgattggcaaccgtgagagatgtcagaacctggtttcttcggactacccagtccatatcgacaagatagaggaacagagtgattgcaagatcctggatggacacttcgtgagccccatggcgcactatgttcccgatatcatgccaatcgagtccgtgatcgccaggttccagttcatagttcctaaggagtggaattctaagtag

SEQ ID NO: 6562 - DNA, 126 bp, Artificial Sequence
  Description of Artificial Sequence: Synthetic coding sequence
atgaaattgagtggaatgtttctcctcttatctctcgcacttttttgcttcttgaccggtgtgttttctcagggaggacaggtagattgcggcgaatttcaggatccaaaagtgtactgcacatag

SEQ ID NO: 6563 - DNA, 459 bp, Artificial Sequence
  Description of Artificial Sequence: Synthetic coding sequence
atgagatttaaaactaccgccaaggacggacttcttctgtggcggggagatagccccatgcgtccaaacagcgatttcatttctttgggcctgagagacggtgcactcgtgttctcatacaacctcggcagcggggtggcctccattatggttaatggctcatttaacgacgggagatggcatcgggtgaaagccgtgcgcgatggccagtcgggcaagatcacagtggacgactacggcgctcggacaggcaaatccccaggcatgatgaggcagctgaatatcaacggcgcgctctacgtgggcggcatgaaggaaattgccctgcatacaaaccgccaatacatgaggggactcgtggggtgcatttcgcactttactctgtctactgattaccatatttcactagttgaggatgcagttgatggtaaaaatattaacacatgcggagcgaagtag

SEQ ID NO: 6564 - DNA, 1611 bp, Artificial Sequence
  Description of Artificial Sequence: Synthetic coding sequence
atggacttcctgctggctctggtgcttgtatcaagtttgtacctccaggccgcagcagaatttgacgggaggtggccacgtcagatcgtgagtagtattggcctctgtcgctatggagggagaatagactgttgttggggctgggccaggcagtcatggggccaatgtcaacccgtgtgtcaacctaggtgcaagcacggagaatgcataggtcccaataaatgcaagtgtcatcccggttacgctgggaaaacctgtaatcaggatctaaatgaatgcggactgaagccaagaccctgtaagcatagatgtatgaacacatacggaagctataagtgttattgcttgaacgggtatatgctcatgcccgacgggagttgctcctcagcattgacttgctctatggccaactgtcaatatggatgcgatgtcgttaagggccagatcagatgtcaatgtccctctcctggcctgcagttagcccccgatgggcgaacctgcgttgacgtcgatgaatgtgctacgggacgggctagctgcccaaggttccgccagtgtgtgaacaccttcgggtcatacatttgcaagtgtcacaagggctttgacctaatgtacattggaggcaagtatcagtgccacgacatcgacgagtgtagtctcggccagtaccagtgcagcagcttcgcaagatgctacaatattaggggatcatacaagtgtaagtgcaaggagggttaccagggtgacggattgacgtgcgtgtacattcctaaagtgatgatcgagcccagcggccctattcatgttcccaaggggaacggaaccattctgaaaggagatacaggtaataacaattggatccctgatgttggaagtacctggtggccacctaaaaccccatatatcccacccattataactaacagaccaacaagtaaaccaacaaccaggcctaccccaaagcccacccctatacctacaccaccacctcccccacctcttcctacagaacttaggacaccgctgccccccacgacgccagaaaggcccaccactggcttaacaacgatagctcctgcagcttccacaccccctggtggcattactgttgacaacagagtgcagacagacccccaaaagcccagaggagatgtgttttctgtattagtacattcttgcaatttcgatcatggactgtgcggatggatccgcgaaaaggataacgatttacattgggagccaatcagggacccggccggaggacagtatttgacggtaagcgcggctaaggcacctgggggcaaggccgcccggctcgtgctacctttaggcaggttgatgcactccggtgacctgtgcttgtcatttcggcacaaggttacaggtctgcacagcgggacacttcaagtcttcgtgcgaaagcatggagcccacggggctgcactgtgggggcgaaacggcggacatggctggagacagactcaaattaccctccgtggcgccgatataaagtcggtcgtgtttaaaggagaaaagcgacgtgggcacactggggaaattggcctggatgatgttagcctgaaaaaggggcactgctcagaggaacgatag

SEQ ID NO: 6565 - DNA, 288 bp, Artificial Sequence
  Description of Artificial Sequence: Synthetic coding sequence
atgctattccgtaatcggttcttgctgctgctggctttggctgctctactcgcgttcgtttccctttccttgcagttttttcaccttatccccgttagtactcctaagaacggtatgtctagcaaaagtagaaaaaggatcatgccggatccagtgaccgagcctcccgttactgacccagtttatgaggcgctgctctactgcaatattccaagcgtagccgagcgaagcatggagggacacgcgccgcatcactttaaactggtatccgtgcatgtgtttatatag

SEQ ID NO: 6566 - DNA, 213 bp, Artificial Sequence
  Description of Artificial Sequence: Synthetic coding sequence
atggcttcagacctcatacgcaccattttggctgtggctctgatcagcaagctgggaaccgcagtggacgctgaactgatgccttccggggcaatcctacagaacaagagggagaatttaccacgggtgtgccatgccttggcgttcttgggaatggctcggtgtcaggacctcttcctggttcggctgcagggttggaaactgggcacatag

SEQ ID NO: 6567 - DNA, 417 bp, Artificial Sequence
  Description of Artificial Sequence: Synthetic coding sequence
atgggacccgaagcgttaagcagcttgctgctgttactgcttgtcgcatctggcgatgcagacatgaaaggtcacttcgatcccgctaagtgccgctatgctctaggcatgcaagataggaccatacctgactctgacatcagcgcttcatcttcctggtctgatagcaccgctgctcgccatagcaggctggagagcagcgatggcgatggagcctggtgtcctgctggttccgtgttcccaaaggaggaagagtatcttcaggtagatctgcagcgtctccacctggtggcgctggtaggcactcagggcagacatgcaggaggcctgggcaaggaattctcacgttcataccggctgcgatattcaagggacggacggcgctggatgggctggaaggacagatggggccagtag

SEQ ID NO: 6568 - DNA, 219 bp, Artificial Sequence
  Description of Artificial Sequence: Synthetic coding sequence
atggctgttagcgtgctaagactcacagtagtgttaggcttactggtactgtttttgacatgctacgcagacgataaaccagataagccagacgataaacctgatgactctgggaaggacccgaagccagattttcctaaatttctgagtctgctagggactgaaatcatcgaaaacgccgtggagtttatcttaaggtctatgtcgcgttcgacttag

SEQ ID NO: 6569 - DNA, 438 bp, Artificial Sequence
  Description of Artificial Sequence: Synthetic coding sequence
atggttcttctgcattggtgcctgctgtggctgctgttccctctcagctcacggacgcaaaagctccccaccagggatgaggagctgttccagatgcaaattcgggacaaagcttttttccatgactcttcagtgataccagatggcgccgagatctcgtcctacctcttcagggacacgccaaagcggtacttctttgtggttgaggaggacaacacgcctctgtctgtgactgtcactccttgcgatgcaccgttggaatggaagctctcgctgcaggaacttccagaggaccggtctggcgaaggatccggggatctggagcctttagaacagcagaagcagcaaattatcaatgaagaaggtacagaactgttctcttataaaggcaacgacgttgaatattttattagctcatcttccccctctgggctctag

SEQ ID NO: 6570 - DNA, 258 bp, Artificial Sequence
  Description of Artificial Sequence: Synthetic coding sequence
atgggacccgaagcactttcaagcctattgcttttgctactggtggcctccggggacgctgacatgaagggccatttcgaccctgccaaatgccgctatgcactggggatgcaggatagaacgatcccagactctgacatatcagcctcaagcagctggtctgattcgactgccgccagacatagtagactcgaaagctctgatggagacggcgcttggtgccccgccggcagcgtgtttcccaaggaggaagagtag

SEQ ID NO: 6571 - DNA, 1410 bp, Artificial Sequence
  Description of Artificial Sequence: Synthetic coding sequence
atgctgaaggtgcattaccccaaattcggagtgagcgaagattgtctgtatcttaacatctacgctcccgcacatgccgatacagggagcaaactgcccgtactcgtttggtttcctgggggggccttcaaaacaggctctgcctcgattttcgacggcagtgccttagctgcatacgaagacgtgttggtagtggtggttcagtaccggctgggcatttttggattcttcaccacttgggaccaacatgctccggggaactgggccttcaaggatcaagtcgcagctctcagttgggtacaaaaaaacatcgagttctttggtggcgaccctagctcagtgacaatttttggggagagcgcaggcgcaatatcggtatctagcctgatcctttcaccaatggctaagggactgtttcataaggccatcatggaatctggtgtcgccattattccctatctggaggcacacgattatgagaagtccgaggatctacaggtggtggctcatttctgtgggaataacgcgtcagactccgaagcactgcttcgatgcctccgaaccaaaccctctaaggaactgctgacactgtctcaaaaaaccaagtcatttacccgtgttgtggatggggcttttttccccaatgagcctctggatctgctctcacagaaggcgttcaaggccatccctagtattattggcgtgaacaaccatgagtgtggatttttacttcccatgaaagaggcgcccgagatcctctcagggagcaacaaatcgttagctttgcatctgatccagaacatccttcacattccacctcagtacctgcacctggttgccaacgaatactttcacgataaacactctctgactgagattcgcgactccttgctggacctcttaggggacgtctttttcgtggtcccagccctgatcaccgctcggtaccaccgcgatgccggggctcccgtgtacttttatgagtttcgccaccgccctcagtgttttgaagacactaagcctgctttcgtaaaagcagaccatgccgacgaggtgcgttttgtcttcggcggggcctttctcaagggtgatattgtcatgttcgaaggtgcaaccgaggaggaaaaactgctgagccggaagatgatgaaatattgggctacttttgcccgaactggaaaccctaacggcaacgacttgtccttgtggcctgcatataacctcaccgagcaatatctccagctggacctgaatatgtccttgggtcaacgactgaaggagcctcgtgttgatttctggaccagcaccatccccctgatcctgtctgccagtgacatgctccatagccctctgtcctctcttacgtttctatcgctccttcaacccttcttcttcttctgtgcaccgtag

SEQ ID NO: 6572 - DNA, 393 bp, Artificial Sequence
  Description of Artificial Sequence: Synthetic coding sequence
atgctcccattcctgtttttctctaccctcttttcttccattttcacagaggcacaaaaacagtactgggtgtgcaactcttccgacgcttccatttcgtatacctactgcggccgagacttaaagcagctctacttcaacctctatatcactgtgaatacgatgaatcttcccaaaaggaaggaagttatatgtaggggctccgatgacgattattctttctgtcgggcattaaagggtgagaccgtaaatacgacaattagcttttcctttaaggggattaagttttctaaagggaaatataagtgcgttgtggaggcaatctccggttcccctgaagagatgttgttctgcctggagtttgttattctgcatcagccgaatagcaattag

SEQ ID NO: 6573 - DNA, 318 bp, Artificial Sequence
  Description of Artificial Sequence: Synthetic coding sequence
atgaagtgtaccgctcgtgaatggttgcgtgtgacgaccgtcctcttcatggctagagccatccctgctatggtggtccccaacgctacacttctggagaaactgttggagaagtatatggacgaggacggtgagtggtggatcgctaaacagcgtggtaagcgcgccattacagacaatgacatgcagagcattttagatcttcataataagctgcgttcccaggtgtatccaacagcttcgaatatggaatatatgacgtgggatgtcgaattggaacgttcagctgagtcctgggctgaatcatgtctgtggtag

SEQ ID NO: 6574 - DNA, 567 bp, Artificial Sequence
  Description of Artificial Sequence: Synthetic coding sequence
atgaccatggtgtgccacagacccgaaggcctggaacagctcgaagcccagacaaactttacaaaaagggagttgcaagttctgtacaggggattcaaaaacgagtgccccagtggggtggtgaacgaggacacttttaaacaaatatacgcacagttcttcccgcacggagatgcaagcacttacgcccattatctctttaatgcattcgataccacacaaactggctcagtgaaattcgaggactttgtgaccgccctgtcaattttgctacgtggtactgtccatgaaaagctccgttggacctttaacctgtatgacattaataaagatggatatatcaacaaagaagagatgatggacatagtgaaggcaatatacgacatgatgggaaagtatacatatcccgtgttgaaagaggatacccccagacagcacgtagacgtgttttttcagaaaatggataaaaacaaggacgggatcgttactttggatgagttcctcgagagctgccaggaagacgataatataatgcgcagcctgcaactgttccagaacgtcatgtag

SEQ ID NO: 6575 - DNA, 1275 bp, Artificial Sequence
  Description of Artificial Sequence: Synthetic coding sequence
atgcctccctttctcattactctgtttctgttccattcgtgttgtttgagagctaatggccacttgagggaaggcatgactttattgaaaactgagtttgccctgcacttataccagtcagtagccgcctgtaggaacgaaacaaactttgtcatttcgccagctggtgtatcactgcccttggaaatcttacagtttggtgccgaaggcagtaccggccagcaactggctgacgccttgggatataccgtccacgataagagagtaaaggacttcctgcatgctgtgtatgcaacacttcccacctccagtcagggtacggagatggaattggcatgtagcctatttgtgcaggtgggtacaccactgtctccctgcttcgtggagcacgtgtcatggtgggcaaattcttccctcgagcctgcggatctcagcgaacctaattcgactgcaattcagactagtgagggcgcgtcaagggagacggccggcggaggcccctcggagggcccgggcggatggccttgggaacaggtttccgcagctttcgcccagctggttctggtgtccactatgtctttccagggtacctggaggaaaagattttctagcaccgatacacaaatcctcccttttacatgtgcctacgggctggtgctgcaagtgcccatgatgcaccaaaccacagaagtgaattacggacagttccaagatacagcagggcaccaagttggcgtactggagctcccctatctcgggtctgctgtttccctttttcttgtgttgcctcgggacaaggacacgcccctgtctcacatcgagccccatctgactgcatctactattcacctgtggacaacttccctgcgacgagcccgtatggacgtatttctgcccagatttcgtattcaaaatcagttcaatctgaagtcaatactcaattcttggggagttaccgacctgtttgatccactgaaagccaacttgaaagggatcagtgggcaggacgggttttacgtgtctgaagccatacataaggctaagatagaagtgctcgaggagggtaccaaggcctccggcgccacagctcttctattactgaagcgctccagaatccccattttcaaggcggatagacccttcatttactttctcagggaacccaacaccgggatcacagtgttcttcgatcgaattcagatcatctaccagtgcctttcaagtaataaagggagcttcgtacattacccgctgaagaacaagcacagtttttag

SEQ ID NO: 6576 - DNA, 1815 bp, Artificial Sequence
  Description of Artificial Sequence: Synthetic coding sequence
atggccgtcctcgtctgcccggcatcgtgccatggcctcaaggaatttagaataaggaggggcatgtggcgattgtgcctggtgtactatttctatccagccagttcaacattgtatgtgctgcgtatagacgtattgaattacacttctaaggatgagggtccatctgccgaagggccacagaggaatacaagactaggatggatccagggaaagcaggtgacagtgctgggatccccagtccctgttaacgttttccttggggttccattcgcggctccacctttgggcagtctcagatttactaatcctcagcccgcatcaccctgggataatctcagagaagctaccagctatcccaacctgtgtctgcagaattcagagtggctactgctcgatcagcacatgcttaaggtacactacccgaagttcggagtgtccgaagactgcttgtatctcaacatatatgcccctgcacatgccgatacagggagcaagctccccgtactggtgtggttccccgggggtgcattcaagactggctccgccagcatctttgacggatcagcactcgcggcttacgaggatgtattggtggtggtggtgcagtatagactcgggatttttggcttctttacaacctgggatcaacacgcccccggcaactgggccttcaaggaccaagtggctgccctgagctgggtgcagaaaaatatcgagttttttggaggagaccctagttcagtgacaatttttggcgagtccgccggggcaatcagcgtcagctctttaatcctgagccccatggcaaaggggctgttccacaaggccatcatggagtctggagtggctatcatcccttaccttgaagcccacgattacgagaaatcagaagacctgcaagtcgtagcccacttctgcggcaacaatgcctcagatagcgaggccctgctcagatgtctacggactaagccatctaaggagctgttaactttatcccaaaagaccaagtcattcacccgggtagttgacggcgccttctttccaaacgagccactggacctgttgtcccaaaaggcgttcaaagccattccgagtataatcggggtgaacaaccatgagtgcggctttctgctgcccatgaaggaggcccctgagatcttgagcggctcaaataagagcctcgccctgcatctcattcagaacatcctgcatatcccaccgcagtatcttcacttagttgctaacgaatattttcacgataagcactctctgacggagatccgagacagtctgcttgaccttttaggagacgtattttttgtcgtgccagcgctcatcaccgctcgctaccaccgcgatgcaggcgccccagtttatttctatgaatttagacatcggcctcagtgtttcgaggacaccaaacccgcgtttgtgaaagcggatcatgccgacgaggtgaggtttgtgttcggtggcgcctttctgaaaggcgacatcgtcatgttcgagggcgcaaccgaggaggagaagttactgtcaaggaagatgatgaaatattgggccacattcgcacggactgggaacccaaacggtaacgacctgtccctctggcctgcttacaacctgactgagcagtatttacagctggatcttaacatgtcactgggccagaggctcaaggagcccagggtagacttttggacctctactattcccctgatcctttccgcgagcgacatgctgcatagtccgctcagcagcctgacttttctttctctgctccagcccttctttttcttctgcgctccatag

SEQ ID NO: 6577 - DNA, 939 bp, Artificial Sequence
  Description of Artificial Sequence: Synthetic coding sequence
atgaatatctggggtcaaatctggccaaaggcagtgtacctggtttgtaattattcacccaaggggaattggtggggccatgctccatacaagcacgggagaccttgcagcgcttgtcccccatcctttggaggcggttgtcgcgaaaatctatgttacaaggaaggttcggacaggtattatcctccgagagaggaggagactaacgaaatcgagaggcagcagtcccaagttcacgatactcacgtgaggacccgaagcgacgatagcagcagaaacgaagtgatatccgcgcaacagatgagtcagattgtttcctgcgaagtgcggctacgggaccagtgtaaaggtactacatgtaatagatacgagtgccccgccggatgtttggactctaaggctaaagttattgggagtgtacattatgaaatgcagagctctatatgcagagccgcgatccactatggaattatcgacaatgatggcggatgggtcgacatcactcgacaagggcggaagcactacttcatcaagtcaaaccgtaacggaatccagactattgggaagtatcaatctgctaacagtttcaccgtctcaaaagtgaccgtccaggctgtaacatgtgagaccactgtcgagcagctgtgccctttccataaacctgctagccactgtccgcgcgtgtactgcccccggaactgtatgcaggccaatccccattatgctcgagttattggtacgcgcgtctactcggacctctcatccatctgtagggcggccgtgcacgcaggagtagtaaggaatcacgggggctacgtggatgtgatgcctgtggacaagcggaaaacgtacatcgcctccttccagaacggcatcttctccgaatctcttcagaacccccctggcggcaaagcgtttagagtctttgccgtggtatag

SEQ ID NO: 6578 - DNA, 777 bp, Artificial Sequence
  Description of Artificial Sequence: Synthetic coding sequence
atgatcgccatcagcgccgtatcctcggccctgcttttctcgctgctctgtgaagcttccaccgtcgtcctcctgaactcaactgattcctccccaccaaccaacaacttcacagatatcgaagcagccctcaaagcccagctggacagcgccgacatccctaaggcgcgccggaagaggtacatttcccagaatgacatgatcgcgatattggattaccacaatcaagtgcggggtaaggtattccctcccgcagctaacatggaatacatggtgtgggatgagaacctggccaaatccgcagaggcctgggccgcgacctgcatttgggatcacggcccgagctatctgctgcggttcctgggccagaacctctctgtacgcaccggacgttacaggagcattctgcagctggtgaagccttggtatgacgaggtcaaggactacgcattcccctatccgcaggactgcaatcctcggtgtcccatgaggtgtttcggccccatgtgcactcactatacacaaatggtgtgggcgacgtcgaatcgcatagggtgcgctattcacacctgccagaatatgaacgtctgggggagtgtttggcgccgagccgtctacctggtgtgtaactacgccccaaaggggaactggataggtgaagccccatataaggttggcgtaccttgcagctcttgccctccgtcatacggcgggtcatgtaccgacaacctctgctttccaggggttacaagcaactatctgtattggtttaaatag

SEQ ID NO: 6579 - DNA, 1215 bp, Artificial Sequence
  Description of Artificial Sequence: Synthetic coding sequence
atgccaccgtttttgatcactctctttctgtttcacagttgctgcctgagagccaacggtcatttgagagaaggaatgactctgctaaaaactgagttcgccctacatctctatcagtccgtagcagcctgtcgcaacgaaaccaactttgttatctccccagcgggcgtgagcctcccactcgagatccttcagtttggcgcagaggggagcaccggacaacagttggctgacgcgctcgggtatacggttcacgataagagagtgaaggacttcttgcacgccgtgtatgctaccctcccaactagcagccagggcacagagatggagctggcttgctccctgttcgtgcaggttggcactcccctcagcccttgcttcgtcgagcatgtgagttggtgggcgaatagtagtttggagcccgcggatctgtcggagcccaactctactgccattcagaccagcgagggcgcctccagagagacggcaggcgggggaccatcagaagggccaggagggtggccctgggagcaagtgtctgccgcttttgcgcagttggtattggtaagtacaatgtcatttcagggtacttggcgcaaaagatttagttcaacagatacacaaattttgccttttacctgtgcctacggattggttctccaggtgcctatgatgcaccaaaccacagaggtgaattacggccaatttcaggacaccgcgggacaccaagttggcgtgttggaactgccttacctgggttccgcagtaagcctgttcctggtgctgccacgggacaaagatactccgctcagccatatcgagccccatttgaccgcatctactatccacctgtggacaaccagtctgcgccgggcaaggatggacgtctttctgccacggtttaggatccaaaatcagttcaatttaaagagcatattaaactcatggggggtgacggacttgttcgacccactgaaggcaaacctgaagggcattagcggtcaggatggattctacgtttctgaagcaattcataaggccaaaattgaagtactagaggagggcactaaggcctcaggcgcgaccgctctccttcttctcaaaagatctaggattcctattttcaaagctgaccggccgtttatctacttcctgcgggagccgaacacggggttcgtctttagcattggacgtgtgagcaacccactagattag

SEQ ID NO: 6580 - DNA, 936 bp, Artificial Sequence
  Description of Artificial Sequence: Synthetic coding sequence
atgctgtaccaaaccataaacagtctgaagacgaaaaatcctaagctaaagatacttctctctatcggcggctacctctttggttctaagggctttcacccgatggtggatagcagcacatcgcgcctagaattcatcaattccatcatactgtttttgcgaaatcacaacttcgacggcctagatgtgagctggatttacccggaccaaaaagagaatacccacttcacggttcttattcatgagttagccgaggcgttccagaaggatttcactaaatcaaccaaggagcggctgctgcttacagccggagtgagtgccgggcggcaaatgattgataatagttatcaggtggagaagcttgccaaagacttggacttcattaacctgttatccttcgacttccatgggtcttgggagaaacctcttatcacagggcacaactcgcccctgagtaaagggtggcaggataggggtccgagctcatactataacgtggaatatgccgtcggttactggattcacaaaggaatgcccagtgagaaggtggtaatgggtatccccacgtatgggcacagcttcacacttgcctctgccgaaaccactgttggtgcacccgcttccggacccggagcagccggacccatcaccgaaagtagcggctttttagcttactatgagatctgtcagtttctgaagggggccaagattactcggcttcaggaccagcaggtcccatatgccgtgaagggcaaccagtgggtgggatatgatgatgtgaagtctatggagaccaaggtccagtttctaaaaaacctgaatctgggaggcgcgatgatctggtcaatcgacatggacgattttacaggaaagtcatgtaaccaaggaccttatcctttggtacaagcagtgaaacgctcactcgggagtctgtag

SEQ ID NO: 6581 - DNA, 555 bp, Artificial Sequence
  Description of Artificial Sequence: Synthetic coding sequence
atggcaagcgaacggctgccaaatagacctgcctgtctgctggtcgccagtggtgcagctgagggcgtgagcgctcagtccttcctgcactgttttaccatggcttcaacggcttttaatctgcaggtcgcaacacctggtggtaaagcgatggaatttgtggacgtgaccgagtccaatgcccgttgggttcaagatttcaggctcaaggcttacgctagccctgcaaaacttgagtctatcgacgagcctatatgtgccgtaggccacggcgtagccgcactatgctgtgccaccaacgaggacagaagctgggtgtttgattcctacagcctgactgggccgtcagtctgtgaactcgtgcgagccccagggtttgccagactgcctctcgttgtggaggactttgtgaaagatagcggagcttgtttctccgcttctgagccagacgccgtgcacgttgtactggacagacacctagtcacgggtcagaatgccagctccaccgtcccggccgtccagaacctcttgtttctatgcgggagccggaaatag

SEQ ID NO: 6582 - DNA, 1257 bp, Artificial Sequence
  Description of Artificial Sequence: Synthetic coding sequence
atgagaagtctcctcctgttgagcgctttctgcctcttagaagctgccctcgctgccgaggtcaagaaacctgccgccgccgctgcccccggaaccgccgagaagctgagccccaaagctgccacgctggctgaaagatcagcaggactcgcattcagcctgtaccaggcgatggccaaagaccaggcagttgagaatattttagtgtctcccgtggtagtggcatccagtttagggctagtgtcgctgggcgggaaggccactacagcttctcaggccaaagctgtgctgagcgccgaacagcttagagacgaagaggtgcacgccggtctgggtgagttactgcggtctttaagtaatagcacggccaggaacgtgacatggaagttgggcagtcgcctgtatggtccttcttctgtgagcttcgcagacgactttgtgaggtccagcaaacagcactataactgtgaacactcaaaaattaactttagggacaaaagatctgcccttcagtctattaacgagtgggccgcccaaacgacagatggcaaactccctgaggttactaaagacgtggagcgtaccgatggggctctgctggtcaatgcaatgttcttcaagccccactgggacgagaagtttcatcataaaatggtggacaatcggggttttatggtaacccggagttacactgtgggagtaatgatgatgcaccggacgggtttatataactattacgatgatgagaaggaaaagctccagattgtggagatgccgctcgcccataaactcagttccttaattatcctgatgcctcatcacgtggagccgttagagagactggagaaactgttgaccaaggagcagctcaaaatctggatgggcaagatgcaaaaaaaagccgtcgcaattagcctgccaaagggcgttgtcgaggtgactcacgacctccagaagcatttggctggcctgggcttgactgaagcaattgataagaacaaggccgacctcagccggatgtcaggcaagaaggacctttacctagcttcagtcttccacgcaaccgcgtttgaattggatacagatggcaacccttttgaccaggacatctacggccgcgaggaactccggtccccgaagttgttctacgccgatcatccctttatcttcctggtgagagatacccagtccggtagcctgctgtttatcggcaggcttgtcagacccaagggcgataagatgcgcgacgagctttag

SEQ ID NO: 6583 - DNA, 1425 bp, Artificial Sequence
  Description of Artificial Sequence: Synthetic coding sequence
atggatcgtaacccctctcctccaccacctggccgggacaaggaagaggaggaagaggtggccgggggcgattgtattggctctacagtttactctaaacattggctctttggtgttttgagtggtttgattcagatcgtcagccctgagaacaccaaaagctcatcagacgacgaagagcagttaacagagctggacgaagaaatggagaatgaaatctgtcgcgtgtgggacatgagcatggacgaagacgtggcactgtttcttcaggaatttaatgcccccgacattttcatgggagtgctcgccaagagcaaatgtccacgtttaagagagatttgtgtggggatcctcggtaacatggcgtgctttcaggagatctgtgttagtatatcgagcgataaaaacttgggccaggttctgctgcactgtctctacgacagcgatcctcctaccctgctggagacatcacggctcctgctgacctgtctctctcaggccgaagtcgcaagcgtctgggtggagcggatccaagagcatccagcaatctatgacagcatttgcttcatcatgtccagttctacgaatgtcgatctgttggtcaaggtaggggaggtggtcgacaagctatttgacctggatgaaaagcttatgctggaatgggtccggaatggtgccgcccagccgctcgaccaacctcaggaagagagtgaagagcagcccgtgttccgcctggtaccttgcatcctcgaggctgccaaacaggttcggtccgagaaccccgaatggcttgatgtctacatgcacatcctgcaactcctgacaacagttgacgacggcattcaggctatagtccattgccctgacactgggaaggacatatggaacctcctgttcgacctggtgtgtcatgagttctgccaaagtgatgatccccctataattctgcaggaacaaaaaaccgtcctcgcatcagtgtttagcgtgcttagtgctatatatgcaagccagaccgagcaggaatacttgaagatcgagaaggtggatctccccctgattgatagtcttattcgcgtcttgcagaatatggagcagtgccaaaagaaaccagaaaactctgcagaatccaatactgaagagacgaagcgcaccgatctcactcaggacgattttcaccttaagatactgaaagacatcctctgtgaatttctatccaatatcttccaggcgttaacaaaggaaacggtggcccaaggagtcaaagaagggcagctaagcaagcagaagtgttcaagcgcctttcagaacctgctgcctttttactctccggtggttgaagactttatcaagatactccgggaagtggacaaggctttagcagacgacctcgagaagaattttccaagcctaaaggtccaaacctag

SEQ ID NO: 6584 - DNA, 438 bp, Artificial Sequence
  Description of Artificial Sequence: Synthetic coding sequence
atgctgactaggctggtgctgtcagctcacctgtcaagtacaaccagtcccccctggacacacgccgctattagttgggagcttgataatgtcttaatgccgagtcctcgcatctggccccaggtgacgcccaccggcagatccgcgtccgtgcgatctgaagggaacacttctagcctgtggaacttctcagctgggcaagacgtgcacgctatcgtcacgcgaacgtgtgagtctgtgctttcatccgctgtgtatacccacggttgcgggtgcgtccggtccgccacgaatattacatgtcaaagtagtggtcaacaaaggcaggccgcacggcaggaagaagagaattccatctgtaaggctcatgattccagggagggtagactgggttacccactgtcagcccaccaacccggtagcggcggccctaactag

SEQ ID NO: 6585 - DNA, 1728 bp, Artificial Sequence
  Description of Artificial Sequence: Synthetic coding sequence
tgaatcttcggcggctcaattcactattttagggtgccgcgggaatattggagggaccgtctgttgaagatgaaagcatgcggcctcaacacactgacgacctacgttccctggaatctgcatgaacctgagagaggcaagtttgattttagcggcaatctcgaccttgaagcctttgtcttgatggctgcagagattggactttgggtgattctacggccaggtccctatatctgcagcgagatggacctggggggactgccctcctggctgctgcaggatccaggaatgagattacggaccacttacaaggggttcactgaggctgtggacctgtactttgaccatctcatgtctcgcgtggtgcctctgcagtacaagagaggcggccctattatcgctgttcaggttgaaaatgaatacgggtcatacaataaagatcccgcctacatgccatacgtcaagaaggcattggaggatcgcggaatcgtcgagctcctgctgactagtgacaacaaggacgggctgtctaagggtatagtgcaaggggtcctagccacaatcaacctacagtcaacacacgaattgcagctgctaacgacatttctcttcaacgtgcaaggcacacagcccaaaatggtcatggaatattggactggctggttcgacagctggggagggccccataacatactggattcctccgaagtgctcaagaccgttagtgctattgttgacgcgggtagcagcatcaatctgtacatgttccacggcggcaccaatttcggatttatgaacggggcaatgcacttccatgactataagagtgatgtgacaagttatgactatgacgccgtcctcactgaagcaggcgattataccgcgaaatatatgaaactcagggatttctttggctctataagtgggattcccttgcccccacctcctgacctcttaccaaagatgccgtatgagcctctcaccccagttctgtacctcagcctttgggatgccctcaagtacctgggggagccgatcaaaagtgagaaacctattaacatggagaaccttccagtcaacgggggcaatggtcaatccttcggctacattctgtacgagaccagcattacctcatccggaattctgagtggccacgtgcacgacagagggcaagtgttcgtgaacacagtgtcgatcggcttcctggattataagacaacaaaaattgcagttccactcatccagggttacacggtgctcagaatcctggtcgagaaccggggccgagtgaattacggcgaaaacatcgatgatcagagaaaaggtctgatcggtaacttgtacctaaatgatagtcctctgaaaaatttccggatttacagcctggacatgaagaaatccttcttccagagatttgggctggacaaatggagcagtttgcctgaaacgcctaccctgcccgccttcttcctgggatctctgagcatttcaagcactccatgcgacacttttcttaagcttgaggggtgggagaagggcgtggtgttcattaatggacagaaccttggtaggtactggaatattgggccacagaagaccctttaccttccaggcccctggctgtcatcaggaattaatcaagtgattgtcttcgaggagaccatggcaggtcccgcacttcagtttaccgagaccccccacctcgggcgcaatcagtacatcaaatag

SEQ ID NO: 6586 - DNA, 255 bp, Artificial Sequence
  Description of Artificial Sequence: Synthetic coding sequence
atgagaactctttttaacttactgtggctggcactagcctgcagccccgtgcatacaaccctcagtaaaagcgatgccaaaaaggccgctagtaaaaccttgctcgaaaagtcccagttctcggacaaaccggtccaagaccggggactcgttgttaccgatctgaaagctgaatctgtcgtgctggagcaccgaagttactgttccgcaaaagcccgcgaccggcattttgcaggtgacgtgctcggctactag

SEQ ID NO: 6587 - DNA, 744 bp, Artificial Sequence
  Description of Artificial Sequence: Synthetic coding sequence
atgagatcgttgctgctcctatctgcgttctgtttactggaagctgccttggccgctgaagtaaaaaagccagctgcagctgcagcacctgggactgccgagaaattgtcacctaaagccgccacgttggccgaacgctccgccgggcttgccttttcactgtatcaggcaatggccaaagaccaggctgtggagaacattctggtcagccctgttgttgttgcatcaagtcttggcctggtcagcctcggtggaaaggcaactactgcaagccaggctaaagccgtattgtctgctgagcagcttcgcgacgaggaggtccatgctggactgggggagctgctccgctctttaagcaacagcaccgcccgcaacgtcacttggaagcttgggtcccgcctgtatggaccttcaagcgtctcgttcgcggacgacttcgtgagatctagtaaacagcactataactgtgaacactccaagatcaacttcagggacaaacggtccgcattgcagagcattaatgagtgggccgctcaaacaaccgatgggaagctccctgaagtcaccaaagacgttgagagaaccgacggcgccctgctagtcaatgcaatgttctttaaacctcactgggacgagaagttccatcacaaaatggtcgataaccggggtttcatggtgacgcgatcatacacagtcggcgtgatgatgatgcataggaccgggctgtacaattattacgactag

SEQ ID NO: 6588 - DNA, 117 bp, Artificial Sequence
  Description of Artificial Sequence: Synthetic coding sequence
atgcggacattgtttaatctcctgtggctcgcattagcttgctcccctgtgcatacaaccctcagcaaatcagatgccaaaaaggccgccagcaaaaccttactggaaaaggtctag

SEQ ID NO: 6589 - DNA, 750 bp, Artificial Sequence
  Description of Artificial Sequence: Synthetic coding sequence
atgcgctcactgctactactgagtgcattttgtctgctcgaggccgctctggccgcggaagtcaagaaacctgcagccgctgcagccccagggacagccgaaaaattgagtccaaaggccgcaactctggcagaaaggtctgctggcctcgccttttcactttatcaggccatggctaaggaccaagccgtcgagaacattctggtctcgcccgtggtcgtcgcgtcatctctcgggctcgtctcccttggagggaaggctacaaccgcgtcccaggcgaaggctgttctcagtgccgagcagttacgcgacgaggaagtccatgctggacttggcgagctgctcagatccttgtcaaactctacagcaagaaacgtgacgtggaagttggggagcagactatacgggccgtcctccgtgtcattcgctgatgatttcgtgcgatcttcaaaacagcactataactgcgaacattccaagattaattttcgggacaaacgttccgccctgcagtcaataaacgagtgggccgctcagacaaccgacggcaaactgcccgaggttacaaaggatgtagaacggacagatggagcccttctggtgaatgctatgttctttaagccacattgggacgaaaaattccatcacaagatggtggacaataggggattcatggtaacgcgatcatatacagtgggagtcatgatgatgcataggaccggcctatataattactacgacgacgagtag

SEQ ID NO: 6590 - DNA, 201 bp, Artificial Sequence
  Description of Artificial Sequence: Synthetic coding sequence
atgaaacctctgctcgtcgtgtttgtgttcttgttcttatgggatcccgtattagctggcatcaattctttgtcatcagaaatgcataaaaaatgttacaagaacggcatttgtcgtctggaatgttatgagtcggagatgctcgtggcatattgcatgttccagctggagtgttgcgtgaagggaaaccccgctccctag

SEQ ID NO: 6591 - DNA, 1002 bp, Artificial Sequence
  Description of Artificial Sequence: Synthetic coding sequence
atggtttcaaaaagtaggtggaagcttctagccatgctcgctttggtgttagtggtgatggtttggtactctattagtcgggaagatcgctacatcgagctgttttattttcccattccagagaagaaagagccgtgcctacagggtgaagccgaaagcaaggcctccaagttgttcggcaattactctcgtgaccaacccatcttcctacgccttgaggattacttctgggtgaagactccatcggcctacgagctgccatacggtaccaagggatctgaagacctgcttcttagagtcctcgccatcactagctcttccatcccaaagaatatccagtccctgcgttgtaggcgttgtgtcgtggtaggcaatgggcatcgtttgagaaactccagtctcggcgatgccatcaataagtacgacgtagtgatcaggctcaacaacgcgcccgtcgctggctatgaaggagatgtcgggtccaagactacgatgcggttgttctatcccgagtccgcgcacttcgaccctaaggtggaaaataaccccgacacactgctggtcttggtggcatttaaggctatggactttcactggatagagacaatactgtccgacaagaaacgcgtgcgcaaggggttctggaagcaaccacctctgatttgggacgtaaatcccaaacagatacgcatcttaaacccctttttcatggagatcgccgctgataagttgctgtctcttcccatgcagcagccgcgcaagatcaagcaaaaacctactacagggctcctggcaattacgcttgcattgcacctgtgtgatctcgtccacatcgccggctttggctatccagacgcctacaacaaaaagcaaactatccactactacgagcaaattactctgaaaagtatggccggaagtggtcacaacgtgagccaggaagcgttagctatcaaacggatgctggaaatgggagcgataaaaaacctgacttcattttag

SEQ ID NO: 6592 - DNA, 645 bp, Artificial Sequence
  Description of Artificial Sequence: Synthetic coding sequence
atgcgacccaagactgggcaggttggttgcgaaacacccgaggaactcggtcctggacctcgtcagagatggcctctcttacttctgggactggccatggtcgcacacgggctgctccggccaatggttgctccacagtccggggacccagacccaggagcctctgtaggttcctccagatcttccctcagaagcctctggggcaggctgttgctgcaaccttcccctcagagggctgatcccaggtgttggcccagggggttctggtccgagccccagagcctgtgctacgtgttcggtaccgggaccaaggtgacagtactggggcagccaaaggctaaccccacagtgaccctgttcccgcccagttcggaggagttgcaggctaacaaagccacccttgtttgcctgatcagtgacttctatcccggagcagtaactgtggcgtggaaagccgatggaagccctgtgaaagcaggcgtggagactacaaaaccttctaagcagtccaacaacaaatacgccgctagcagctacctgtctctaactccagagcagtggaaatcacatcgtagctattcttgtcaggtcactcacgaagggtccaccgtggagaaaaccgtggcaccgaccgagtgctcatag

SEQ ID NO: 6593 - DNA, 1050 bp, Artificial Sequence
  Description of Artificial Sequence: Synthetic coding sequence
tagctgtataagaatcggcttggaagcggggggagaggccggtgcataaagcaaggagaaaactggtactctcccaccgaattcgaggccatggcaggacgagccagttccaaagattggaaaaggagtataagatatgctggtcggccccttcagtgcctcatccaggacgggattttaaacccacatgctgcgagctgcacttgtgccgcttgctgtgacgatatgaccttgagtggtcccgtgcggttatttgtcccttataaaaggcgcaagaaggagaacgaactcccgactacccccgtgaagaaagactccccgaagaatataaccctcctgcccgctaccgccgccacaacttttaccgttactccctccggtcagatcacaacatcaggtgccctgaccttcgaccgcgcttcaaccgtggaggccacagctgtgatctctgagagccccgctcaaggcgatgtctttgcaggtgccactgtgcaggaggcctcagtccagccaccctgcagggcttcacaccccgaacctcactatccgggataccaggactcctgtcagatagctccattccctgaggcagcgttacccacaagtcatcctaaaatcgtcctgacctccctgcccgccctggccgtcccacctcccacccctaccaaagcagcaccacctgcactcgttaatgggctagagctctctgagcctaggtcttggctctatcttgaggaaatggttaactctctgttgaacacggcccagcagctgaagacccttttcgagcaggccaaacacgcctccacttaccgagaggccgctacaaaccaggcaaagattcacgccgatgctgaaagaaaggagcagtcatgtgtgaactgtggacgtgaggccatgtctgagtgtacgggctgccataaggtgaactattgcagtactttttgccagcgcaagcggtggtccctcaccatgctgacgagtctggtgagcatatcctggctgagagctattctcccctgccagcccccaaaagtactcggcctgtag

SEQ ID NO: 6594 - DNA, 600 bp, Artificial Sequence
  Description of Artificial Sequence: Synthetic coding sequence
atgtcgctggacatccagtccctggatatccagtgcgaagaactttccgacgccagatgggctgagttgcttcccctattgcagcagtgccaggtagtcaggcttgatgattgcggcctcaccgaggccaggtgtaaggatatcagttctgccctcagagtcaatccggctctcgccgaattgaatcttaggtccaacgaactcggcgacgtgggagtccattgtgtacttcagggactccaaacacctagttgcaaaatccagaaactgagtctgcagaattgctgcttgactggtgccgggtgtggcgtgctttcctcaaccctgcgaacattacccaccctgcaagagctacatctctcggacaacctgctcggagatgccgggctgcagctgctgtgtgagggactgcttgacccacagtgtcgtcttgagaaattacagctcgaatattgtagtctgagtgccgcaagctgcgaacctctggcttctgtactgagggccaagccagacttcaaagagctcacagtgagcaataatgacattaacgaggccggcgtgagggtgctctgtcagggcctgaaagacagcccatgctag

SEQ ID NO: 6595 - DNA, 465 bp, Artificial Sequence
  Description of Artificial Sequence: Synthetic coding sequence
atggcaggcatcccaggactgctgttcctcctgtttttcctgttatgcgccgtggggcaggtgagtccttactcagcaccttggaagccaacatggccagcctacaggctgcctgttgtgttgccacagtccaccctgaatcttgccaaaccagattttggcgcggaagccaagttggaagtgtcatcttcgtgtggaccacagtgtcacaaaggaactccgctcccaacgtatgaagaggccaagcagtacttgtcttacgaaacattgtacgcaaacggctctcgaactgaaacccaagtgggcatctatatcttgagcagcagcggagatggtgcccagcatagggacagcggatctagcgggaaatcacgtcggaagcggcagatttacgggtatgactccagattttccatctttgggaaggacttcctgctgaactacccattctccacaagcgtgtag

SEQ ID NO: 6596 - DNA, 936 bp, Artificial Sequence
  Description of Artificial Sequence: Synthetic coding sequence
atgggtatcatacagtctatcctcgccacctcacgcgactgctatagcttcaagaagaagcctattccgaagaagcccactatgttggctctggccaaaatcctgctcatttcaaccttgttttactccctgctttcggggtcccatgggaaggagaaccaggatataaatactacccagaacatcgccgaggtctttaagaccatggagaataagccaatttcactggagtccgaagccaatctaaactctgataaagagaacattaccaccagtaacttgaaggcctcacacagcccacctctgaatctgcccaacaattctcatggcatcactgatttttcctcgaactcctccgccgagcactcgctgggtagtcttaaaccaacatcaacaatcagcaccagcccgcctttaattcacagttttgtatctaaagtcccatggaacgcccctattgcggatgaggatctccttcctattagtgctcaccccaacgctacacccgccttatcatctgaaaacttcacatggagtcttgtcaatgacactgtcaagacgcctgacaattcttcaatcaccgtgtcaatcctgagcagcgagcccacgagccccagcgttacgcctctgatcgtggaaccttcagggtggctgaccaccaattccgacagtttcactggatttaccccgtaccaggaaaaaacaacactccaacctacattgaagtttaccaataactccaaacttttcccgaacacatcagacccacaaaaagtgctgcgtctagacaacgcccctgagccctacgacgtatcttttggcaattcttcctactataaccccactttaaacgatagtgctatgcccgagagcgaagaaaatgctcgcgacggcattccaatggacgacattcctccactccgtacaagtgtgtag

SEQ ID NO: 6597 - DNA, 1404 bp, Artificial Sequence
  Description of Artificial Sequence: Synthetic coding sequence
atgctgatcttttggacaataaccctgtttctgcttggagcagccaaaggcaaagaggtatgctatgaagatctgggatgtttcagcgatacagagccatgggggggtacagcgatccgaccacttaaaattctgccatggtcaccagagaaaataggaactaggtttctgctctacacaaatgaaaaccccaataactttcagattctactcctgagcgaccccagcactatcgaagcctctaatttccaaatggaccggaaaacgcggttcattattcacggcttcatagacaaaggtgatgaatcatgggtgacagatatgtgtaagaaactgtttgaggttgaagaggttaactgtatttgtgttgactggaagaagggctctcaggcaacatacacccaagctgccaataacgtcagggttgtgggcgcccaggtggctcaaatgctcgatatattactgactgaatattcttatccaccgagcaaggtccacctgataggacactcgctgggagctcacgttgcaggagaagctggcagcaagacccccggcctgagtcggataaccggtctggatcctgtggaagcttcattcgagtcaacaccggaagaggtgcgtcttgatccctcagacgctgactttgtggacgtgatccacaccgacgctgcaccactaattccctttctgggattcggcacaaaccagcagatgggtcaccttgactttttcccgaacggcggtgagtcgatgccgggctgtaagaaaaacgctttgagccagatcgtcgatctggacggtatttgggctggcaccagggattttgtcgcgtgtaatcatctgcgatcttacaaatattaccttgaatctattctgaacccagacgggtttgccgcttacccttgcacaagctacaagagttttgaaagtgacaagtgcttcccgtgtcccgaccaaggttgtccccagatgggccattatgctgacaagtttgcaggcagaacatcagaagaacagcagaagtttttcctgaataccggcgaggcctcaaacttcgcaagatggcggtacggagtatcaatcaccctcagcggacgcaccgcaacaggccagattaaggtggcactcttcgggaataagggcaatacacaccagtacagtatattccggggaatactgaagcctggatccacgcactcgtacgaattcgatgctaaattggacgtgggcactatagagaaagtgaagtttctatggaataataacgtcatcaatcccaccctacctaaggtgggtgcaaccaagatcacagtccagaagggggaggaaaagaccgtttacaatttttgctcagaagataccgttagggaagatacgctcctgaccctaacaccttgctag

SEQ ID NO: 6598 - DNA, 81 bp, Artificial Sequence
  Description of Artificial Sequence: Synthetic coding sequence
atgcgaaccctattcaatctcctctggctcgccctagcatgctcacccgtgcacaccaccctgtctaaaagtgatgcatag

SEQ ID NO: 6599 - DNA, 549 bp, Artificial Sequence
  Description of Artificial Sequence: Synthetic coding sequence
atgcgacgcatgtgggccactcagggcctcgcagtggccctggccttgtcagtgttacctggatcaagagcactccggcccggagactgtgaggtctgcatatcctacttaggccggttctatcaggatctaaaggacagagacgtgacttttagcccagcgactatagagaatgaactgatcaagttctgtcgtgaagctcggggcaaggagaatcgactgtgttattatatcggggccactgacgacgcggctaccaagatcattaatgaggtgagtaagcctctggcccaccatattcccgtcgaaaaaatctgcgagaagctgaaaaagaaggactcccagatttgcgaactgaagtatgataaacagatcgacctttccactgttgatctaaagaagctgcgagtgaaagagctgaagaagattcttgatgactggggtgaaacgtgtaagggctgtgccgaaaaatctgattacatcagaaagatcaatgagctgatgccaaaatatgcccccaaagccgcttctgcccgtaccgacctctag

SEQ ID NO: 6600 - DNA, 153 bp, Artificial Sequence
  Description of Artificial Sequence: Synthetic coding sequence
atgaaggtgtttttccttttcgctgtgctgttctgtcttgtccagacaaactccgtacatatctcacatagagaagcgcgcggcccatcttttaggatatgcgtggacttcttgggtccccggtgggcacgcggctgttccactggcaactag

SEQ ID NO: 6601 - DNA, 666 bp, Artificial Sequence
  Description of Artificial Sequence: Synthetic coding sequence
atgggagccacgaccatggaccagaagtcactgtgggccggggtcgtggtgcttctgctgttgcagggcggcagcgcgtataaactggtttgttatttcacgaattggagccaagacaggcaagaacccggcaagtttactcccgagaacattgatccttttctgtgctcacaccttatctacagttttgcaagcatcgaaaacaacaaggtgatcatcaaggacaagtcagaggtgatgctctaccagacaatcaacagccttaaaaccaaaaacccaaaactgaagattctgttgagcatcggtggctacctgtttggtagcaagggctttcaccctatggtcgactcctctacctcaaggctcgagtttataaatagtattatcttgtttctgcgaaatcacaacttcgacggtctggacgtcagctggatatacccagatcaaaaagagaacacacactttaccgtgctcatccacgagttagcagaagcatttcagaaagacttcaccaaaagcacaaaagagcgcctactgttaactgctggcgtttctgccggcaggcagatgattgacaatagctatcaggtggaaaagcttgctaaggacttggacttcattaatctgctaagctttgacttccatggtagctgggagaaaccctag

SEQ ID NO: 6602 - DNA, 1257 bp, Artificial Sequence
  Description of Artificial Sequence: Synthetic coding sequence
atgaggaccctttttaacttattatggctggctctagcgtgctctccagttcacaccaccctgtctaaatctgacgccaagaaagcggcaagcaagactctgctggagaaagttaagttctgtagttgctgcccgggctggagcgcgatggcgcgcagctggttgacagcgacatcggccacgcagtcacaatttagcgacaagcccgtgcaggaccgcggtttagtcgttactgaccttaaggccgaatctgttgttctggaacatcgtagctactgcagtgccaaagcccgcgacaggcattttgcaggggatgttctggggtacgtgacgccatggaactctcatggctatgatgtaacgaaagtgttcggctccaagttcacgcaaatctccccagtctggttgcaattaaaaagaaggggacgtgaaatgttcgaagtgacaggattgcatgatgtggatcaaggttggatgagagccgtcaggaagcatgctaaaggactgcatattgtcccacggctcctgttcgaggactggacctatgacgacttccgtaacgtacttgactccgaggacgaaatagaggagctgagtaagaccgtggtgcaggttgccaaaaatcagcacttcgatggttttgtggttgaggtttggaatcaactgttatctcagaagcgcgtcggtcttattcacatgctcacacacctggcagaggccctacatcaggcacggcttcttgccctgctggtgatcccgccagccatcacccctggtaccgaccagctgggaatgtttactcataaggagtttgaacagttagcacccgttctggacgggtttagcttgatgacatatgattattccacagcgcaccaacctggccctaatgctccgttgtcctgggtccgtgcctgcgtgcaggttttagacccaaagagtaaatggcgcagtaaaattctccttgggctcaacttttatggtatggattacgctactagtaaggatgcccgcgagccagtggtcggggctcgctacatccagactcttaaagatcaccgcccaaggatggtttgggactcccaggcctcggagcattttttcgagtacaaaaagagtagaagcggaaggcatgtggtcttttaccccacattaaagagcctgcaggtgagactcgaactggcacgcgagctcggggtgggcgtgtctatctgggagctcggccagggactggactatttctacgatctcctgtag

SEQ ID NO: 6603 - DNA, 612 bp, Artificial Sequence
  Description of Artificial Sequence: Synthetic coding sequence
atgagatccctgcttctgctatcagccttttgcttgctggaggcagctttggccgctgaggtaaaaaagcctgcagcagcagcggcacctggtacagcagaaaagctgagccctaaggctgccacactggcggaaagatcagccggattagctttttctctgtatcaagcaatggctaaagaccaagcagtggaaaacatcctggtctccccagtggttgtagcgtctagcttaggcctggtcagcttaggcggcaaagcaacaacagcctcccaggctaaagctgtcttgtctgccgagcagctccgggatgaagaagtccacgctgggctcggggaattgctcagatctctcagcaactcaacggcaagaaacgtgacctggaagctgggcagccggctgtacggtccctcatccgtgtctttcgccgacgatttcgtgagatctagcaagcagcattacaattgtgaacacagcaagattaatttccgcgataaacgttcagcactgcaatctatcaatgaatgggcagctcaaacaacagacggcaaacttcctgaggtgacaaaagatgtcgaaagaactgacggagctctgctggtgaatgcctag

SEQ ID NO: 6604 - DNA, 492 bp, Artificial Sequence
  Description of Artificial Sequence: Synthetic coding sequence
atgcggtctctccttctcctgagcgcgttttgcctgctcgaggccgccctggctgcggaggtgaagaagccagcagcagccgcagctcccggtaccgcagagaagctctcccccaaagcagcaaccttggccgagcgctccgcgggactggccttttcactgtaccaggccatggctaaggaccaagcagtagagaatattctcgtgtcgccagtggtagtcgctagttccttgggtctggtgtctctcggcgggaaggcaaccactgctagccaagctaaggctgttttgagcgcggagcaactccgcgatgaggaagttcacgcagggttgggggagctgctacgttcccttagcaatagcactgctcgcaacgttacctggaagctgggaagtcggttatacgggccaagcagtgtctctttcgcggatgatttcgttaggtccagcaaacaacattataattgcgaacactccaaaattaacttttag

SEQ ID NO: 6605 - DNA, 570 bp, Artificial Sequence
  Description of Artificial Sequence: Synthetic coding sequence
atgtctctggatatccaaagcctggatattcagtgtgaggagttgagcgacgcacgatgggcggagctgcttccattactgcaacaatgtcaggtggtaagattagatgactgtggtctgaccgaagcacgttgcaaggatataagcagcgccctgagagtcaacccagccctggccgaactgaatctgagatctaatgaacttggagatgtgggcgtgcactgcgtcttgcagggtttgcaaaccccttcgtgtaagattcagaagctgagcttacagaattgttgcttgactggagccggttgcggagtcctgtctagcactctgcgcacgttgccgacactacaagaattacacctttccgacaacctattgggagatgcgggcctgcagcttctgtgcgagggtctgctagaccctcagtgtcgcctggagaagctgcagctggagtactgcagcctatccgctgccagctgcgagccgctggcctcagtgttgcgagctaagcccgacttcaaggaactcacggtgtcaaacaacgatattaatgaagcaggggtgcgagtctag

SEQ ID NO: 6606 - DNA, 585 bp, Artificial Sequence
  Description of Artificial Sequence: Synthetic coding sequence
atgtcactagatattcagagtctggacatccagtgcgaagagctgtctgatgcacgatgggccgagttgctcccattactgcagcagtgccaggtagtgcgactagatgattgcgggttaaccgaggctagatgcaaagacatcagcagcgctctgcgagtgaacccagcgctggccgaactcaacctgaggtcaaatgaactaggtgacgttggcgtgcattgcgtactgcagggtctgcaaacaccgagctgtaaaattcagaagctgtcactccagaattgctgcctgacaggtgcaggctgcggtgtactgagttccacactccggacgcttcctaccctgcaagaactccatctgagcgacaatctgctgggcgatgcgggactgcagttgctctgcgagggtctactggatcctcagtgccgcctggagaaactgcagctcgagtactgctcactgtctgctgccagctgcgaacccctcgcctccgtgctccgggccaaacctgactttaaggaacttacagtgagcaacaatgacattaatgaggcgggggtgagggtgctctgccagggactgtag

SEQ ID NO: 6607 - DNA, 1086 bp, Artificial Sequence
  Description of Artificial Sequence: Synthetic coding sequence
atgggtataatccagagcatcctggcgacctctagagattgttactcctttaaaaagaaaccgattcccaagaagccaaccatgcttgctctggctaagattcttctcatcagtaccttgttttatagcctgttgtctggctcccacgggaaagaaaaccaggatatcaacacgacccagaatattgcggaagttttcaaaacgatggaaaataaaccgatctcactggaatccgaggcaaacctaaactccgacaaagaaaatattactaccagcaatctgaaggcatctcattctccaccactcaatctgcctaataactctcatggaatcactgacttttcgagcaatagcagtgccgaacacagcctgggttctctcaaaccaacaagcaccatctcaacttctcccccactcatccactcctttgtgagcaaggtcccttggaatgcacccatcgctgatgaggatctgctgcctatcagcgcccaccctaatgctacccccgctctcagcagtgagaacttcacctggtcccttgtgaatgataccgtgaagacccccgacaatagctctatcaccgtcagcattttgtccagcgaaccaaccagcccatcagtgaccccactcatcgtggaaccttcaggctggctaactaccaacagtgatagtttcacaggctttacgccgtaccaagagaagacaacgctccagccaaccctaaaattcacgaataacagtaagctcttccccaacaccagcgatccccagaaggagaatcgaaacaccggcatcgtctttggagctatcctgggagcaatactcggcgtctccttgctaaccctggtgggttatctcctctgcggcaagaggaaaacagactctttttctcaccgccggctttacgatgatcgcaatgaacccgttctgcggcttgacaacgcccctgagccttacgacgtgtctttcggcaactcatcttactacaaccccacactcaatgactccgcaatgcctgagagcgaggagaacgcacgcgacgggatcccaatggatgatatcccgcctcttaggacctctgtctag

SEQ ID NO: 6608 - DNA, 327 bp, Artificial Sequence
  Description of Artificial Sequence: Synthetic coding sequence
taacccaagagtaagtggcgctccaagatcctcctgggcttgaacttctatggaatggattacgcaacaagcaaggatgcacgagagcccgtggtcggagcgaggtacatccagacattgaaggaccacaggccacgcatggtgtgggattctcaagcctcagaacacttctttgaatataaaaagagtcgctcaggcagacacgtcgtcttctatccaaccctgaaatcactccaagttcggctcgaactggcgcgagaactgggcgttggcgtaagcatatgggagctgggccagggtcttgactacttctacgacctgctgtag

SEQ ID NO: 6609 - DNA, 504 bp, Artificial Sequence
  Description of Artificial Sequence: Synthetic coding sequence
atgaggtccctcctgcttctgtccgctttttgtcttttggaggctgcattggcggcggaagtgaagaagccggccgcggccgccgccccagggactgctgagaaactttctcctaaagctgctacgctggcggaacggtcagcggggcttgccttcagtctgtatcaggccatggcgaaggaccaggccgtggagaacatcctcgtaagcccggtcgttgttgcttcctccctaggcttggtgtcactgggaggcaaggctaccactgcttctcaggctaaggccgtactgtccgccgagcagttaagagatgaggaggttcacgctgggcttggagaactattgcggtctctgtcaaacagtaccgcacggaacgtcacttggaaattagggagccggctgtatggaccatctagtgtatcttttgccgacgatttcgttaggagctctaaacagcattacaattgtgaacactccaaaatcaactttagggacaaaagatag

SEQ ID NO: 6610 - DNA, 1209 bp, Artificial Sequence
  Description of Artificial Sequence: Synthetic coding sequence
atgatggtagctctcagaggggcaagcgcactgctagtcctgttcctcgccgccttcctcccgcccccgcagtgcacccaggacccagccatggttcactatatttaccagagatttcgagtgctcgaacaggggttggaaaagtgcacacaggcaactagagcgtatattcaggagttccaggagttttcaaagaatattagcgtgatgttggggcgctgccagacgtacacctccgaatataagtctgcggtcggcaacctggctctgagagtggagcgtgctcagcgcgaaatagattacatacagtacctgcgggaggccgatgagtgcattgagagtgaagacaagacccttgcggaaatgctgctgcaagaggccgaagaagagaaaaagattaggacactgctaaatgcctcgtgtgataacatgttgatgggtatcaagagtcttaagattgtgaagaagatgatggacacccacggatcatggatgaaagatgcggtatacaacagccctaaggtctatctgctaataggttctcgcaacaataccgtgtgggaattcgccaatatacgcgccttcatggaagataacactaaaccagctccacggaagcagattctcactctgtcctggcagggaacaggccaggtcatttacaaaggcttcctctttttccacaatcaggcgacatccaacgagatcattaaatacaacttgcaaaagagaacagtcgaggatagaatgctgctgcccgggggagtggggcgcgctctggtctatcagcatagtccaagcacgtacatcgatcttgctgtcgacgaacacggcttgtgggccatccactctggacctggtactcatagccatctggtgctgactaagattgagcctgggactctgggcgtggagcatagttgggacaccccctgcagatcccaagacgcggaggctagttttctgctatgtggcgtgctatatgttgtgtattcaacaggcgggcaggggcctcacaggatcacatgcatttacgaccccctggggacaatttctgaggaggacctgcctaacctcttcttcccaaagaggcctcgctctcactccatgatccactacaaccctagggataagcagctctacgcctggaacgaagggaatcagattatttacaagctgcaaacaaagaggaaattgccgctgaagtag

SEQ ID NO: 6611 - DNA, 975 bp, Artificial Sequence
  Description of Artificial Sequence: Synthetic coding sequence
atgagaagcctcctactactctccgccttctgtctcctggaggccgcgttagctgccgaagtcaaaaagcctgcggccgcagcagcccctgggaccgccgaaaagctgagtcccaaggctgctaccctcgctgaaaggagcgcaggcttggctttttcactctaccaggctatggccaaagaccaggccgtcgagaacattctggtaagcccagtagtggtcgcttcttcgctcggtctcgtctctctggggggaaaggctactaccgcatcccaggccaaagcagtactctctgcagagcagcttcgtgatgaagaggtgcacgccggactcggcgagctcctgcggagcctcagcaactcaactgcccgaaacgttacctggaagttaggaagcaggctctacgggccaagttcagtatccttcgcagacgatttcgtgcggtccagtaaacagcactacaattgcgaacacagcaaaatcaacttccgcgacaagcgatcggcgctgcagagcattaacgagtgggccgctcagacaaccgatggaaagctgccagaagtgactaaagatgtcgaacggaccgacggagctttgctggttaatgccatgttttttaagccacactgggatgagaaattccaccacaagatggtggataatcgaggcttcatggtgacacgaagttacactgtgggcgtgatgatgatgcacagaaccggcttatataactactacgacgacgagaaagaaaagctacagatcgtagaaatgccccttgcacacaaactgtccagcctcatcatcctgatgcctcatcacgttgagcctctggaacgacttgaaaaactcctcacaaaagagcaacttaagatatggatgggcaagatgcagaaaaaggccgttgccattagccttcccaagggggtggtggaggtgacacacgatctgcaggtgcggggggggcctgcgtag

SEQ ID NO: 6612 - DNA, 990 bp, Artificial Sequence
  Description of Artificial Sequence: Synthetic coding sequence
atggtcagtaaatcccggtggaagttactggcaatgttggctcttgtgctcgttgttatggtctggtactccatctctagggaagactccttctatttccctatcccggaaaaaaaggagccctgtctccagggagaagccgagtctaaagcatctaagctgttcggcaactattcccgggaccagccaatctttctccggctggaagactacttctgggtcaagacgccatcagcctatgagcttccttatgggacaaagggatcggaagaccttctcttacgggtgctggccatcacatcctccagcatcccaaagaacattcagtccctccggtgtagaaggtgcgtggttgtgggaaacggccaccggctcagaaactcgtccctgggcgacgccatcaacaagtatgatgtggtcattcgtttgaataacgctccggtcgcaggctacgagggagacgtagggtccaagaccacaatgcgactcttctaccccgagagcgcccactttgatccaaaggtcgaaaacaaccccgatacgctcctggtgctcgtcgctttcaaagctatggactttcattggatcgagactatattgtcagacaaaaagagagtgcgcaaaggcttttggaagcaaccgcccctcatctgggatgtgaaccccaaacagatacggattctgaacccattctttatggagattgccgcagacaagctgctctccctacccatgcaacagccacggaagataaagcagaagccaactaccggcttgctagcaatcacattggccctccatttatgcgatctggtgcatatcgccggatttgggtatcctgacgcatataataagaaacagacgatccactattacgagcagattacactcaagagcatggcgggatccggtcacaatgtgtcgcaggaggccctcgcaataaagaggatgcttgagatgggcgcaatcaagaacctgactagtttctag

SEQ ID NO: 6613 - DNA, 351 bp, Artificial Sequence
  Description of Artificial Sequence: Synthetic coding sequence
atgcgtactctttttaatctgctgtggttggcactcgcatgcagccccgtgcacactacactcagtaaatctgacgcaaagaaagccgcttctaaaactttgctggagaagagccaattctctgataaacccgtgcaggacaggggcttggttgtgacagatctgaaggcggaaagtgtggtgctggagcaccgaagctactgcagcgcaaaggcccgggataggcacttcgcaggagacgtactgggatacgtcaccccatggaacagtcacggctatgatgttaccaaggttttcggatcaaaatttactcagatttctccagtgtggttacagctgaaaagacgctag

SEQ ID NO: 6614 - DNA, 282 bp, Artificial Sequence
  Description of Artificial Sequence: Synthetic coding sequence
atggacagcctgcggaaaatgttaatttccgtcgctatgctgggggctggcgcgggagtgggctatgcactactggtaattgtcacacctggcgaacggaggaagcaggagatgctgaaggaaatgcccttacaagaccccaggtctcgagaggaggccgcaaggacccagcagctccttctagctactctgcaagaggccgccacaacccaggaaaatgtggcctggcgcaagaattggatggtcgggggtgaaggtggcgctgggggccgttctccttag

SEQ ID NO: 6615 - DNA, 255 bp, Artificial Sequence
  Description of Artificial Sequence: Synthetic coding sequence
atgaggccaaagacaggacaggtggggtgcgaaacccctgaggagctcggaccaggtccacgccagcgttggccgttgctgctgctgggtttggcgatggtcgcccacggcctgctccgaccaatggtagccccacagtcgggtgaccctgatcctggtgccagcgtggggagctctagaagtagcctgcggtcgctctgggggcggtccgcacaggggcaaccccattgtcactccgttcctgctctcttgtag

SEQ ID NO: 6616 - DNA, 27 bp, Artificial Sequence
  Description of Artificial Sequence: Synthetic coding sequence
atgagcctggacattcagagtctttag

SEQ ID NO: 6617 - DNA, 576 bp, Artificial Sequence
  Description of Artificial Sequence: Synthetic coding sequence
atgctgatattttggaccattaccctcttcttgttgggggctgccaagggaaaggaggtctgttatgaggatctcggctgcttttcggacacggaaccttggggcggtacggctatcagacccctgaagatcctcccctggtcacctgagaagatcggaacccggtttttactgtacacgaatgagaatcctaacaattttcagatcctcctcctgagtgatcccagtaccatagaagcatcaaactttcaaatggaccgaaagacccgctttataatacacggttttattgataagggagatgaaagctgggttaccgacatgtgcaaaaaactctttgaagtcgaggaggtcaattgtatctgtgtcgattggaaaaagggatctcaggcaacctacacacaagccgctaataatgtgagggtagtgggtgcgcaggttgctcagatgctcgatattctcctgacggagtactcttaccctcctagcaaggtgcatctcatcggtcatagcctcggtgcccatgtggcaggcgaggccggaagcaagactcctggcctgtcgcgaattacctag

SEQ ID NO: 6618 - DNA, 123 bp, Artificial Sequence
  Description of Artificial Sequence: Synthetic coding sequence
atgagcctcgatattcagtcgttagacatccagtgtgaggagcttagcgacgcgaggtgggccgagctcctgccgctgctccagcagtgtcaagtggtccgtctcgatgactgtgggttatag

SEQ ID NO: 6619 - DNA, 648 bp, Artificial Sequence
  Description of Artificial Sequence: Synthetic coding sequence
atgcgccccaaaacgggccaggtggggtgcgagacacccgaggaattgggccctggcccccggcagagatggccgctgctgttgctggggctggcaatggtggcgcatggactcctacggcccatggtggctccacagagcggagaccctgaccctggagcctctgtcgggtcttcccgaagctctctccgatccctgtggggctctaggttactgcttcagccctctccccagcgagccgacccaaggtgctggcctcgcggattctggtctgaacctcagtctctttgctatgtgtttggtacagggactaaagtcaccgtacttggtcagcccaaagcgaaccctactgtgacactgtttccacctagcagtgaggaactgcaggctaataaagccacacttgtgtgcctgatttcggacttctatcctggcgccgtgactgtggcctggaaggcggatggcagcccggttaaggccggagtggagactacaaagccatctaagcagtccaacaataaatatgctgcttcttcatacctctctctcacaccggagcaatggaagagtcatcgatcttatagctgccaggtcactcatgaaggttccactgtggagaagaccgtcgcccccacggaatgcagctag

SEQ ID NO: 6620 - DNA, 999 bp, Artificial Sequence
  Description of Artificial Sequence: Synthetic coding sequence
atgtgccctgcgggctggaagttactggccatgctggctcttgtccttgtggttatggtatggtacagcatctcgcgggaggacagatatatcgagctgttctattttcctatcccagaaaagaaggaaccatgtttgcaaggcgaggccgaaagcaaggcctctaaactgtttgggaactactcccgtgaccagcctattttcctgcgactcgaagattatttctgggtcaaaaccccctctgcttatgagctgccctacggcaccaaagggtctgaagatctcctcctccgcgttcttgctattacctcttcatccattccaaaaaacatacagagtctgaggtgccgacgctgcgtggtagtgggtaacggccataggcttagaaactcctcactaggtgacgccatcaataaatacgacgttgtaatcaggctgaacaatgcacccgttgccggatacgagggtgacgtgggatccaaaactacaatgagattattctaccccgagtccgcccacttcgaccctaaagtggagaataacccagataccctgctcgtgttggtagcattcaaggctatggatttccattggatcgaaacaatcctctcggataagaagcgcgtccgcaagggtttctggaaacagcctcccctcatctgggacgtcaaccccaagcagattaggatcctgaatccatttttcatggagatcgcagccgacaagctgctgagcctgcccatgcagcagcccagaaagattaaacaaaagccaaccacgggcctcctggccattaccctggccctgcatctgtgtgatctcgtgcatatcgccgggtttggttatcccgacgcctataataaaaaacagacgatccactattacgaacaaatcactctgaagtctatggctggcagcggtcataacgtatcacaggaagcactcgccataaaacgcatgctggagatgggggcaatcaagaacttaacttcattttag

SEQ ID NO: 6621 - DNA, 888 bp, Artificial Sequence
  Description of Artificial Sequence: Synthetic coding sequence
atgcggtcactcctgctgctatctgccttctgtttactggaagcagcattagccgccgaggtaaagaagccagcagctgcggccgcccccgggactgccgagaagctgtcaccaaaagccgcaaccctggctgagcggagtgcggggctggcgttctctctttatcaagccatggccaaggaccaggcagttgagaacatcctcgtgtccccagtggtggtggctagtagcttgggcttagtatccctcggggggaaagccacaacagcgagtcaagccaaagctgtactgagcgcagaacagctccgggatgaggaggtccacgctggtttaggcgagttgctgcgctccttgtcgaattcaaccgcccggaacgttacctggaagttaggttctaggctctatggaccatctagcgtgtcgtttgctgacgacttcgtaaggagttctaaacaacactataattgcgagcatagcaagataaattttcgtgacaaacgttccgcgctgcaatctatcaacgaatgggctgcccagaccactgatggaaagctgccagaggtgaccaaagatgtagaacgaaccgatggtgcgctgctggtcaatgctatgttttttaagccacactgggatgagaagttccatcataaaatggtggataatagggggttcatggtgactcggtcttatacggtaggcgtcatgatgatgcacaggactggcttatacaattactacgatgacgagaaagaaaagctgcaaatagtggaaatgccgctggctcataaactaagcagtttaataattcttatgccccatcacgttgagcctttagaaagactggaaaagctcctgactaaagaacagttaaagatctggatgggctag

SEQ ID NO: 6622 - DNA, 399 bp, Artificial Sequence
  Description of Artificial Sequence: Synthetic coding sequence
atgagaacgttgttcaatctgctgtggttagcactggcctgctcaccagtgcacaccactctgtcaaaaagcgacgctaagaaggcagcatcaaagacccttctggaaaagagtcaattctctgataagcccgtgcaagatagaggcctagtggttactgacctgaaggccgagtctgtggtgttggaacatcgtagctattgtagcgctaaggccagggaccggcattttgcaggggacgtcctcgggtacgtaaccccgtggaacagccacggttatgatgtaaccaaggtgtttggatcgaaatttacccagatctcaccggtgtggttgcaactcaagcgccgcggccgtgagatgttcgaggtgacgggcttgcacgacgtggatcagggttag

SEQ ID NO: 6623 - DNA, 360 bp, Artificial Sequence
  Description of Artificial Sequence: Synthetic coding sequence
atgcggactttgttcaatctgctatggttggctctggcctgtagtccagttcacaccactctcagtaagagcgacgcgaagaaagccgcctccaaaaccctgctggagaaatcccagtttagtgacaaacctgttcaagataggggtctggtagtcactgatctgaaagctgagagcgtggtcctggagcatcgaagttactgttctgccaaggcacgagaccgacatttcgctggagatgtgctcggatatgtaaccccatggaatagtcacggctatgatgtgacgaaggtcttcgggtcgaaatttactcagatcagtcccgtatggctgcagttgaaacggcgcggaagagaatag

SEQ ID NO: 6624 - DNA, 390 bp, Artificial Sequence
  Description of Artificial Sequence: Synthetic coding sequence
atgccaatggcttcaccccagactcttgtcctgtacttgctcgttctagcggtcacagaggcatggggccaagaggcagtcatacctgggtgtcatttacatccgttcaacgtgacggtgcgctctgacagacagggaacgtgtcagggttcgcacgttgcccaggcctgcgtaggtcactgtgagtcatccgcatttccgtcacggtactcagtactggtggcgagtggatataggcataatatcacctctgtctctcagtgctgtaccatcagcggcctgaagaaagtcaaagtccagctacagtgtgttggctctcggcgggaagagctagagatttttacagcccgggcatgtcagtgcgacatgtgcaggcttagtaggtattag

SEQ ID NO: 6625 - DNA, 1386 bp, Artificial Sequence
  Description of Artificial Sequence: Synthetic coding sequence
atgagcctcgacatacagagtttggacatacaatgcgaggagctgtctgatgcgcgctgggccgaattgctaccgttgttgcaacaatgtcaggtcgtacggttagatgactgcggactcacagaggcaaggtgcaaagacatttccagtgccctacgggtgaatcccgctctcgcagagctgaacctcaggtcgaatgagctgggagatgtcggagtgcattgcgtcctgcaaggcttacagacaccaagttgcaagatccagaagttgtccctgcagaattgttgcttgacaggggcagggtgcggcgtgctgtctagtaccctcaggacactgcctaccctccaggaattacacctttcagataatctgctaggggacgcgggcctccaacttctgtgcgaggggctgctggacccacagtgtcgtttagagaagctgcaactggaatactgtagcctgtctgccgccagctgcgagcctctcgccagtgtgctccgtgctaagccagacttcaaagaactaactgtcagtaataatgacatcaacgaggcgggcgtgcgagtgttatgccaagggctgaaagactccccgtgtcaactcgaggccctgaaactggagagctgcggggtgacaagcgacaattgccgagacctgtgtggaatagtggctagtaaggccagcctgcgcgaattggctttgggatccaacaagctgggtgatgtaggcatggccgagctttgtcccggcttgttgcacccctcaagccgtctaagaacactgtggatttgggaatgtggtataactgccaagggatgcggggatctgtgtagggttctccgcgccaaggaatctctcaaagagttgagccttgcaggcaatgaacttggggatgagggcgcacgtctgttgtgtgaaaccctgctagaaccaggctgccaactggagagcctctgggtcaagtcctgttcttttacagctgcctgctgctcgcacttttccagcgtcctagcccagaaccggtttctcttggaactgcagatctctaataaccggctggaagatgccggcgtcagggaactgtgccagggactggggcagcctgggtctgtgcttcgggtcctgtggctggcagactgcgacgtctccgactcctcctgctcgagtcttgcggccactctattagcgaaccactccctgcgtgaactcgacctatcaaataattgcctgggagatgctggcatcctgcaactagtggaatcagtgagacaacctggctgcctgctcgaacagctggtgctgtacgatatttactggtctgaagaaatggaagacaggttgcaggctctggaaaaagacaaacccagcttgagggtcatctcctag

SEQ ID NO: 6626 - DNA, 453 bp, Artificial Sequence
  Description of Artificial Sequence: Synthetic coding sequence
atgcgtagtttgctactcctatctgcattctgcctgctagaggcggccctggccgcagaagtaaagaaacccgctgcagctgcagctcccggcacagccgaaaaactgtctcccaaagctgccacactcgcggaaaggtccgccgggttggccttctcgctgtaccaagccatggccaaggaccaggccgtggagaacattttggtgtccccagtggttgtggccagcagcctggggctggtctcccttgggggaaaggcaacgaccgcctcacaggccaaggccgtcctgagtgcagagcaactgagggacgaggaggtgcacgctgggctcggggagttacttagatctctctctaattccaccgcgaggaatgtgacgtggaaattaggttcccggctgtacgggccaagttccgtttcttttgcagacgacttcgtccgcagcagctag

SEQ ID NO: 6627 - DNA, 1257 bp, Artificial Sequence
  Description of Artificial Sequence: Synthetic coding sequence
atgcgaagcttgctcttgctgagtgctttctgtcttctggaggccgcactcgccgcagaggtcaagaagcctgctgctgctgccgctccaggaacggccgagaaactgagccctaaagcagctaccctggccgagcgctcagccggcctggcattcagtctctaccaagctatggccaaggatcaggcggtggagaacatactcgtgtctccagtggtggtggcaagtagcctaggtctagtgtcccttggcggcaaagccaccactgcaagccaggcaaaggccgttctctcagccgagcagctcagagacgaggaagtgcacgcaggcctgggggaactgcttcgaagcttgtcgaacagtaccgccaggaacgtgacgtggaagctgggctccagactttacggcccgtcaagcgtgagcttcgctgacgatttcgtgcggtcctcaaagcaacactataactgcgagcactcaaaaataaactttagggataaacgatcggccttacagtcgattaacgagtgggccgcacagacaactgacggaaagctgcctgaggtgaccaaggacgttgaaagaactgatggagccctgcttgttaatgctatgttcttcaagccccactgggacgagaaatttcaccacaagatggtggataatcggggctttatggttacacgctcctatactgtgggagttatgatgatgcatcgtactggactgtacaattactacgacgatgaaaaagaaaagctgcagattgtggagatgcctcttgcgcataaacttagcagcctgattatcctcatgccgcatcacgttgagccgttagagaggttagagaaactccttactaaggagcagttgaaaatttggatgggaaagatgcaaaagaaggccgttgcaatttccctccctaaaggcgtggtagaagttacccatgatctgcaaaaacacctagccggccttggtttgaccgaagccattgataagaataaggccgacctatcccgcatgagtggtaagaaggacctgtacctcgcttccgtgttccacgccaccgcttttgaactggacacggacggtaacccattcgaccaggacatttacggccgtgaagagcttagatcccctaaacttttctacgctgatcacccatttatattcttggtaagggacacacaatcaggcagcctgctgttcattggtagattggtaaggcccaaaggcgacaagatgagagacgaactatag

SEQ ID NO: 6628 - DNA, 1002 bp, Artificial Sequence
  Description of Artificial Sequence: Synthetic coding sequence
atggtctcaaagtcgcggtggaagctccttgcgatgctcgctctcgtgctggttgtgatggtgtggtattccatctcaagggaggatcgctatattgagctcttttattttccgatcccagagaagaaagaaccttgtctgcagggcgaggcggagtcaaaagcttccaagttattcggcaactattctagggaccagccaatcttcctgcgcctcgaggactatttctgggtcaaaaccccttcagcctatgagctcccttacgggacaaagggaagcgaggacctcctgttgcgggtccttgcaatcactagttcttccatcccaaagaatattcaatccttgcggtgtaggagatgtgtggtggtggggaatgggcatcgtctgaggaacagtagcctcggggatgcaattaataaatacgacgttgttattagactaaataatgccccagttgccggatatgagggggatgttgggagtaaaacaactatgcgcttgttctaccctgagtcagcacacttcgaccctaaagtcgagaataatcccgacacacttctagtgctggtggcctttaaagctatggacttccactggattgagaccattttgtccgacaaaaagcgcgttcgaaaaggcttttggaagcagcccccattgatttgggacgtgaatcctaagcagatcaggattctgaaccctttctttatggaaattgccgcagataagctccttagcctgcccatgcaacaacccagaaagatcaagcagaaacctaccacaggactgcttgcgattacacttgctctccatctatgcgacctggtacacattgcgggttttgggtaccctgatgcctataacaagaaacagaccatccattactacgaacagatcacactaaaaagcatggctggcagcggacacaatgtgagccaggaggcccttgctattaagaggatgctcgagatgggagcaattaagaatctgacaagtttctag

SEQ ID NO: 6629 - DNA, 987 bp, Artificial Sequence
  Description of Artificial Sequence: Synthetic coding sequence
atgtgtcccgcaggatggaagttgctggccatgctggcactcgtactcgtggttatggtgtggtatagcatcagcagagaggatagtttctattttccaattcccgagaaaaaagagccttgtctacaaggcgaggccgaatcaaaggcttctaaactgtttgggaactatagccgcgaccagcccatctttctgaggcttgaggattacttttgggtgaagacaccatccgcttacgagctgccatatggtaccaaagggtctgaagacctgctgctgcgcgtactggccattaccagctcatcgatcccgaagaatatccagtcgctccgatgccggaggtgcgtggtggtgggcaacgggcatagacttcggaatagcagcctgggagatgcgataaacaaatacgacgtggtcatacgactcaacaacgcacccgtagcagggtacgagggggatgttgggtccaagactacaatgagactgttctatcccgagagtgcgcactttgaccccaaggttgaaaacaacccggataccttgttggtgctggttgctttcaaagccatggacttccattggatcgaaaccatactgtccgataagaaaagagtgagaaagggattttggaaacagccaccgttaatatgggatgtgaatcctaagcagatccgtattctaaacccatttttcatggagatcgcagccgacaagctactctcgttgcctatgcaacagccacgtaaaatcaaacagaaacccaccacagggctcttggcaattacactagcactgcacttgtgcgatctggtgcacatcgcagggtttgggtacccagatgcatataataagaagcagactatccattactacgagcagataactctgaaatccatggccggctcaggccacaatgtgagccaggaagctctcgccatcaaacgtatgttggagatgggcgctattaagaatctgaccagtttctag

SEQ ID NO: 6630 - DNA, 585 bp, Artificial Sequence
  Description of Artificial Sequence: Synthetic coding sequence
atgacaatgaggcataattggacaccagacttatcaccactctgggttttgctcctgtgtgcacacgtggtcaccctgctagtccgtgctactccggtgtcacagaccacaaccgccgctacagcctccgttagatctactaaagatccatgtccttctcagcctcccgtgtttcctgcagccaagcagtgtcccgcactcgaggtgacttggcccgaagtggaagtgcctcttaacggcacgctcagtcttagctgcgttgcctgtagtcgttttccgaatttctccattttatattggctgggaaacggctcattcatcgaacatttaccaggccgcctctgggaggggtccacctctcgggaacgagggtccactgggacccagctctgcaaagctctcgtgctggaacaattgactcctgcactgcactccacaaacttttcctgtgtcctggtagatcctgaacaggtcgtgcaacgccacgtggttctggcccagttatgggctggcctcagagccacactcccacctactcaggaagccttgccaagttcccactcttcaccgcagcagcagggttag

SEQ ID NO: 6631 - DNA, 1386 bp, Artificial Sequence
  Description of Artificial Sequence: Synthetic coding sequence
atgagtctggacattcagtccctggacattcaatgcgaagagctaagcgacgcgcgatgggctgaactgctgccgctcctacagcaatgccaggtggtgaggttggacgactgcggtctgactgaggctcggtgtaaggatatctcctctgccctgagggtgaacccagcgcttgccgaactaaatctgcgcagcaacgagctgggagatgtgggtgttcattgcgtgctgcagggactgcaaaccccctcctgcaagatccagaagctctcactacaaaattgttgcctcactggggcaggctgtggagtactgagctccaccctaagaactcttcccacccttcaggaattgcacctgagcgataaccttctgggagacgccggccttcagctgctctgtgaaggactattagacccacagtgtaggctggagaaattgcaactggaatactgtagcctgagtgcagcttcatgcgaaccgttagcatccgtattgagagccaaacctgactttaaagagctgaccgtgtctaacaatgatattaatgaggctggcgtccgggtgttatgccaaggtctgaaagactcaccctgccagctcgaggctctcaaactggagtcgtgcggggttacctcagacaactgtagagacctttgtggaattgtggcctctaaggcatccttacgtgaattggctctaggttccaacaaacttggcgacgtggggatggcggaactttgccctggactactccacccttccagtaggttacgcaccctgtggatttgggagtgcggaatcacagcaaaaggctgcggagacctgtgccgggtcctaagagctaaagaatctctcaaagaactctccctggctggcaacgagttaggtgacgaaggtgcacgtctcctctgcgaaaccctgttagaacccggctgccagctggagagcctttgggtcaaaagctgtagttttacagccgcatgctgttcacatttttcctccgtcctagcccagaataggttccttctggaactgcaaatctccaataataggctggaagacgcaggggtgagagagttatgccagggcttaggccagcccggatctgtgctgagagtgttgtggctggccgactgtgatgttagcgattcaagctgctccagcctggccgcaacccttctcgctaatcactccctgcgggagcttgatctctccaataattgtttgggggatgccggaatcctgcagcttgtagagagcgtaaggcagcccgggtgtctattggagcagcttgttctttacgacatctattggagcgaggagatggaggatagattacaggccctggagaaggataagccgtcacttcgagtgatctcatag

SEQ ID NO: 6632 - DNA, 1995 bp, Artificial Sequence
  Description of Artificial Sequence: Synthetic coding sequence
atgccacaggcacctagtacaggcagcagtttgataagggacccaagcattgctcatagaaatacccagatcctatggacagaagcagggcgggatttggcccaggatacccgttacacgggcgaggagtcactcaccatcttcgtcgacaagcggaaactctccaagagggccgagggctctgactcaactactaattctagcagtgtgacattagaaaccttgcatcagttggccgctagctattttatcgaccgcgactcaacactgcggcggctccatcatatccagatagcatcgaccgccattaaggtaaccgaaaccagaacaggaccactggggtgttccaactacgacaatctcgactcggtgtcctccgtccttgtccagtcccccgagaataagatccagctccaaggtctacaggtgctactacctgattacctgcaggagcgcttcgttcaggctgccctttcatacattgcctgcaactcggaaggggagttcatatgtaaggaaaatgattgttggtgtcattgcggacctaaatttcccgaatgcaactgccctagtatggacatccaggccatggaagaaaatctactgcgaatcaccgagacatggaaggcatacaattcggatttcgaggagtcagacgaatttaagctgttcatgaagagactacctatgaattatttcctaaatacctctaccattatgcacctatggactatggatagcaattttcagcgtcggtacgagcagcttgagaacagcatgaaacagctgtttctcaaggctcagaagattgtgcacaagttgttttccctgagtaaacggtgccataagcagcctctcatcagcctgcccaggcaacgtaccagtacctattggctgactcggatccagagcttcctgtattgtaatgaaaacggcctcttggggtctttcagcgaagaaacccacagctgtacctgtcctaatgaccaagtggtttgcacagccttccttccatgcactgtgggcgacgcatccgcatgtctgacatgtgccccagacaatcggactcgttgcggtacctgtaacaccggatacatgctgtcccaaggattatgcaaaccagaagtggctgaatctacagaccattacatcgggtttgagaccgacctgcaggacctcgagatgaaatacctcttgcagaaaaccgatcgtagaattgaggtccatgcaattttcatttccaatgatatgaggctgaattcgtggtttgacccttcctggcgcaagcgcatgcttctgactctgaagagcaacaaatacaagagttcattggtccacatgatcctgggcttgtcactccagatttgcctcacaaaaaattctacgctggagccagtactcgccgtgtatgtcaaccccttcggtgggtcacattccgagagttggttcatgccggtgaatgaaaattcattccctgactgggagcgtaccaagctggatctgcccctccagtgctacaattggaccttgaccttagggaacaaatggaagacattttttgagacggttcacatctacctgagatcccggataaaatctaatgggcctaacggaaatgagagtatctactacgagccattggaatttatagatcctagcaggaacctggggtacatgaagattaataacatccaggtttttgggtactccatgcactttgatcccgaggccatcagggacttgatattgcagctggactatccatacacccaggggtcccaagactctgcacttctccagcttcttgagatcagagaccgggtgaataagctttccccacccggacagaggcgattggacctgttttcctgcctcctgcggcacagactgaagctgtctactagcgaggtggtaaggatccagtcagctctgcaggcctttaatgccaagctgcccaatactatggactacgacacgacaaaactgtgttcctag

SEQ ID NO: 6633 - DNA, 459 bp, Artificial Sequence
  Description of Artificial Sequence: Synthetic coding sequence
atggctcgcgattacgaccatctgtttaagttacttattatcggcgattcaggagtgggaaagagctcattgctactgcgcttcgctgacaataccttcagcggatcttacattaccaccatcggggtggattttaagattcggaccgttgaaattaacggtgagaaagtgaagttgcagatctgggacactgcgggacaggaacggtttcgcaccattaccagtacatactatagaggaacacacggggttattgtggtttatgatgtaactagcgccgagtcctttgtgaacgttaagagatggttgcacgaaattaatcaaaattgcgatgatgtatgtcgcattctcgatgtgcaattgcaccatggcgctgggccaccgtccaaggagaggcagcctggtaagacggctgcagctactaccgagcgctgcggcgaggcccacgaggagcagtag

SEQ ID NO: 6634 - DNA, 696 bp, Artificial Sequence
  Description of Artificial Sequence: Synthetic coding sequence
atgctgtacatcgggattgcagagtacttcttcaagtctgcctcctttgcccatttcacagcaggagtgtttaatgtgacattgtctactgaagaaatttctaatcatttcgtacagaatagtcaaggcttagggaacgtcctatcccgaattgctgagatctacatcctgagtcagcctttcatggtccggataatggccacggaacccccaatcatcaaccttcagcccgggaatttcacactcgatatccctgcgtcaattatgatgctcacccaaccaaaaaatagcaccgtggaaaccatcgtgtcaatggactttgtcgccagtacgtcggttgggctcgtgatcctgggccaacggctggtgtgcagcttatccctgaatcgtttccgactggcactccccgaatctaacaggagcaatatcgaagttctgcggttcgagaacattctcagttcaatcctccactttggcgtcctgcctcttgcaaacgccaagcttcagcagggttttccactgtcaaatccccacaaattcctgttcgttaattccgatatcgaggtgcttgaaggctttctgctcatcagcaccgacctaaaatacgaaacctcctcgaagcagcagccatcctttcacgtttgggagggactcaacctgatctctaggcagtggcgaggaaaaagcgctccatag

SEQ ID NO: 6635 - DNA, 1911 bp, Artificial Sequence
  Description of Artificial Sequence: Synthetic coding sequence
atgaccacgtggtccctccgcagaaggccagcccggaccctgggtctacttctgctagtggtcttaggctttctcgtcctccgacgactggactggagtaccttagtgccgctccgtctaaggcacagacaattgggcctgcaggcaaaaggatggaacttcatgttggaagacagcacgttctggatcttcggaggaagcattcactatttcagagtgccgcgcgaatactggagggatcgcctgctcaagatgaaggcctgcggcctcaacactctcaccacatacgttccatggaacctccatgagcctgagcgagggaagttcgatttttctggaaatcttgatctggaggcattcgttctgatggcagcagagattggactgtgggtgattctgaggcctgggccgtatatctgttcagagatggacctgggagggcttccctcatggctgctgcaggatccagggatgcgtctccggactacctataagggtttcaccgaggcagtggatttatattttgatcacctgatgtctcgggttgtgcctctgcagtataagcgaggcgggcccattatcgcagtgcaggttgagaacgagtatggaagctataacaaggatcctgcctacatgccttacgtcaagaaggcgttagaagatcgagggattgttgagcttttgcttacctcagacaacaaagatgggctaagcaagggtatagttcagggagtgctggccacaattaacctccaatccacccacgagctgcagctgctgacaactttccttttcaatgtgcagggtactcaacctaaaatggtgatggagtactggactggatggttcgatagctggggaggcccccacaacatcttagattcttccgaggtcctgaaaaccgtgagcgccatcgtggacgcgggaagttccatcaatctttatatgtttcatggcggaacaaatttcggcttcatgaatggggccatgcacttccatgactacaagagcgatgttactagctacgattacgacgccgtgttgaccgaggctggggattacacagccaaatacatgaaactgcgggacttcttcggatccatttcgggaatccctctgccacctcctccagacctcctgcctaagatgccgtacgaaccccttacccccgtgctgtatctatctctgtgggatgcattgaagtacttgggtgagccaatcaagagcgaaaagcctatcaacatggaaaatcttcccgttaatggcggcaacggacagagctttgggtacatcctctatgagactagtatcaccagttcaggcatattgtccggccatgtgcatgacagaggacaagtgtttgtcaacacagtctctatcgggttcctggactataaaacaactaaaatagcagtgcccttaatccaagggtacacagtgctgaggattcttgtggagaacagaggtcgtgtgaattacggagagaatatcgacgatcaaagaaagggcttgattggaaatctgtacttgaatgatagtcccctgaagaacttccggatttacagtctcgacatgaaaaaaagcttcttccagcggtttgggctcgacaaatggtcaagccttcctgagacaccgactctgcctgcgttcttcctgggctctctgagtatttccagcaccccctgcgacacattcctcaagctggaggggtgggagaagggggtggtcttcattaatggccagaatcttggtaggtattggaatatcggccctcaaaagacgctttacctccctgggccttggctgtcgtcgggcattaatcaggtaatcgtctttgaggaaaccatggccggccctgctctgcagttcacagagactccccatctggggcggaatcaatacatcaagtag

SEQ ID NO: 6636 - DNA, 1374 bp, Artificial Sequence
  Description of Artificial Sequence: Synthetic coding sequence
atgggctgcagcctgcctctctcatgcataatggttcgctcagtggcctgggctggcttcatggtcctgctcatgattccttggggatctgcagccaagttggtttgttactttaccaactgggctcagtacagacagggcgaggctaggttcctccctaaggacttagacccttccctatgtactcatttaatctatgctttcgccggcatgacgaatcaccagctgtccaccacagagtggaatgatgaaactctgtatcaggaattcaacggactgaagaagatgttcaccgatatggtggccactgccaataaccggcaaacttttgtcaacagcgctattcgtttcttgcgcaagtactcatttgacggcctcgacctggattgggagtatcctggctctcaggggtcccctgctgttgacaaagaacggtttactacgttggtgcaggacttggcaaacgcctttcaacaggaggctcagacctccggaaaagaaaggctgctgctgagtgcagccgtgccagcaggccagacctatgtggatgcaggatacgaggtagataaaattgctcaaaacctcgattttgtaaatctgatggcatatgactttcacggatcctgggaaaaagtgactggtcacaactcccccctgtacaaaaggcaggaggaaagcggagcagccgccagcctcaatgttgatgctgccgtgcagcagtggctgcagaaaggaacccctgcatccaagctaattttgggtatgcccacatacggaagatccttcaccttggcctcctcctcagacacgcgggtgggggcaccagctaccggctctgggactccaggtcccttcacaaaggagggagggatgctggcttattatgaggtctgcagctggaagggagcgaccaagcagagaattcaagatcagaaggtcccctacatctttcgggacaaccagtgggttggattcgacgacgtcgagtccttcaaaacaaaggtaagttatttaaaacagaaaggcctagggggagctatggtctgggcccttgatttagacgactttgctggctttagttgcaatcagggaagatacccactcattcagaccttacgccaggaactgtccctgccataccttcccagtgggacacccgagctggaggtgcctaaacctggccaacccagtgaacccgaacacggacccagccctggacaggatactttctgccagggtaaggccgacggcctatatcccaatcctcgggagagatcatctttctacagctgcgccgccggccggctatttcagcagagctgtccaacgggcctggttttctcaaactcctgtaaatgctgtacatggaactag

SEQ ID NO: 6637 - DNA, 1125 bp, Artificial Sequence
  Description of Artificial Sequence: Synthetic coding sequence
atgtatgttagcacccgggaacggtacaagtggctgcggttcagcgaggactgtctgtacctgaacgtgtatgcccctgctagggcccccggagaccctcagttgccagtgatggtgtggttcccaggcggcgctttcatcgtgggagccgccagttcctacgaaggaagtgacctggccgcgcgagagaaggtggtgctagttttcctgcagcatcggctcggcatcttcgggttcctgagatggagaggtcgcacagacgatagccacgcgaggggaaactggggtttgttagaccagatggccgcattgcggtgggtgcaggagaacatcgccgcctttggaggagatcccggcaacgtgacgctgtttggacagtcggctggtgccatgagtatctctgggctgatgatgtcccccctggcgtccggtctatttcatcgggccatatcccagtccggtaccgccctattcagactatttatcacttcaaatcctctgaaagtggcaaagaaagtggcccatctggccgggtgtaatcacaatagcacccagatcttagtcaattgcctcagagcactgtctgggacaaaagttatgcgcgtctctaacaaaatgaggttcctgcaacttaacttccaaagggaccccgaagaaatcatttggagtatgtctcctgtggtggacggggttgtcatccctgacgatccattggtgttgctaactcagggaaaagtgagctcagttccatacctgctgggtgtgaataatctcgagtttaactggctgctgccttacattatgaaatttccgctcaaccgacaggctatgcgtaaggagacgatcactaagatgctgtggtccactcggacgttacttaatattactaaagaacaggtgccacttgtggttgaggagtatctggataacgtcaatgagcatgactggaagatgctgcgtaacagaatgatggatattgtacaggacgccactttcgtttacgccacgctacagactgcccattaccacagagagacccctatgatgggaatctgtcctgcaggacacgcaactaccaggatgaagtcaacatgttcctggatcctgccgcaagagtgggcgtag

SEQ ID NO: 6638 - DNA, 384 bp, Artificial Sequence
  Description of Artificial Sequence: Synthetic coding sequence
atgaagacaggtctattttttctctgcttgctgggaaccgctgccgccataccaaccaatgcccggctgctgtctgatcattccaaaccaacggccgaaactgttgcccctgataataccgctatccccagtcttagggccgaagcagaggagaatgagaaggaaacggccgtcagtacagaggacgactcacaccataaggctgaaaagtctagcgtgttaaagtcaaaggaagaaagccatgaacagtctgcagagcaggggaagtcttccagccaggagctgggcctcaaggaccaggaggatagtgacggacatctctctgtcaacctcgaatatgcccccactgaggggacgttggatattaaggaagacatgtcttag

SEQ ID NO: 6639 - DNA, 285 bp, Artificial Sequence
  Description of Artificial Sequence: Synthetic coding sequence
atgcgcaccctcgcaattctagccgccattcttttggtggctttgcaggctcaggccgagcccctccaggcccgggccgacgaggtcgccgctgcccctgagcagattgctgccgacattcccgaggtggtggtgtctttagcttgggacgaaagcctcgcaccaaagcaccctggttctcggaagaacatggcctgttattgcaggatccccgcttgtattgcaggagaacggagatacggtacttgtatctaccagggaaggctgtgggccttctgttgctag

SEQ ID NO: 6640 - DNA, 414 bp, Artificial Sequence
  Description of Artificial Sequence: Synthetic coding sequence
atggctgccctgtctcgggcgctgggaccactcagaactccggcccctccactgtggatcggtctgtttctggtggctactggaagccagcagagcctggctcaaccattgcctggaaatacgaccgaggctacaccgcggtctctcagagcctcaggatctctttgcggccctcatgccaaggcgccatatctctgtgaggccacccatgaacccgccgctgcacgaatccgcgctcaagtgcccgatacacggtggtctcgagtcgggggtcagaggttttactctagagtactgagccccctgcaccgtggtcccagtggccataccgaggctagcgcccagcgttcccacatggggaaactcaaggaaccccagccccaggaccacaagcccggtctgggggcatcgtag

SEQ ID NO: 6641 - DNA, 228 bp, Artificial Sequence
  Description of Artificial Sequence: Synthetic coding sequence
atgctgaaggttcactacccaaagtttggagtctccgaagactgcttgtacctcaacatttacgcccctgctcacgccgataccggaagtaagctccccgtgcttgtgtggttcccgggaggagcttttaagaccggtagtgcttctatctttgacgggagtgcactagcggcttacgaagacgtacttgtggttgtcgtgcagtatcggctcggcattttcgggtag

SEQ ID NO: 6642 - DNA, 1491 bp, Artificial Sequence
  Description of Artificial Sequence: Synthetic coding sequence
atggctccggccaggactatggccagggctagactggcaccagccgattgtttgaacagctttaccgcaggggttccggggtttgtcctcgatacaaacgcgagcgtcagcaacggcgctaccttcctcgagagcccaacagtacgcaggggatgggattgtgtcagggcgtgctgtaccacgcaaaactgtaatttggccctggttgaattgcagccagaccgaggcgaagatgccatcgccgcctgcttcttgattaattgcctttacgagcagaatttcgtatgcaaattcgcaccacgagaggggttcattaactacctgacgcgcgaagtgtatagatcctaccgccagctcagaacgcagggatttggcggctctggcatacccaaagcatgggccggcatcgacctgaaagtgcaaccacaagaaccacttgtcctcaaagatgtagagaatactgactggagactgctgcgaggcgatacagatgtgagagtcgaaagaaaggaccctaaccaggtcgaactatgggggttaaaggagggtacatatctctttcaattaactgtgacttcaagcgaccaccctgaggacactgcaaacgtgacagttaccgttctgtcaaccaagcaaaccgaagattactgcctggcaagcaacaaagtggggaggtgtcgaggctccttcccacggtggtattatgatccaaccgaacagatctgtaaaagcttcgtgtatggtgggtgccttggcaacaaaaacaattacctaagggaagaagagtgcatcctggcttgtagaggggtgcagggaggtcctcttagaggctctagtggtgcccaggcaacatttccacagggaccatccatggaacgccgtcacccagtgtgttctgggacttgtcagcccacccaatttcggtgcagcaacggctgttgcattgatagtttcctggaatgcgatgatacccccaattgcccagatgcctcggacgaagccgcctgcgaaaagtacacctccgggtttgatgagctgcaacgcatacacttccccagcgataaagggcattgcgttgatctgcctgatacgggtctctgcaaggaatctattccccgttggtactacaacccgttcagcgaacattgtgcacgcttcacatatgggggttgttatggcaataagaacaattttgaggaagaacagcagtgtttggaatcctgtagagggattagcaagaaggacgttttcggattgcgcagggaaattcccataccctccaccgggagcgttgagatggccgtggcagtattcctggtcatctgcattgttgtggtcgtggcgattctgggctactgtttctttaaaaatcaaaggaaggactttcatggccatcaccaccatcctcctccgaccccagcatcttccaccgttagcaccacagaggatactgagcatttagtgtacaaccatacaaccaggcctttgtag

SEQ ID NO: 6643 - DNA, 528 bp, Artificial Sequence
  Description of Artificial Sequence: Synthetic coding sequence
atgcccccgggtacccgagcatgtcgtgtgccaaggcctgggcggcgcgctcctagacctagaagggacggagaaccaggtggccatggtgtggccccagccagcgccgaagaggtgggcgccaggcctggcttacgggcggtcgccagactattgcctcagcaacatctgcaggctggctatgtgtgcgagaggaaggatttgcttgtgaatggatgctgtaatgttaacgtgccctccacaaagcaatactgctgtgatgggtgttggccaaatggatgttgtagcgcctatgagtactgcgtgagttgctgtctgcaacctaacaaacagctgttacttgagaggttcttgaatcgcgccgcggtggcattccagaatctgttcatggctgtcgaggatcactttgagttatgcctagccaagtgtaggacgtcaagccagtccgtacagcacgagaatacctatcgggaccctatcgcaaaatactgttacggggagagcccacccgaactgttccctgcctag

SEQ ID NO: 6644 - DNA, 1881 bp, Artificial Sequence
  Description of Artificial Sequence: Synthetic coding sequence
atggacttagtcctgaagagatgcttactgcacctcgccgtgattggagccttgctggccgtgggcgcaaccaaagtcccgcggaatcaagactggctaggagtaagccggcagttgcgcacaaaagcctggaaccgccaactgtacccagaatggactgaagcacagcggctcgattgctggagaggcgggcaagtgtcacttaaggtcagcaatgacgggccaacgcttatcggtgcaaatgcgagtttctccatcgctctgaattttcctggctcccaaaaagttcttccagacggacaggtaatatgggtcaacaatacaatcatcaacggcgatcaggtttggggtggccagccggtctatccacaagaaacggacgacgcctgtatctttccagacggaggcccgtgcccctctggctcatggagccagaagcgctcctttgtgtatgtatggaagacttggggccagtactggcaggtcctgggaggacctgtttctggtctgtctatcggaactgggcgagccatgctggggactcacacaatggaagttacagtttatcaccgtaggggcagtcggtcgtatgttcctctcgcacattccagctccgcatttacaattaccgatcaggtgccattctccgtgagcgtcagccagctaagggccctggatggcggcaataaacactttctgaggaatcagcccttaacctttgctctgcagttgcacgacccttcaggttacttggctgaggctgatctgagttatacgtgggatttcggcgatagctcaggtaccctgatctccagggcccttgtcgtgacacatacctacctcgagccgggccctgtgactgcccaggtagtgctccaagccgccattccattgacatcttgcggttccagcccagtaccgggcacaaccgatggccatcgaccaacagcggaggctccgaacacaactgcaggtcaggtgccaaccacagaagtggtaggcacgacaccgggacaggccccaacggccgagccaagcgggaccacaagcgttcaggtgcctaccaccgaagtaatcagcactgcccctgtgcagatgccaaccgccgagtccaccgccgcccaagtgacaactacggagtgggtggaaactaccgctcgggaactccctataccggaaccagaggggcccgatgccagctccattatgagcactgagagcattaccggcagtctgggaccgctgttggacggtacagccactctgaggttggttaagcgccaggtgcccctcgactgcgtgctctacagatacggctccttttcagtgacactggacattgtgcaggggatcgagtctgccgaaatcctgcaggcggttccctcaggtgagggggatgcctttgaacttacagtatcctgtcagggcgggctccccaaggaagcttgcatggagatttcttccccaggctgtcagccgccagcacagagattatgtcaacctgtactgccaagtcctgcttgccagctggtgctccatcagatcctgaaaggcggaagcggcacgtattgcttgaacgtctctctggctgatactaactctcttgctgtggtgtcaacacagctgatcatgcctgtcccagggattctgctgacaggccaggaggccggcctggggcaggttcctctcatcgtgggcattctacttgtcctcatggccgtggtgctcgccagtttaatctataggcgccgcttaatgaagcaggatttcagtgtgcctcagctccctcacagctcaagccattggttgaggctccctagaatattttgttcatgtcccatcggtgaaaactcccctcttctctccggacagcaggtgtag

SEQ ID NO: 6645 - DNA, 1611 bp, Artificial Sequence
  Description of Artificial Sequence: Synthetic coding sequence
atgccaactttatgttcttcttttgggttacaggtcctgttgcctgagtacctaagagaaagattcgtcgccgctgcattaagctatatcacctgtagcagcgaaggtgaactagtttgtaaggaaaacgactgttggtgcaagtgctccccgaccttccctgagtgcaactgtcccgatgcggatatacaggccatggaggattcgttgctgcaaatacaggactcctgggcaacgcacaatcgccaattcgaggagtctgaggagtttcaggctcttctcaagagactgcccgatgacagattcctcaatagtaccgctattagccagttctgggcaatggacaccagtcttcaacatagatatcagcaacttggggcaggattgaaggtgctttttaaaaagactcacagaatactgaggagattatttaatctgtgcaagcgatgtcacagacaacctagattccgcttacctaaggagtcaagcccaaggtccctctcgtactggtggaatcggatccagagcttgttgtattgtggtgagtcgacgttccccgggacattccttgaacagtcacattcgtgtacatgtccatatgaccagtcttcatgtcaggggccgatcccgtgtgcgttaggcgagggccccgcttgcgcccattgcgcccccgataatagcactcgatgcggctcctgtaaccccggatacgtgctcgcccagggtctgtgcagaccggaagttgcagagagtttagaaaactttctcggtctggaaacagacctccaggacctggagcttaagtacctgttacaaaagcaggatagtagaatcgaagtccactctatttttatctctaatgacatgaggcttggttcctggttcgacccgagttggagaaaacggatgttgctgaccctgaagagcaataaatacaaacctgggcttgtgcacgtaatgcttgccctttcacttcagatttgcctcacaaagaactctacactggagcctgttatggccatttatgtgaaccctttcggcggttctcactctgagtcgtggtttatgccagtcaatgaggggtcctttcctgactgggagcggacaaatgtcgacgccgccgcccaatgccagaactggacaatcacgttaggtaaccggtggaagacgttctttgagacagtgcatgtgtatctacgttctcgtattaagtcccttgatgactctagcaacgagacaatttactacgaaccgctggagatgacagatccttctaagaacctgggctacatgaagatcaataccctgcaggtctttgggtactcgctgccctttgacccagatgccatcagggatctcatcttacagctcgattacccctacactcagggaagtcaggatagtgcccttctccagttgattgagctccgagatcgggtcaaccagctcagtccccccgggaaggtgaggctcgacctcttctcctgcctactccggcaccgtctcaagcttgcgaataacgaagttggccggatccaaagctcgttgcgtgcattcaattccaaattgcccaaccctgtggagtatgaaacaggaaagctgtgcagctag

SEQ ID NO: 6646 - DNA, 423 bp, Artificial Sequence
  Description of Artificial Sequence: Synthetic coding sequence
atgtcacaaagtatagaggtcctgaatcttcgcacacaaagagatttccagtacgtgttaaagatggagacccagatgaaaggtctgaaggctaagttcagacagattgaggacgaccgtaaaactctgatgactaagcacttccaggaactaaaagagaagatggatgagctcctgccactgattcccgtgctggagcagtacaaaaccgatgctaaattaattacacagttcaaagaggagattcgaaacctttccgcagttctgaccggcatacaagaagagattggcgcgtacgattacgaagaactgcaccaacgggtgctaagcttggagaccaggcttcgcgactgcatgaagaaactcatcgacctgaagaaaaggaaagaagaggagaagcggcaacaaaaaggggaggcctag

SEQ ID NO: 6647 - DNA, 1119 bp, Artificial Sequence
  Description of Artificial Sequence: Synthetic coding sequence
atggcttacattgaacagcgaaggattagccatgaagggagccctgtgaagcctgttgcaatcagagagttccaaaaaacagaagacatgcgccgatacctccaccagaatcgcgtgcctgctgagcccagctcactgttgtcactttctgcttcacataatcagctctctcacactgacctggaacttcaccagcggagggagcagctcgttgaacggactagacgggaggcgcagctcgccgctctccaatacgaggaggagaaaataagaacgaaacagattcagcgcgacgccgtattggactttgtaaagcaaaaggcctcacagtctccccaaaagcaacatccacttctcgatggcgttgatggcgagtgtccgttcccctctcgtcgtagccagcacacagacgatagcgccctttgtatgtccctttctggcctgaaccaggtgggctgtgcagcaactctgccccactcctctgcttttaccccccttaagtctgacgatcggcctaacgccctgctaagctctcccgccaccgagaccgtgcatcacagtcctgcctacagcttccctgctgcgatacagaggaaccagcctcagcgccccgagtccttcctatttcgcgcgggggtgagagccgagaccaacaaaggccacgccagccccctgccgccatctgccgcccccaccacagactccaccgatagcatcacaggacagaactccagacagcgcgaggaagagttagagctgatcgatcagctccggaaacacatcgaataccggctgaaggtgagtctgccatgcgatttaggtgccgcgctgaccgatggcgtcgtcttgtgccatctcgcaaaccacgtcagacctcggagcgttcccagtatccacgtgcccagccccgccgtacctaaactgactatggccaaatgccgtcggaacgtcgaaaatttcctcgaggcctgccgtaaaattggcgtgccacaggagcagctgtgtctgcccctgcacatactggaagaaaagggtctgtcacaagtagccgtgacggttcaggccttactggaactggcccccccaaagcagcagcagcaccaactcagtgcagtatag

SEQ ID NO: 6648 - DNA, 1242 bp, Artificial Sequence
  Description of Artificial Sequence: Synthetic coding sequence
atggagaatatgttattgtggcttatcttttttacgccgggctggactctgattgatgggtccgaaatggaatgggattttatgtggcacctgagaaaggtgcctcggattgtgagcgaacgcacattccacctgacatctcctgcctttgaggccgatgccaagatgatggttaacacagtatgtggaattgaatgtcagaaggaactgcctactccctctttaagtgagttggaggattacctctcctacgagaccgtgttcgagaacggcacgcggacattaacccgcgtcaaggtgcaggatttagtgctggagccaacccagaatattactacaaagggtgtctctgttaggcgtaaaagacaggtgtatggaaccgatagccgatttagtatcctggacaaaagattcctaaccaacttcccattttccactgcggtgaagctctctaccggctgttctggcatcttaattagcccccagcacgttctcactgccgcacattgtgtccatgacgggaaagattatgtgaaagggtccaaaaaacttcgcgtgggcttactgaaaatgaggaataagtctggcggtaaaaaaaggcgcggatccaagcggtcccggcgtgaggcatcaggcggggaccagcgagaaggcacacgggaacatttgcgtgagagagctaaagggggtaggaggcgtaagaagagcggacgcggccagagaatcgctgagggtaggcccagtttccagtggaccagagtgaagaatacacacattccgaaaggatgggcgaggggaggcatgggcgacgcaaccctcgattatgactacgcactcctcgagctaaaacgagcgcacaaaaaaaaatacatggagctgggcatcagccccaccatcaagaaaatgccagggggtatgattcacttttcaggatttgacaatgatcgggccgatcagcttgtgtaccgcttctgttccgtttctgacgagtctaacgatctgctctatcagtattgcgacgcggagagcggaagtactgggagcggagtgtatttacgactgaaggaccctgacaagaagaattggaaacgcaagatcatcgccgtatatagtgggcatcagtgggtcgatgtgcacggagttcaaaaagattataacgtcgcagtgcgaattacgcccctcaagtacgcgcagatctgtctgtggatacatgggaatgacgcgaactgcgcatacggatag

SEQ ID NO: 6649 - DNA, 2541 bp, Artificial Sequence
  Description of Artificial Sequence: Synthetic coding sequence
atgttcaagtgctggagcgtagtgctcgtgctgggcttcatttttctggagtctgaagggagaccgacgaaggaggggggctacggacttaagagctatcagcctctgatgaggctgcgccataaggaaaaaaatcaggagtcaagtcgggtgaaaggattcatgattcaagacggcccattcggttcgtgtgaaaacaagtattgtggtttgggtaggcattgtgtcacctcgagagagactggacaggcagaatgcgcctgcatggatttatgtaaacgtcactacaagcctgtgtgtggtagtgacggcgaattttatgaaaatcactgcgaggtacacagggccgcctgcctgaaaaaacagaagatcaccatagtccataatgaagactgtttttttaagggtgacaaatgcaaaactacagagtacagcaagatgaagaatatgctcctcgacctgcagaaccagaagtacatcatgcaggaaaatgagaatccaaatggcgatgatatctctcggaagaaactgcttgtggaccagatgttcaaatattttgacgctgactccaacggccttgtggacatcaacgagctcacccaagtcattaagcaggaagaattaggaaaagacctctttgactgtaccttgtacgtactgctgaaatatgacgactttaacgccgacaagcacctcgctcttgaggaattctatcgcgcttttcaagtgatacaactgtcactgcctgaagatcagaagctgtccataacagcagccacggttggacagtccgccgtgctctcctgcgcaattcaggggactctgagacctccaatcatatggaagcggaataacatcattctgaacaacctggatttggaggatatcaatgacttcggcgacgacggttcactctacattacaaaggtgacaaccacacacgttggaaattacacctgctatgcagatgggtacgaacaggtctaccaaacacacattttccaggttaatgttcccccggtcatccgagtgtatccagagtcgcaagcccgagaaccaggcgtgactgccagtctgaggtgtcacgccgagggcatcccaaagccccaacttggatggctgaagaacggtatcgatattactccgaagcttagcaagcagctgactctgcaggccaatgggagtgaggtacacatctcgaacgtccgttatgaggacacaggcgcctacacttgtatcgcaaaaaatgaagcaggtgtagacgaggatatttccagcttattcgtagaggattccgctaggaagacgctcgccaatatcctgtggcgggaggagggtctcggcattggtaacatgttctatgtattttacgaggacgggattaaggtgatccagccgatcgagtgtgagtttcaaaggcacattaagccatctgagaagctcttgggattccaggacgaggtgtgccccaaggccgaaggcgacgaagtgcagaggtgtgtgtgggccagtgcagttaacgtcaaagacaagttcatatacgtggcacagcccacactggatcgtgtgctgatagtggatgttcagtcacagaaagtggtccaggccgtgtctacagaccccgtgcccgttaaactgcattacgataaaagccatgaccaggtttgggtcctttcatggggtacgctggagaagacctccccaacactccaggtgatcacactggcctcagggaacgtacctcaccatactattcacacccaaccagtgggcaaacagttcgaccgagtcgacgatttctttattcctaccacaacactaataattacacatatgagatttggatttatattacataaagatgaggctgccctacagaagatagacctcgagaccatgagttacattaagacaatcaatctaaaagattataaatgtgtgccccagtcactggcgtacacccacctcgggggctactacttcataggctgtaagccagacagcaccggcgctgtcagtccccaggtgatggtagatggcgtgaccgacagcgtaatcggattcaatagcgacgtgactggcaccccatatgtgagcccggatggccactacctggtcagtattaatgatgtgaaagggctggttcgtgtgcagtatattactattaggggggaaatccaggaagcgttcgatatttataccaatcttcacatctctgacttggccttccagccatctttcactgaggctcatcagtataatatatatggatcctccagtactcagactgatgtcctgttcgttgagctgtcctctggtaaagtcaaaatgattaagtcattgaaagaaccccttaaagctgaagaatggccctggaaccgcaagaaccgccagattcaggactccggacttttcgggcagtatctgatgactccttcaaaggattctctgttcattctggacggaaggctgaataagctgaactgcgaaataacagaggtggaaaaaggcaatactgtcatttgggtaggcgacgcttag

SEQ ID NO: 6650 - DNA, 582 bp, Artificial Sequence
  Description of Artificial Sequence: Synthetic coding sequence
atgctcggcgtgctggagctgctcctactcggagctgcctggcttgcaggccctgcgcgaggtcaaaatgagactgaacccattgtgctggagggcaagtgtctggttgtgtgcgacagcaacccgacaagcgatcctaccggcaccgctctcgggataagcgttcgctccggatcggctaaggttgccttctctgcaattagatctaccaaccacgagccaagcgaaatgagtaaccgaacaatgatcatatattttgaccaggttttggtgaacataggaaacaatttcgattccgaaaggtccactttcatagccccaaggaaaggaatctacagcttcaatttccacgtagtcaaagtatataaccgccagaccatacaggtctctctcatgcttaacggatggccggtaatttctgcctttgcaggagaccaggacgtcacacgtgaagctgcctcaaacggggttctgattcaaatggagaagggagatcgggcttaccttaaactcgagagggggaatttgatggggggctggaaatactcaaccttcagtgggttccttgtattccccctttag

SEQ ID NO: 6651 - DNA, 813 bp, Artificial Sequence
  Description of Artificial Sequence: Synthetic coding sequence
atgcacggttcatgtagtttcctgatgttgctactgcctctcctccttttactagtggcaacaacagggccggtcggagccttgacagatgaggaaaaacgcctgatggtggagctccacaacttgtaccgcgcacaagtgagccccacagcctcagacatgcttcacatgaggtgggacgaggaattagctgcctttgctaaggcctatgcaaggcagtgcgtctggggccataacaaggagaggggtcgccggggtgagaacctgttcgcaattactgatgagggcatggatgtgcccctggctatggaagagtggcaccacgaacgggaacattacaatctctctgcagcaacatgttctccaggccaaatgtgtggccactacactcaagtggtatgggccaagacggagcgaatcggttgcgggtcccacttctgtgagaagctgcagggtgtggaggagaccaacattgagctactggtgtgcaattatgagcctcccggaaacgtgaaagggaagcgcccttaccaggaaggcaccccttgctcgcaatgtcccagtggctaccattgtaagaatagtctgtgtgagcctattggtagccccgaagatgctcaggacctgccctacttggtcacagaagctccctctttcagggccaccgaggccagcgatagccgtaaaatgggggccgagggaccagataaaccgtccgttgtgagcgggctgaatagcggccccggccacgtctgggggccgctactcggcctcctcttactcccgccgttggtactcgcaggcatcttttag

SEQ ID NO: 6652 - DNA, 702 bp, Artificial Sequence
  Description of Artificial Sequence: Synthetic coding sequence
atggaccaagtgtttatgattgactcaaagtgcgagagcggaaaaggacggtgctcattcaatccaaacgtcaacaccgtgtctgtgatgattaatgaggaactcttttctggaatgtatatcgacttcatggggaccgacgccgctatattccgtagcctgaccaagagaaatgccgtccggacagaccagcacaatagtaagtggctaagcgaacccatgtttgtagacgctcatgtgattcctgacggcacagatccgaacgacgccaaggtctatttttttttcaaggagaagcttacagataacaaccgcagtacaaagcagatacactccatgatagcgaggatatgtccaaatgacactggcggcttaagatccctcgtaaataagtggaccacattcctgaaagctcgcctcgtgtgcagcgtgaccgatgaggatggccccgagactcacttcgatgaactagaagacgttttcttgcttgaaactgacaatccgcggacaaccttggtgtacggcatttttactacaagttcatccgttttcaaaggtagcgctgtgtgcgtctaccacctgtcagatatccagactgtcttcaacggtcctttcgctcacaaggaagggccaaatcaccagctcataagctatcaggggaggatcccttatcctaggcccggtaccaacacttgtgtatag

SEQ ID NO: 6653 - DNA, 1368 bp, Artificial Sequence
  Description of Artificial Sequence: Synthetic coding sequence
atgctacatcctgaaacaagtcctgggcggggacatctgctcgccgttttacttgccctcctcggtaccgcttgggctgaggtatggccaccccagttacaggaacaggcccccatggccggagctctcaacaggaaggagtctttccttctgctctccctgcataacagactccgctcttgggtccaacccccagcagccgacatgcggagattagattggagcgatagtttggcccagttggctcaggctagggcagccctgtgcgggattccaacccctagtctcgctagtggattgtggaggactctgcaggttggttggaacatgcaactgctgccagctggcctggcttcctttgttgaggtggtaagtctatggtttgcagagggccagaggtattcacatgctgctggagaatgcgcccggaatgccacctgcacgcactacactcagctggtgtgggcgacatcctctcaacttggctgcgggcgtcacctgtgctcggctggtcaagcagctatcgaagcatttgtgtgtgcttactcccctaggggcaattgggaggtgaacggaaagactatagtgccttataagaagggtgcatggtgttccctctgcactgcttcagtgagtgggtgtttcaaagcttgggaccacgctggtggtctttgcgaggttccacgcaatccttgcagaatgtcctgtcaaaaccatggaaggttaaatatcagtacctgccactgccactgtcctccaggatacaccggcaggtattgtcaagtgcgctgctcactgcagtgtgtgcatgggcggttcagggaagaggaatgtagctgcgtgtgcgacatcggatacggcggggcacagtgtgctaccaaagttcactttccattccatacatgcgaccttcgcatcgacggggactgctttatggtgagcagcgaagcagatacctattaccgagctcgtatgaagtgtcaacgcaaaggaggcgtcctggcccaaatcaagagtcagaaggtgcaagatatcctggctttctacctgggccggctggaaacaacaaacgaggtaattgactcggactttgaaactaggaacttttggataggactgacgtataagaccgcgaaggatagttttcgatgggccacaggagaacatcaggccttcacctctttcgcattcggccagccggacaaccatggcctggtgtggctctctgccgccatggggttcggaaactgtgtggaactgcaagcctctgccgcctttaactggaacaaccagaggtgtaagacccgcaaccggtatatctgccagttcgctcaggagcatatttctcggtggggtcctggctcctag

SEQ ID NO: 6654 - DNA, 462 bp, Artificial Sequence
  Description of Artificial Sequence: Synthetic coding sequence
atggcaaggttctgggtatgcgtggcaggcgccggatttttcctcgcatttcttgtgttgcactcaaggttttgcggcagtccggtgttacgcaatttcacctttgccgtgtcttggaggactgaaaagatcctgtacagattggacgtgggctggccgaagcaccccgagtatttcaccggcactaccttttgcgtagcagtagattcactgaacgggctggtgtacattggacagcggggagacaatatccctaagattctcgtctttactgaagacggctactttttacgcgcttggaattacactgttgacacgccccatggaatctttgccgcttccaccctgtacgaacagagcgtgtggataaccgacgtgggctccgacttcatgattttgtggttacatggggagaatggtacgggccccgcaaagttcaatatcccacactccgttacatag

SEQ ID NO: 6655 - DNA, 375 bp, Artificial Sequence
  Description of Artificial Sequence: Synthetic coding sequence
atgtggcggtgtcccctcggcctactcttgctgttgcctctggcggggcatctggccctcggggcacagcagggacggggaaggcgggagctggcacccggtctacatctccgaggtatccgagatgccggcgggcgctactgtcaggaacaggatctgtgctgtcgagggagggcggatgactgcgcactgccctatctcggtgcgatatgctattgcgatcttttttgcaaccgcacagttagcgattgctgtcctgatttttgggacttttgtctcggggtgcctcctcctttcccaccaattcaggcgcctgccagacggaccggttctggctcagttactaagaaccacgcttggtggatccagacgtag

SEQ ID NO: 6656 - DNA, 777 bp, Artificial Sequence
  Description of Artificial Sequence: Synthetic coding sequence
atgaagaccttgtacctagctgacacgttccccacaaatttcagggattctgcgggcgccatgaagcagatcaatgactacgtggcaaaacaaactaagggcaagatcgttgacctgttgaagaacctggatagtaacgccgtagtaatcatggtaaactacatcttcttcaaggccaagtgggagacctcctttaatcataagggcacgcaggaacaggacttctacgtgacgtcggaaacggttgtgcgggtacccatgatgagtcgggaggaccaataccactatttactggatcgcaatctctcatgccgggtagtcggcgtgccatatcagggcaatgccaccgccctgttcatcttgccctcagaggggaaaatgcaacaggtggaaaacgggctgagcgaaaaaacgctgcgcaaatggctcaaaatgtttaaaaagcgccagctcgaattatatctccccaagttcagcattgagggaagctaccaactggagaaggtgctcccttccctcggcattagcaatgtgtttacaagtcatgccgatctgagcggcataagcaatcactccaacattcaagtcagcgagatggtgcacaaagcggtggtggaagtcgacgagtcagggactagagccgcagccgccactggaacaatcttcacattcaggagtgcaagactcaattcccagaggttggtttttaatagaccttttttgatgtttattgtcgacaataacattctctttttggggaaggtcaaccggccatag

SEQ ID NO: 6657 - DNA, 1731 bp, Artificial Sequence
  Description of Artificial Sequence: Synthetic coding sequence
atgattgtgtttgggtgggctgtgttcctggccagtcgatccctcggacagggactcctcttgacgctggaagagcatatcgcacatttcttaggaactggaggagccgccactactatgggaaactcgtgcatttgtagagacgatagtgggaccgacgactctgtggatacgcagcagcaacaggccgaaaacagtgcggttccgaccgccgatacacgctctcagcctagagaccctgttagacccccccgccgtggccgcggaccacacgaaccccgcaggaaaaagcagaacgtggacgggctggtacttgataccttggccgtgatccggactctagtcgacaacgaccaggaacctccgtatagtatgatcactctgcacgaaatggccgaaacggacgaaggatggttggacgtcgtgcagtccttgattcgagtgatccccctggaagatccactgggcccagctgtgattactttgctgctggacgaatgcccactgcctactaaggacgcactgcagaagctcaccgagattttgaacttgaatggggaggtggcctgtcaggattcctcccatcctgctaagcatcggaacacttcagcagtgctcgggtgtctggccgaaaagttggccgggcctgcctccattggcttactgtcacctggtatcctggaatacctgctccagtgcctgaagctgcagtcgcaccccactgtcatgctgttcgccctaatcgccttggagaagtttgcccaaactagcgaaaacaaactcactattagcgagtccagtatctccgataggttggtcacgcttgaatcgtgggcaaacgatccagactatctgaagcgacaggtgggcttctgcgcacagtggtctctggacaatctgttcctgaaggagggaaggcaactgacatacgaaaaagtgaatctgagttccatccgcgcaatgctgaactccaatgatgtgtccgaatatctgaagatttccccccatggcctcgaggcaaggtgcgacgccagcagcttcgaatccgtgcggtgtactttctgtgtggatgccggggtgtggtactacgaagtgactgtcgtgaccagcggagtaatgcagatcgggtgggcaactcgggattcaaagttcttaaatcacgagggctacgggattggtgatgacgaatactcttgcgcttacgatgggtgcaggcaactcatttggtataacgcaaggtcaaaaccacacattcatccctgctggaaggaaggtgacaccgtgggattcttacttgatttaaacgaaaagcagatgatttttttcctaaatgggaatcagttgcccccggaaaagcaagttttctcctctaccgtcagcgggtttttcgccgccgcttcatttatgagctaccagcagtgcgaattcaacttcggagccaaacctttcaaatatcccccaagtatgaaattttctacatttaacgactatgccttcctgacagcagaagaaaagattattctgcctcgacatcggagactagcactgctcaaacaagtctccattcgggagaactgttgttctctctgttgtgacgaggtagcagacactcagttgaagccatgtgggcactctgacctctgtatggattgtgcgctgcagctggaaacgtgtccactgtgcaggaaggagattgttagccgcatccgccagatttctcatatatcttag

SEQ ID NO: 6658 - DNA, 1359 bp, Artificial Sequence
  Description of Artificial Sequence: Synthetic coding sequence
atggccgatatgcaccgcggctatgcagactctccctcaaaggcaggagcagccccctacgtacaggccttcgattctctgctcgccggacccgtagcagagtatctcaagatcagcaaagagattggcggcgacgtacagaagcacgccgaaatggtgcacacaggtttaaagctcgaacgcgcactactagtaacagcaagtcagtgccagcagccagctgagaataagttgtccgacctgctggcgccaattagtgagcagattaaagaagttatcaccttccgcgaaaaaaatagaggtagcaagctgtttaatcatctctctgccgtctctgaatcaattcaggctctcggctgggtggccatggcgccgaagcctggcccttatgtgaaggagatgaacgatgccgccatgttctataccaatcgcgttcttaaagagtacaaagacgtcgacaaaaaacatgtcgactgggtaaaggcctatctctccatttggaccgagctccaagcatacatcaaagagtttcacaccacaggactcgcctggtcaaaaaccggccccgtcgcaaaagaactgtctggcttgcctagcggcccctccgcaggaagttgtcctccccccccccccccttgcccacctccacctcctgtgagtaccatctcgtgttcttacgaaagtgcgtcacgctcctccttgttcgcccaaatcaaccagggcgaaagcatcactcacgctttgaaacatgtgtcagatgacatgaaaacacataaaaaccccgcgctgaaggcacagagtggcccggtgcggtcggggccgaaacccttcagtgctcctaagccccaaaccagtcccagtccaaagagagccacaaagaaggagcctgcagtccttgaactggaaggaaagaaatggagggttgagaaccaagaaaatgtgtctaacctggtgatcgaggataccgagcttaagcaggtggcctatatatacaaatgcgtgaatacgacacttcagataaaaggtaagattaacagcatcaccgtggacaactgcaagaaactcggactagtgttcgatgatgtagtcgggattgtggagattattaactctaaagatgttaaagtccaggtaatggggaaggtgcccacaattagcatcaacaagacagacggttgccacgcctatttaagtaagaactcgttggattgtgagattgtgagcgccaaaagttcagagatgaatgtgctgatccccaccgaggggggcgacttcaacgagtttccggtcccagaacagttcaagaccctgtggaacggccagaaactggtcacaaccgtaactgagatcgccggttag

SEQ ID NO: 6659 - DNA, 1533 bp, Artificial Sequence
  Description of Artificial Sequence: Synthetic coding sequence
atgggccgaccaacacagtggccctcactcctgctccttctactgctgcctggcccacccccagtcgccggcctggaggatgctgcctttccccacctgggcgaaagtctgcagcctctgcctcgggcatgccctctcagatgtagttgccccagagtggacaccgtggactgtgacgggctggacttacgcgtattccctgacaacataactcgcgctgcacagcacttgagtctgcagaacaaccaactgcaggagctcccttataatgagctgagccggctgtccggtttacgaacacttaacctccacaacaatctcatatcaagcgagggcttaccggacgaggcttttgaatcgctcacacagctgcaacatctttgcgtagcccacaataaactgagcgtggctcctcaattcctgccgaggagcctccgagtcgcagacctcgccgcaaaccaggtgatggagattttcccactgaccttcggagagaagccagctctgaggagtgtttatctacacaacaaccagctctccaacgccgggttgccgccagacgcattcaggggaagcgaagcaattgctacactgagtctgtcaaacaatcagcttagttacttgccccctagccttcccccatcactcgaacgattacatctccagaataatctgatttccaaagtgccgcgtggcgcgcttagccggcagacacagctaagagagctctacttgcagcacaaccagctcaccgactcgggccttgatgccaccacattctcaaagctgcactcactggagtacctggatctcagccataaccagctgacgaccgtgcccgccggactgccaaggacgttggcgatccttcacttaggccggaatcgaattagacaagttgaagccgcacggctgcatggcgccagagggctacgatacctgctgctacagcacaaccagttgggcagtagcggactaccggcaggggctctgagacctctgcgcggcctgcataccctccacctatacggaaacggtctggatagggtcccccccgccctgcctaggagacttcgtgctctagttctgccacacaatcacgtggcagcccttggagcacgagatttagttgctacacctggccttaccgagctgaaccttgcctacaaccgactggcttcagccagagtgcatcatcgcgcctttagacgtctcagagccctgcgtagtctggacctggccggtaaccagctgactcggctacccatgggcctcccaacaggtctccgcactttgcagctacaacggaatcagttgcggatgctggaaccggaaccgttggcgggactagaccaactgcgggagctgtccttggcccataaccgcctccgagttggcgatatagggccagggacgtggcatgagctgcaagcccttcaggttcgccataggctcgttagtcacactgttccccgagctccaccatcgccctgtctgccttgccacgtgccaaacatactggtatcatggtag

SEQ ID NO: 6660 - DNA, 114 bp, Artificial Sequence
  Description of Artificial Sequence: Synthetic coding sequence
atgaacagcactctgaatttttttatccagtcttacaataacgcctcaaatgacacctacctgtacagggtgcaacggctcattaggagtcagatgcagcaggtccactgctag

SEQ ID NO: 6661 - DNA, 1266 bp, Artificial Sequence
  Description of Artificial Sequence: Synthetic coding sequence
atgggccgcccaacccagtggccttcgctgctcttgctcttgttgcttcctgggcctccccctgtcgccggcctagaggacgcggccttcccacacttgggcgagagcttgcagcccctaccacgagcgtgcccattgaggtgctcctgcccgcgggtagataccgtggactgcgacggcctggatctgagggtattcccagataacatcacacgagcagcccaacacctttctctgcaaaataatcagctgcaggagctgccctataatgagttgtcccggttatcagggctgagaaccttgaacctgcataataacctgatcagctcagagggcctgcctgatgaggcatttgaaagcctcactcagttacagcatctctgtgttgcgcacaataagaacaacttgatttccaaggtaccccgaggtgccctgagcagacagacccagctgcgcgaactttacctgcagcacaaccaactgacagactctggcctcgatgccacgaccttctccaagcttcacagtcttgagtatttagatcttagccacaaccagctgacaactgtccccgctggccttcccaggaccttggccatactgcacctggggcgaaatcgcatccggcaggtggaggccgcccgactccatggagctagaggcttgcgctatctgcttttgcaacataatcaactgggaagctctgggctgccggcaggagccctccgacccctgcgcggtctgcataccttacacctctacggaaatggcctcgatcgtgtaccgccagctttgcctagaagactacgggctctagtcctgcctcacaaccatgtggccgccctgggcgccagggatcttgtggcaacgcctggactgaccgagctgaatctggcctataatcgattggcctcagctcgggtgcatcaccgcgctttcagacgattgagggctctacgcagtcttgatctagcaggcaaccagttaactaggctgcctatgggcctaccaactggattgagaaccctccaattgcaaagaaatcaactgagaatgctcgaaccggagccgctggcgggcttagaccagctgcgggagctgtctttagctcacaacaggcttagggtgggcgacatcgggcctggcacttggcacgagctccaggcactccaggtccgacacaggcttgtttcacacaccgtcccaagagctcctccttctccatgcctgccatgtcacgttccaaacatactggtgagctggtag

SEQ ID NO: 6662 - DNA, 993 bp, Artificial Sequence
  Description of Artificial Sequence: Synthetic coding sequence
atgtctagttggagcaggcagagaccaaaaagccccggcgggattcagccacacgtctcccggaccctcttcttgttgttactcttggccgccagcgcatggggtgtaaccctgtcaccaaaggattgtcaggtgttcaggtcagatcatgggtcctccatttcatgccaacctcccgctgagattccaggatacctgccggcagacactgttcatcttgccgtggagttctttaatctgactcacctcccagccaacctgctgcagggagcctcaaaattacaagagctgcatctctcaagcaatggattggaatctctttcacccgagtttttgcgtcctgtcccccaactgagagtcctcgacctcacgcgtaatgcacttgtgctgaaagagaaccagcttgaggtcttagaggtatcttggcttcacgggttgaaggctctgggtcatctggacctcagcggaaacagactgcgcaaacttcccccagggcttctcgccaattttacactcttgaggactctcgatttaggtgaaaaccagttggaaacactgccacctgaccttctgcgaggacccctgcagctggagcgactccacttagagggtaacaagctgcaggttctcggaaaggatctgctcctgccccagccggacctgcggtatctgtttctgaatggcaataaacttgcaagggtcgccgccggggccttccaaggcttgagacagcttgatatgctggacctatctaacaactctctggccagcgtgccggaagggctctgggccagcctaggccagcctaattgggacatgcgggatgggttcgacatctctggaaacccatggatctgcgaccaaaatctgtctgatttgtataggtggctgcaggctcaaaaagacaaaatgttctcacagaatgacactaggtgcgcagggccagaggccgtgaagggccagactctgttggcggtcgccaagtcgcagtag

SEQ ID NO: 6663 - DNA, 1815 bp, Artificial Sequence
  Description of Artificial Sequence: Synthetic coding sequence
atgatgcgggcggtttgggaagccttggcggcgctggccgccgtcgcctgcctggtcggcgctgtaagaggaggacccggcctgagtatgtttgccgggcaggccgctcagcccgacccttgctcagacgagaatggccatcctcgacggtgtattcctgactttgtcaacgccgcttttggcaaagatgtgagggtcagcagcacatgcggccgtcctccagcacgatactgcgtggtcagtgagcggggggaggaaaggcttcgatcttgccatttatgcaatgcatcagaccccaagaaggcgcacccccccgcttttctcactgatctgaacaatccacacaatttgacatgctggcagagcgagaattatcttcagtttcctcacaatgttactctcaccctatcactgggcaagaaattcgaggtcacgtacgtgagccttcagttctgtagccctcggccggaaagcatggccatttataaaagcatggactatggccgcacatgggtgcctttccaattctactcaactcagtgccgcaagatgtataaccgaccgcatcgtgccccaattaccaaacagaatgagcaggaagcggtttgtacagactcccatacagatatgcggcctttgtccgggggattaatcgcctttagcaccctcgacggtcgcccgagcgcacacgattttgacaactccccagtgctgcaagactgggtgaccgcaactgatatcagagttgctttctcacgcctgcatacattcggagatgaaaatgaggatgatagcgagctggcccgcgatagctacttttatgcagtgagcgaccttcaggtgggtggccgatgcaaatgtaacggccacgccgcccgctgcgtgcgagaccgcgatgacagcttggtgtgcgattgcagacacaacacagcaggtccggagtgtgaccgctgcaaaccttttcattatgaccgtccttggcagagggcgaccgcccgggaggccaacgagtgtgttgcctgtaattgtaaccttcacgccaggcggtgccgtttcaatatggaattgtacaaactgagtggacggaaaagtggtggcgtgtgcttgaattgtcgccataacactgctgggcgccattgtcattactgcaaagagggctactacagggatatgggaaaacccattacacacagaaaggcctgtaaggcttgcgactgtcaccccgtgggcgctgctggaaagacctgcaaccaaaccaccggacagtgcccttgcaaggatggcgtgactggtattacctgtaaccggtgcgcaaaagggtatcagcagagtagaagccctatcgcgccatgtatcaagattcctgttgctccgccaacaaccgcggccagcagcgtcgaggaacccgaggactgtgattcctactgcaaagcatccaagggtaagctcaagatcaatatgaagaaatactgtaagaaggattatgctgtccagattcatattctgaaggctgacaaggccggagactggtggaagtttaccgtcaatatcatatccgtgtacaaacagggcacaagcaggatccggagaggagaccagtcactgtggatcaggtcgagggatattgcttgtaagtgtccaaaaatcaaacccctaaaaaagtatctgctgctgggcaacgcggaggattctccagatcaatccggcatcgtcgcagataagtcttctctggttattcagtggcgcgatacctgggcacgaaggttgcggaaatttcagcagagggagaagaaaggcaagtgcaaaaaggcctag

SEQ ID NO: 6664 - DNA, 948 bp, Artificial Sequence
  Description of Artificial Sequence: Synthetic coding sequence
atggggcaggatcgcgaggagaccaacatcgagctcctggtgtgcaattatgaacctccgggtaacgtgaagggcaagcggccgtaccaggaggggacaccctgcagtcagtgtccctctggttaccactgtaagaacagcctctgtgagcccatcggttcaccagaagacgcccaggacctgccttatcttgtaaccgaagccccttccttccgggctaccgaggcttccgactctcggaagatgggcacgcctagttccctggctaccgggataccggccttcttggtgacagaagtttcaggatccttggcgaccaaagccctgccagccgtggagacccaggcgccaacctctctggccacgaaagatcctcccagcatggctactgaggccccaccttgtgtcactaccgaagtgccctccatcctggcagcccatagtctgccctcactcgacgaagaacctgttacgtttcccaagtctacacatgtgcctattcctaagagcgcggataaggtgaccgataaaacgaaggtgcccagtaggtcccccgagaattccctggacccaaaaatgtcgctgactggggcccgtgaacttcttcctcacgcccaggaggaagcagaggccgaagcggaactccccccctctagcgaagttctggcctctgtatttccagcacaggataagccaggcgagctgcaggccactctggaccatacaggacacacctctagtaaaagcctcccaaacttccccaatacgagcgctacagctaacgcaacaggtgggagagcacttgccctgcagtcttcactgcctggcgccgagggccctgataagccatcagtcgtgagcgggcttaactcaggcccaggacatgtctggggacccttactgggccttttacttctccctcccctcgtgcttgcaggcatcttctag

SEQ ID NO: 6665 - DNA, 207 bp, Artificial Sequence
  Description of Artificial Sequence: Synthetic coding sequence
atgcaggtgagcaccgctgcattggcagtgctcctttgcacgatggctctttgtaatcaagtcttatcggctcccttggcagcagacactccgacagcgtgctgctttagctataccagccgtcaaattcctcaaaactttattgcagattattttgagacttctagtcagtgtagcaagccttccgtcatggctgcaccaggatag

SEQ ID NO: 6666 - DNA, 3369 bp, Artificial Sequence
  Description of Artificial Sequence: Synthetic coding sequence
atgtccctccaagagatgtttagattcccaatgggccttctgcttggttctgtactgctggttgccagtgcccccgctaccctggagccacccggatgtagtaataaagagcagcaggtgactgtaagtcatacatacaaaatagatgttcccaagtctgccctggtgcaggttgatgctgacccccaacctctgtctgatgatggggcctccctgttggcactaggagaggcgagagaggaacagaatatcatctttaggcataacatccgcctacagactccgcagaaagattgtgagcttgccggatccgtccaggatcttctggctcgtgtgaaaaaactggaagaggaaatggtggaaatgaaagagcagtgcagcgcccagaggtgctgtcaaggcgttacggatctgtcaagacattgcagcggacatggaactttttccttggaaacatgctcatgtcactgtgaggaagggagagaaggaccagcttgcgaaaggctcgcttgtcctggggcatgtagcgggcacggccgctgtgtcgatgggagatgcctatgtcatgagccatatgtcggcgccgattgtggataccccgcctgtcctgaaaattgctccggccacggcgagtgtgtccgaggcgtctgtcaatgccatgaggattttatgtctgaggattgttcagaaaaacgatgtcccggagattgttcgggacacggtttttgtgatactggagagtgttattgcgaggagggcttcacaggtctggactgtgcccaggtagtgacgcctcagggtctgcagctgctgaaaaatacggaggactccctcctggttagctgggagcccagctctcaggtggatcactatctactttcttactatcccctgggaaaggagctctctggtaagcagatccaggtccccaaggaacaacactcttatgagatcctcggtcttctgccaggcacaaagtatattgtcaccctgagaaacgttaagaacgaggtctccagctctccacagcacctgctcgccaccaccgatctggctgtactgggaaccgcctgggtgacggacgagactgagaactcgctcgatgtagagtgggaaaatccgtctacagaagtcgattattataaattgagatatggccccatgactggacaagaagtggctgaagtgactgtacccaaaagctcagaccctaaatcccgatacgacataaccgggttacatccagggacagagtataaaattaccgttgtgccaatgaggggcgaactcgaagggaagcctatcctgctgaatggtcgcaccgagatcgatagccctaccaacgttgtgactgatagagtgactgaagataccgcaactgtatcctgggatcctgtgcaagcagtcatcgacaagtacgtggtgcggtatacctccgctgatggcgatactaaggaaatggcagtgcacaaagacgagagctcgacagttctgaccggcctcaaaccgggagaagcatacaaagtttacgtatgggcagaacggggaaatcaggggagtaaaaaggcggacaccaatgccctgactgaaattgattctcctgctaatctcgtgacagaccgggtgaccgagaacaccgcaacgataagctgggatcctgtacaagctacgatcgataggtacgttgttaggtacacttccgcaaaggacggcgaaactcgggaagtccccgtgggcaaggaacagtcttctactgttctgacaggcctccgcccgggggttgaatacacagtgcatgtatgggctcagaagggagcccaagaatccaagaaagctgatactaaggcacagacagatattgacagcccgcagaacctggtcacagactgggtgacggagaataccgccacggttagttgggatccggtgcaggcaactatagatcgatatgttgtacactacacctccgccaatggagagaccagagaggtgcctgtgggaaaggagcaatcgagcactgtattgactggcctgaggccaggtatggagtacacagttcacgtttgggcccagaagggcaaccaggagtccaagaaggcggataccaaagcacagacggagatcgacggccccaaaaacctggtaaccgattgggttaccgaaaacatggccacagtaagttgggaccctgtacaagccaccatcgacaagtacatggttcgttacacctccgcagacggggagaccagggaagtccctgtaggtaaagagcactcatctaccgttctgactggcctccggcccggcatggagtatatggtccatgtgtgggctcagaagggagctcaggagagcaagaaggccgacacgaaggcccagacggagcttgacccccctcggaatctaagaccctctgccgtgacgcagagtggcggaatactcacttggactcctcctagcgcacagatacacggctacattttgacttaccagtttcccgacggtactgtgaaggagatgcagctcggaagggaagaccaacggtttgccctgcagggacttgagcagggcgccacttaccccgtgtctttagtcgccttcaagggtggtagacggtcacggaatgtgagcaccactctgtccaccgtgggagcccgtttcccccatccatccgattgctcccaggttcagcagaatagtaatgctgccagcggtttgtatacgatttacctccacggagatgcgagcaggccactgcaggtctactgcgacatggagactgatgggggaggatggatagtgttccagaggcggaacaccggtcagttggatttctttaagcggtggcgatcttacgtggagggttttggagaccctatgaaagaattctggctgggactagacaaattacacaatctgactacaggtactcctgccaggtatgaagtcagggtggacctccagaccgctaatgaaagcgcctatgccatatatgattttttccaggttgcaagctccaaagagcggtacaagttaacagtggggaagtaccgcgggaccgcgggcgacgctctgacatatcacaacggttggaaattcacaacctttgatagggataacgacatagccttatcaaactgtgcactgacccatcacggcggctggtggtacaagaattgtcacctggccaacccaaacggaagatatggcgaaactaaacacagtgaaggagttaattgggagccatggaagggacatgagttttccattccttacgtcgagctgaaaatccggcctcatggttacagccgtgagcccgtgctcggcaggaagaaaaggaccctgcgaggcaggctgcgcacattttag

SEQ ID NO: 6667 - DNA, 897 bp, Artificial Sequence
  Description of Artificial Sequence: Synthetic coding sequence
atgctgcatcccgaaactagtcccggccgtggtcacttgttagccgtcttactcgccctcctgggcactgcatgggccgaggtgtggcccccacagctccaggaacaggcccccatggccggcgccctgaacaggaaagagtcatttttacttctcagcctgcataatagactccggagctgggtgcagcctccggccgctgacatgcgaaggttggactggtccgatagcctcaattggctaaagcccggcccactgtggaaccctaacccagaaccaggcgtacgcccagtggcccacccagcatctgggttggaacacgccgcttgccccagggcctggcgacccttattgaaatggtccctgtggtttgccgaggggcagcggtattctcacgccgcaggagaatgtgcccggaatgctacctgcacccattacacacagctcgtgtgggccacttccagtcagttagggtgtggcagacacctgtgctctgccgggcaagccgctattgaggctttcgtctgcgcctattctccccgtggaaactgggaggtgaatggaaaaacaattgtaccctataagaaaggggcttggtgctccctctgcacagctagcgtcagcggatgctttaaagcatgggatcatgcgggaggactttgcgaagtgcctagaaatccttgccgtatgagctgccagaatcatggaagattgaatatctccacttgtcactgccattgtccccctggatacacaggaagatattgtcaggtaaggtgctctcttcaatgtgtgcacgggagatttagggaggaggaatgttcctgcgtgtgtgatatcggttacgagccttctgtgccgccgaggtgtatcttcccgagcactccagtgacctag

SEQ ID NO: 6668 - DNA, 1728 bp, Artificial Sequence
  Description of Artificial Sequence: Synthetic coding sequence
atggacctcgtactgaagcgttgcttgctgcatctggctgtcatcggagcactgcttgccgtcggcgctactaaagggtcccaggtctgggggggccagccagtgtatcctcaggagaccgacgatgcctgtatttttcccgacggcgggccttgcccgtctggttcttggtctcagaagcgaagttttgtttatgtttggaaaacatggggtcagtattggcaagttcttggggggcccgtctcaggacttagtatcggaactggaagggccatgctcggcacccatactatggaagtcaccgtgtatcacagaaggggcagcaggagttatgtgcccctggctcattcttcctctgcgtttactatcaccgatcaagtgcctttcagcgtttctgtctcacagctgagggctctggacggcggcaacaaacactttttaaggaatcagccactcacatttgccctgcagttacatgatccttcaggctatctggccgaagctgacctgtcctacacctgggacttcggtgacagctcaggcacccttatttctagggctttagttgtgactcatacctatctcgagcccgggccggttacggctcaggtggtactccaggccgctatcccgctgacctcctgcggctcctcacccgtgcctggtactaccgacgggcaccgccctacggcggaagcacccaacacgactgccggtcaagttccaacaactgaggtagtaggcactactccagggcaagcgcccactgcagagccctctggcaccacatccgtccaggttcccactacagaagtgatctcaactgcccccgtgcagatgcccacagccgaatccactgggatgacccccgagaaagtgcccgtgtcagaagttatgggcactacgttggccgagatgtccacccccgaagccactgggatgacacctgccgaggtgtcaattgttgttttgtctggcactacagcagcacaggtcaccaccaccgaatgggtggaaaccaccgcccgagagctgcctattccagagcccgaaggaccagacgcatctagtatcatgagtactgaaagcatcaccggtagtctgggacctttactggacggtaccgctacgttacggcttgtgaagcgtcaggtgccattggattgcgtgctgtacagatatggttccttctctgtaacgctcgacatcgtacagggaattgaaagtgcagagattcttcaggcagtccccagtggcgaaggagatgcttttgagcttactgttagctgtcagggaggcctgcccaaggaggcatgcatggaaattagctctccgggatgccaaccgcccgcccagcggctgtgtcagcccgtcctgccctcaccagcttgccaactggtgcttcatcaaattctcaaaggtggctctggtacctattgtcttaacgtctccctggctgacacaaactcactcgcagttgtgtcaacacaattgatcatgcctggtcaggaagccggcctgggacaggtgcccctgatagttgggatactattggtcctgatggcagtcgttctcgcctcccttatttaccgacgacgtttaatgaaacaagacttcagtgtgccacagctccctcattcttctagccactggctccggcttccacggatcttctgttcgtgcccaatcggcgaaaactcccctctcttgagtggccagcaggtttag

SEQ ID NO: 6669 - DNA, 330 bp, Artificial Sequence
  Description of Artificial Sequence: Synthetic coding sequence
tagagtgggcagtccctcaaaagcctgaacgcgagtagtggccatctggcactcattctttcttctattttcgggctgctcctcttagtactcttcattctttttttgacatggtgcagggttcagaagcagaaacatctgcctctgagagtgtccacacgaaggcgtggatccttagaggaaaacttattccatgagatggagacatgtctcaaacgggaggacccacatggaacccggacctccgacgatacacccaaccacgggtgtgaagacgcaagcgacacctccctgttgggcgtcttgcctgccagtgaggcgacaaagtag

SEQ ID NO: 6670 - DNA, 312 bp, Artificial Sequence
  Description of Artificial Sequence: Synthetic coding sequence
atgagcggcagaggtaagggcgggaaggggctgggcaaggggggagcgaagagacacagaaaggtgctgagagataacatccagggcataacgaaaccagcgatccgccgcctggcccgaagaggtggcgtcaagcgaatcagcggtctgatatatgaggagacaaggggagtgctgaaagtcttcctggagaacgtgatcagggacgccgtgacatacaccgaacatgcaaagcggaagaccgttacagctatggacgtcgtttacgctctgaagaggcagggaaggactctgtacggtttcggaggctag

SEQ ID NO: 6671 - DNA, 2889 bp, Artificial Sequence
  Description of Artificial Sequence: Synthetic coding sequence
atgttacgccggccagcgcccgctctcgctcccgcggcccggctgctactggcagggctgctatgtggcgggggcgtgtgggccgccagagtcaataaacataagccttggctcgagcccacttaccacggtatcgttacggaaaacgacaataccgtgctgttggatccgccactcattgccctggataaagatgccccattaagattcgctgaatccttcgaggtaactgtcaccaaagaaggcgagatttgcggctttaagatccatggccagaatgtcccgttcgatgctgtggttgttgacaaatccactggtgaaggggtgattcgctccaaggagaaattggactgtgagttgcagaaggattactccttcactatacaggcctacgactgtggcaagggaccagatggaactaacgtgaaaaagagccacaaagcgactgttcacatacaggttaacgacgttaacgagtacgcgcccgtgttcaaagagaagagctataaagctactgtgatcgaaggaaagcagtatgacagtattctgcgtgtggaagccgtcgacgccgactgttccccccaatttagccagatttgcagttatgagataatcactccagatgtcccgttcactgttgacaaggatggatatatcaagaacaccgaaaagctgaattacggtaaagaacaccagtataagctaactgtcacggcatatgactgcggaaaaaagcgcgccacagaggacgttctagtgaagatctccatcaagccaacttgtactcccggctggcagggatggaataacagaattgagtatgagcccggaaccggtgctctggcagtcttccccaatattcacctcgaaacatgcgatgagccagttgcatctgttcaggctacagttgaactggagacatcacacatagggaaggggtgtgacagggatacttattcagagaagagccttcacagactgtgtggcgccgccgccggtaccgcagagctgctaccatccccaagtgggtcccttaactggaccatgggcctgcctacggataatggccacgactctgatcaggtgttcgaattcaacggaacacaggcagtgcgtatccctgacggtgtcgtctccgtgtctccaaaggaaccttttacaatcagcgtatggatgcgtcatggccccttcgggcgtaagaaagaaacaatactgtgctctagcgacaagactgacatgaaccggcaccactactcgctttacgttcacggctgcagactgatcttcttgttcaggcaggacccgagtgaggaaaaaaaatataggcctgcagagttccactggaagctgaaccaagtctgtgacgaagaatggcaccattacgtgctgaacgtcgagttcccgtccgtcactctgtatgtggacggcacctctcacgagccattctccgtgaccgaagactatcctctgcacccctcgaaaatagagacacagctcgtggtaggggcttgttggcagggtggtgacctgcatatgacacagttcttcagaggaaatttagccggactaacacttcgcagcggtaagctagccgataagaaagtcatcgattgtctgtatacttgcaaggaaggactcgatctgcaggtgctggaagactctggtaggggggtgcagattcaggcacatcctagtcagctagtcttgacactagaaggcgaagacttaggcgaactggataaggcaatgcagcatatttcttaccttaactcccgccagtttcccacccctggtattagaagactgaaaatcacctccacgattaagtgttttaatgaggcaacctgtatttccgttccccctgtggacggctacgtgatggtgctgcagcccgaggagcccaagattagtctttcgggcgtccatcactttgcaagggctgcttccgaattcgagagctcagagggtgtgttcctcttccccgagctgagaattatctcgaccattactagggaggtcgagcctgagggggacggtgcagaggatcctaccgtgcaggagagcctggtgagcgaggagattgtgcatgacctggacacttgtgaagtgaccgtggaaggcgaggagctgaaccacgagcaggagagcttggaggtggatatggcgcggctgcagcagaaaggtatcgaagtgtcatcctccgagctaggaatgacatttaccggcgtggacacaatggcctcttatgaggaagtactccatttacttcgttacaggaactggcatgctcgatccctcttggatagaaaatttaagctcatctgcagcgaactgaacggaaggtacatctccaatgaatttaaggtggaagtgaacgtcattcatactgccaatcccatggaacatgctaaccatatggctgcccagccccagttcgtgcaccctgagcacaggagctttgttgatctgtctggccataatctggctaacccacatccgtttgctgtggtaccttccacggctaccgttgtaatcgtagtgtgtgtaagctttctggtgtttatgataattctaggcgtgtttcgaattcgcgctgcccaccgtagaacaatgcgagatcaggacacaggtaaggaaaatgagatggactgggacgactccgcattaactatcacagtcaaccctatggaaacatacgaggaccaacattctagcgaggaagaagaggaagaagaagaggaagaggagagtgaggacggagaggaagaggatgatattacaagtgcggaatctgaaagctctgaggaggaggaaggagagcagggggatccacagaacgccactcgccaacaacagcttgaatgggatgacagcactctgagctactag

SEQ ID NO: 6672 - DNA, 912 bp, Artificial Sequence
  Description of Artificial Sequence: Synthetic coding sequence
atgctccatccggagacctctccaggacgagggcatctgctggcagtcctgttggccctgctgggtaccgcttgggctgaagtgtggcctccccagctgcaggaacaagcaccgatggccggggcgctgaaccgtaaggagtcttttctgttactgagccttcacaaccgccttaggtcttgggttcagcctcctgctgctgacatgaggaggcttgactggagcgacagcttggcacagttagctcaggctcgggccgcgctgtgtgggactccgacaccttctctcgccagcggcctttggaggaccctgcaagtcgggtggaatatgcagttattacccgcagggttggtatccttcgtcgaagtcgtcagtctgtggttcgcagagggccagcgatactctcacgcagcaggtgagtgcgcaaggaatgcaacctgtacgcactatactcaactggtgtgggccacaagttcccaacttgggtgcgggaggcatctgtgtagtgctggccaggcggccatcgaggcttttgtctgcgcctacagtccgagggggaactgggaagtgaacggtaagactatcgtcccctataagaaaggggcatggtgtagtttatgcactgcaagtgtgtcaggttgctttaaggcctgggatcacgcaggcgggctttgcgaagtcccccgcaatccatgcaggatgtcctgtcagaatcacgggagattgaacatttccacctgccactgccactgtccgccggggtataccggccgatactgtcaggtgaggtgtagtctccagtgcgtccatgggcggttccgagaagaagagtgtagctgcgtgtgcgatataggatacggcgagcccagtgtgcctccacgctgtatttttccatctacacctgtgacatag

SEQ ID NO: 6673 - DNA, 1356 bp, Artificial Sequence
  Description of Artificial Sequence: Synthetic coding sequence
atggaggccacaggcactgacgaagttgacaaactgaaaactaaattcatttcggcctggaacaacatgaaatacagctgggtgctgaaaaccaagacgtatttttctcgcaactctccagtgttgctgctgggcaagtgctaccacttcaagtacgaggacgaagataaaacactgccggctgaatctggttgcactattgaggatcatgttatcgcaggaaatgtcgaggagttcagaaaggattttataagccgtatctggctcacctaccgtgaagaatttccacaaatagaaggctctgccttaactacggattgcggatggggctgcacactccgcacagggcagatgttgctggcacaaggcctgattttgcacttcctgggtcgggcatggacttggcccgatgctctcaacatcgaaaacagcgattcagagagctggacttcccacactgtcaaaaagttcacagcttcttttgaggcctctctctcaggagagagggagttcaagactccaacgatcagcctgaaagagacgattgggaagtattccgacgaccatgagatgcggaacgaggtttaccacagaaaaattataagttggtttggggactcgcctttggccctcttcggactgcaccagttgatcgagtacggtaagaaatcaggaaaaaaagcaggtgactggtacggacccgctgtcgtggctcatattctgagaaaggccgtcgaggaggccagacacccagatcttcaggggattacaatttatgtcgcgcaggactgcacagtgtacaatagtgacgtcatcgataagcagagcgcgtccatgacctcagataacgctgacgataaagctgtgatcattctagtgcccgtgcgccttggcggcgagagaacgaacacagattacttggagttcgtcaaggggattctcagccttgagtattgtgtaggtatcatcggtggcaaaccaaagcaatcttactacttcgccggatttcaggatgacagtctgatctacatggatccgcactattgccagagctttgtggacgtgagcatcaaagattttcctctcgagacgttccactgccccagtccaaaaaaaatgtccttcagaaagatggacccttcctgcactatcggtttttattgccgcaacgtccaggatttcaaacgggcctcagaagaaatcacaaagatgctgaaattctcctccaaagaaaaataccccctctttactttcgtgaatggccattccagagactatgactttacatccaccacgactaacgaggaagacctgtttagtgaggatgagaaaaagcagaaaaagaagaaaaagtag

SEQ ID NO: 6674 - DNA, 1557 bp, Artificial Sequence
  Description of Artificial Sequence: Synthetic coding sequence
atgcgcacatgggactaccgatggtctctggccttggtcgcccagacaggggtgcattgttgcaacctctcatcgcttcagcctctgccccccaggtttaagcgtttctcctgtctgtccctgtcctccggttgggactacagcaacagtggaaacatgaagcctccccttctcgtcttcattgtttgcctgttgtggttaaaagactcccattgcgcccccacatggaaagacaaaacagctatctcagagaatctgaagtccttctctgaagtgggcgaaatagatgccgacgaggaggtcaagaaggcactaactggcatcaagcaaatgaagatcatgatggagcgaaaagaaaaggagcacactaacttgatgagtaccctgaagaagtgccgagaagagaaacaggaggctcttaagctgttaaacgaggtccaagagcacctagaggaagaagaacgcctgtgcagagagagtctcgccgacagctggggtgagtgtcgctcctgtctggaaaataactgtatgaggatttataccacctgccagccctcttggtcaagcgtaaaaaataagatcgagagattcttcagaaaaatttaccagtttctgtttcccttccacgaggacaatgaaaaggatctgcccatatccgaaaagttgatcgaagaagacgcccagctgactcagatggaggacgttttttcgcagctcaccgtcgacgtcaattctctattcaaccggtccttcaatgtgtttcgccagatgcagcaggaattcgaccagacatttcaaagccattttatctcagatacagacctcacagagccgtacttctttcctgcattttccaaagagccaatgaccaaggccgatctggaacagtgctgggacatccccaactttttccagcttttttgcaactttagcgtgtccatctatgaaagcgtgtccgagaccatcacaaaaatgcttaaagccatcgaggatctgcctaagcaagataaagcaccagatcatggaggtctgatctcgaagatgctgcccggccaggaccgcgggctctgcggtgagctggatcagaatctaagcagatgcttcaaatttcatgagaagtgtcaaaagtgccaagcacacctcagtgaagattgccctgatgtacccgccctgcataccgagctggacgaagctatccgactggtgaatgttagtaatcaacagtatggacagattctgcagatgactcgcaaacatctggaggatacagcctatctagtagaaaagatgagggggcagtttggttgggtgtcggagctcgccaatcaggcccccgaaacggagatcatctttaactctatccaggttgttccacggatccacgaggggaatatttcgaagcaggacgagaccatgatgacagatctgtccattctgcctagttctaacttcacccttaaaatccccctggaagaatccgctgaatctagcaactttatcggttatgtggtcgcaaaggctctccagcattttaaggagcacttcaagacatggtag

SEQ ID NO: 6675 - DNA, 1716 bp, Artificial Sequence
  Description of Artificial Sequence: Synthetic coding sequence
gtggagatgcgcaaatggagcagtgaacccggccctgagcccgataccgtcgaagcggtgatcgagtatatgtacactgggcggattcgcgttagtaccggaagtgttcacgaggttctggagcttgctgacaggtttctcttaatccgactgaaagaattctgtggcgagttcctgaagaagaagctgcatcttagcaattgcgttgcgattcatagcctcgcccacatgtatacactgagtcagcttgccctgaaagcggccgatatgatccgaaggaattttcacaaggtgatccaagacgaggaattttataccctgccttttcacctgattagggattggttgtctgacctggagataaccgtcgacagcgaagaggtacttttcgagaccgttttaaagtgggtgcagcgaaacgcagaggagcgcgaacggtattttgaagagttatttaagcttctccgactttctcagatgaagcctacatatttaacccggcacgtaaaaccggaacggctggtagcaaacaatgaggtctgcgtgaaactagttgctgatgccgtggagcggcacgctctgagggccgaaaatattcagagtggaacatgccagcatcccacgtctcacgtgtccttgcttccgaggtatgggcaaaatatggatgtgattatggtaatcggcggagtttccgaggggggcgattacttaagcgaatgcgtggggtattttgtagatgaagatcggtgggtgaatttgccacacatccacaaccatctggatggtcacgcagtagcggtgaccgaaagctatgtgtacgtggcagggtcaatggaacccggatttgctaagactgtagaaaggtataatcccaatcttaacacctgggagcacgtctgctccctgatgaccagaaagcactctttcggcctgacagaagtgaaaggcaagctgtattccattggcggacacggcaatttctcacccggtttcaaggatgttactgtctataatcctgagctggataagtggcataacttggaatccgcccctaaaattctaagagacgttaaagctctggccatagaggatcggtttgtgtacattgctgcgagaactccagtggacagagacaccgaagacggcctgaaggctgtgataacctgttacgacacagagaccagacagtggcaggacgtggagtctctccctcttattgataactactgctttttccaaatgtcagtggtcaattcaaatttctaccagacagcttcttgctgtcctaagagctactgccttgagaacgaagaggcagtgagaaagattgccagtcaggtatctgatgagatcctggagagtttgcccccggaggttttgagcatagaaggcgccgccatatgctattataaagatgatgtttttatcattggagggtggaagaactccgacgacatagacaaacagtatcgcaaagaagcatacagatattgtgccgagaggaagaggtggatgctgttgcctcccatgccccagccgagatgtagggcaactgcatgccacgtccgtattccatataggtacctgcatgggacccagagataccctatgccacagaaccttatgtggcagaaggacagaattcgccagatgcaagaaatacataggcatgccttaaacatgaggcgggtgcctagttcccagatcgaatgctag

SEQ ID NO: 6676 - DNA, 729 bp, Artificial Sequence
  Description of Artificial Sequence: Synthetic coding sequence
atgctgaagaagatctctgtcggcgtggccggagacctcaacaccgttaccatgaagctgggatgtgtgctgatggcatgggccctctacctgtccctgggcgttttatgggtcgcccagatgcttctggcggccgggtgtcatgctgagttgtttccagcacctatactccgggctgtaccttctgccgaacctcaggccggctccccaatgaccctctcttgtcaaaccaagctgccactgcaaaggtccgcggctcgtctcctcttctccttctacaaggacggccggatcgtgcaatccagaggtttgtccagcgagtttcagatcccaaccgcttccgaggaccattcaggctcttattggtgtgaagcggccaccgaggacaaccaagtttggaaacaaagccctcagctggagatcagagtgcaaggcgcaagctcctctgctgctccgccaactttgaatcccgctccacaaaaatcggcagctcctggcacggcaccggaggaggccccaggccctcttccaccgccacctaccccttcatcagaagatccaggtttctctagcccccttggaatgcctgaccctcatctataccaccaaatgggcctgctgcttaagcatatgcaggatgtgagagtgctgctgggccacttgctgatggagctccgagaactcagcggccaccggaaacctgggaccacaaaggccactgctgagtag

SEQ ID NO: 6677 - DNA, 1392 bp, Artificial Sequence
  Description of Artificial Sequence: Synthetic coding sequence
atgtatgtgagtactcgcgagcggtataagtggctgaggttctccgaggattgcctctatcttaatgtctatgctcccgccagagcaccaggagaccctcagcttcctgtgatggtgtggttccccggaggagctttcattgtcggtgctgcatcctcctacgagggcagcgacctggctgccagagagaaagtggtcctcgtatttctgcagcaccgcttgggcattttcggcttcctttctacagacgatagccacgctagggggaactggggacttttggaccaaatggctgcgctgcgctgggtgcaagagaatattgccgcctttggcggtgacccaggcaacgttacgctgtttggtcagtcagcaggtgcaatgtctatctcaggactgatgatgagcccactcgcttccgggctgttccatagggcaatcagccagtcaggaacagcactcttccggctgtttatcacttctaatcctctcaaggtggccaaaaaagtggcacatctcgctggctgtaatcataattcaacacaaatcttggtgaattgtctgcgggcactctccggcacaaaggttatgcgggtgagcaataaaatgaggttcctgcagctcaacttccaaagagaccctgaggagataatttggtctatgtcgcccgtggtggacggcgtcgtaattcccgatgaccctttggttctcttgacacagggcaaggtgagctctgtgccttatctccttggagttaacaacctcgagttcaactggctcctgccatacattatgaagttcccactgaaccggcaggcaatgcggaaggaaacaattacgaaaatgttatggtccactaggactttgctcaacattaccaaggagcaggtgcccttagttgtggaggaataccttgacaacgtgaatgagcacgactggaaaatgcttcggaaccgtatgatggatatagtacaggacgccacttttgtttatgctactctgcagacagctcactaccatcgtgatgcaggattgccagtctacctttacgaatttgagcatcacgctaggggcatcattgtcaagccccggaccgacggggctgatcatggcgacgagatgtactttctattcgggggaccatttgctactggcctctcaatggggaaagagaaggccctcagcctccagatgatgaagtactgggcaaatttcgctagaaccggaaatcccaacgatggcaatctgccatgttggccaaggtacaacaaggacgagaagtacttgcagctggacttcaccacacgggtgggaatgaaactcaaggagaagaaaatggccttttggatgagcctgtatcaaagtcaaaggcccgaaaaacagcgccagttctag

SEQ ID NO: 6678 - DNA, 1215 bp, Artificial Sequence
  Description of Artificial Sequence: Synthetic coding sequence
atgttctaccacgcatacgacagttatctggaaaatgctttcccatttgacgagctcaggcccctgacatgcgacgggcacgacacttggggttctttctccctgacccttattgatgctctggataccctgctaatcctgggaaatgtgtcagaatttcagcgagtcgtcgaggtcctgcaggattctgtcgattttgacatcgatgtgaacgcatccgttttcgagactaacatcagggttgtcgggggtctgctgagcgctcacctgttgtcaaagaaggctggcgtagaagtggaggcaggctggccctgctctggacctctactaaggatggcggaggaggctgctcggaaactactccctgccttccaaacacccactgggatgccttatggcacggtaaacctgttacacggggtgaaccccggcgaaactcccgtcacctgcacagcaggtattgggacattcatagttgagttcgctacgttgagttccttaacgggcgatcctgttttcgaggacgtagcacgagtagcattgatgagattatgggagagtcggtcagacattgggctggttggaaaccacatagatgttctcaccggtaaatgggtcgcccaggatgctgggatcggcgctggcgtcgacagttacttcgagtatttagtaaaaggagcaatcttgctccaggataagaagcttatggcaatgtttttggaatacaacaaggcaatcaggaattacacaaggtttgatgactggtatctgtgggtacagatgtataaggggacagtttcaatgccagtattccagtctctggaggcctattggcctgggcttcaaagcctaataggagatatcgacaatgccatgcggacctttctgaattactataccgtatggaaacaatttggcgggcttcctgagttttacaacatcccacagggatacacggtagagaagcgagaggggtacccacttcgacctgagctcatagagagcgccatgtatctgtaccgcgcaactggagaccctacacttctggagttgggtagggatgctgtggagagcattgaaaagatcagtaaagtggaatgcggctttgcaactgtgtccgtgtgcatggcaccaaggactggcaagagcctgcctctgttgttgaagtctctattcaaggggagagcgctgggagtgttgacctaccagcattag

SEQ ID NO: 6679 - DNA, 1281 bp, Artificial Sequence
  Description of Artificial Sequence: Synthetic coding sequence
atggggtggacggacaccctcgagtctgccgaagacattttctggaaacaggccgattttggttacgcccgggagcgccttgaggaaatgcatgtgttgtgtcagcccaaggaaacctccgactccagtctcgtctgctcgcggtatctccagtattgcagggccaccaacttgtatctagacttgcgcaacataaaacgaaatcacgatagattcaaggaagatttttttcagtctggcgaaatcgggggacactgcaagttggacattcgcaccctgacgagtgaggggcagcggaagtcccccttacagtcatggtttgcagagctgcagagttatacccaactcaatttccgaccaatcgaggacgccaagtgcgatatcgtcatcgaaaagcccacttactttatgaagctggacgccggcgtgaacatgtatcatcatttctgtgacttcataaatttatatattacacagcacgtaaacaatagcttcagtacagacgtttacatcgtgatgtgggacacctctagctatggttatggggacctgttctcggatacctggaacgccttcaccgattacgatgtaatacaccttaaaacatatgattctaagcgcgtttgttttaaagaagctgttttttcccttcttcccaggatgcgttatggcctattctacaatacgcccttgatatcgggatgtcaaaataccggactattcagagcctttgctcagcacgttctccaccgactgaacattacacaggaaggaccaaaagatggtaaaatcagggtcaccatcctggccagatctacagagtatagaaagatccttaatcagaacgagctggttaacgcacttaaaaccgtgtctaccttcgaagtgcagattgtggactataaatatcgcgagctggggttcctcgatcagctcagaattacacacaacaccgacattttcatcggaatgcatggtgcaggactcacacacctgctgtttcttcctgactgggctgcagttttcgaattatacaactgtgaagatgagcgctgctacctggacttagccagacttcgcggagtgcattacattacatggcggcggcagaacaaggtgttcccccaagacaagggccaccatccaactctgggagagcacccgaaatttaccaattactcattcgacgtagaggaattcatgtacctggtactacaagccgccgatcacgtgctacagcacccaaaatggcccttcaagaaaaagcacgatgaactctag

SEQ ID NO: 6680 - DNA, 1098 bp, Artificial Sequence
  Description of Artificial Sequence: Synthetic coding sequence
atgaagttggggtgcgtgctcatggcttgggcactgtatttgagtctgggtgtcctgtgggtcgcacagatgctgttagtagcaagcagcttttcagcagcttctttcgaaaccctgcagtgcgaggggcccgtgtgtaccgaggaaagctcttgccacacggaagatgatctgacagacgccagagaagcggggtttcaagtgaaagcctatacattcagtgagccctttcatttaatcgtttcttacgactggctaattctgcaaggcccagcgaaaccagtgttcgagggcgacttgctggtgctccggtgtcaggcgtggcaggactggccactgacacaggttaccttttaccgggatgggagtgctctcggaccccctgggccaaacagagagttctcgatcacagttgtgcagaaggcggattctgggcactaccattgttcaggcatctttcagagtccaggccccgggatacccgaaaccgcgtctgttgtcgctattaccgtgcaggagttattccctgcacctattttgcgagcagtcccaagcgctgaacctcaagccggaagcccaatgaccctctcttgtcagactaaactgcctctgcagcggtccgccgcaaggcttttgttctccttttacaaggatgggaggattgtccagtctcggggactctcttccgagtttcagattcccacagcatctgaagatcactcaggatcgtactggtgtgaggctgccacagaagacaatcaggtatggaagcagagccctcagctggaaatcagagtgcagggcgcctcctccagcgctgccccccccaccctgaaccctgcaccccagaaatctgctgctccgggtactgcaccagaggaggccccaggacctttgcctccaccaccaaccccttcaagcgaggatccagggttttcatctccactcggaatgcccgacccccacttgtaccaccaaatgggtctgttgctgaagcatatgcaggacgtcagagtgctacttggccatttgttgatggagttgcgcgagttgagcggacacaggaaacctggaactacaaaggcaacagcggaatag

SEQ ID NO: 6681 - DNA, 1407 bp, Artificial Sequence
  Description of Artificial Sequence: Synthetic coding sequence
atgcggtggatcctgtgctggtcccttacattgtgccttatggcccagacggccttaggtgcactgcataccaaacggccccaggtggttacaaaatatggtacgctccaaggtaagcagatgcatgtcggtaagaccccgatccaggtcttcctgggagtgccattcagcagaccccccctggggatcttaagattcgcaccacccgaacctcctgaaccttggaaaggcattcgcgacgccactacgtatccacctggatgcctgcaggagagttggggccagctggccagcatgtacgttagtaccagagaacggtacaagtggctcagattttcagaggattgcctttacctgaacgtctatgctcccgcaagagctcccggagatccacagctgcccgtgatggtttggttccccggaggcgccttcatcgtcggcgcggccagctcttatgaggggtcagacttggccgcacgggagaaggtagtcctggtcttcctccaacataggctgggaatcttcggttttctgtccacggacgatagtcacgccaggggcaattggggccttctagaccagatggctgcgctgcgttgggtgcaggagaacatcgcggcttttggcggcgatccaggaaatgtcaccctgttcggccaatcagcaggcgctatgtctattagcgggctgatgatgagccctctggcttctgggttgttccacagagcaatctcacagtctggcacagccttatttagattgtttattaccagtaatcctctaaaggtggccaaaaaagtcgctcatctggctggctgtaaccacaactctactcagattctggtaaactgtctacgggcactgtctggtacaaaggtaatgcgcgtgtccaacaaaatgcggtttttacagctgaatttccagcgcgatcctgaggagatcatttggagcatgagccccgttgtcgacggagtggtgattcccgacgacccgctggtcctccttactcagggtaaggtgagcagcgtaccctacttgctcggtgttaacaatttggagtttaactggctgcttccctacatcatgaaattccctctcaaccggcaggctatgcggaaagagaccatcactaaaatgctatggagtactaggacattgctcaatatcacaaaagaacaagtacctctggtggtggaggaatacttggataacgtgaacgagcatgattggaagatgttacgaaacagaatgatggacattgtgcaggacgccacttttgtgtacgctacattgcagaccgcccattaccacagagaaactcctatgatgggtatttgccctgccggccacgcaaccacacgtatgaaatctacttgtagttggatccttccgcaggaatgggcttag

SEQ ID NO: 6682 - DNA, 756 bp, Artificial Sequence
  Description of Artificial Sequence: Synthetic coding sequence
atgagtagttatgggtacggggacctgttctctgacacttggaacgcattcacggattacgatgtgattcatttgaagacatacgattcgaagagggtgtgttttaaagaagcagtttttagcctgctaccacgaatgcgttacggactgttctacaatacaccactgatcagcgggtgtcagaataccggtctgttcagagccttcgcccaacatgtcctacatcgcctgaatatcacccaggagggacccaaagacggaaagatccgagttacgattctcgcccggagcacagaataccgcaaaatcctcaaccagaacgagttggtaaacgcccttaaaacagtgagcacttttgaagtacagatcgtggactataaatacagagaactcggattcctcgatcaactgaggattactcacaacaccgacatctttattgggatgcacggagccggcctgactcatcttttgttcctcccggattgggccgccgtattcgagttgtataattgcgaggatgaaaggtgctatctggatctggcacgccttagaggcgtgcactatattacttggcgtcgtcagaataaagtgttcccccaggataagggacatcaccctacactcggggaacaccccaagttcacgaactactcctttgacgtcgaggagttcatgtatcttgtgcttcaagccgccgaccacgtgctgcaacaccctaagtggccgttcaaaaaaaagcatgacgaactttag

SEQ ID NO: 6683 - DNA, 927 bp, Artificial Sequence
  Description of Artificial Sequence: Synthetic coding sequence
atgattcctgtagaattattactgtgctacctgttgttgcaccccgtagacgccactagttatggcaagcagaccaacgtattgatgcattttcccctttctcttgagtctcaaaccccttcttctgatcccttatcgtgccagttcctgcaccccaagtccctccctggcttctctcacatggctcctcttccaaagtttctggttagccttgctctccggaatgcgctggaggaagccggctgtcaggctgacgtctgggctttgcaactccagctttataggcagggcggagttaacgccacacaggtcctcatccaacacctcagaggcttgcaaaaaggcaggtcaaccgagaggaacgtgtctgtggaggctctggcctcagctttgcagctgctggcgagggagcagcagtctacaggcagagtgggcagatctctgcccacagaagactgcgagaatgaaaaggagcaggctgtacacaatgttgtccaactcttgcccggagtcggaacgttctacaacctgggtacggctttgtattatgccacacagaactgccttgggaaagcccgagaaaggggtcgcgacggcgctatcgaccttggctacgatttgctaatgacaatggccggcatgagtggtggtcccatgggtctcgcgatttcagcagcacttaaacccgcactccggagcggcgtgcagcagctgatccagtattaccaggaccagaaagatgctaatatctcacagccagagaccactaaggaaggactgcgagccataagcgacgttagcgacctcgaggaaactactacgctggccagttttatctccgaagtagtctcctcggccccttattggggttgggccatcatcaagagctacgacctggaccctggtgccgggtctctggaaatatag

SEQ ID NO: 6684 - DNA, 2862 bp, Artificial Sequence
  Description of Artificial Sequence: Synthetic coding sequence
atgcgcgtacttgcttgtctgctggcagccctggtcggcattcaagcggtagagcgactacggctcgcggatggtccccatggctgcgccggccgccttgaggtgtggcacggaggccggtggggcacagtgtgtgacgacggatgggacctgagggacgcagctgtggcctgtcgacagctgggatgcggtggtgccctcgccgctcctggaggcgcttttttcggcgaaggagcaggcccagtgtggctgtcagaactggcttgtagaggaaacgagggacaacttggactatgtcatcacagaggttggaaagcgcacatttgcagccacgaagaggacgcaggggtggtgtgtgccgggcagcgggttgctaactcaagagatgattcaacttccccgttggacggggccccctggcctggcctgcttctcgagctgtcaccgagtaccgaagaacccctggtcacacacgcaccacggcccgccgggaatccccaaaacgcttcccggaagaaatcaccccgcccgaaacaggctaagtctactagggccccactcctgaccaccggcgcccccaggcaggaaaggttacgcttggtgagcgggcctcatagatgcgctggcaggctggaagtgtggcatggcgggagatgggggacagtgtgtgacgacggatgggatctgcgcgatgcagcagtggcatgcagagaattaggttgtggaggcgccttggccgctccggggggggctaggtttgggccaggcgctgggccagtgtggatggacgacgtagggtgcggaggaggagagcaagctctgagagactgtcctcgctcaccctggggccggagcaactgtgatcacagcgaggacgctggccttgtttgcacgggaccggcaccaaggctccgcctggcggacggtccccatggctgtgctggccggttagaggtctggcacggcggtaggtggggatcagtgtgcgacgatgcatgggacctccgtgacgctgcggtcgcatgtcgagagctgggatgcgggggcgccctggctgcccccggcggagctttctttggtgagggaagtgggccaattatcctggatgatctgcgctgtcgcggaaacgagacagcgctcaggttctgtccagcacgcccttggggacagcacgattgccaccacagagaggacgccggggccgtatgcgatggcatgcctctaggatatgtgccaccaaccgctcctacggacagcaataactctactccacgggaggctgcttcccgccccccaagcacaatgacctcgcaggcccctgggaccgcaggcgtgtctcctccaccagcttctccaacagttctgtgggaaccaggccccgaggccgggagcccccaactgcggctggtggccggccccagcaagtgctcgggaagactggaagtttggcatgatcaacggtgggggaccgtgtgtgacgactcatgggacatgcgggactcggccgtggtatgcagagaattgggctgcggaggcccacagcagcctgaccctgctgccggcaggttcggctggggggccggacccatatggctagacgacgtggggtgtgtggggacagaagcatctctgtccgactgccccgcagccccgtggggaaaacataattgcgcacataatgaagacgttggtgtcacctgtactggccctcccggtttggattccatatcagaccccttctcgtggagctggattcctggcctaggacgggaccgcgatgcgtggttgccaggagagctcgcaacgaaaccaagtgctagcgttacggcaagcgtgctggagaaaactacgactaaggctccgggcaagatgcccaagagcaccaaaaagtgggtcaccaaaaatgcaaaacgacccaccacgcaaccacctgtgatgcccactaccaagcactccagggcccaaagtcctcctgacctgactagtcaaaccacggccgcactcacaacagaagccagcaggaggcccacctccgagtttactcgccgcccaaccacagaggccccccagagatggactagccacactacagcaacactgacacctcaggcacccagagaacgtacaactaagacaatggcaatgctgacaacccaaggcccccaggagatgaccagtgagtctactataaagtccatcccgcaagcctctctggaacccagcgcggaaatccctgagggatctcccgaatctccaaaggatccagcaccctcaccttcagtctcaaccactggtgaatccggcctgttcagagtgcggttggccgatggaccaaaccggtgtgcgggaaggcttgaagtttggcatgcaggtagatgggggaccgtgtgcgatgacaattgggatctgcgagacgcgactgtcgcctgctgggagctgggctgcggcaaagtgaggccaagagtggggaagactcattatggccctggaaccggtcctatctggttagacgacatggggtgtaagggtagtgaggcctcactatctgactgtccatccggcgcctgggggaaacacaattgcgatcatgaggaagatgtgggtctgacatgcaccggatatacagattacgacgactacccaccttggacctgggatcctactagtcgggaggacttggctaaggggaccactacagccggagtgccaggccacacgctgccctggcgaactactcggcgccctggctcctccagccctgccatccggcgattgcccgacaccgaaccggaagcaggcctccgcgaagttatgttactcgttcagggcctccccgggcttcagagacttccgtctccatag

SEQ ID NO: 6685 - DNA, 474 bp, Artificial Sequence
  Description of Artificial Sequence: Synthetic coding sequence
atgttacggaccgagtcctgtcgtccccgctcacccgccggacaagtcgcagccgcttccccccttctcctgctgctgttgttattggcatggtgtgcaggggcttgtagaggagcacccatcctgccccaagggctgcagcctgaacagcaactgcaattatggaacgaaatcgacgacacttgtagttcatttctctcaatagatagccagccccaggccagtaacgctttggaagagttgtgctttatgattatgggcatgctcccgaagccccaggaacaagatgagaaggataacactaaaaggtcatctgtggtccaccccttgctccaactggttccccacctgcacgagcgcagaatgaaacgcttcagagtggatgaggagtttcaatcaccattcgcctcacagtctcgaggatacttcctgttccgaccaaggaatgggagacggtctgccgggttcatttag

SEQ ID NO: 6686 - DNA, 1545 bp, Artificial Sequence
  Description of Artificial Sequence: Synthetic coding sequence
atgccaagcaccgtcctgccttcaactgtgctcccatcgctcctgccaactgcaggcgccggctggtcaatgcgctggatcctatgttggtctctgactctgtgtcttatggctcagacagctctgggtgcactgcatacaaagagaccacaggttgtaacaaaatacggaaccctacaggggaagcaaatgcatgtcggtaagacccccatacaggtatttctcggcgttccattcagccgccctccgctcgggattctgagatttgctccccccgaaccccctgaaccatggaaaggcattcgagacgccaccacctatccccctggctgcctgcaagaaagctggggtcagctggcgtcaatgtatgtgtcaactagagaaagatataagtggcttcggttttcagaagactgcctctaccttaatgtgtatgcacctgcacgggctccaggtgatcctcagttacctgtgatggtgtggttccctggaggagcgttcatagtcggagctgcatcttcctatgaaggctcagacctcgctgcaagagaaaaagtcgtcctagttttcctacagcatcggctcgggatcttcggatttctgagcactgatgacagccacgccagaggcaactggggcctactggatcagatggccgctttgaggtgggttcaggaaaatatcgctgctttcggtggcgaccctggtaatgtcacactcttcggacaatccgccggcgcgatgagcatcagcggcttaatgatgtctccactggcctctgggctattccacagagctatcagccaatcaggcacagccctttttcggctgttcataaccagtaaccctctgaaggtggccaaaaaggtggctcatttggcagggtgtaaccacaattcaactcagatcctggtaaactgcctgagggccctttctggcacaaaggttatgcgagtctccaataaaatgagattccttcagcttaactttcaacgcgatcccgaggagattatttggagcatgtcccctgtggtagatggcgtggttattccagatgatccactggtgctgcttacacaggggaaggtgagctccgttccttatctcctgggagtgaataatcttgagttcaattggctcctgccttacaatattacaaaagaacaggtcccactggtcgtggaagagtacctcgataacgtgaatgagcacgactggaaaatgcttcgcaaccgcatgatggatatcgtacaggatgctacctttgtgtatgctactctgcagacagctcactatcatagaggcctctccatgggtaaagaaaaggcactctccttgcagatgatgaagtactgggctaacttcgctcggactggtaatccaaatgacggaaacctgccctgttggccaaggtataacaaggatgaaaagtacctgcagttggacttcacaactagagtaggcatgaagttaaaggagaagaagatggctttctggatgtcactgtaccagtcgcaacgcccagaaaagcagagacagttctag

SEQ ID NO: 6687 - DNA, 1062 bp, Artificial Sequence
  Description of Artificial Sequence: Synthetic coding sequence
atgagcaaccctacccaaaccgacgctgactctgacctggtgggcgatgtctgcgataccaatgaagacagcgacggggatggccaccaagacacaaaagataactgcccacagctgcctaatagttcccagctggattccgataacgatggactgggtgacgagtgtgatggcgacgacgataacgatgggattcctgactacgtgcccccagggcccgacaattgtcgattggtgcccaatcccaaccagaaggattctgacggaaatggggtgggagacgtctgtgaggacgacttcgataatgacgctgtagtggaccccctggatgtttgccccgagtcagcagaggtgacgctcacagacttcagggcttaccaaactgtggttctggacccagagggggatgctcagattgatcccaactgggtggtgctgaatcaggggatggaaatagtgcagacaatgaatagcgatcccgggctggctgtcgggtacacagctttcaatggggtggacttcgagggaacattccatgtcaacaccgtgaccgatgacgattacgccggattcctgttctcctaccaggactccgggcgattttatgtggtgatgtggaagcagactgaacagacctactggcaggccacacctttcagggccgtggcacaacctggactacagctcaaggctgtgactagcgtgtccggtccaggagagcacctgcggaacgcactctggcacactggccatacccccgaccaggtcagacttttgtggactgacccccggaacgtgggctggagggacaagacatcctacagatggcagctgttgcataggccccaggtcgggtacatccgggtaaagttgtacgaaggcccacaattggtggcggattcaggggtgataattgacaccagtatgcgtgggggtcgcctgggcgtcttttgcttctcccaggagaatatcatttggtcaaatctgcagtatcgctgtaatgatacagtccctgaggatttcgagcccttccggagacagttgctacagggccgcgtgtag

SEQ ID NO: 6688 - DNA, 1074 bp, Artificial Sequence
  Description of Artificial Sequence: Synthetic coding sequence
atggagatcgagcatactttagaccaaatgattagtaaagttggcaaccatatcgatgtgctgaccgggaagtgggttgcccaggacgctgggattggggcaggggttgacagctacttcgagtacttggtgaagggagccattttacttcaggacaagaagctgatggctatgttcttggagtacaataaggccataagaaactacacccgattcgatgattggtatctgtgggtgcagatgtataaaggcacagtgtctatgccagtgttccaatcactggaagcatactggccaggcttacaatccctgataggagatatcgacaacgcaatgcggacattccttaattactatactgtctggaagcaatttggtgggctccctgagttctataatatcccccagggttatacggtggagaaacgggaaggctaccccctcagacccgagctcattgaaagtgctatgtacctgtatcgtgccaccggggatcccaccctgctcgaactcggacgcgatgcggtcgagtctatcgagaaaatttccaaggtcgaatgcggcttcgccacaattaaggacttacgggatcataagcttgacaataggatggaatcgttcttcctggccgaaacagtcaagtacctatatctgctgtttgatcctactaatttcattcacaataacgggagtacttttgacgctgtgatcactccatatggcgaatgtatactcggcgctgggggctacatttttaatacagaagcccatcccatagaccctgctgccctccattgctgtcagcgacttaaagaagagcaatgggaggttgaagatttgatgagggagttttacagcctgaaaagatcgaggagcaagtttcagaagaacacggtgtcttctgggccctgggaacctccagcaagaccaggcactctttttagccccgagaatcacgaccaggcacgagaaaggaagcccgccaagcagaaagtgcctctgctctcctgcccatctcagccctttacctctaagctggctctcctgggacaggtgttcctagattcaagttag

SEQ ID NO: 6689 - DNA, 1341 bp, Artificial Sequence
  Description of Artificial Sequence: Synthetic coding sequence
atgctgcaccctgagacttccccggggcgtggacatctgctcgctgtcttgctagccctgctgggcaccgcttgggccgaagtttggcctcctcagttgcaggaacaggcacctatggccggagctttgaaccgcaaggaaagctttcttttgctgtccctccacaatcgtctcaggagctgggtgcagcccccagcagccgatatgcggagattggattggtctgacagccttgcccaactggcccaggccagggccgctctctgtgggatcccaacgccatctcttgctagtggactctggcggactctccaggtaggatggaatatgcagctcctacctgcgggtttagcctctttcgtggaagtcgtgagcctgtggtttgccgaaggtcaaagatatagtcatgcggcaggtgagtgcgctcggaacgccacatgcacacattatactcagttggtctgggccaccagcagccagctcggctgcggcagacatctgtgctcagctggccaggctgctatcgaggctttcgtctgtgcatacagcccaagaggaaattgggaggtgaatggaaaaacaatagttccttacaaaaagggcgcttggtgctctctttgcacagcctcagtgagcggatgttttaaagcatgggatcacgcaggaggattgtgcgaggtgccgaggaatccctgccgaatgtcttgccaaaatcacggccggctcaatatctcaacttgccattgtcattgtccccccgggtatacgggtcgttactgccaggtacggtgctctctacagtgcgtccacggccgatttagggaggaagagtgctcgtgcgtctgcgacatcggctacggcggagctcagtgtgccactaaggtacatttccctttccacacctgcgacctgcgcattgatggggattgcttcatggtatcttctgaagctgacacctattaccgagcaagaatgaaatgccaacgaaagggaggtgttttagctcagattaaaagtcagaaagtccaagacatcttagcattttatttaggcagactggaaaccacaaacgaggtgatagactcggactttgagaccaggaacttttggattggcctcacgtataagactgccaaggatagttttcgttgggccactggtgagcaccaggcgttcacatcctttgctttcggacagccagataatcacggatttgggaactgcgtcgagttgcaggcttctgccgcgtttaactggaataaccagcgctgtaaaactaggaatcgctacatttgccagttcgcccaggaacacattagtcgatggggccccgggagttag

SEQ ID NO: 6690 - DNA, 900 bp, Artificial Sequence
  Description of Artificial Sequence: Synthetic coding sequence
atgggcggaccccgggcgctgctggccgcactatgggccctggaggcagcaggtacggctgccctccggataggggcatttaatattcaaagcttcggcgacagcaaagtgagtgaccccgcgtgtggttccataattgcaaaaatcctcgcggggtacgatctggccttggtgcaagaggtgcgggaccccgatttatcagcagtgtctgccctcatggaacaaatcaactccgtttctgaacatgaatattctttcgtcagctcacaacccctaggccgggatcaatacaaggagatgtatctgtttgtgtaccggaaagacgctgtgagcgtggttgatacctacctctaccccgatcccgaggatgtattctcccgcgaaccgttcgtggttaaattcagtgcacctggaacgggcgaaagagcgccaccattgccatccagacgggcgttgaccccgccccccctgcccgcagcggcgcagaatctagtgcttattccattacatgcggccccgcaccaggcagtggccgaaattgatgccttgtatgacgtttacctcgatgtaattgataagtggggcacagacgatatgcttttccttggtgactttaacgctgactgtagttatgttcgtgcgcaggattgggctgccattcgcctgaggtccagcgaagttttcaaatggctcatccctgactcagcagacacaacagtgggtaactctgactgcgcatacgatcgcatagtcgcctgcggagctaggctgcgccggtcactgaagccacagtccgccactgtgcacgatttccaagaagagtttggactggatcagactcaggcactagccatttctgatcactttcctgtggaggtgaccctcaaattccacagatag

SEQ ID NO: 6691 - DNA, 1458 bp, Artificial Sequence
  Description of Artificial Sequence: Synthetic coding sequence
atggataacaataagcactgcaaacaggacaactgtctgttaacaccaaattccggacaggaagatgccgacaacgacggggtcggcgaccagtgtgatgatgatgccgacggcgacgggatcaaaaacgtggaagataattgccggttgttccctaataaggaccagcagaatagtgataccgatagcttcggtgacgcctgcgacaattgcccaaacgttcccaacaacgatcagaaagataccgatggaaacggcgagggcgacgcgtgcgacaacgatgtagacggagatgggattcccaatggtctcgataattgtccgaaagtacccaatccactccagacagaccgagatgaggatggggttggtgatgcctgcgacagctgtcccgagatgagtaaccctacacaaactgatgccgactcagatctggtcggagacgtgtgcgacacaaatgaggactccgacggggatgggcatcaagacaccaaggacaattgtccccagctccccaattcatcccagcttgactcagacaacgatggactcggagatgaatgcgatggtgacgacgataatgacggaatccccgactacgttccacccggccctgataattgccgcctggtgccaaatcctaaccagaaagactccgacggaaacggcgtaggtgacgtatgtgaagacgactttgataacgatgctgtggtggacccgcttgacgtgtgtccagaatccgctgaagtgaccctgacagatttcagggcctatcagacagttgtgcttgatcccgaaggggatgctcagatcgacccgaactgggttgtcctgaatcagggaatggagatagttcagactatgaattctgacccaggactcgccgttggctatactgccttcaatggggtcgattttgaaggcactttccatgtgaacaccgtaaccgacgacgactatgcaggttttctattctcataccaagactccgggcggttctatgttgtgatgtggaagcagaccgaacagacctattggcaggccaccccgtttcgcgctgttgcacagccagggctccagctgaaggcagtgacttcagtgagcggtccaggcgaacaccttcggaacgctctttggcacactgggcataccccagatcaagtaagactactgtggaccgatccacgcaacgtgggatggcgcgataagacgtcttaccgatggcagctactgcaccgtcctcaagtaggatacattcgtgtcaaactgtacgaaggtccccagctcgtcgccgattccggagtcatcatagatacatcaatgaggggaggccggttgggagttttctgtttctcacaagaaaatatcatctggtccaacctccagtaccggtgtaacgacactgtccctgaggatttcgaaccatttcgacggcagctgttacaggggcgggtctag

SEQ ID NO: 6692 - DNA, 2358 bp, Artificial Sequence
  Description of Artificial Sequence: Synthetic coding sequence
atgaaacacacgcttgcgctgctggcccctctgctgggtctcgggttgggcctggcacttagtcaattagcagcgggcgccacagattgcaaatttttagggcccgcagagcacctgactttcacacctgctgcacgtgcccgctggttggctcctagggttcgcgcccccggattgcttgatagcctctatgggacagtaaggagatttctgagtgtggtgcagctcaatccttttccttccgagcttgtcaaggcacttttgaatgaactggccagcgtgaaggttaatgaagttgtgcggtacgaagccggctacgttgtctgtgcagtcatcgcaggactctacctcctgctcgtgccaacagcaggcctatgtttttgttgctgtcggtgtcatcggaggtgcggcggtcgcgtcaagacagaacataaagccctggcttgcgagagggctgctcttatggtattcttactgttgactacgcttctcctgttgattggggtggtgtgcgccttcgtgacgaaccagaggacccacgaacaaatgggacccagcattgaggccatgccagaaacactcctgtctctttgggggctggtgtccgacgttccacaggaactgcaggcagtggcgcagcagtttagcctgcctcaggagcaggttagtgaagaacttgacggcgtcggcgtgtctatagggtccgctatccatactcagcttagaagtagtgtctaccccctgctcgcggctgtcgggagtcttgggcaagtacttcaagtctcagttcatcacctgcaaacactgaatgctaccgttgtcgaactgcaggccggacagcaggatttggaaccagctattcgtgaacatcgggatcggctgcttgagctcctccaggaagctcggtgccagggggattgtgcaggtgccctgtcatgggcgcggacgttggagttaggcgccgattttagtcaggttccctcagtggaccacgtgctccaccagcttaagggggtccccgaagccaacttttcatctatggttcaggaagaaaattcgactttcaacgcactgccagcactggccgctatgcagacatcatctgtggtgcaggaactgaaaaaggccgttgcccagcagcctgagggggtcagaacattggccgagggtttccccgggctcgaagctgcatctagatgggctcaggccctgcaggaagtagaagagagctccagaccttacttacaggaggtacagcgatacgagacctaccgctggatcgttgggtgcgtcctttgttcagtggttctattcgttgtgctgtgtaatctattgggtctcaacctgggaatctggggccttagcgccagggacgatccctcccacccagaggcaaaaggggaggccggcgcccggtttctgatggccggcgtggggctttctttcttgttcgccgctccccttattctgctggtttttgcaacttttcttgtgggtggaaacgtgcagacgcttgtgtgccagtcttgggagaatggcgaacttttcgagtttgccgacacccccgggaatttacctcctagtatgaatctgtcccagttgctgggacttaggaagaatatatctatccatcaggcttaccaacagtgtaaagaaggtgcggcactgtggacagttctgcagcttaacgattcttacgatctggaagagcacttggacatcaaccagatccagagacctgttgttaaaaccagcatggaacagttggcccaggagctgcaaggcctcgctcaggcacaggacaatagtgtgctgggtcagagactccaagaagaagcgcaggggcttcgtaatttacaccaagagaaggtggtgccacaacagagcctagttgctaagctgaatctgtccgtgcgagccctggagtcctctgcccccaatctacagcttgagacctccgacgtactggccaatgtaacttacctcaagggcgaattgccagcatgggctgcccgcattctgcggaatgtgtccgaatgttttcttgctagggagatgggatacttctcccagtacgtagcatgggtcagagaagaagtgacgcagcgcattgccacctgtcaacctctttccggcgctctggataatagccgtgttattctctgcgatatgatggccgacccttggaacgctttttggttttgcctggcttggtgtacattctttctcataccttctattattttcgccgtgaagacaagcaagtacttccgtcccatacgcaagcggcttagcagcaccagtagtgaagagactcagctgttccacatacctcgggtaacaagccttaagctctag

SEQ ID NO: 6693 - DNA, 792 bp, Artificial Sequence
  Description of Artificial Sequence: Synthetic coding sequence
atgggtagagttctggaagaagcccggttcgcagtagcattcactgaaagtatgaaggagatggcccaggcccagtggaaggcccgccagattagcctagcagtcacctcggccgtcccagtgcaaccacacgcgaaaggaaaagtttatgttcagtctcagggcatcgctacaacacctaacgctgcctttaactggaataccttcctgcagcgctccgaaatcaaccagagcgcggacaatcttcatatctttctactgatatgtggtcttcgccaggtgaaagaccccctctacctggtggacgccttctccgcctggcatcaagaggaaccaaatgtgcacctagtgatcgtcggacccgaggttgaccccgtcttcacacgggaggtcaaggccaaagtaaagcgcgcggctggggtccgactcataggagaaatgcctcaggaagacctccatgccgtggttaaaaactgtttcgcagtcgtcaattccagcgtgtccgagggcatgtcagcagccatcctggaagcaatggacctggaggtgccggttctcgcacgcaacatcccagggaacgcggccgtcgtcaaacacgaggtaaccggcctgttattctctaacccccaagaattcgtgcacctggctaaacgcctggtgtccgaccccgcacttgagaaagagatcgtcgttaacggccgggagtatgtaaggatgtatcacagctggcaggtagaaagggatacttatcagcagttgattcgtaagcttgaagggtctacggaagactag

SEQ ID NO: 6694 - DNA, 456 bp, Artificial Sequence
  Description of Artificial Sequence: Synthetic coding sequence
atgaagaccgctgtcatgaaggaactgtacagcttcctgcatcatcagaatcgttatgggtctgagcaggaattcgttgacgacctgaagaatatgtggtttggcctgtactccagagggaacgaggaaggcgacagtagcgggtttgaacatgtgttcagcggggaggtcaagaaggggaaggttaccgggtttcataactggatacgcttttatctggaagagaaagaaggcctcgtcgattattactcacatatatacgacgggcccgtgccagtcaagccaggccgaatttcactttcatgcccggacatctacctgggacaggtgcatctctgggagtggcaggaggtacacagacactcactccacagcgtgtttcacctcattgagctccgtgcacggaaaggacatgagggatcctgtgagacagaagtattgtcaagccttgactag

SEQ ID NO: 6695 - DNA, 363 bp, Artificial Sequence
  Description of Artificial Sequence: Synthetic coding sequence
atgcttcctcagtggcttctacttctgtttctgttgttcttctttttgttcctgctgaccaggggaagtctttccccaactaagtataaccttctggagcttaaggagtcctgcatcagaaatcaggattgcgagactggatgttgtcaacgagctcctgacaattgcgagagccactgcgccgagaagggctcagaaggctccctctgccagactcaggtcttctttggtcagtaccgggcctgtccgtgcttgagaaacctgacttgcatctactcaaagaacgaaaaatggctctctattgcttatggccggtgccagaaaattggcaggcagaagctggccaagaagatgttcttttag

SEQ ID NO: 6696 - DNA, 951 bp, Artificial Sequence
  Description of Artificial Sequence: Synthetic coding sequence
atggccgaagccgcgctggaggccgtccgtagcgagctcagagagttcccagccgccgcccgcgaactgtgcgtaccactggctgtcccctatcttgacaaaccaccgacacctttgcacttttacagagactgggtttgcccgaacagaccttgtatcattcgaaatgcattgcaacattggcccgctttgcagaaatggagcctgccctatttcagagccacagttggttcaacagaggtctccgtcgcagttacccctgatggatacgctgatgctgtcagaggagacaggttcatgatgccggccgagcgtcggctgccactgagctttgtacttgacgtcctggaaggaagagctcagcacccgggggtcctctacgtccaaaaacaatgcagcaacctcccaagtgaactaccccagctgttgcctgacctggagtcgcacgtcccctgggcgtctgaagccttgggcaaaatgcctgacgcagtaaacttctggctgggggaagctgccgcggtcaccagcttgcacaaagatcactacgaaaatctatactgtgttgtgagcggcgagaagcacttccttttccatccaccctccgataggccattcattccctacgaactctacacccctgcaacataccagttaacagaagagggcacctttaaagtcgtggacgaggaggctatggagaaggtgccctggatccctttggaccctcttgctcctgatctggcccgttacccaagctattctcaggcccaggctctcagatgcacagttcgagccggagagatgttgtacctacctgctctgtggtttcaccatgtgcagcagtctcagggatgtatcgcagtcaatttttggtatgacatggaatatgatttgaaatacagctactttcagctactggactccctcacgaaggccagcggcttggattag

SEQ ID NO: 6697 - DNA, 657 bp, Artificial Sequence
  Description of Artificial Sequence: Synthetic coding sequence
atgggtcgcgtatttctaacaggggaaaaggcaaatagcattctcaagcggtaccctcgggcgaacggtttctttgaggagattcgccagggcaatatagagcgcgagtgtaaagaggagttttgcacattcgaagaagcacgcgaggcgtttgagaataacgaaaagacaaaggagttttggagtacgtacaccaaagcccaacagggcgagagcaatcgggggagcgactggttccagttttatctgacattcccacttatttttgggctgtttataattctcctggtgatctttctgatttggcggtgcttcctgcggaacaagactcgacgccagacagttacagaaggacacatccccttcccacagcatctcaacatcatcacgcccccgccccctcccgatgaagtttttgatagctctggactgtctccgggttttttaggctacgtcgtcggtcgcagcgactctgtgagcacaagactgtcaaactgtgacccacctcctacttacgaggaagccactggccaggtcaatctgcaacgtagcgagaccgaaccccacctcgacccaccgcctgagtatgaggacattgtaaactctaacagtgcctccgctattccaatggtccccgtcgtcaccacgattaagtag

SEQ ID NO: 6698 - DNA, 909 bp, Artificial Sequence
  Description of Artificial Sequence: Synthetic coding sequence
atggctatgttcctggaatacaacaaagccataaggaattataccagatttgatgattggtacctgtgggttcagatgtacaagggtaccgtctccatgccggtgtttcaatccctcgaagcctactggccagggttgcaatctttgatcggagacattgacaatgctatgaggacttttctgaattactacaccgtgtggaaacagtttggaggcttacctgagttttataacatccctcaggggtatactgtggagaagcgcgaggggtatccgctgagaccggagctaattgagtccgccatgtacctttacagggccaccggggaccccacacttctggaattggggcgcgacgccgttgaatctatcgagaaaatttctaaagtcgagtgcggatttgcaaccataaaggacctgcgagatcataaactggacaatcgcatggagtctttctttttggcagaaaccgtgaaatacctgtacttgctgtttgatccaaccaatttcatccataataatggttctacctttgatgcagttattactccttacggcgaatgtattcttggcgccggcggctacatcttcaacacagaggcccaccccatcgatcccgctgccctccactgctgccaacgcttgaaagaagagcagtgggaagtggaggatctgatgagggagttttattcattgaaacgctctagatctaaattccaaaaaaacaccgtgtcatcagggccttgggaaccccctgcaaggcctggtaccctgttcagcccagagaaccatgatcaagcccgagagcgcaagcctgctaagcagaaggtgccacttctgtcttgcccaagtcagccctttaccagcaaacttgcattactggggcaggtgttcctagattcctcttag

SEQ ID NO: 6699 - DNA, 459 bp, Artificial Sequence
  Description of Artificial Sequence: Synthetic coding sequence
atgctcgtggatggtccttccgaaaggcctgcactatgttttctgttgctcgccgtggcaatgtccttctttgggtccgcactgagtattgacgagaccagagcgcacctgttactgaaggagaaaatgatgcgcctcggcggccgcctggtcctgaacacaaaggaggagctggcaaacgaacggcttatgaccctgaagatcgcggagatgaaggaagctatgagaaccttgatctttcctccaagcatgcatttcttccaagcgaagcacctgatcgagaggagccaggtcttcaacatactgaggatgatgccaaaaggcgccgctttgcacttacatgacatcgggatcgtgacaatggactggcttgtccgcaacgttacttataggccccactgccacatttgctttacacctcggggcatcatgcaattccgctttgcccatccaacatag

SEQ ID NO: 6700 - DNA, 3951 bp, Artificial Sequence
  Description of Artificial Sequence: Synthetic coding sequence
atggaaccccgccttttttgctggaccacgttgttccttctggcaggttggtgtctgcccggcctcccttgcccctcaagatgtctgtgctttaagtctacagtgcgttgtatgcacctgatgctggatcatatccctcaagtgcctcaacagactacagtactggaccttcggtttaacagaatccgggaaatcccaggatccgccttcaaaaaattaaagaacctgaacacacttctgcttaataacaatcacattaggaaaatctctaggaatgctttcgaggggctggaaaaccttctgtacctgtacttgtacaaaaacgaaattcacgctctggataagcagacctttaaaggcctcatcagtctcgagcacctctacattcactttaatcagcttgagatgctgcagcccgaaactttcggagacctgttgcgactggagcggctttttttgcacaataacaaattgagtaagattccggccgggagtttctccaatcttgactccctcaaacgcctgagattagattctaacgcacttgtttgcgattgtgacttaatgtggctaggcgaactcctacaagggttcgcccagcatgggcacacgcaggctgcagcgacgtgcgaatatcccagacgcctacatgggagagcagtcgctagtgtgacggtggaagaattcaattgtcagtcaccacggatcactttcgaaccccaggatgtggaggtccccagcgggaatacggtgtactttacctgccgtgccgaggggaaccctaagccagagattatctggatacacaataaccactcattggatctggaggatgatacaagactgaacgtgttcgatgatggcacgctgatgatacgcaacacacgtgaatcagatcaaggggtctaccagtgtatggctcgaaattctgcgggcgaagctaaaacacaatcagctatgctacggtattcttctctgcctgcaaaacccagtttcgtgattcagccacaggatacagaagtcctgattggtacaagcaccacactggagtgcatggcaactgggcatcctcaccctctgatcacatggactcgggacaacggacttgaactggacggatctaggcatgttgccacatcttccgggttatatctgcaaaatatcacacagagggatcacggcagatttacatgtcacgctaacaatagccatggcacagtgcaggccgctgcgaatattatcgttcaggcccccccccagttcaccgtcacacctaaggatcaagtcgtcctagaagaacatgcagttgaatggctgtgtgaagcagacgggaacccaccacctgtcatcgtgtggactaagactgggggtcagctacccgtggaggggcagcacaccgttctctcatccgggactctgcgtatcgaccgggctgcgcagcatgaccagggtcaatacgaatgtcaagccgtctcttccctgggggtgaaaaaagtctcagtgcagcttactgtcaagcctaaggcccttgcagtttttacgcaactgccacaagatacatccgtggaggtcgggaagaatatcaatataagctgccatgcccagggcgaaccccaaccaataatcacctggaacaaagagggggtccagatcaccgagtccggtaagttccacgttgatgacgaaggaactctcactatctatgacgcagggttccctgaccaaggccgttacgaatgcgtcgcgcggaattcttttggcctcgcagtgacaaacatgttcctcacggtcacggccatacaagggaggcaggcaggcgatgatttcgtggaatctagtattttggacgctgtccagagggttgatagtgctattaactcaacgcgtagacacctgttctcccagaagccacacacctcttctgatctgctggctcagttccactaccctagggacccacttatcgtagagatggctcgggccggggagatttttgaacacactctacagcttatacgggagcgagtaaaacagggactcaccgtggatctggagggtaaggaattccgatacaacgatctggtcagccctcgcagcctgtcactgatcgccaacctatctgggtgtacagctagaagaccccttcctaactgctcgaacagatgtttccatgccaaataccgcgctcatgacggcacatgtaacaacctccagcaaccgacttggggggccgctctgacagcctttgctcggctgttgcagccagcttaccgtgatggcattagggctccacgcggtctgggtcttccagttggatctaggcagccactccctcctccccgtctcgtggccacggtgtgggcccgcgcggccgcggtgacacctgaccactcttatacccggatgctcatgcactgggggtggtttcttgagcatgatctggatcatactgtacccgcgctatctaccgcacgcttctctgacggacggccatgttcctccgtctgcaccaacgaccccccatgcttccctatgaacaccagacatgctgatccaagaggtacacacgctccctgtatgctgtttgcaagatctagcccagcatgtgcttccgggagaccctctgcaactgtggatagtgtctacgctcgagaacaaatcaaccaacagacggcctatatcgatgggagtaatgtgtacggttcttccgaacgggagtcgcaagctttgagagatccatcagtaccaagaggcctactaaagactggattcccttggccaccgtctggcaaacctctgttgcccttttcaaccggccccccaacagaatgtgccaggcaggaacaggaaagtccctgtttcctggcgggtgaccatcgggctaacgaacatctagccctcgcagcgatgcacaccctctggtttagagagcacaatcgtatggcaacagagctctctgctttgaacccacactgggagggcaacaccgtatatcaggaggcccgaaagatcgtgggtgccgagctgcagcacattacatattcgcattggctgcccaaagtgcttggggacccaggcacacgaatgctgaggggctatcgagggtacaatcctaatgtgaacgccgggattatcaattccttcgcgacggcagcatttcggttcggtcacactctgattaaccctattttgtatagactcaacgccactttgggcgaaatctcggagggacacctgccctttcataaggcgctgttctctcctagcagaataatcaaggagggaggtatagatcctgtgctcagagggctgttcggggtagccgcaaaatggagggctccatcatatctgctgagccccgaactgacccagaggctgttttctgccgcatactccgctgcggtcgattcagccgccactatcatccaacggggccgggaccacggaatccccccctacgtagacttccgtgtgttctgtaacttgacaagcgtgaagaactttgaggatctgcagaatgaaatcaaggactccgagattagacaaaagttacggaagctgtatggcagccccggagacatcgatctgtggccagcccttatggtcgaggatttgattcccggaacaagggtgggccccacactgatgtgtctctttgtgacacagtttcagagattgcgggatggggataggttttggtatgaaaatcccggggtgttcaccccagcccagttgacccagctcaaacaggctagcctgagtcgtgtattgtgcgacaatggtgactcaatccaacaggttcaggccgatgtgtttgtaaaggccgagtacccccaggattatctgaattgttcagaaatacctaaggtggaccttcgggtgtggcaggactgttgtgcagataaacaagcagggggaacaccggaggccggacgcgtttacagatgctag

SEQ ID NO: 6701 - DNA, 891 bp, Artificial Sequence
  Description of Artificial Sequence: Synthetic coding sequence
atggacccctccaaaatagctcatacagaatatcctgtaaatacaatcattatccatgaggattttgataataatagtatgagtaacaacatcgcgctgctgaagacggatacagccatgcattttggtaacctcgtgcagagtatttgctttttaggaaggatgctccacactccaccagtcctacagaactgctgggttagcggctggaatcctacttcagcgacagggaaccacatgactatgagcgtgcttcgaaagatctttgtgaaggacttagacatgtgtcctctgtacaagctgcagaaaacagaatgtggtagccataccaaggaggagaccaaaacggcctgtctcggtgacccagggtcccccatgatgtgccagctccagcagtttgacctgtgggtgctccgcggagtgttgaactttgggggtgaaacttgcccagggctgttcctctacaccaaagtggaggactattctaagtggataacatctaaagctgagagggccggcccacccttgtctagcctccatcactgggaaaaactcatatccttctctcaccatggtccgaacgccacaatgacccagaaaacctacagtgactcagaactgggacacgtgggcagctatctgcaggggcagcgccggaccattacacatagccggttgggtaactcttcccgtgacagtctggacgtgcgggagaaggatgttaaggagtcaggtcgctcgcctgaagcaagtgtccagcctttgtactatgactactatggaggagaagtgggtgagggccgaatctttgccggccagaaccggctctaccagccagaggagataatccttgtgagcttcgttctagtattcttttgtagttccatttag

SEQ ID NO: 6702 - DNA, 2808 bp, Artificial Sequence
  Description of Artificial Sequence: Synthetic coding sequence
atgcgaaagcctcgtcgcaagtctagacagaatgccgaaggccggagaagccctagcccatacagtctgaaatgcagccctaccagggaaaccttgacctatgctcaggcccagcggatcgtagaagtggatatcgatggaaggctccatcggatctcaatctatgatcctttaaagattatcaccgaagacgagcttactgcgcaggacattaccgagtgcaacagcaataaggagaacagtgaacagccccaattccctggaaaatctaaaaagccttcttctaagggcaagaaaaaggagtcctgcagtaagcacgcatctggtactagttttcacctccctcagccttctttccgaatggttgactctggtattcaacccgaggccccgccccttcccgcagcctattacagatatatcgagaagcctcccgaagacctcgacgctgaagtggaatatgatatggacgaggaagatctggcctggctcgatatggtcaacgagaagcgtcgtgttgatgggcattctctggtgagtgcagacacatttgagctactcgttgacaggcttgagaaagaaagttatctggagtcacgaagcagtggcgcccagcaatccttgattgacgaagacgccttttgttgcgtttgtcttgacgatgagtgtcacaatagtaacgtgatcctcttttgcgatatctgcaatttggccgtgcaccaggaatgctacggcgttccttatatacccgagggccagtggctctgccgctgctgcttgcaatctccaagtaggcctgttgattgtattctttgtccgaacaagggcggagcttttaaacagacctccgacgggcactgggcacatgtagtctgtgccatttggattcctgaggtgtgcttcgccaataccgtttttttagagcctattgagggaattgataatatacctcccgctaggtggaaattgacctgttacatttgtaagcagaagggtttaggagccgccatccagtgtcataaggttaactgctacactgctttccacgtgacatgcgctcagagggcaggcctttttatgaagatcgagcctatgagggaaactagtcttaacggaaccatctttacggtacgtaaaactgcgtactgtgaggcccatagcccacctggcgctgctaccgccaggaggaaaggcgactcccctaggagtatctcagagaccggggacgaggagggcctcaaggagggcgacggagaagaggaggaggaagaggaggtggaggaggaggaacaggaagcacaaggaggtgtgagcggcagcctgaaaggtgtgcccaagaaatcaaagatgtccctgaaacagaagatcaaaaaggaacccgaggaggcaggacaagacaccccttccactttgcccatgctggcggtaccacagatcccgtcatatcgtctgaataagatatgctctggtcttagtttccagcgaaaaaaccagtttatgcagcggttacacaattactggctactgaaacgccaagctcgtaacggagttcctctgatccgccgactccatagccatttgcagagccaacgcaacgccgaacagcgggagcaagacgagaaaacatctgcagtgaaagaagagcttaagtactggcagaagctcaggcatgatctggagcgggcacgcctcttaatcgaactcatcaggaagcgggagaaactgaagcgggagcaagtgaaggtccagcaggcagccatggaactcgagcttatgccattcaacgtcttgctgaggaccacgttagatctcctgcaggagaaggacccagctcatatatttgccgagccagtcaatctttctgaggtgcccgattaccttgagtttatctcgaagcctatggatttttcaacaatgcgaagaaagctggaatcgcatttgtatcgcactttggaggaatttgaggaggactttaatctgatagtgaccaattgcatgaagtacaacgctaaggataccatctttcatcgtgccgcagtacggctacgcgacttaggaggagctatattaagacacgcacgaagacaggccgagaatatcgggtatgatccagaacgcggcacacacttgccagaatccccaaagttagaggatttctacaggtttagctgggaggacggcatgactaacgggtttgggaaacacactgaatccggctccgattccgaatgttctctcggactcagcgggggtcttgcatttgaggcctgttctggacttaccccaccaaaacgtagtaggggaaagccagccctgagccgcgtgcccttcctcgagggggtaaacggggacagcgattataatggctccggaaggagcctgttgttgccctttgaggacaggggcgacttggagccactggaactggtttgggccaagtgccgcggttatccctcgtatccagccctaatcatcgaccccaaaatgccccgcgagggcttgcttcataacggagtgcccatccccgtgccccccctggacgtgcttaagctaggtgaacagaaacaagctgaagccggcgagaaactcttcctggtgctgttcttcgacaataagcgtacgtggcaatggttgccaagagataaagtgttgcccctcggtgtggaagacaccgtagacaagctgaaaatgctggagggtcgcaagacaagcattcggaagtcagtacaggtggcttatgacagggccatgattcacctgtcccgagtccgtggcccccatagcttcgtgactagcagctatttatag

SEQ ID NO: 6703 - DNA, 270 bp, Artificial Sequence
  Description of Artificial Sequence: Synthetic coding sequence
atgaaaacaggccttttcttcttgtgtctgctgggcacagcggccgcaattcctaccaatgccaggttacttagtgaccattccaagccaaccgccgagaccgttgcaccagacaacactgcgattccatctctgcgagcggaggcagaagaaaacgagaaggaaacggcagtttctaccgaggacgactcccatcataaggccgagaagagtagcgtgcttaaatcaaaggaggagtctcacgaacagtccgctgagcagggaaagtag

SEQ ID NO: 6704 - DNA, 657 bp, Artificial Sequence
  Description of Artificial Sequence: Synthetic coding sequence
atgggaagagtattcctcaccggcgaaaaggctaactccatcctaaagcgttatcctcgcgctaatggtttctttgaagagattagacaggggaacatagagagggagtgcaaggaggaattttgcacatttgaagaagcacgtgaagcttttgaaaataatgaaaagaccaaggagttctggtccacatatactaaggcgcaacagggcgagtcaaacagggggtctgattggttccagttttaccttacttttcctctgatcttcgggctctttattatccttctagttatttttttgatctggcggtgcttccttcgtaataaaactagacgacagaccgttacggagggccacatcccctttcctcagcacctcaacattattactcctccacccccgcccgatgaagtcttcgacagtagtggcttatctcccgggttcttggggtacgtagtaggcaggagcgactctgtttccactcggctgagtaactgcgatcctccccctacttacgaggaggcaactggccaagtaaatttacagcgatccgaaactgagccacacttagacccacctccagagtacgaagatattgtgaactctaactctgcgtctgccatccctatggtgcctgttgtcaccaccataaagtag

SEQ ID NO: 6705 - DNA, 540 bp, Artificial Sequence
  Description of Artificial Sequence: Synthetic coding sequence
atgtcactcggccccgaggtcttcctgggtcctcccgaagcccagtccttcttaagctcccatacacgcatcccccgagccaaccattgggacctggaactcctgacacctggtaatctggagcgggagtgcctagaagagaggtgttcttgggaagaagccagggagtatttcgaggataatactttaacggaaaggttttgggaatcctatatttataatggaaagggcggacggggacgggtggatgtggcctccctggcggtgggtctgaccggcggcatcctgctaatcgtgcttgccggcctcggggctttttggtacctgaggtggcgtcagcatagggggcagcagccatgccctcaggaggctggtcttatttcccccctctcccccctcaacccattgggcccacccactcctttgccaccaccgccccctccacccccaggcttgcccacctacgaacaagccctggcggcctctggggtacacgacgcaccgccccctccttataccagccttaggaggccccactag

SEQ ID NO: 6706 - DNA, 765 bp, Artificial Sequence
  Description of Artificial Sequence: Synthetic coding sequence
atgacgctagaagacattgtgcagagggaagtgtggggaaccgttgttgcccggggggctcccgcaccaccagggcccgtcccgactcgtggagctgcctcccggagattgtcagtgtcaccagcctccacctcagagacaagcctgtatcaggttctcctgggcgcacgacagcttgttcagcctgggccccacgccatgtatgccagagtacggcaggtggaatctaaccccctttaccagggcaccgcatcgtccgcagacgtggcgctcgtggaactagaggctcctgtcccgtttacaaactatattctgccggtgtgtctgcccgatcctagcgtaatctttgagacgggtatgaattgttgggtgactgggtggggcagcccttccgaagaggacctcctgcccgaacccagaatactgcagaaacttgcggtacccattatcgatacacctaagtgcaatctcctctactctaaagatacagagttcggctaccaacctaagactatcaaaaatgatatgctgtgtgccgggttcgaggagggaaagaaagacgcctgcaagggagatagcgggggtccacttgtgtgcctggttggacagtcctggctgcaggccggagttatctcctggggagagggatgtgcccgacagaacaggcctggagtttacattcgggtgaccgcccaccacaactggatacaccgcatcataccaaaactccagtttcagcccgcccgactgggcgggcagaagtag

SEQ ID NO: 6707 - DNA, 1899 bp, Artificial Sequence
  Description of Artificial Sequence: Synthetic coding sequence
atgacgccacccgtcctcacaaccgccgaaactagcgtgaagccttctgtaagcgcatttacccatagtcctcccgaaaacaccaccggtattagctcaactatctccttccactcacgcactttgaacctgacagatgttattgaagagcttgctcaggcttccacccagacactgaaatcaactatcgccagcgagaccacactcagcagtaagtctcaccagagcacgactacaagaaaagccatcatccgacactccaccattccacctttcttgtctagttctgccacactcatgcctgtccccatttcaccacccttcacccagagagctgtgactgacaatgtcgctacacccatatcagggttgatgacaaacaccgtcgttaaacttcacgaaagcagccgacataacgccaagcctcagcaactggtggccgaagtcgctacatctcccaaggtccacccgaacgcgaagttcaccattggcacaacccactttatctactccaatctgctgcatagcaccccaatgccagccctgacaaccgtgaagtctcagaatagtaagcttacaccctcgccttgggccgaaaaccagttttggcacaaaccatattctgagatagctgagaagggtaagaagccagaggtatctatgctggctacgactggtctgtctgaggccaccacattggtgtcggattgggacggccagaagaacactaaaaagagtgatttcgataaaaagcccgttcaggaggccacgacatcaaaattgctgccatttgattcactctccaggtatattttcgagaaaccgcgcattgtcggtggcaaggcggcaagctttactatccccgcaaacagcgatgcctttcttccttgcgaggcagttgggaaccctctccccactattcactggacaagggtaccgagtggactggatctcagcaaaagaaaacaaaacagccgagtccaggtccttccaaatggcacactcagcattcagagagtggagattcaggaccgtggacaatatctttgttctgcatcaaacttgtttggcaccgaccatctccatgttacactatccgttgtgagctacccccctaggatcctggagcgacggaccaaagagataacagtgcatagcggctccacggtggaactaaagtgcagggctgaaggccggcccagtccaaccgtcacctggatactcgccaaccagaccgtggtatccgagagtagccagggatcgcggcaggccgtagtgacagtagacggaaccctggtgctccacaacctgtcaatttacgataggggcttttataaatgtgtagcctcgaatcctgggggtcaggacagtctgctggtgaaaatccaagtgatcgctgcccccccagtgatcctggaacagcggagacaagttatcgtggggacctggggcgagtctttgaaactcccttgcacagccaagggaaccccgcagccaagtgtttactgggtcctaagtgacggcacggaggtcaagcctcttcagtttacaaacagcaaactatttttgttttctaacggtacgctctacatccgaaacctggcttcctcagaccggggcacttacgagtgtatcgcaacctcatcgacaggcagcgaacggcgggttgtcatgctcactatggaagaaagggtgaccagcccgaggatcgaagcagcctcccaaaagagaactgaagtgaacttcggagataagttgttgctcaactgttcagcgactggagaacccaaaccacagattatgtggaggctaccaagtaaggcggtagttgatcaacagcaccgggtggcagctggatccacaagtacactgatggatccatgcttgctggatcagtag

SEQ ID NO: 6708 - DNA, 681 bp, Artificial Sequence
  Description of Artificial Sequence: Synthetic coding sequence
atggatattatcgtgttgctccctaagggtcattgtacaaagattcaagaactccagatgaccacggtgctgaagcaaaatgtgcacgtcttcggcgtcgagggcaacagtgatgagctggacgaacccatcaagaccgtctttgcagacgttgcttttgtgaaaaaacataacctcatgagtcttaacagcattaattggtcaagggtgctggtgcagatggctcaccacttttttgcgtattttcaatgtactccatccctggatacacatcctctccccttggttgaggtggtggtgccgacgggcgccgctgggaaccttgctgccgggtatatcgcacagaagatcggcctgcctatcaggctcgttgtggccgtaaaccggaatgacattatccaccgtaccgtgcaacagggcgacttctccttgagtgaggctgtaaagagcacactagcgtccgcaatggacattcaggtgccctataatatggagcgggtgttctggctgctgtccggcagtgattctcaggtgactcgggcgcttatggagcagttcgaacgcactcagagcgttaatctgccaaaagagctccatagcaagcactcaccggtcttgccccgcccttgcctctgtagtcaggttcccggaagctgtccaggctgttggcccgatccatag

SEQ ID NO: 6709 - DNA, 729 bp, Artificial Sequence
  Description of Artificial Sequence: Synthetic coding sequence
atgttccagaccggaggcctcattgtcttttacggactcctggctcagacacttccactcaatgtcaatcccgcactcccactgagtcctacgggcctggcaggatcgctgaccaacgcactgagcaacgggctgctgtccggggggttgctcggaattctcgagaatctgcctctgctcgatatcctgaaaccagggggaggaacctccggcggactgctggggggactcttgggtaaagtgacgtccgttattcctggtttgaataacatcatcgatatcaaggtcacggatccacaactgttagagttgggactggttcaaagccccgacggccatcgcctatatgtcaccatacccctcggcatcaaattacaggtcaatacgccactggttggggcttctctgttgcggctggctgttaaattggacattaccgccgagattctggccgtcagagataagcaggagcggatccaccttgtgttgggggactgcacccactctccgggctctctgcagatctcactgctggacgggttgggccctctgcctatccaggggctcctggatagtcttaccggcattctgaataaggtactaccagagctcgtccagggcaatgtctgtcctctagtgaatgaggttctgcgcggactcgacatcaccctggtgcacgacattgtgaatatgctgatacacggactgcagttcgtaatcaaggtttag

SEQ ID NO: 6710 - DNA, 1422 bp, Artificial Sequence
  Description of Artificial Sequence: Synthetic coding sequence
atgagcctcgaagccagtctgtgttctcttgaagaatgcgccgcctttcagccgagctcgccttcccctctgcagccccaaggcccggtgaagtctaataatatagtgaccgttactggcattagcctgtgtctgtttattattatcgctactgttctgattaccctgtggcgtaggttcggaagacctgctaagtgtagcacgccggcaagacataattctatccatagcccatccttcagaaaaaattccgacgaggagaacatctgtgagctgagtgaacagagaggaagcttcagcgacggaggggatggccccacaggtagtccgggggataccggtattcctctgacctatcgccgttctggaccagtgcctccagaagatgatgctagtgggtccgaatcttttcagtcaaacgctcagaagattatccccccgctcttttcctacaggctggcacagcagcagctcaaggagatgaaaaaaaaaggcttgaccgagaccacgaaagtgtatcacgtgagtcaatccccgctgactgacacagcgatcgacgcagccccatctgcacccctggatctcgagagccctgaggaagccgcagcgaataagttccggatcaagtctcccttccccgagcagcctgctgtgtcggcaggcgagcgccctcccagcaggctggacctgaacgtgactcaggcctcatgtgctattagcccgtcccaaactctgatcaggaagagtcaggcacggcacgtgggttctcggggtggccctagtgaacggagtcacgcaaggaatgcccatttccggagaactgccagctttcacgaggctagacaggctagaccgttccgggaaaggagtatgtctaccctcacccccagacaagcccctgcgtatagctccagaacccgcacttgtgaacaggctgaggaccggtttaggccacagagcagaggcgcccatctctttcccgaaaaacttgagcacttccaggaagcaagcggcacaaggggcccgctcaatcctctgcccaagagttataccttagggcagcctctccgcaaaccggatctgggagaccaccaggcaggtttggttgcaggcatcgagaggaccgagccgcaccgagcccgccgcggacctagtccaagccacaaaagcgtcagtcgtaaacagagctcacccatctctccaaaggataactaccagcgcgtgagctcactctctccaagccaatgtcggaaggacaaatgccagagtttccctacgcacccagagttcgctttctatgataatactagtttcggtctcaccgaggcagagcaacgtatgctcgacctgccaggatatttcggaagcaatgaagaggatgaaaccacaagtacgctgtcggtggagaagcttgtgatttag

SEQ ID NO: 6711 - DNA, 2310 bp, Artificial Sequence
  Description of Artificial Sequence: Synthetic coding sequence
atgttaagcaaaaagggtatctttccttggatattgacctgcatttccgaggaaatggcctttcggacaatttgtgtgttggtgggggtgtttatttgttccatctgtgtcaaagggagctctcagccccaggcccgagtgtacttaacctttgatgagcttcgagaaacaaagacctctgagtacttttccctctcccaccacccacttgattaccgaatcttacttatggatgaggaccaggacaggatttatgtgggatcaaaggatcatatcctatcactgaatattaataacatttcccaagaagccttgagtgtgttttggccagcctcgaccataaaagttgaggagtgcaagatggccggaaaagaccctacccatggctgcggaaactttgttagagttattcagacattcaatagaacccatctgtatgtgtgcggatccggtgcgttctctccagtttgtacatatctgaaccggggacgccgtagcgaggatcaggtcttcatgatcgattccaagtgtgagtctggaaaaggccggtgcagctttaatcccaatgttaacactgttagcgtgatgattaatgaggagctcttcagcggtatgtatatcgactttatgggcacggacgcagccatttttaggagcctgactaaacgcaatgccgtccggactgatcaacacaatagtaagtggctaagcgaaccaatgttcgtcgacgcacacgtcattccagatggcaccgatcctaacgacgccaaagtctactttttctttaaggagaaacttactgataacaatcgcagcacaaaacagattcacagcatgattgccagaatctgccccaacgacacaggcgggctaagatctttggtgaataaatggacaacgttcctgaaagctcggctggtgtgctccgtgactgacgaagatggcccagaaactcacttcgacgagctagaggacgtattcctgctggagactgataaccctagaaccactctggtttacggaatcttcaccacatcttctagtgtcttcaaaggctcggccgtttgcgtgtaccatctctctgatattcagacagtgtttaatggcccattcgctcacaaagagggacccaaccaccaacttatttcttaccagggccgtatcccataccctcgccctggtacttgccccggtggcgcttttacaccaaacatgcggacaaccaaagaatttcccgatgatgtcgtgacgtttattcgaaaccaccccctgatgtacaacagcatataccccatccataaacgcccgctcatcgtcagaatcggcacagactacaagtatactaagatcgctgtagatcgcgtaaatgccgccgatggtagataccacgtgctttttttgggcacagataggggcaccgtgcaaaaggtggttgttctgcccacaaataattccgtcagtggtgagttgattctcgaagagctagaggtcttcaaaaatcacgctcccatcaccaccatgaaaataagttcaaaaaaacagcagttgtacgtttcctcgaatgaaggggttagtcaagtttccctgcaccgctgtcatatttacggaacagcatgtgcagattgttgtctggctcgagacccatattgcgcctgggacggtcactcatgctcacggttctacccaacgggcaagcggaggtctcggcggcaagacgtgagacacggcaaccccctcacacagtgtcggggtttcaacttgaaagcttacaggaatgcagcggagatagtgcaatacggagtgaagaacaacaccacattcctggagtgcgccccaaagtcgccacaagcatccataaagtggttgctgcagaaagacaaagatcgacgcaaagaggtcaagttgaacgagcgcatcatcgctacatctcagggcttacttattaggtccgtgcaaggcagcgaccagggactctaccactgtatcgcaaccgagaatagcttcaaacagaccattgcaaaaatcaattttaaagtgctggactcagaaatggtggccgtggtgaccgataagtggagtccttggacctgggcatctagtgttagagcgctccctttccaccctaaagacatcatgggcgccttcagccattccgaaatgcagatgattaatcaatattgcaaagacaccagacagcaacatcagcaaggagacgagtctcagaagatgcgaggggactacggtaagctgaaagccctgattaactctagaaagtcgagaaaccgcagaaatcaactgcctgaatcatag

SEQ ID NO: 6712 - DNA, 942 bp, Artificial Sequence
  Description of Artificial Sequence: Synthetic coding sequence
atgcctggatggctcaccctacccacgctgtgccgatttctcctttgggctttcacgatctttcacaaggcacagggagatcccgcctcccacccggggacaacaccaccttcctataaggttcggtggagtaaggtcgaaccaggcgaattgagagagaccctgattctcatcacaaacggacttcatgcccgaggttacggaccccttggaggcagagcccgaatgcgaagaggccatcggctcgacgcttcactggtaatcgcgggggtccggctggaggacgaagggcggtaccgttgtgagttgattaacgggattgaggacgaatccgtggccttgaccctctctctggaaggtgtcgtgtttccataccagccctcacgtggtcggtaccaatttaactattacgaagccaagcaggcttgtgaggaacaggatggacgcctggccacctattctcagttgtatcaggcctggaccgaggggcttgattggtgcaacgcaggatggcttcttgaagggagcgtaaggtatccagtgctgacagccagggcgccgtgtgggggcagaggtcgccctgggatcagaagctatggaccccgggatcgaatgcgtgatcggtatgacgccttttgcttcacgtcagcccttgccgggcaagtgttcttcgtccccgggcggctcaccttgtcagaagcgcatgcagcctgtagacgcaggggcgccgtggtcgccaaagtcggacacctctatgccgcttggaaattctccggcctggatcagtgcgacgggggttggttggccgatggaagcgtccgctttccaatcaccacgcccaggcccagatgtggcggcctcccggacccaggagtaagatcctttggcttcccgcggcctcagcaggctgcctacggaacatattgctacgctgaaaactag

SEQ ID NO: 6713 - DNA, 1089 bp, Artificial Sequence
  Description of Artificial Sequence: Synthetic coding sequence
atggcctggacgttcgagtgctcaaggacaacctctcctgagccccttagtacctctccctgccgaaccacttcttccagaaactctcccactatgtcctgccctgccagcgttgcgtgcgaacctagcacatcaacgactaccagcagtccacccaaggcttgccttacgagacctagtagtccaagcccgtcttgttccacttcagcttggcataataaaaataacctcatcagcaaagttcctagaggagccttgagtaggcagacacagttgagggaactgtatcttcagcacaatcagctgaccgactccgggctggatgcgaccacctttagtaaactccatagtctggagtacctcgacctgagccacaaccagcttaccaccgtgccagcaggccttccaaggaccctcgctattctgcacctggggcgtaaccgtatacgccaagttgaagcggctcggttgcatggggccagaggtctgagataccttttgttgcagcacaaccaactcgggtcctcgggcctcccggctggagcgctgcggccactgagggggcttcataccctccacctttacggcaacggcctggaccgggtaccccctgctctgcctcgccggttgagagctctcgttctcccccacaaccatgtcgcggccttaggggccagagatctggtcgccactccagggctaactgaattgaatctggcctataaccggttggcttccgcccgggtgcatcaccgtgctttcaggcgactgagggctctgagaagtctggacctggcaggcaaccagcttacaagactcccgatgggcctccccacaggtctaagaacactgcagctacagaggaaccagctgcgtatgttggaaccggagcccctcgcaggtttggaccagctccgggaactgtcactcgcacacaatagactccgggtgggcgacattggtcccgggacttggcacgaactgcaggccctccaggtgcgtcatagattggtctctcacaccgttcccagggccccgcccagcccctgcctgccttgccacgttcctaatattctggtgtcgtggtag

SEQ ID NO: 6714 - DNA, 900 bp, Artificial Sequence
  Description of Artificial Sequence: Synthetic coding sequence
atgttacaccccgagacaagccctgggcggggccacctgttggctgtgttactcgctctcctgggcaccgcatgggccgaggtatggccaccccagctgcaagagcaagccccgatggcaggagctttaaaccggaaggaatctttcctgcttctttccttgcacaacaggctgcgatcctgggttcagccacctgccgccgatatgagaaggctggactggagcgactcccttgcccagctggctcagggtagtccgctctggaatcctaacccagaacccggggtgagaccagttgctcaccccgcaagcggccttgagcacgcggccgcaccaagggcatggtgccccctctcaaagtggtctttatggttcgctgagggacagagatattcccatgctgccggtgaatgcgcgcgtaatgccacttgcacccattatacacaactggtctgggcaacatcgtctcaacttgggtgcggccgccatctttgcagcgcaggccaggccgcaattgaggcttttgtgtgcgcctattctcctcggggaaactgggaagttaatggcaaaacaatagtgccatacaagaaaggggcttggtgctcgctgtgcacagccagcgttagtgggtgttttaaggcctgggatcacgcaggaggactttgcgaggtgccacgaaacccatgccggatgagttgccagaatcacgggagactcaatatctccacatgccattgtcattgccctcccggatacaccgggcggtattgtcaagttcggtgcagccttcagtgtgtccacggaaggttcagagaggaagagtgcagttgtgtctgtgacattggatacgaaccctctgttcctcccagatgtatttttccatcaaccccagtcacgtag

SEQ ID NO: 6715 - DNA, 1047 bp, Artificial Sequence
  Description of Artificial Sequence: Synthetic coding sequence
atgctggatacaaatcttattctgctgcctctattccagttcatcgtgcccaaagaatggaacagtaagtacagacccgtgtgcatacatttggcggggaccggggaccaccactactggcggaggcgcacattgatggcccgccctatgatcaaagaggcacgcatggccagcttgctgctggagaatccttattatggatgtcgaaaacctaaggatcaggtgcgttcatctcttaaaaatgtgagtgacttgttcgtgatggggggcgccctggtactggagagcgccgcattactgcactggcttgaacgcgaggggtacggacccctgggcatgactggcattagtatgggcggtcatatggcttccctggcagtgtctaattggccgaagccaatgcctctgatcccgtgccttagctggtctacggcaagcggggtgtttactacaacagatagtttcaagatgggccaagagttcgttaagcacttcaccagctcagccgacaagctgactaacctcaacctcgtcagcagaacccttaatcttgatatctccaatcaggtggtgagtcagaaacctgcggattgccacaacagttctaaaacgagcgtgtcggcaacgagcgagggattgttactgcaggacacctctaagatgaaacggttcaaccagaccctgagcacaaacaagtccggatatacatccaggaaccctcagtcataccacctcctgtccaaggagcagtcccgtaactccctgcggaaggagtcattgatcttcatgaagggtgtgatggacgagtgcactcacgtggccaacttctccgtgcccgtagacccctccctgataattgtggtgcaagccaaggaagacgcttacataccccggacaggggtgaggtcactccaggaaatatggcccgggtgcgaaatcagatacctggaaggaggccatatctctgcttatttgtttaagcagggactattccgccaagccatttatgatgccttcgacagattcctgcataaatatgctaattag

SEQ ID NO: 6716 - DNA, 1044 bp, Artificial Sequence
  Description of Artificial Sequence: Synthetic coding sequence
atgcgggcttgcatcagtctcgtccttgccgttctgtgcggccttgcttgggccgatttatactccgctcctacttcttgccaagggcgatgctatgaagccttcgacaaacaccatcaatgccattgcaacgctcgatgccaggaatttggcaactgttgtaaggactttgaatctctctgtagcgatcacgaggtcagccactcttctgatgcaatcacaaaggaggagatacagagtatttcagagaagatatatagagctgatacaaataaggcccagaaagaagatatcgtgctaaacagccagaactgcatcagcccctctgaaaccagaaatcaggtcgacaggtgtccaaaacccctctttacctacgtgaacgagaaactgtttagcaagcccacctacgcagcgttcattaatctcttgaataactatcagcgcgctaccggtcacggagagcatttctccgctcaagagcttgctgagcaggatgcctttcttcgcgaaattatgaagactgcagtgatgaaggagctttacagctttctgcaccaccagaacagatacggcagcgagcaggagttcgtagacgacttaaagaatatgtggttcggcctatatagcagaggcaatgaggagggcgacagctcaggcttcgagcatgtgttctctggcgaagtgaaaaaggggaaagtcaccggattccacaactggatcagattttatttagaagagaaagaaggattagtcgactattactcacatatctacgatggaccttgggattcataccccgacgttctcgcgatgcaatttaactgggatgggtactataaggaggtgggttccgcgtttatcggctcttcgccagagtttgagttcgccctctattctctgtgtttcatcgcccgcccaggtaaagtttgccagctgtcgttgggaggatatccgctcgctgtcaggacctatacatgggacaagagcacatatggcaatggtaagaagtacatcgcgaccgcttacatcgtctcctccacttag

SEQ ID NO: 6717 - DNA, 864 bp, Artificial Sequence
  Description of Artificial Sequence: Synthetic coding sequence
atgctgaagaaaatttcagtgggagtcgcaggcgatcttaatacagttacaatgaagctgggttgcgtcctgatggcttgggctctttacctgtcactgggagtgctctgggtggcgcagatgcttctcgccgcatcattcgaaaccctgcagtgcgagggacccgtctgtacggaggaaagcagttgccacaccgaagacgacttaaccgatgcccgtgaagcaggcttccaggtcaaggcatacacgttctccgagccttttcatctgatcgtttcgtatgagttgttccccgctccgattcttagagccgtgccgtctgccgagccccaggccggctcaccgatgacactctcatgccagacaaagcttcctctgcagcgaagcgcagcaagactgctgttttccttctacaaggacggccgaattgtccaatctcgcgggttgagttctgaattccaaattcccacggcatctgaggaccactctggatcttactggtgcgaggccgccacagaggacaaccaggtttggaagcaatcaccgcagctcgaaatcagagtacagggcgcctctagttcagcggctccacccactctgaacccggcccctcagaagagcgctgcacctggaacagcacctgaagaggcccccgggcccctgcctccccctccaacacccagtagcgaggatccaggtttttcatctcccctcgggatgccagacccacatctgtatcatcagatgggactgctcctgaagcatatgcaggacgtgagagtgttgctgggtcacctgctgatggaattgcgagaacttagcggccaccgcaaacccggcaccaccaaggccactgccgagtag

SEQ ID NO: 6718 - DNA, 1815 bp, Artificial Sequence
  Description of Artificial Sequence: Synthetic coding sequence
atgatgagagcagtgtgggaagcactggccgctctagcagccgtcgcttgtctggttggggcggtgagagggggtccagggctttccatgtttgccggacaggctgcacagccagacccctgttcagacgagaacggccacccacgtcgatgcatacccgactttgtcaatgcagccttcggcaaggacgttcgcgtaagttcaacatgtgggcggccgcctgcccggtattgcgttgtatctgaaaggggggaggaacgactgaggagctgtcacttgtgtaacgctagcgacccaaagaaggcacaccccccagcatttttgaccgatctcaacaacccacacaaccttacttgctggcaatcggaaaactacctgcagtttccccacaatgtgaccttgacacttagcctggggaagaagttcgaggtgacatatgtcagcctgcaattttgctcaccacgcccagaatccatggctatttacaagagtatggattatggccgcacctgggtgcctttccagttctattccacacagtgtcgcaaaatgtacaacaggccccatagggccccaatcacaaagcagaacgaacaggaagcagtgtgcactgacagccacacagatatgcgaccattgtctggaggactgatagcgttttccactttggatggaaggccctccgctcacgatttcgacaattcacccgtcctccaggattgggtgacagcaacagatataagagtggctttttcccgtctgcatacatttggagacgagaatgaagacgactccgaactggctagagacagctatttctacgccgtgtcagatttacaagtgggaggaaggtgcaagtgcaatgggcacgccgcccggtgcgtaagggatagggatgactccttagtgtgcgattgcagacacaacacagctgggcctgagtgtgacaggtgtaagccatttcattacgataggccctggcaacgcgccacggccagggaagccaatgagtgcgtcgcctgtaattgtaacctgcatgcaagacgctgtagattcaatatggagctgtataaattgagcggcaggaaatccgggggggtctgtctgaactgtcgacacaacacggccgggcgtcactgccattactgtaaagaaggctactacagagatatgggtaaacccattacgcaccgcaaggcctgcaaggcctgtgattgccaccctgtcggggccgcaggcaagacttgtaatcaaaccacagggcagtgtccatgcaaggacggggtgaccggcattacctgcaacaggtgtgctaaaggttaccagcaatccaggtccccaattgctccatgtatcaagatacccgtggctccccctacgactgcagcgagttccgtagaggagcctgaagactgtgacagctattgcaaagcaagcaaaggcaaactaaaaataaatatgaaaaaatattgtaaaaaagactatgcagtgcagattcacatactgaaggctgacaaagcaggagactggtggaaatttacagtgaacattattagcgtgtataaacagggcacatctcgcatccgacggggagatcagagtctgtggattcgttcccgggatatcgcttgcaagtgtcccaagataaagccgctgaaaaaatatctactgctcgggaatgccgaggactccccagatcaatcaggcattgtcgcggacaagtcatccctcgtcattcagtggcgtgatacgtgggcaagacgtttgcgaaaattccagcagcgggagaagaagggaaagtgcaaaaaggcctag

SEQ ID NO: 6719 - DNA, 1005 bp, Artificial Sequence
  Description of Artificial Sequence: Synthetic coding sequence
atgagatccgcgggcgggagaggagagattaaggttagacgtgagttgcagccgtcgaagcaggtctcaggtctgacaaatcacgcacgcacaggacaggaaaagaggaatctacaacgccttgtcctcgaaactccatcccagaacatctttttctctcctgtcagcgtgtcgacatccttggcgatgctctccctaggggcccactccgtcaccaaaactcagattctccaggggctgggatttaacctgacccatacacccgagtcagcaattcaccaaggattccagcacctggtccactcactgaccgttcctagcaaagacctgacactgaaaatgggaagtgccttattcgtgaagaaggagctgcagctgcaagcaaatttcctgggcaacgtgaagagactgtatgaagctgaggtctttagtactgacttttcgaaccccagtattgcgcaggcgcgcattaactcccacgtaaaaaaaaagacccaagggaaggtggtcgacatcattcaggggcttgaccttcttaccgctatggttctagtgaaccatatcttcttcaaggcaaaatgggagaagccttttcacccagaatatactcggaaaaattttccttttctggtgggggaacaagtgacggtacacgttcccatgatgcatcagaaggagcagtttgcatttggagtggacacagaattgaattgtttcgtgctccagatggattataagggtgatgccgttgcctttttcgtcttgccatccaaggggaagatgaggcagttggagcaggcactgagtgccagaacactgcgcaagtggagccattccttgcagaagagatggattgaagtgtttatcccccgattctccatctctgcgtcctacaatctagagactatccttccaaaaatgggaatccagaacgtattcgacaagaacgccgacttctccggcattgccaagagagattcgctgcaagtaagcaaggttagctag

SEQ ID NO: 6720 - DNA, 1065 bp, Artificial Sequence
  Description of Artificial Sequence: Synthetic coding sequence
atggcaccagctagacgcccagcgggcgcaagactgctgctggtgtatgccgggctgctggcagctgcggcagctgggctcggcagtccggagcctggagctcccagtaggtcccgcgctcgcagggagccaccccccggcaacgagctacctcggggcccaggtgagtcccgcgccggaccagctgcaaggcctcccgagccaacggccgagagagcgcatagtgtggacccaagagacgcttggatgctgtttgttagacagagcgataaaggggtgaacgggaagaagcgttccaggggaaaggctaagaagctcaagtttgggttgccagggccccctggcccccctggtccccagggtccgccgggcccaatcattcctccggaagctttgctaaaggagttccaactactcctgaagggcgccgttaggcagagagagagagctgaaccagaaccttgcacatgcgggccagcggggcctgtcgcagccagcctggcacctgttagcgctactgcaggcgaagacgacgatgatgtggttggagatgttctggctcttctggctgcccccctggcacccggaccgagagccccaagagtcgaagcagccttcctttgccgtttgcgtagagatgccctggtcgaaaggcgcgccctccacgagctcggggtctattatctgcctgatgcggaaggagcatttcggagaggtccgggtcttaacctgacctcagggcagtaccgcgccccagtggccgggttttacgccctggccgccaccctacacgtcgcacttggagagcctcccaggcgggggcctccgcgccctcgggatcacctccggctgttgatctgtatccagagtcgctgtcagaggaacgcttccctcgaggccatcatgggcctggagagttcctctgagctgttcacaattagcgtcaatggggtcttgtacctccagatgggtcagtggacctctgtgtttctcgataatgcctccgggtgcagcctgacagtgcggtctggctctcactttagcgccgtgctcctgggtgtctag

SEQ ID NO: 6721 - DNA, 2685 bp, Artificial Sequence
  Description of Artificial Sequence: Synthetic coding sequence
atgtccttgccgaggtgctgcccgcaccctcttaggcccgaagggtctggggcaatgggacctgaagccctctccagcctgttgcttctgctcttggttgcctccggtgatgctgatatgaaggggcactttgatccggcaaagtgtcgatatgccctcggaatgcaggacagaaccattccagactctgacatttccgcctcctcttcctggagcgactctactgctgctcggcattctcgcctggaatccagtgacggcgatggcgcttggtgtcccgcaggttcggttttccctaaggaagaggaatacctacaggtagatctccagaggttacacctggtcgctctggttgggacgcaggggcgtcacgccggcggactgggcaaggaattttctcgatcttatcgactgcggtattctcgggatggaagacggtggatgggttggaaggacaggtgggggcaggaggtgataagcggaaatgaggatcctgaaggagtcgtcctgaaagacctcggcccgccaatggtggccaggcttgttagattctatcctagagcagatagggttatgtcggtgtgtctccgggttgagctgtatgggtgtctatggagagacggactgctgagctacactgcacccgttggccagacaatgtatttatctgaagcagtttatctgaacgacagcacttacgacggtcataccgtgggggggctgcagtacggcggccttgggcagctagcggatggggtggtcgggctggatgactttcgtaagtcccaagagctgagggtgtggcctggctacgattacgtaggatggtccaatcatagcttttcatccggatacgtggagatggagttcgagtttgaccggctgcgggcttttcaagcgatgcaggtccattgtaataacatgcacactctgggcgctcgacttcccggcggtgtggaatgtaggttcagacgcggccctgcgatggcctgggagggcgagcccatgcgccataatcttggcggcaatctgggagacccacgcgcacgggctgtcagtgtacctttggggggccgagtggcacgcttccttcagtgtagattcctctttgccgggccttggctgctattttctgagatctctttcatctctgacgtcgtgaataattcaagcccagcccttggcggaacgttcccccccgcgccctggtggccaccaggacccccgccaaccaacttcagttctctggagttggaaccacgcggccagcagcctgttgctaaggcggaggggtcaccaaccgcaatcctgatcggctgccttgtcgccatcatcctgcttctactgctcatcattgctttgatgctctggaggctccactggcgtagactcctttccaaagcagaacgtcgagtgttggaagaagagctaactgttcaccttagtgtccccggagacaccatattgatcaacaatcgacccgggccaagagaacctcctccctatcaggagccccgcccccggggcaatcccccccactctgccccatgcgttccaaacggctctgcttactcaggtgactacatggagccggagaaacctggggcgcccttattgcccccccctccccaaaacagtgtgcctcactacgcggaggccgatatcgtgaccctgcagggcgtgaccgggggaaatacctatgcagttccagcactgccacccggggccgtcggggacggccctccacgcgtcgacttcccacggagtaggcttcgattcaaagagaaacttggggaaggacaatttggagaagtgcacctgtgtgaggtcgattcaccacaagaccttgtatccctggacttccccctgaatgtgcgtaaggggcacccactgctcgtcgcagtgaaaatcctgcggccagacgctaccaaaaacgctcgaaatgacttcttgaaggaggtgaagattatgtccagactgaaggatccaaacataataaggctgcttggggtttgtgttcaggacgaccccctgtgcatgattacagactacatggagaacggagatcttaatcaatttctgtcagcccatcagttagaagacaaggcggctgaaggagccccaggcgatggtcaggctgcccagggaccgaccatttcataccccatgctccttcatgttgctgcacagattgcaagtggaatgcggtatctcgccacactcaatttcgttcacagggatctggctactaggaactgcctggttggcgagaacttcacaattaagatcgctgatttcggcatgtctcggaatctatacgcaggtgactactacagggtgcagggaagagccgtccttccaattcgctggatggcatgggagtgcatacttatggggaagtttacgactgccagtgacgtctgggcctttggcgtgacactgtgggaagtgctcatgttgtgcagagctcaaccattcggccaactgaccgatgagcaggtgatcgagaatgcaggcgagttcttccgcgatcagggccgccaggtgtacctgagccgacctccagcgtgcccccagggcttgtacgaactgatgctgaggtgctggagtagggagtctgagcaaagacccccattctcccagttacatcggttcctcgcagaggatgcactgaatacagtttag

SEQ ID NO: 6722 - DNA, 2685 bp, Artificial Sequence
  Description of Artificial Sequence: Synthetic coding sequence
atgtcactccctcggtgctgtcctcaccccctgaggccagaggggtccggagcaatgggccccgaagccctttccagtcttcttctgctgctgctggtggcctctggcgacgcagatatgaagggccattttgacccagccaagtgtcggtatgcgctggggatgcaggacaggacgatcccagactctgacattagcgcctcctcatcctggtctgactcaacagcagcccgacactctagactggagtctagcgacggtgacggagcttggtgcccggccggctcggtctttcccaaggaagaggaatacttgcaagtagaccttcagcgcctgcacctcgtcgccttagttggcacacaaggccgtcacgcgggtggtctggggaaagagttttcacgctcttatagactgaggtacagccgagacgggaggcgttggatgggatggaaagaccggtgggggcaggaggtcataagtgggaatgaggaccccgaaggagtcgtgttaaaggacctgggacctcccatggttgcacgactggttagattctacccaagagccgatagggtcatgagcgtctgcctcagggttgaactgtatgggtgtctgtggagagatggcttgttgtcctatacagctcccgtgggccaaaccatgtatttgtctgaagcagtctatttaaacgactcgacttacgacggccacaccgtgggaggcctccagtatgggggattaggtcaactggccgatggagtggtcggcctggacgatttccgcaagtcccaggagctgagagtgtggcccggctacgattacgttgggtggagcaaccacagcttctcatcaggatacgtcgaaatggaattcgaattcgatagactgcgcgcatttcaagcaatgcaggttcactgtaacaacatgcacaccctgggggctcgactgcccggcggagtggagtgtcgctttcgacggggaccggccatggcctgggaaggggaacccatgcgacacaacctggggggaaacttgggggacccaagagccagggccgtcagtgtgcctctgggcggcagagtcgccagattccttcagtgtaggttcctgtttgcgggcccatggctcctgttttccgaaattagcttcatctctgacgttgttaataactcctcccctgctttgggaggcactttcccacctgccccatggtggcctcccggccccccaccaactaactttagctccctcgagctcgaaccaagaggtcagcaacccgtcgctaaagccgagggttccccaacagctatcctcattggctgcctggtggccatcatccttctgttactgctgattattgccctgatgctgtggaggttacattggaggcggctgctatctaaggccgaaaggagggtgttggaagaggagctcactgtgcatctctcagtccccggtgatacaatcctgataaacaatcggcctggcccacgcgagcctcctccctaccaggagccacgcccgcgtgggaacccgccccactcggccccttgcgttccgaatggttcagcctactccggagactatatggaacccgaaaagcccggagccccattgctccccccacctccacagaactcggtgccccattacgccgaagccgacatcgttacccttcaaggagtgactggaggcaacacttacgcggtgcccgccctgccccctggggccgtgggagatggacccccaagggtagactttcccaggagtagactgaggttcaaagagaagctgggagaggggcagttcggggaggtgcacctgtgtgaggtagacagccctcaggatctcgtctctttggactttcccctgaacgtacggaagggccacccccttctggtggccgttaagatacttaggcccgatgctaccaagaatgcccgtaatgacttcctcaaggaggtgaaaattatgtccagacttaaagatccaaacatcatccggctgctgggcgtgtgcgtgcaggacgacccattatgtatgattaccgactacatggagaacggagacctgaatcaatttttatccgcccatcagctggaagacaaagcagccgaaggagctccaggggacggtcaggcagctcaaggaccgaccatttcctacccaatgttgcttcacgttgccgctcaaattgctagcgggatgagatacttagccaccctgaacttcgtccaccgggaccttgcgacccgcaattgcctggtgggcgaaaatttcacgatcaagatcgccgacttcggaatgtctaggaacctctatgccggggactactacagagttcaggggagagcagtgctacctattagatggatggcctgggagtgcatcttaatgggtaaattcactactgcttctgacgtctgggcattcggggtaaccctgtgggaggtgttaatgctgtgccgagctcagcccttcggccagctgaccgatgagcaggtaatagaaaatgctggcgaattctttagagatcaggggcggcaggtgtatctgagcagaccgccagcttgtccccagggcctgtatgagctcatgctaagatgctggagcagggagtcagagcagaggccgccctttagccagttacaccggtttcttgccgaagatgcccttaatacagtctag

SEQ ID NO: 6723 - DNA, 2886 bp, Artificial Sequence
  Description of Artificial Sequence: Synthetic coding sequence
atgttgttgctactgcttctcgctcccctgttccttagaccaccaggcgcagggggcgcacaaacacccaacgctacatccgagggatgccaaattatccacccgccttgggaggggggcattagataccgcgggctcactagggatcaggtgaaggccatcaacttcctgcccgtggattacgagatagagtatgtttgccgtggtgagcgcgaggtggtggggcctaaagtaagaaaatgcctggctaacggtagctggacggatatggacaccccaagccggtgcgtgcgcatttgttctaaatcttaccttaccctagagaacgggaaggtgttcctgaccggtggagatctacccgccctggacggggctcgggtagatttcaggtgcgaccctgatttccatcttgtgggctcttcacggtccatctgctcacagggacagtggagtaccccaaaaccccattgccaagtcaatcgtactcctcattcagaacgcagggcagtatatatcggcgcccttttccctatgtcaggggggtggcccggcggccaggcttgccaaccagcagtcgagatggcactggaggatgtgaactccaggcgcgacatcctccctgattacgaacttaagttaatccatcacgatagcaagtgcgatcccggccaggctaccaaatacctgtatgaattgctctacaacgatccaattaaaatcatactgatgcctgggtgctcaagcgtgagcacgttagtggcagaggccgcacgcatgtggaacttgatcgtcttgagttacggctcatcctccccagcattatccaatcggcaacgatttccaactttcttccgcacacacccaagcgcaacattacacaacccaactagggtgaagttgtttgagaaatgggggtggaagaaaatagccactatccaacagaccacagaggttttcacttcaacccttgacgatctagaggaacgcgtgaaagaagccggcatcgagataacattcaggcagtcattcttctcagatccagccgtgccagtgaaaaacctgaaacggcaggacgctcgaatcattgtaggcctattctatgaaactgaggcccgcaaagttttttgtgaagtttataaagaacggctgtttggtaaaaaatacgtgtggtttctcattggctggtacgccgataattggtttaagatttacgacccctcaataaactgcactgtcgatgagatgactgaggccgtcgagggacacattactacggagatcgtgatgcttaaccccgcaaatacacgctctatcagtaatatgacgtcccaggaatttgttgaaaaactgacaaagcggctgaaacgacacccagaggaaacgggagggtttcaggaggctcccctggcttacgacgccatctgggctcttgcgttagccctcaacaagaccagcggcggagggggccgcagcggagttagactagaagattttaattataacaatcagacaatcacagatcaaatctaccgagccatgaacagcagcagcttcgaaggggttagcgggcatgtggtgtttgatgccagcggttcaagaatggcttggacactaatcgagcagctccagggaggtagttacaagaaaattggctactacgactctaccaaggatgacctgtcctggagcaagactgacaaatggatcggcgggtccccgcctgcagatcaaaccctggtcattaagactttccgttttctgtctcagaaattgttcattagcgtgagtgttttgtcaagtctgggcatcgttctcgctgtggtctgtttgagttttaacatctacaatagccatgtgcggtatatccagaattcacaaccaaatctgaataacttaacagccgtgggatgtagtcttgccttggctgcggtctttccgttgggacttgatgggtaccacataggccgcaaccaattcccattcgtgtgtcaagctagactttggctcctgggactggggttttctcttgggtatggctccatgttcacaaaaatttggtgggtgcacactgtctttaccaaaaaagaggaaaagaaggagtggagaaagaccctagagccgtggaaactttacgccactgtaggactgcttgttggcatggatgtgctgacattagcgatttggcagattgttgatccattacatcgtacgattgagacctttgccaaggaggaaccgaaagaggatatagacgtcagtattctgcctcagcttgagcactgtagctcccgaaagatgaatacttggctcgggattttttatggctacaagggacttctcttgctgcttggcatattcttagcctatgagaccaaatcggtgtcaacagagaagattaacgaccaccgggcagtaggcatggctatttataacgtcgctgtcctgtgtttaattactgcccccgtgaccatgattctctccagccagcaggatgccgctttcgcctttgcttccctcgcgatcgtgttttcaagctacatcacactcgtggtcctgttcgtccctaaaatgagaaggttaattactaggggagaatggcaatcagaggcgcaggacacaatgaagacaggtagcagtactaacaacaatgaggaagagaaatcacgccttttagagaaggagaacagggagctggagaaaatcattgcagaaaaagaggaacgggtgtccgagctcagacaccaattgcagtcccggcagcagctacgttcaagacgccaccctccgactccacctgagccatcgggtgggttgcctcgcggcccacccgaacctccagatcgcctctcatgcgacggttccagagtgcatcttctgtataagtag

SEQ ID NO: 6724 - DNA, 2559 bp, Artificial Sequence
  Description of Artificial Sequence: Synthetic coding sequence
atgctgcccactgaggtgccacaatcacacccgggtccttcagcactgctgttgctacagcttctcctgccgcctacttctgctttcttccctaatatctggtccctgctcgctgctcctggttctattactcatcaggacctgactgaggaggctgcattgaacgtcaccttacagctcttcctggaacagcctccgccaggacgaccacctctgaggttagaggattttctgggccggactttactagcggacgatctgttcgccgcctacttcggcccaggatcctccaggcggtttcgggctgctctgggggaagtctccagagcgaacgctgcacaggacttcttgcccacttcacgcaatgatcccgacctgcacttcgacgcagaaaggctcggccagggcagagcgaggctcgtgggagcactcagagaaactgtggtggccgcccgggcactagaccataccctggctcgccagaggcttggcgctgcactccatgccctccaggatttctacagccacagcaattgggtggaattgggcgagcagcagccacacccacatctcctctggccccgacaggagcttcagaacttagctcaggtagctgaccctacgtgctcagattgtgaggagctgtcatgtccccgcaattggctgggcttcaccctgctaaccagcggctatttcggaacccatccaccaaagccccccggtaaatgctcccacggagggcacttcgatagatcctcatcccagccccctcgtggtggtatcaacaaggattccacctctcctggattcagtccccatcacatgttacacctccaggccgccaagttagcactcctggcctctattcaggctttttctttactgaggtctagacttggcgatcgggatttttctagactcctggatattactccagccagttcactcagctttgtgctggatacaacagggtcgatgggcgaggagataaacgcagccaaaattcaagcaagacacctggtggaacagcgccgcggatccccgatggaaccagtacactatgtactggtgcctttccacgaccctgggttcgggcccgtgttcacgacttctgaccctgattccttttggcagcagctcaatgagattcatgctctgggcggcggagacgagcccgaaatgtgtttaagtgccctacagctggcacttctacacacaccgccactaagcgatattttcgtgtttactgacgccagtcccaaagacgccttcttgaccaaccaggtggagtctctcacccaggagcgccgatgcagggtcacattccttgtgaccgaggatacttctagagtgcagggccgcgccagacgggagattctgagtcctctgcgctttgaaccatataaagctgtggcactggcttcggggggggaggtgatcttcactaaagatcagcacatcagagatgtcgctgctatagtgggggagtccatggcagcactcgttactttacccctggacccccctgtggttgttccaggccaacccctcgtgtttagtgtcgatggattgttgcagaagatcaccgtgcgcatacacggcgacatctcttcgttttggataaaaaaccctgccggagtctcacaaggccaagaggaaggtggcggcccccttgggcatactcgccgctttggacagttttggatggtgacaatggatgacccaccacagacaggcacatgggaaattcaggtgacggctgaggacactccaggagtgcgtgttcaagcgcagaccagtttggactttctgttccactttgggatccctatggaagacggtccgcaccccggcttgtatccgcttactcaacccgtggccgggctgcagacccagttactggtagaggtgacggggcttggatctagagccaaccctggcgatccacagccccatttcagtcacgttattttgcgaggcgtccccgagggagctgagctgggtcaggtgcctttggaaccagtgggcccacctgaaagaggccttctcgctgcctcgttgtctccaacgctgctttccaccccccggcctttctctctagagctgatcgggcaggacgccgccggacggaggttgcaccgagccgcccctcagccgtctacggtggtcccagtacttctggagctaagcggcccctcaggcttcctcgcccctgggagcaaggttccactttccctgcgaattgcatcgttttccggcccgcaggatctcgatctgaggacattcgttaatccttccttcagcttaacttcaaacctgagtagggcccatctggaactgaacgagagtgcatgggggcggctgtggctggaagttcccgacagtgcagctcccgatagtgtggtgatggtgacagtaaccgccggcggacgcgaagcgaaccctgtgcctccaacacacgcatttctgcggcttctcgtgtcggcccctgccccccaggtcagaaatcactactttccatcgcaggggccagcccaccacccctacagactgatttag

SEQ ID NO: 6725 - DNA, 756 bp, Artificial Sequence
  Description of Artificial Sequence: Synthetic coding sequence
atgccccacctagcatctcttttcacggcgtctagccggtgctgtccccaccctcttagaccagaagggagtggtgccatgggccccgaggccttatccagcctgcttctcttactgctggtggcaagcggggacgcagacatgaaagggcacttcgacccagccaaatgtcgatacgctcttggaatgcaggacaggaccatcccagattccgacatcagcgcctcctcatcctggtcagattcaactgccgcccgacacagtcgcctcgagagctcggacggcgatggcgcatggtgcccagccggttctgttttcccaaaagaggaagagtacctccaggtggacctccagcgattacacctggtcgccttggtgggaacacaggggcgccacgccggaggtctggggaaggagttctcgcgaagttacaggctgcgttattctcgcgatgggagacgatggatgggttggaaggacaggtggggccaggaagtgattagtggtaacgaggacccagagggcgtcgtgctcaaagaccttggcccaccaatggtggctcgcttagttcggttttacccccgtgctgatcgggttatgagtgtatgtctgagagtagaactatatggctgcttgtggcgcggggagtggttgagctttctcggaatctgtttcctgtcaaggggactggagggcggcgaatgcggtgaatgggctagccggataccctcccccgccggcaagctgtcgctctag

SEQ ID NO: 6726 - DNA, 726 bp, Artificial Sequence
  Description of Artificial Sequence: Synthetic coding sequence
atgaagttcatacttctctgggcccttcttaatctgactgtggctctggcgttcaatccagattataccgtgagttccacgcccccgtacctggtctatttaaagagcgactacctcccctgcgcgggcgtcctgatacaccctctttgggtgatcaccgcagcccattgcaacctgccgaagctgagagttattcttggcgtgactatccctgccgactccaacgaaaaacacctgcaggtgatcggctacgagaaaatgatccatcaccctcacttctctgttacgtcaatcgatcatgatatcatgctaatcaagctgaaaaccgaggccgagcttaacgactatgtgaagctcgccaatttgccctatcaaaccatcagtgaaaacaccatgtgttctgtgtctacctggagctacaacgtatgtgacatttataaagagccggattcccttcagacagtgaatatctccgtcatcagcaaacctcagtgtcgggacgcctacaagacatacaacatcactgaaaacatgctctgcgtggggattgtccccgggaggcgccagccgtgtaaggaggtgagtgctgcccctgcaatctgcaacggcatgctgcagggcatactcagcttcgcagatggttgcgtcctgagggctgatgtcggcatatatgccaaaatcttctactatattccttggattgagaatgttatccagaacaattag

SEQ ID NO: 6727 - DNA, 1536 bp, Artificial Sequence
  Description of Artificial Sequence: Synthetic coding sequence
atggccaaaggcctgtcagtacagaacgacaagcacccgggctaccagccagcattgctcctgtccccgggcgcaccgctgttcgcagacggaccagcctatgcactcttgcacctgctgctgcacgagggcaaagctgagatggcagaccaggccgccgcatggctgaccagacagggctcctttcagggcggcttccgcagtacgcaggacaccgttattgccctggacgccctcagcgcttactggatagcatctcacaccaccgaggaacgggggctgaatgtgactctatccagtaccggccgcaatggctttaagtcacacgctctgcagcttaataaccgtcaaattcgaggcttggaagaggagctgcagttttccctggggtctaaaatcaatgtgaaggtgggtgggaactcaaaaggcacattgaaggtccttcggacgtacaacgttctcgacatgaagaacaccacatgccaggatctgcagatcgaggtcaccgtcaagggacacgtcgagtacacgatggaggccaatgaagattacgaggactacgagtatgatgagctcccagcgaaggatgatcctgacgccccactgcaacctgtgaccccattgcaactcttcgaagggcggcgaaacaggcgcaggagagaggcccctaaggtagtggaggaacaggagagtagagttcactacaccgtgtgtatttggcgcaacggcaaggtcggcctgtccggcatggccatagctgacgttactctgctcagcggcttccacgcactgcgagcagatctggagaagttgacctcactctcagatcgttatgtatcccatttcgaaacagaagggccacatgtcctgttgtattttgattcagtgccaacgtcccgagagtgtgttggttttgaggctgtacaggaggtaccggttgggctggtacagcctgccagtgcgaccctttacgattactataatcctgaaagaagatgttctgtcttttacggcgcgccaagtaagtcccggctcctagccactctgtgttccgctgaggtatgccagtgtgccgaggggaagtgccctcgccaaaggcgggccctcgagcggggcttgcaagacgaggacggctatcggatgaaatttgcatgttactaccctagagtggagtatgggttccaagtgaaggttctccgcgaagactcccgggctgccttcaggctgttcgaaaccaaaatcacccaagtgctccattttacgaaggacgtcaaagccgccgccaatcaaatgcgtaatttcttggtacgcgcctcttgtcgtctgagacttgagcctggcaaagagtatcttatcatgggactcgatggcgctacgtatgacctggaaggacaccctcaatatctactggatagcaatagctggatcgaggagatgccctccgaacgcctgtgcagatcaactaggcagagggctgcttgcgctcagctaaacgattttcttcaggagtatgggacgcagggctgccaggtatag

SEQ ID NO: 6728 - DNA, 2067 bp, Artificial Sequence
  Description of Artificial Sequence: Synthetic coding sequence
atgctcccgaccgaggtgcctcagtcacatcctggcccctcagctctgctccttctccagctcctgcttccaccaacatcagcgttcttccccaatatatggagcctgctggcagccccgggaagcattactcatcaggatctgacagaagaagctgcactcaatgtgacactccagttgtttctagaacaaccccctccggggagacccccgctccggcttgaggatttcctagggaggacacttttggcagatgatttgttcgctgcctacttcggtcctgggtcttcaagacgcttccgggccgccctcggagaagttagccgggcaaacgctgctcaggactttttaccgaccagtcgtaacgaccctgacttgcattttgatgccgaaagactcggtcaggggagagcacgtctggtgggtgccttgcgggaaacggtggtagcggcccgtgcattagaccacaccctcgcgcggcagcggctgggggctgccctccacgcccttcaggatttctacagccattctaactgggtggaactgggggaacagcagccccaccctcacctcctctggccgcgccaagaattgcagaacctggcccaggtggctgacccaacatgctctgactgtgaggaactttcctgccctagaaattggctaggcttcaccttgctcacatctggctacttcggtactcacccccccaaacctccaggcaagtgtagccacggggggcactttgatcgttcatccagccagcccccgcgaggcggaattaacaaagattccacctcccctggctttagcccacaccatatgctccaccttcaggcagcaaagctcgcgctcctggcttcaatccaagctttctcactccttcgcagcagattgggcgaccgagatttttcacggcttctggacatcaccccagcctcctcattgtctttcgtgttggacaccacaggatccatgggggaggaaataaatgcagctaaaatccaggcgaggcaccttgtggaacaaaggcgcggttcccccatggaaccagtgcactacgttttagtgccttttcatgaccctgggttcggaccagtgttcactacaagcgacccagacagtttctggcaacagctgaatgaaatacatgcattggggggaggtgacgagccggagatgtgtctgtctgctctgcaattggccttgctgcatacaccgcctctatcagatatattcgtgtttaccgacgccagtcccaaggacgcctttcttactaaccaggttgagtcactgacacaggagcgaaggtgtcgggtcaccttcctcgtgaccgaagacacttcccgtgtccagggtcgcgcaagaagagaaattctgagcccactgagattcgaaccctacaaggcagtggctcttgcttctggcggtgaggtgatcttcacaaaagaccagcacattcgagacgttgccgctattgtgggcgagtcaatggccgccctggttactctccctctggatccacccgtggtggtgcccggtcaaccactggtcttttcagtggacgggctgctccagaagataactgtgcgcattcatggggatatttccagtttttggatcaagaatccagcaggtgtctcacagggacaggaagaagggggaggccccctcggacacacaagaaggttcgggcagttctggatggtgactatggacgacccgccccagacggggacgtgggaaatacaggtgacagcggaggacacgccaggagtcagagtccaggcacaaacaagcctcgactttctgtttcatttcggcatccctatggaggacggacctcatcctgggttataccctctcacccagcccgtggctggactgcaaacccagctgctggtcgaaagccaatcctggggatcatctgctgctttcttgccaagacacccctcccgtggtccaagagggtgtagaacacgaccgggcgccctgggagcacggggaacctctggggctaggtctccacgctcattggccgtggctcacgccgctgtgcacccatag

SEQ ID NO: 6729 - DNA, 2559 bp, Artificial Sequence
  Description of Artificial Sequence: Synthetic coding sequence
atgctcccgacagaggtcccccagtcgcaccccggtccttccgctctgctgctgctgcaacttctcctgcctcccacctctgctttcttccccaatatttggtcactgctggctgcacctggaagtattacacaccaggacctcaccgaggaggctgccctgaatgtgactctgcagctatttctggagcagcccccacccggcaggccacccctgagactggaggacttcctcggaaggactttattagccgacgacctctttgctgcttatttcggtccaggttcatcgcgtcggtttagggccgcattaggggaggtcagtagggctaatgccgcacaggactttctgccgacctccagaaacgatccagaccttcactttgacgcagagcgcttggggcagggtagagcccgtctggtgggggcccttcgagaaaccgtcgtcgcggcccgcgccctcgaccatactctggcccgccagagactgggagcagctctgcacgcactgcaggacttttactcccactcaaattgggtggagttaggcgaacagcagcctcacccacatcttctgtggccacgtcaggagctccagaacctagcccaagtggccgacccaacctgcagcgactgcgaggagctttcctgcccaaggaactggttaggcttcactttgttgactagtggctacttcggtacgcacccgccgaagccccctggaaagtgctcacacggcggacatttcgatcggtcgagctcccagccccctcgcgggggtattaataaagattccaccagcccgggctttagtccccaccacatgctgcaccttcaagctgcaaagctggccctgctggcctctatccaggcctttagcctgctaaggtcgcgcctgggtgaccgcgacttttctaggctattagacatcacacccgccagtagcctgagctttgtcctcgacactacagggagcatgggcgaggaaattaatgccgccaagatacaagcacggcacctggtggaacagaggaggggctccccaatggagccggtgcattatgtactggtgccattccacgatccgggatttggtcccgtgtttacaacgtcagatcctgactctttctggcagcagctcaacgagattcacgccctgggtggaggagatgaaccggaaatgtgtctctctgctttgcaactcgctttgctccatacaccacctctgtccgacatcttcgtttttacagacgcttcacccaaggacgcattcctgacaaatcaggtggagagccttacacaggaaagacgctgccgcgtgaccttcctggtcacggaggacactagtcgggtacagggtcgagctaggagagagatactatctcctctacggtttgaaccctataaagctgtggccttggcgtccggaggtgaggtgatctttaccaaggaccagcatatccgcgatgtggcagcaattgtgggtgagagtatggctgcccttgtcaccctgccattggatccccccgtagttgtccccggacagcctttggtgttttccgtcgacggcctcctgcagaagattaccgttagaatacatggggacatctccagcttttggatcaaaaatccggcaggcgtttcccagggccaagaagagggcgggggtccacttggacacaccagacggttcgggcagttctggatggtgacgatggatgatccccctcagacagggacctgggagattcaggtgactgctgaggacacccccggcgtccgtgttcaggctcagacgtccttagacttcctgttccactttggcatccccatggaggatggccctcaccccgggctgtatccgctcacacagccggttgctgggctgcaaacccagcttctcgtcgaggtcacaggattaggctcacgggcaaatccaggcgatccgcagccccacttttcccacgtgatactccgcggtgtgcctgaaggagctgaattaggtcaggtacctcttgaacctgtagggcctcccgaaaggggactgttagccgccagcctctctccaactctcctttccactccccgcccattttccctcgagctaatcggacaggacgccgccggcagacgcctccatagagccgccccacagccctcaacagtggtgccggtgttgttagaacttagtggcccttctgggtttctggcgcctggtagtaaggttcccttgagcctcaggatcgcctcatttagtggacctcaggatctagatcttaggacctttgttaacccttccttctcattgacctcaaacctcagtcgggcccaccttgagctgaatgagtccgcgtggggcagactctggctggaggtgccggactcagccgctccagactcagtagtaatggtgaccgtgaccgcaggtggccgcgaagcaaaccctgtgcccccaacacatgcctttctcaggctattagtgtcagcacccgcgccccaggtgagaaaccactacttcccctcccagggacctgctcatcatccttacagactcatatag

SEQ ID NO: 6730 - DNA, 1737 bp, Artificial Sequence
  Description of Artificial Sequence: Synthetic coding sequence
atgttgctgcttctcttactcgctccactctttctgcggcctcctggcgccgggggcgcccagacacctaatgccacctccgaaggctgtcagatcattcaccctccgtgggagggaggaattcgatacagagggctgacaagggaccaggtgaaggctataaacttcctgcccgtcgattatgagattgaatacgtgtgtaggggcgaaagggaggtcgttggtcctaaggtcaggaagtgtctggccaatggcagttggaccgatatggataccccgtctcgttgtgttaggatatgcagcaagtcatacctgacactcgagaacggcaaagtgttccttactggcggcgatcttcctgcactggacggagcgagggtcgactttcgctgcgacccagactttcacctggtgggcagcagtaggtctatatgctctcagggccagtggtcaacccctaaacctcactgccaggttaatagaacgccacacagcgagcgcagagctgtatacatcggtgctctgttccctatgtctggtggatggcctggagggcaggcatgccaaccagccgttgagatggcactcgaggacgttaactctcggcgagacatcttgccagactacgagttaaagttgatacaccacgactctaaatgtgaccccggacaggccacaaaatacctatacgaactcctgtataacgatccaataaagatcattctgatgcctgggtgcagttctgtcagtaccctcgtggccgaagcggccagaatgtggaacctgattgtattatcttatggttcttcgagtcccgctctgagtaatcgtcagcgattccctacattttttcgtactcacccctcggccacactgcacaacccgacacgagtgaagctgttcgagaagtggggttggaagaaaattgccacgatccagcagactaccgaggtgttcacctcaacgctggacgacttggaggagcgagttaaggaggcaggcatcgaaatcacattccggcagtcattcttttccgaccccgccgtgccagtgaagaacctgaagcgccaggatgcaagaattatcgttggcctattctacgagaccgaagctagaaaggtgttttgtgaggtctacaaagagagattatttggaaaaaagtatgtttggttcctgataggatggtacgccgataattggttcaagatctacgacccatctatcaattgcaccgtggacgagatgaccgaagccgtggagggtcacatcaccaccgagatcgtgatgcttaatccagcaaatactcggtcaataagcaacatgacttcacaggagtttgtggagaagctcactaaacgcctcaaaaggcaccctgaggagaccgggggttttcaggaggcacccctagcgtacgacgctatctgggcactggccctcgctctcaacaaaacatcagggggcgggggtagatccggcgtccggcttgaagattttaattacaacaatcagactattaccgaccaaatctacagggccatgaattccagttctttcgagggcgtgagcggtcacgttgtcttcgatgcatcaggtagccgtatggcctggaccctgatcgaacagctacagggggggtcgtacaaaaaaatcggctactacgattctacaaaagatgatttaagttggtctaaaaccgacaaatggattgtgatctcaaggacacattcccctacatag

SEQ ID NO: 6731 - DNA, 1326 bp, Artificial Sequence
  Description of Artificial Sequence: Synthetic coding sequence
atggagtttgagttcgatcgactgagagcattccaggccatgcaggttcactgtaacaatatgcataccttaggagctagactaccaggaggggtggaatgtagatttcgccggggccctgcaatggcctgggagggggagcccatgaggcacaacttggggggtaatctaggggatccacgcgctcgggcggtgtcggtgcctctgggggggagagtggctcggtttttacagtgtcgcttcctcttcgccggaccctggcttctgttctctgaaattagcttcatctcagacgtggtcaataactcgagtcctgcactcgggggcaccttcccacccgctccctggtggccgccgggcccgccacccaccaactttagcagcctcgagctggagcccaggggccagcagcccgtcgccaaggctgaggggtcccccactgctatcctgataggatgcctagtcgcaatcattttactccttctgctcatcatcgccctaatgctatggcgcctgcactggagaagactgctgagtaaagttctggagagccatccccgcacaaggagccccgggcttgtaggcattaggcccacccctttgcccgtcagccctatggctctgcggtgttgctcgcctatccagccaactgcgtcgttttggccccttacacctgttcccttagaagccagggcccccccgcacccacctggccctaacccacctacaccccgcggcgtcacaggcggaaatacatacgccgtgcctgcgttaccgcccggcgctgttggagatgggcctccacgtgtggatttccctcggagtagactgcgatttaaggaaaagttgggagagggacagttcggcgaagtccacttatgcgaagtggattcaccgcaagaccttgtgtcactcgatttcccactcaacgtacggaagggacaccccctgctggtcgccgtgaaaatccttcgcccggacgctactaaaaatgcacgcaacgacttccttaaagaagtcaaaattatgagcagacttaaggaccctaacataattcgactattaggagtgtgcgtgcaagatgaccccctgtgcatgatcacagattatatggagaacggtgacctgaaccagttcctaagcgcccaccagttggaggataaggcagcagaaggagcaccaggagacggccaagctgcccagggcccgactatttcatacccaatgctcctccacgtggccgctcaaatcgccagtggaatgcggtacctcgcgactcttaactttgtccacttctggggcgagaggcacaggttccttcactag

SEQ ID NO: 6732 - DNA, 2685 bp, Artificial Sequence
  Description of Artificial Sequence: Synthetic coding sequence
atgtcccttcctcggtgttgcccccaccccttaagacccgaggggtcgggggctatggggccagaggccttatcttcacttctcctcttgctgctggtcgccagcggggacgcagatatgaagggacacttcgacccagcaaagtgtagatatgcgttgggtatgcaagaccggaccatccccgatagcgacatctccgcttctagctcttggtccgactcaactgccgctaggcactcacgccttgagagctcagacggggacggtgcctggtgccctgcggggtccgtatttcccaaggaagaagaatacctgcaagtggacctgcaacgcctgcatctcgtcgccctcgtcggtacgcagggtcggcacgcaggtggtttaggaaaagaatttagcagaagttacagactgaggtattcccgcgacggtaggagatggatggggtggaaggacagatggggccaggaagtcatttctggaaatgaagaccctgagggggtggtgctgaaagatctgggccccccaatggtggccaggctcgtgagattttaccctcgagccgatagagtgatgagcgtgtgtctcagagtcgagctttacgggtgcctgtggcgcgacgggctgctcagctacactgctcccgtagggcaaaccatgtacctctccgaggctgtgtatttgaatgattctacatacgacgggcacacggtcggaggtttacagtatgggggcctaggtcaactggccgatggtgttgttggactcgatgatttcaggaaaagtcaggagcttagagtctggcccggctatgactacgtaggctggagcaaccacagcttctcaagcgggtacgtggagatggaattcgagttcgaccgtctgagggcctttcaggccatgcaggtgcactgtaacaacatgcacacactgggcgcccggttgccagggggagtcgagtgtagattcaggcgtgggccagctatggcctgggaaggtgaaccaatgcgccacaacttggggggcaatctcggcgaccctagagctcgcgccgtatctgttccactggggggacgtgtggcccggttcttgcagtgccggtttctgtttgctgggccctggcttctgttctcggaaataagctttatcagcgacgtggttaacaattcttccccagccctgggaggtaccttcccacctgccccctggtggcctccaggacctcctcctaccaatttttcaagtctagagctggagcccagaggccagcaaccagttgcgaaggccgaaggctctccaaccgccatcttgattggttgtctggtggcaatcatcctgctactgctgttaatcatcgcccttatgctctggaggttgcattggcgtagacttttgtcaaaggcggagcgccgggtacttgaggaagaactcaccgtccacctaagcgtacccggggataccattttgatcaacaatagacctgggccccgagagccgcctccctaccaggaaccgcgaccaagggggaaccccccccactcagcaccttgcgtccccaacgggtcggcttattccggagattacatggaacccgaaaaaccaggcgcacccttgttgccaccgccacctcaaaacagtgtgccacactatgctgaggccgatattgtcaccctgcagggcgtgactggaggtaatacatacgccgttccagccctacctcccggggccgtgggggacggacctccccgggtggatttcccacgcagtagactgagatttaaagagaaactaggggaagggcaattcggggaagtacacctctgcgaagtggattccccccaggacctggtgtcactggattttcctttgaacgttaggaagggccaccctctgctcgtcgctgtgaagatactgaggccagatgcgactaaaaatgctaggaacgatttcttgaaggaggtgaaaatcatgagcaggctgaaggatcctaacatcatacgactgttgggggtttgcgtgcaggatgaccctttgtgcatgatcactgattatatggaaaatggcgatctcaatcagtttctttccgcccaccagctcgaagataaagcggctgagggcgcccccggagacggccaggccgctcaggggcccaccatcagctacccgatgctccttcacgtggccgcacaaatagccagcggcatgaggtacctcgcaacactgaacttcgtgcatcgggatctggctaccagaaactgtttggttggggaaaatttcactataaagatcgcagattttggcatgtccaggaacttgtacgcgggcgactactacagggtccagggaagggctgttctgcctattcggtggatggcttgggaatgcatactgatgggcaaattcacaaccgcgagtgacgtgtgggccttcggggtgacgctttgggaggtgcttatgttgtgtcgcgcccaaccatttggacagttgaccgacgaacaggtgattgagaacgccggcgaattctttcgggaccagggaagacaggtttacctatctcgcccacctgcttgcccgcagggactttacgagctgatgctgcgctgctggtccagggagtctgaacagcggcccccattcagccagctacatcgatttctcgctgaagacgccctgaacaccgtgtag

SEQ ID NO: 6733 - DNA, 216 bp, Artificial Sequence
  Description of Artificial Sequence: Synthetic coding sequence
atgcccgcgggcgttccgatgagtacctatctcaagatgtttgcggccagtcttctggctatgtgcgccggtgcagaggtggtgcacaggtactaccggcccgacttaacaatccccgaaatcccccccaagcggggcgagctgaagaccgaattacttggccttaaagagaggaaacataaaccacaggtttcccaacaagaagagttaaaatag

SEQ ID NO: 6734 - DNA, 2760 bp, Artificial Sequence
  Description of Artificial Sequence: Synthetic coding sequence
atgggcccagaggcgctgagctcgctgctgttgctgcttctagtggcttccggagatgccgacatgaagggccactttgaccccgctaaatgtagatacgccctcggcatgcaagatcgaacgatcccagatagcgatatctcagcctcaagctcgtggtcagacagcactgccgcgaggcacagcaggctggagtcctctgacggggacggagcatggtgtccggcaggcagtgtgtttcccaaagaagaagaatacctgcaggtggatctgcaaaggctgcacctggtcgccctagtcggaactcaggggagacacgcaggcggcttaggcaaggaattcagtagatcataccgtcttaggtactcccgggacggtcggcggtggatgggatggaaggaccggtgggggcaggaggttatatccgggaatgaagaccccgagggcgtggtgctgaaggatctcggaccacccatggttgccagactggtgcgcttctaccctcgggccgaccgggtcatgtccgtttgtctacgcgtggagctttacggctgtctttggcgggacggacttctgagttacaccgcaccggttgggcagacaatgtacttgtctgaggccgtctacctcaacgatagtacctacgatggccacactgttggtggtctccaatatggaggcctggggcaactggctgatggggtggtgggattagatgactttcgaaagagccaggagctgagggtctggccaggctacgattatgtgggttggtcaaatcacagtttctcgtcaggctatgtggagatggagttcgagttcgacaggctgcgggccttccaggccatgcaggtgcattgtaacaacatgcacacactcggcgccaggctccctggcggtgtggagtgcaggttcagacgtggacctgccatggcatgggaaggcgaacccatgaggcacaatctcggggggaatcttggtgatccccgggctagggccgtgtctgtgcccttgggcggaagagtcgcaagattcctccagtgtcgtttcctgttcgcagggccatggcttttgttttcagagatctcattcatcagcgacgtggtgaacaactcgagccccgccttggggggcactttcccacctgccccttggtggcctcctggcccgccccccactaactttagtagccttgagctggaacctcggggacaacagcccgtggctaaggccgaaggatctcccacggcaatactgatcggttgcctggtggccatcatacttctgttgctcctgataattgcactaatgttatggcgtcttcactggcgccggctgttgtccaaggcagaacggcgcgtgctggaagaagaactgaccgtccatctctccgtacctggggatactatcttaatcaacaacaggccaggcccaagggaaccccccccatatcaagagccgcgtccacgcggcaatccacctcatagcgctccttgcgtaccgaatggttccgctctccttctgagcaatcctgcataccggctgctgctcgcaacttatgcacgtcctccccgtggtcccggtcccccaacacccgcttgggctaaaccaaccaacacccaggcatactccggcgactacatggagcctgaaaagcccggcgccccactgctgcctccccctccccagaactccgtgcctcattatgcagaagccgacatcgtgaccctgcagggcgtgactggaggtaatacctacgccgtcccggctcttccacccggggccgtcggcgatgggcccccacgagttgatttccctcggtcacggctgcgcttcaaagagaaacttggggagggccagttcggagaagtccacctctgtgaggtggactctccacaggacctggtgagcctggacttccctctcaacgtcaggaagggccaccctctgctggtcgctgtcaagattttaaggccagacgccactaagaatgcttccttttcgctgttttccaggaacgattttctgaaagaagtgaaaattatgtccagactcaaggaccctaacataatacggctgttgggtgtgtgcgtccaggatgaccccctctgcatgatcacagactacatggaaaatggggacctcaatcaatttctctcagctcatcaactggaggataaagccgccgaaggggctcctggcgacggccaagccgctcagggtccaactatctcataccctatgctcttgcacgttgctgcgcagatcgcgagcggcatgcgatatttggcaaccctgaactttgtgcaccgcgaccttgcaactaggaactgcctggttggggagaacttcacgattaagattgctgattttggtatgagccgaaatctctacgcgggcgactattatcgcgtgcaggggcgtgccgtgcttcccatcagatggatggcatgggagtgcatcctgatgggcaaattcacaactgcaagtgatgtttgggcctttggggttaccctgtgggaagttcttatgttgtgtcgcgctcagccttttggacagttgaccgatgagcaggtaattgagaatgccggggagttttttagagaccagggccgccaggtttatctttcgcggcccccggcctgcccccaaggcctctatgagctgatgttaaggtgttggtccagagagtcggaacagcgcccacccttctcacaactgcatcggtttctggcagaggatgctttgaatactgtttag

SEQ ID NO: 6735 - DNA, 447 bp, Artificial Sequence
  Description of Artificial Sequence: Synthetic coding sequence
atgcaaactttccctgtagccggcgcactggatcccgccattctcgacacctcttctcctcaggctctttacactgtactcctgatcgtgctggttatgatgtcactggtgtttggtaaattcgttccagtgaactgggagcctccccagccactgccgttccccaagtacctgcgctgctaccgctgtttgctcgaaaccaaagaactaggctgtctattgggatccgacatctgtttgaccccagccggctcatcctgcattacgcttcataagaagaactcaagtggttcggatgtcatggtgtctgattgtaggtcaaaagaacagatgtctgactgtagcaatactaggacttcaccagtcagcggattctggatattttcccagtactgtttcctggacttctgcaacgaccctcaaaatcgtggcctctataccccatag

SEQ ID NO: 6736 - DNA, 5097 bp, Artificial Sequence
  Description of Artificial Sequence: Synthetic coding sequence
atgcgtctgctctggggtctcatttgggcatcctctttttttacactgtctctgcagaagccaaggctgctgctatttagcccatctgtcgtgcatcttggagtaccactgtcggtcggcgttcagttgcaggacgtcccgagaggccaagttgtgaagggcagtgtgttcttgagaaaccctagccgcaacaatgtgccctgcagcccgaaagtggactttacgttaagcagtgagcgtgatttcgctctgctgagccttcaggtgcctctcaaagacgccaaatcttgcggacttcaccaactgctaaggggcccagaagtccaactcgtcgcccacagtccatggttgaaagatagcctctcacggaccaccaatatccaaggcatcaacctgttgttctcctctagacgtggtcatctcttcctgcaaacagatcagcctatctacaaccctggtcaacgggttagatacagggttttcgccctcgaccagaaaatgcgcccctcaaccgatacaatcaccgtgatggtcgaaaacagccacggattaagagtgcggaagaaagaagtgtatatgccttcatctatctttcaggatgactttgtaataccggatattagcgagcccggaacctggaagattagcgcacggttcagcgatggcctcgaatcaaactccagcacgcagttcgaggttaagaaatatgtcctgcctaatttcgaggttaaaattactccgggcaagccctatattttaaccgtgcctggtcacctggacgagatgcaacttgacatacaggctagatacatatacggcaagcccgttcagggggttgcctatgtcagattcggtcttttggacgaggatgggaagaaaacatttttccgtggccttgagagccaaacaaaactggtcaacgggcagtcccatatatccctgtcaaaagcagagttccaagacgcacttgaaaaacttaatatgggtattaccgatctgcagggcttgaggttgtatgtcgccgccgcgatcattgagtaccccggtggggagatggaagaggcagaattgacctcttggtactttgtgagcagccccttttctctggatctgtcaaagactaagcggcacctggtgcctggtgccccatttctcctgcaggcactcgtgcgcgagatgtctgggagtcctgcctcaggcatacccgttaaagtgagcgccacagtgtcgtcacccgggtcagtcccagaggtgcaggatattcaacagaacaccgatgggtctggtcaagtatcgatccccattatcattccacagacgatctctgaactccaattgtctgtcagcgcgggctcacctcatccagctatagctcggttaacagtcgctgcaccgccatcgggaggcccagggtttctgagtatcgagcgaccagattcacgcccccctagggttggcgatactttgaatttaaatctgcgggctgtgggtagtggcgccactttcagccactattactatatgatcctctctaggggccagattgtgttcatgaatcgagaacccaagaggaccctcacctccgtttccgttttcgtggaccatcaccttgccccgagcttctacttcgttgccttctattatcatggggatcaccctgtggccaacagcctccgggtcgatgtgcaggcgggcgcgtgcgaaggcaaactcgaactctctgtggatggtgcaaaacaatatcggaacggggaatccgtcaagcttcatttggaaacagactccctagccttagtagcattgggagcactggacacagcactctatgcagctggttctaagtctcataagccactgaatatgggcaaggtatttgaagccatgaattcctatgacctgggctgcggacccggggggggggactcagcactccaggtttttcaggctgctggactggcatttagtgatggcgaccaatggacactttcacgaaagcggctgtcctgtcccaaggaaaagaccacccggaagaaacggaacgttaattttcagaaggctataaacgagaagcttggtcagtacgccagtcccacagctaaacgttgctgtcaggatggtgtcactcggttgcctatgatgcggtcatgcgagcagcgggctgctcgggtacagcagcctgattgccgggagcccttcctgagctgttgccagtttgctgagtcccttcgcaaaaagtcacgggacaaaggccaggcaggcttgcaaagggctctggaaatactacaggaagaggaccttattgatgaagacgacatcccagtgagaagctttttcccggaaaactggctgtggagggtagaaacagtggacagatttcagatactgactctctggttgccagactcactgacgacttgggagatccacgggctgtccctctcaaagactaagggtctttgtgtcgctaccccagtgcagctgagggtcttcagagaatttcaccttcatctacgactgccaatgtccgttaggagatttgagcagctggagcttaggccagtgttgtataattatctggacaaaaatctgacagtttccgtgcatgtctccccggttgagggcctctgtctggcaggcgggggagggctcgcccagcaggtcctggtgccagccgggtccgctagaccggtcgccttcagcgtggtgccaactgccgcggctgccgtgtctctgaaggtagtggctcggggatccttcgagtttcccgtgggggatgctgtgagcaaagtactgcaaattgagaaggaaggggctattcatagggaggagctggtctatgagctgaatccattggaccaccgcggcagaacactcgaaattcctggcaattcagatccaaatatgattcctgacggggattttaacagttacgttagggtcacggcttcagacccattggatacattgggctccgaaggggctcttagccctggtggggtagccagtctcttgcgcctgccccgaggatgtggggagcagaccatgatttacttggcgccaaccctggccgccagccgctacctcgacaagaccgagcagtggtcaactctgcctccagagacaaaggaccacgctgtggatctgatccagaaggggtacatgaggatacagcagtttcgcaaggccgacggctcgtatgcagcatggttgtcacgtggcagttccacttggctgaccgccttcgtgctgaaggtgctgagtctcgcacaggagcaggtcggcggaagtcccgagaagctccaggaaacctctaattggctccttagccaacaacaggcagacggatcttttcaggatttgtcaccagtcattcataggtccatgcaggggggtctcgtcggcaatgatgagacagttgcgttgaccgcatttgttacaatcgctctgcaccacggcctggctgtgtttcaggatgaaggcgctgaacccctgaaacagagggtggaagctagcatttcaaaggccagtagcttcttaggggaaaaagcctccgccggcttactcggcgcacatgctgccgctattacagcatatgcactcacactcacaaaagcaccggctgatttaaggggcgtcgctcataacaacctgatggcaatggctcaggaaacaggcgacaatctgtattggggttctgtcactgggtcacagagtaatgcggtgagcccgacccccgcacccaggaacccatctgatcccatgcctcaggccccagcgctctggattgagacgactgcctacgccctcttgcatctattactccacgagggcaaggctgaaatggcagaccaggccgcagcctggctcacacgacaagggtcattccaaggcggtttcaggagcacccaagacaccgtgatcgcgctggacgccctgtctgcttattggatcgccagccacacaactgaggagagaggcctgaacgtgaccctttcgtccaccgggcggaacgggtttaagtcccacgcactccagctgaacaacaggcagattagaggtctggaagaggagttgcagttcagcctcggtagtaagattaacgtcaaggtgggagggaactccaaggggaccctgaaagttctgaggacatataatgtgctggatatgaagaacaccacttgccaggacctccagatagaggtgacggtgaagggccacgtcgaatacaccatggaagctaacgaggactatgaagactatgaatacgacgaactgccagcaaaggatgatcctgatgctcccctgcagcctgttaccccactgcagctgttcgagggaaggcgcaaccgcaggcgccgggaagcccccaaactcacgtctctgtcagaccggtatgtttctcactttgaaacagagggaccacacgtgctgctgtactttgattctgtgccaacttcgcgcgagtgtgtcggattcgaagccgtccaggaagtgccagtgggactcgtgcagccggcaagcgcgaccctatatgattattacaaccccgagagacgctgttcagttttctacggcgcaccaagcaaaagccgactgctggcaacactctgcagcgcagaagtttgtcaatgtgcagaggggaagtgcccccgccagagacgagcccttgaacgggggctccaggatgaggacggataccggatgaaatttgcatgctattacccaagggtcgagtatgggttccaggttaaagtgctcagagaagacagtcgggctgcgttccgcctcttcgagactaaaattacacaggtgttgcatttcaccaaagacgttaaggccgctgccaatcagatgcgaaatttcctcgtcagagcaagttgcagactgcgcctggaacccggcaaggagtatctaatcatgggccttgatggagccacatacgatctggaggggcacccccaatacctcctggattctaattcgtggattgaggagatgccatctgagagactttgtcgctccactcgccaaagagcagcttgcgcgcagttgaacgacttcctccaggagtatggtacgcagggatgccaggtgtag

SEQ ID NO: 6737 - DNA, 1986 bp, Artificial Sequence
  Description of Artificial Sequence: Synthetic coding sequence
atggatctggttctgaagaggtgcctcctgcatctggctgttattggagccctgttggccgtgggagcgacaaaagtgccaaggaaccaggattggcttggtgtgtccagacagctccgaacgaaggcctggaataggcagttataccccgaatggaccgaggcacagcgcctcgattgttggcggggagggcaggtctccctcaaagtctctaacgacgggcctaccttgatcggggccaacgcttcattttcaatagctttgaattttcccggcagccagaaggtactgccggatgggcaggtcatctgggtcaataatactattattaacggcagccaggtgtggggcggtcagcccgtgtacccgcaggagacagacgacgcttgtattttcccagatggaggcccatgtccgtcaggctcttggagccagaaacggtctttcgtgtacgtgtggaagacatggggacagtattggcaggtgcttggaggtccagtttccggcctgtctatcggcactgggagagccatgctgggaacgcacacaatggaggtaacagtctatcaccggcgcgggtctcgatcctacgtgcctctggcacattcatctagcgcttttaccattaccgatcaggtgcccttctcagtgtctgtgagccagctgcgggccctggacggggggaacaagcattttctccggaaccagcctctcacctttgcccttcaattgcacgacccttccggctatttggcagaagccgatttgtcctacacatgggatttcggtgatagcagcggcaccctgatctctcgggctttagtggtgacccacacctatttggagccaggccccgtcaccgcccaggtggtactgcaggccgcaatcccccttaccagctgcggatccagccccgtgcccggaacgaccgacggacacagacctactgctgaagcccccaacaccaccgccgggcaggtgccaactacagaggtggtaggcactacccctggccaggcacctactgcagaaccgagcggcaccacatcagtgcaggttcccactactgaggttatcagtacggcgccagtacagatgcccactgcggaaagcacaggcatgacacccgagaaggttcctgtgtcagaggtaatggggaccacgctcgccgaaatgagcacccctgaggctacaggtatgactcctgccgaggtctccattgttgtcttgtctggcacgacagcagcccaggttacaacaactgagtgggtcgaaacaaccgcgagggagctgcccatcccagagcccgagggcccggatgcttcatccatcatgtcgactgagagcattacaggctcactaggccccctcctggatgggaccgcaacgttgcggttggtgaagcgccaagtcccattagactgtgttctctacagatacggaagtttctcagtaacgttggatatcgtacaagggattgaatccgccgagattctgcaggcggtaccaagtggggaaggtgatgcctttgagttgactgtgagctgccaaggcggattgcctaaggaagcatgcatggaaatttcttcccctgggtgtcagcctcccgcccagcgcctgtgtcagcccgtcttaccgtcccccgcttgccaactcgtgttacaccagattcttaagggggggtctggcacttactgccttaatgtgagcctcgcagataccaatagcctagcagtcgtgagcactcagctcattatgcctggacaggaggctggtctcgggcaggtgcctcttatagtgggaatccttctggtgctgatggctgtcgttctggcctccctgatctataggaggcggcttatgaagcaggacttctccgtccctcagttacctcactcctcttcacattggctaaggcttcccaggattttctgctcatgcccaataggagagaatagtcccctgctcagtgggcagcaggtgtag

SEQ ID NO: 6738 - DNA, 516 bp, Artificial Sequence
  Description of Artificial Sequence: Synthetic coding sequence
atgaggcataatctgggcggcaatctgggggacccgagggcccgcgctgttagtgtccctctgggcgggcgggttgccagattccttcagtgccgcttcctcttcgccggtccctggctgctgttctccgaaatctccttcatctctgacgtcgtgaataattcaagccccgccttaggaggcacttttcccccggcgccttggtggcctcctggtcctcctcctaccaatttctcatctctggaactagaaccccgggggcagcagcccgttgcgaaagcagaaggaagcccaactgccatacttatcggctgtctggtggccatcatcctgttgctcctgctaattattgcgctgatgctctggagactgcattggagacggttattatccaaggtcttagaatcacatcccagaaccagaagtcccggtctggtgggaatacgccctaccccgctccccgtgtcccctatggctctggtgcatctatgtgaagtggattccccacaagactag

SEQ ID NO: 6739 - DNA, 1986 bp, Artificial Sequence
  Description of Artificial Sequence: Synthetic coding sequence
atggacctggtcttgaaacgctgcctcctgcacctggcagttataggggcccttctcgccgtcggagccactaaggtccctaggaaccaggattggcttggggtctctcggcagttaagaaccaaggcatggaatagacagctttaccccgaatggactgaagcccagcgcctggactgttggagaggcgggcaggtctcactgaaagtgtctaacgatggccccacccttattggtgcgaacgcctcattctcaattgccttgaatttcccggggagtcaaaaggtgctccctgacggccaggtcatctgggttaacaacaccattatcaatgggagccaggtgtggggtggacaacccgtgtacccccaagagacagatgacgcatgcatattccctgacggcggaccctgtccatcaggaagctggagtcaaaagcggagttttgtttacgtgtggaagacctggggccagtattggcaggtgttaggcggacccgtctccggactgagcattgggacgggaagggctatgctggggacccacacaatggaggtcacagtttaccacagacgggggtcccgcagctacgttcccctagctcattctagctccgcctttactattaccgaccaagttcccttttcagtatccgtgagccaactacgggcacttgacggcggcaacaaacacttcctcagaaatcaaccccttactttcgcccttcagctacatgacccaagtgggtatctggcggaggccgacctgtcctacacttgggattttggagactcaagtggtaccctgataagcagagcattggttgtcacccatacttacctggagccaggcccagtgacagcccaggtcgtgcttcaggcagctattcctctcacaagctgcggctccagtccggtacccggcactaccgacggacataggcccacagctgaggcaccaaacacaaccgccgggcaagtgcctactacagaggtggtgggaaccacacccggtcaggcgccaacagctgagccttctggtaccacatcagtccaagtgccaacaaccgaggtcatatccactgcccctgttcagatgccaacagctgaatctacgggcatgacccccgagaaggtgcctgtgagtgaggtgatgggaacaacgctggccgaaatgtcaacaccagaagctacgggaatgacacctgcagaggtgagcattgtggtgctcagtggtacgactgctgcccaagtcactaccaccgaatgggtcgagacaaccgcgagagaactacctatcccagaaccagagggccctgatgccagctccattatgtctactgaatccatcaccggctcgttaggacccctgcttgatggcaccgctacgctgcgtctggtaaagagacaggtcccactcgattgcgtgctgtaccgctatggatccttctcggtgaccctcgatattgtgcagggaattgagtcagctgagattttacaggccgtcccttccggtgagggggatgccttcgagttgacggtctcttgtcagggaggacttcctaaagaggcttgtatggagatcagctcaccaggttgtcagccaccagctcagcgactttgtcaacctgtgctcccttcacctgcttgtcagctggtcctgcaccagattttgaagggcggatccggaacatattgcctgaacgtttccctcgctgacaccaattctctggccgtagtgtctacgcagctgattatgccagggcaggaggcaggcctggggcaggttcctctgatcgtcggcatcttattggtcctcatggctgtggtcctagcctccctgatatacaggagaagattgatgaaacaagatttctccgtgcctcagctgccacactctagtagccactggctgcgtctgcctagaatcttttgctcctgtcccattggagaaaattctcctttgctgagcggacagcaggtatag

SEQ ID NO: 6740 - DNA, 1737 bp, Artificial Sequence
  Description of Artificial Sequence: Synthetic coding sequence
atgttgctcctgttgctgctggccccgcttttcctgcgccctcctggagctggcggggctcagacaccaaatgccacaagcgaaggatgtcagatcattcacccaccctgggaagggggcattagatatcgggggctgaccagggaccaggttaaagccatcaacttcctgccggtagactacgaaatcgagtatgtctgtcgtggcgaacgggaggtcgtggggcctaaggtgcgtaagtgtctggcaaacgggtcatggaccgacatggataccccaagtagatgcgtccgcatctgctctaaatcctatctcaccctcgaaaatggcaaagtgttcttgacaggcggtgatttacccgcattggatggggccagggtggactttcggtgcgaccccgacttccacttagttgggtcatcccggagcatatgcagccagggccagtggtctacacctaagcctcactgtcaggtgaataggacacctcatagcgagaggcgcgcggtctatattggggccttattccccatgtccggggggtggccagggggccaggcatgtcagcccgctgtcgaaatggccctcgaagatgtgaattccagacgggatatccttccagattacgagctgaagttgatccatcatgactctaaatgtgatcctgggcaggccactaaatatctctacgagctgctttataacgaccctatcaagattatccttatgccgggttgcagcagtgtttctaccctcgtagcagaggctgcccgcatgtggaacctgattgtgctgtcctatggaagcagcagccctgcattgtcaaaccgccaacggtttcccacttttttcaggactcatccctctgccaccctgcacaacccgactagagttaagctgtttgaaaaatggggctggaagaaaatagccacaatccagcagactaccgaggttttcacatcaaccctggacgatctggaagagcgcgtgaaggaagccggcatcgagataacattcaggcagagctttttttctgaccctgccgtgccagtcaaaaacctaaagaggcaagacgcccgcattatagtgggcctgttctatgaaacggaagcccggaaggtattttgtgaagtttacaaggaaagactgttcggcaagaagtacgtgtggttcctgatcggttggtacgcagacaattggttcaagatttacgatccgagcatcaactgcacagtcgacgagatgacagaggccgtggaaggccatataaccacagagatcgtgatgttgaatcctgccaacacccggagcatctctaacatgacgtctcaggagttcgttgagaaattgactaagcggttgaagcggcaccctgaagaaactgggggcttccaggaagcccccctggcctatgacgccatatgggctttggccttagccctcaacaagacaagtgggggcggtgggcgctcaggtgtcagactcgaagatttcaattataataatcagaccattaccgatcagatctacagagccatgaatagctcctctttcgaaggggtgtccggccatgtggtatttgacgcgagtggtagtaggatggcttggacccttatcgagcagctccagggtgggagttataaaaaaattggatattatgatagtacaaaggatgatcttagctggtctaagaccgacaagtggattgtgatttccagaactcacagccctacgtag

SEQ ID NO: 6741 - DNA, 1326 bp, Artificial Sequence
  Description of Artificial Sequence: Synthetic coding sequence
atggagttcgagttcgatcgtcttcgagcttttcaagcaatgcaagtgcactgtaacaacatgcacaccttgggggcacgccttcctgggggcgtcgaatgccgatttcggcgaggccctgcaatggcctgggaaggggagccaatgcgacacaatctgggcggcaacctcggtgacccgagggctagagccgtgtccgttccactaggcggacgagttgcacggttcctgcagtgccgcttcctgtttgccggtccatggcttctattttccgagatttcatttatctctgatgttgtcaacaactccagtcctgctctgggaggaaccttcccacctgccccgtggtggccccccgggcctcctcccaccaacttctccagcctcgaactggagccaagaggtcagcagcccgtcgctaaagcggagggcagccccacagccatcctgataggatgcctcgtggcaatcattctgctgctactgcttattattgctttgatgctctggagactgcactggcgccgcctgctgagcaaggtgctagaaagccaccctcgcaccaggtctcctgggctggttggcataaggcccacccccttgcccgtgtcgcctatggccctgagatgttgttcgcccattcagcccactgccagcttctggccactcacgcccgttcctttggaggccagggcaccaccgcatcccccgggaccgaacccccccaccccccgcggcgtgactggcggtaacacctacgctgtgccagctctgcctccgggcgccgtaggcgatggccccccacgggtcgattttccgcggagcaggctgcgcttcaaagaaaaactgggagaggggcagttcggggaggtgcacctctgtgaagtggactctcctcaagatctggtgagcttggactttccactcaatgttcgcaaaggacaccccttactggtagctgtgaagatcttgagaccagatgccactaagaacgcccggaatgacttcttgaaagaggtcaaaatcatgtcacgtctaaaggatcccaacatcatacgcctgttgggagtctgcgtccaggacgacccactatgcatgattacagattacatggaaaatggggacctgaaccagttcctaagcgcccaccagttggaagacaaagcggccgaaggcgcacccggtgacggccaagcagcccagggccctactattagctatccaatgctcctccatgtcgcggcacagattgcgtccggcatgaggtatcttgctactctgaactttgtccacttctggggtgagagacatcggttcctccactag

SEQ ID NO: 6742 - DNA, 447 bp, Artificial Sequence
  Description of Artificial Sequence: Synthetic coding sequence
atgcagactttcccagttgccggggcgctggaccctgccatccttgacactagctcccctcaggcgctatatacagtactcttaatcgtgttagtgatgatgtcgctggtattcggtaaatttgtcccagtgaactgggagccacctcaaccattgccctttccaaagtatctgaggtgttataggtgtctgctggagaccaaggagctggggtgtctcttaggaagcgatatttgcctgacacccgccggttcttcatgtattactctgcacaagaagaacagctcagggagtgatgtcatggtgagcgactgccgatccaaagaacaaatgtcggactgttcaaacacccgtaccagccccgtaagcggattctggatcttcagccagtactgctttctcgacttttgtaacgacccccaaaatcgcgggctttacaccccgtag

SEQ ID NO: 6743 - DNA, 732 bp, Artificial Sequence
  Description of Artificial Sequence: Synthetic coding sequence
atgggccccgaggcgctgtcctccctgctgttactgcttctggtcgcgagcggcgacgccgatatgaagggacactttgatcctgcgaagtgccgctacgccctgggcatgcaggatcggacaattcccgatagcgacatcagcgcctctagtagctggagtgatagcaccgcggcccgacattcacgccttgagagctctgacggggacggagcctggtgccccgccggaagtgtatttccaaaggaagaagagtatctccaggtggaccttcagcggctccatctcgtcgcacttgtggggacccaaggccggcatgcggggggtctgggcaaggagttcagtcgctcctatcggctccgatacagcagagacggccggcgctggatgggctggaaagatcgctggggccaagaggtgatctcgggtaacgaggatcccgagggcgtggtgctcaaggacctgggaccacccatggtagcaagactggttaggttttatccccgagccgacagagtgatgtccgtgtgcctgagagtggaactgtacggatgtctatggagagactgtagcatgggggtctgggcttcgtggcagatggtctggtgggggtggatgacgcttggtagggtcaggagttgcggcagcgggcaagcaatgaccatgtgggacggagccacaacagcctcacccgtggccatgtggagatggagtctgtcactgacggggtag

SEQ ID NO: 6744 - DNA, 732 bp, Artificial Sequence
  Description of Artificial Sequence: Synthetic coding sequence
atggggccagaggctttgtcttctctgcttctgctactgcttgtcgcctccggtgacgcagatatgaagggacattttgatcctgctaagtgtcgctatgccctgggcatgcaggacaggacgatccctgacagcgatatcagtgcctcatcttcgtggagtgactctacagccgcccggcactcaaggctggaaagttcagacggcgacggggcatggtgtcctgccggatctgtgttccccaaggaagaggagtacctccaagtggaccttcagcggctccatctggtagctctggttgggacccaggggcgccacgcaggaggcttggggaaggaatttagccgcagttaccgcttgcgttacagtagagatggaagaaggtggatggggtggaaggaccgatgggggcaggaggtcatttcaggcaatgaagatccagagggcgtggtccttaaagaccttgggcctcccatggtggcgcgactcgtgcggttctaccctcgcgccgaccgtgttatgagcgtttgtttgcgcgtggagctatacgggtgcctgtggcgcgactgttctatgggtgtttgggcctcatggcagatggtgtggtggggatggatgacgctggggagggtgcggtcatgcggaagcggacaggcgatgactatgtgggacggcgccaccaccgcaagccccgtggccatgtggagatggagcctgtccttaaccggctag

SEQ ID NO: 6745 - DNA, 1224 bp, Artificial Sequence
  Description of Artificial Sequence: Synthetic coding sequence
atgaggctgctggcctggctgatctttcttgccaattggggcggcgcaagagctgagcccggaaagttttggcacatcgctgacctgcacttggatcccgactacaaagtctccaaggacccttttcaggtttgtcccagcgctggttcccaacccgtacctgacgcaggcccctggggcgactatctgtgcgactctccatgggcactaatcaactcttccatttacgcgatgaaggaaatagagccggagcctgacttcattctgtggactggagacgatacgccgcacgtgccagatgaaaaactcggcgaggcagctgtgttagaaattgttgaaaggctgactaaattgattcgagaggtgttcccgggcgccttttattgcgaaaagctcccaggcccgtcaggcgctgggaggatcgtcgttctaaacacgaatctttattacactagcaatgccctgacagcagacatggcagacccaggccagcagttccagtggctggaggacgtgttgaccgacgcctcaaaggccggcgatatggtatacatcgtgggacatgtgccccccggctttttcgaaaaaacacaaaataaagcctggttccgcgagggattcaatgagaagtacctgaaggtggtgcgcaaacaccacagagttattgctggtcagtttttcggacatcaccatacagactcttttcgtatgctttacgatgatgccggtgtgcccatctccgcaatgtttataacaccgggggttaccccatggaaaaccacactgcctggtgtggtcaatggagctaacaatcctgctatccgggtgttcgagtacgatcgtgcgactctgtccctgaaagatatggtgacatatttcatgaatctgagccaagccaatgcgcaagggactccaaggtgggaactcgaataccagctgaccgaggcctatggcgtgccagacgcatccgcccatagtatgcacaccgtccttgataggattgccggcgatcagagtactctgcagagatactatgtgtacaattctgtgtcttacagcgcaggtgtgtgcgacgaggcttgctcaatgcagcacgtatgtgctatgcggcaagtagacattgacgcttatacaacatgcctgtacgcaagtgggaccaccccagtcccgcagctccccctcctgctgatggcactacttggactctgcactttggtactctag

SEQ ID NO: 6746 - DNA, 756 bp, Artificial Sequence
  Description of Artificial Sequence: Synthetic coding sequence
atgccacatttggcgtccctgtttacagcctctagtcgttgttgtccacatcctcttcgtcctgaaggcagtggggctatggggccagaggcactcagctccctgcttctgctgctcctcgtagcaagtggggatgcggacatgaagggacacttcgatcctgcgaagtgtcgctatgccctcgggatgcaagatcgaacaatccccgattctgatatctctgcctctagttcttggagcgactctaccgccgcacgccacagccgcctggagagctctgacggagacggggcctggtgccccgcgggctccgtgttccccaaggaggaagaatacctccaggtggacctccagcgtctccatctcgtggccctcgtggggacgcagggaaggcatgcgggaggacttggcaaagaattcagcagaagctaccgactgcgatacagccgggacggacgccgatggatgggctggaaggatagatggggacaagaagtgatctcaggcaacgaagaccctgagggagtggttttgaaggacctaggccctcctatggtagcccggctcgttagattttatccgcgtgccgaccgtgtcatgtcagtgtgcctccgggtagagctgtatgggtgtctctggcgaggcgagtggctgtccttcctggggatatgtttcctgtccaggggcctggagggcggggaatgcggggagtgggcgtcacgcattccctcacctgcaggtaaactgagcctctag

SEQ ID NO: 6747 - DNA, 756 bp, Artificial Sequence
  Description of Artificial Sequence: Synthetic coding sequence
atgccacaccttgcatccttgttcactgcctcatcccgatgttgcccacaccccctgcggcccgaaggatctggagccatggggccagaagcactgtccagtctgcttctcctcttgctggtcgcctccggagacgccgatatgaaaggtcactttgaccctgccaaatgtcgctatgcccttggcatgcaggacagaactatcccagactccgacatctccgcttcttcgtcctggagcgattctaccgctgcgcggcattccaggctcgaatcgtccgatggggacggagcctggtgtccagccggaagcgtgtttcccaaagaggaagagtacctccaagtggacctgcaaaggctccacctggtggctctggtgggaactcaaggacgccatgcaggcggcttaggcaaggagttctctaggtcttacaggctgaggtatagcagagacggccgaaggtggatggggtggaaggatagatggggacaggaagtaatcagcggcaacgaagacccagagggtgttgtgctgaaagacctggggcctcctatggtggcgcggttagtccggttctatcctcgggcggaccgcgtgatgtcggtatgcctcagggtcgagctgtatgggtgcctctggcggggtgagtggctgtccttcctgggaatttgcttcctgagccgaggtcttgaaggaggagagtgcggtgaatgggcttcccgtatccccagccccgccggaaagctgtccctgtag

SEQ ID NO: 6748 - DNA, 456 bp, Artificial Sequence
  Description of Artificial Sequence: Synthetic coding sequence
atggatctggtgctgaaacgttgtctactccatctcgcagtgattggagccctgctggccgtgggggccactaaagtgcccaggaatcaggattggctcggtgtgtcacgccagctccgcactaaagcttggaaccggcagctttatccagagtggacagaggcacagcgtcttgactgttggcgcggcggacaggtgagtctcaaagtcagcaacgacggccccacactaatcggcgctaacgcgagcttctcaatagctctcaatttccctgggagccagaaggtgcttcccgatgggcaagttatctgggttaataatactattattaatggctctcaggtctggggaggccaaccggtatatccacaggaaaccgatgatgcttgcatatttcccgacggaggaccctgtccgagtggctcgtggtcccaaaagagatcttttgtatattag

SEQ ID NO: 6749 - DNA, 216 bp, Artificial Sequence
  Description of Artificial Sequence: Synthetic coding sequence
atgccagccggagttccgatgtctacgtacctgaaaatgtttgcggccagccttctggcaatgtgtgctggcgcagaagttgtgcatcggtactatcggccagacctgactatccccgagatccccccgaaaagaggggagctgaaaaccgagctgctgggcctgaaggagagaaaacataagccgcaggtgtcacaacaggaggaacttaagtag

SEQ ID NO: 6750 - DNA, 447 bp, Artificial Sequence
  Description of Artificial Sequence: Synthetic coding sequence
atgcagacattcccggtggccggagccctggacccagctatacttgacacctcaagcccacaggccctctacacagttctcctcattgtgctagtaatgatgagtctggtctttggcaaattcgtgccagtgaactgggaacctccacagccacttcccttccctaagtaccttaggtgttacaggtgcctgttagagacaaaagagctaggttgtcttctgggttctgacatctgtcttacacctgccggaagctcatgcataactctgcataaaaaaaactctagtgggagtgatgtcatggtctcagattgccgctctaaggagcaaatgtccgactgttcaaacacgcggacgtctccggtaagcgggttttggatcttctcccagtactgttttctcgatttttgtaatgatccccagaatcgaggactttataccccctag

SEQ ID NO: 6751 - DNA, 447 bp, Artificial Sequence
  Description of Artificial Sequence: Synthetic coding sequence
atgcagacattccccgtcgccggcgccctggacccagcaatcctggacacaagcagtcctcaggctctctataccgtcttgttaattgtgctggtaatgatgtctctagtatttggcaagtttgtgccggtgaactgggagccaccgcagcctttgcccttcccaaaatacctgaggtgctaccggtgcctgctggagaccaaggagttggggtgcttgctgggatccgatatctgtctgactcctgcggggtccagttgcattaccctgcacaagaaaaattcttcgggctcagacgttatggtgtcggattgcagatccaaggagcaaatgagcgactgtagtaacactaggacaagtcctgtctcagggttttggattttttctcagtactgctttctcgatttctgcaatgatccccagaaccggggactgtacacgccctag

SEQ ID NO: 6752 - DNA, 1326 bp, Artificial Sequence
  Description of Artificial Sequence: Synthetic coding sequence
atggaatttgaattcgatagactgagagcatttcaggccatgcaggttcactgcaacaatatgcacaccctgggggccagattgccaggaggagtcgaatgtcggttccgcagaggtcctgcgatggcgtgggagggagaacccatgagacacaatttgggggggaatctcggagacccccgggcccgggccgtttccgtgccactgggtggacgggtcgcacgcttcctgcagtgtcgttttttgttcgccgggccatggctgctgttcagtgaaatctcctttatatcagacgtggtcaacaacagttcccctgcccttgggggcacttttcctccagccccatggtggcctcccggccccccccctactaacttctcgagcctggaactggagccgcggggccagcaacctgtggccaaagccgagggatcaccaactgcaattctcataggctgtctcgtggcaatcatcctgttactactgctcattatcgcactgatgctgtggcggctacactggagaagactactgagcaaggtcctcgagtctcacccacgaactagatctcccggattagtaggcatcagacccactcccctccccgtatctcctatggcactccgctgctgttcacccatccagccaactgcctccttttggccgcttaccccggtccccctggaggctcgggccccaccacacccacccgggcccaatccacccactcccagaggtgttaccggcggaaacacttacgccgtgcccgcactgcctccaggggccgttggcgacggtccacctcgcgtcgattttcctagatctagactgaggttcaaagaaaagttaggcgagggccagttcggtgaggtccatctttgcgaggtagactcaccccaggacctcgtctctctcgactttccgctgaatgtgcgcaaggggcatccgctcctggtggccgtgaagatcctccggcccgatgccacgaaaaatgcccggaatgacttcctgaaggaggtcaagatcatgagtaggctgaaagatccgaacataatcagattactgggtgtttgtgtccaggatgacccgctgtgtatgattaccgattatatggagaacggtgacttgaatcagtttctgtcagctcaccagctcgaggataaagccgcagagggcgcacctggagatggtcaggcggcgcagggaccaactatttcataccccatgctgttacatgttgctgcccagattgcttctggaatgcggtacctggcgaccctgaatttcgtgcatttctggggcgaacgccaccgattccttcattag

SEQ ID NO: 6753 - DNA, 2067 bp, Artificial Sequence
  Description of Artificial Sequence: Synthetic coding sequence
atgctgcccaccgaagtgccgcagtctcaccccggtcccagcgccctgctgctgctgcagttgctgctcccacccacctcagctttctttcccaatatctggtcccttcttgctgctcccggaagcataactcaccaggacctgactgaagaagcagccctcaacgttacactgcagttgttcctggagcagccaccccctgggaggccccccctgagactcgaggatttcctcggccggactctgctcgctgatgacctgttcgcagcatactttgggcctgggtcaagcagacgtttcagggcagcactgggggaagtcagtcgtgcgaacgcagctcaggacttcctgcctacaagcagaaacgatccggacctccattttgatgctgagcgtctagggcaaggccgggccagacttgtgggggccctgcgcgaaacggttgtggcggcaagggccctcgaccacacactcgcccgccaacggttgggagcagcgctccatgctcttcaggatttttatagtcactcgaattgggtggaacttggcgaacagcagcctcacccacatctgctatggcctcgccaagaacttcaaaacctcgcccaggtggcggacccgacatgctccgactgcgaggaactctcttgccccagaaactggcttggttttacgctactcacatctgggtatttcggaacacacccgccgaaacctccaggaaagtgttctcacggagggcacttcgaccgtagttcctctcaaccacctcgtggcggcatcaacaaggatagcacctctccaggattcagcccacaccatatgctgcatttacaggctgcaaagttagctcttctagcctcgatccaggccttctctctactacgcagcaggctgggggaccgggatttctccagactgttggacatcacccccgcctcaagcctgagtttcgtgctggacaccaccggtagcatgggtgaggaaatcaacgcagcgaagatccaggcccgtcacctcgtggagcagaggcgtggaagccccatggagcctgtccactacgtgctggtacccttccacgatccgggcttcgggcccgtatttaccacttctgaccccgacagcttctggcagcagcttaatgaaattcatgcactgggcggcggggatgagccggaaatgtgcctttctgcgctgcagcttgccctgctgcataccccccccttgtcagacatctttgtgttcacagatgcttctccaaaggatgcattcctgacgaaccaagtggagagtctgacgcaggaaagaaggtgcagggttacctttctggtcacggaggatacctcacgcgtgcagggaagagcccgaagggagatactgagtcctcttagatttgagccctacaaggccgttgcactggcctcaggcggtgaggtgatctttacgaaagatcagcatatccgggatgtggcagccatcgttggtgaaagtatggcggccttggttaccctcccccttgatcctcccgtggttgtgcctggtcagcccctcgtctttagcgtggatggattgttacagaaaataaccgtcagaatacatggcgacatttcctccttctggattaagaacccagccggagtctctcagggacaggaggagggcgggggccccctgggtcatacacgtcgcttcggtcagttctggatggtgacaatggatgaccctccacagactgggacctgggagatccaggtgacggctgaggatactcctggggtgcgcgtgcaggctcagacctcgcttgacttcctgtttcactttggcatccctatggaggacggtccacacccaggcctatatcctctgacacaaccggttgcgggtttacaaacgcaactacttgtggaatctcagtcctggggcagctctgctgcctttctgcctcggcatccatcccgagggcctcgtggttgtagaacaaggccgggtgcactgggtgccagaggaacatccggggccaggtctcccaggtccctagctgtggcccacgcggctgtccatccatag

SEQ ID NO: 6754 - DNA, 1326 bp, Artificial Sequence
  Description of Artificial Sequence: Synthetic coding sequence
atggagtttgaattcgaccggcttcgtgccttccaagctatgcaggtccactgcaacaatatgcatacactcggagcaaggctccctggtggggtggaatgtaggtttcgccgcggccccgctatggcgtgggagggagagccgatgagacataaccttggcggcaacctcggggaccctcgcgccagggctgtctcggtgcccctgggcggccgggtggctagattcctgcagtgcagattcctgttcgctggtccttggctgctgttcagcgaaatcagcttcatttctgacgtcgttaataacagttcacccgcccttggaggcacctttcctcccgccccttggtggcctcccggtccgcctccgacaaatttttcctctttggagctagagcctagggggcaacagcctgtggcaaaagctgagggcagccccaccgctatcctgattgggtgtctcgttgcgattatcctactgctactcctcatcatcgccttgatgctgtggcgtctccattggagaagactgctctccaaggtgctcgaatctcaccctaggaccagaagccccggattggtaggaattagacccaccctcttgccagtgagcccaatggctttgagatgctgcagccccatccaacccaccgcatcattttggccactaacacccgtccccctcgaggcgagggctcctccacaccctccaggacccaatccgcccactcctcgtggtgtgacaggtggcaacacatatgctgttccagctctgccaccaggggccgtaggggatggtccaccacgggttgactttcctcgtagtcggctgcgtttcaaagagaaacttggcgaaggccagtttggagaagtgcatctgtgcgaagtggacagtcctcaggatctcgtgtctctggacttccccctcaatgtacgcaaaggccatcccctcttggttgcggtgaagatcctccgaccggatgccacgaaaaatgccagaaatgacttcctcaaggaggtcaaaatcatgagcaggctgaaagaccctaacatcataaggctgctcggggtgtgcgtacaggatgaccccctgtgcatgattaccgattatatggagaacggcgaccttaatcagtttttgtccgcccatcagctggaggacaaagccgccgagggggcacctggcgatggccaggcagcgcagggaccaaccattagttaccctatgcttctgcacgtggcggcccagatagcaagcggtatgaggtatctggcaaccttaaactttgtgcacttctggggtgagaggcatcgcttcctgcactag

SEQ ID NO: 6755 - DNA, 2559 bp, Artificial Sequence
  Description of Artificial Sequence: Synthetic coding sequence
atgctgcccactgaagtgcctcaatcgcatcctggaccaagcgctcttttgcttctgcagctgctccttcctcctacatccgccttttttcccaatatttggagcttgctggccgctcccggaagcattacacaccaagacctcaccgaggaagcagcgcttaacgtaacgctacagctgtttctggaacaacccccccccggccgacctcccctgcggctcgaagactttcttggtcgaaccctgctggcggatgaccttttcgccgcctacttcggaccagggtcgagtaggcgcttcagggcggcactgggagaggtttcaagagccaacgcagctcaggattttttaccaacttcaaggaacgatcctgatctgcatttcgatgctgagaggcttggtcaagggcgggcgcgcttagtgggtgccctgagagaaactgtggtggccgccagagctctagatcacaccttagcccggcaacgactaggcgccgcgctccacgctctgcaggacttttacagccactccaactgggtggagctcggcgagcagcagcctcacccccacctgctctggccccgacaggagttgcagaatctggcccaggtggcagaccccacttgtagtgactgcgaagagctctcctgcccccgtaactggctgggtttcactcttttaacaagcgggtacttcggtactcatcctcctaagccacccggaaagtgttcccacggagggcactttgacaggagttcaagtcagcctcctcgcggcggtattaataaagactcaaccagtccaggcttctcaccccatcatatgctacatctccaggctgccaaactggccctgctagctagcattcaggcattcagcctgctgagatcaagacttggagatcgggacttctctcggctgctggatattacacctgcctcctcactgtcatttgtcctggataccactgggtctatgggggaggaaattaatgcagccaagatccaggcaagacacttagttgaacagcggagagggagtccaatggaacctgtgcattacgtacttgttccatttcacgatcctgggttcgggcccgtgtttaccacttcagatcctgattcgttttggcaacagcttaatgagatccatgccctaggcggaggggatgagcctgaaatgtgcctcagtgctttgcagttagctctgttgcacaccccccccttatcagatatctttgtgtttacagacgcctcccctaaggacgctttcctgaccaaccaggttgagagtctcacccaagaaagaagatgccgggtgacatttcttgtgaccgaagatacaagccgcgtacaggggagggcaaggcgcgagattctaagcccccttaggttcgagccttacaaagcagtagcactcgccagcggtggcgaggtcattttcaccaaagatcagcatattagggacgtcgccgccattgttggggagagcatggcggctctggtgactctgcctctggatccaccagtggttgtccctggtcagccactcgtgttctccgtggacggcttgcttcagaagatcactgtgcggatccacggcgatatttcctccttctggatcaagaatccggcgggggtatctcagggacaagaggaaggcgggggcccactggggcacaccagaaggtttggtcagttttggatggtgacgatggacgatcctccacagactggaacatgggagatccaggtaaccgcagaggataccccaggagttcgagttcaggcacagacatctctggattttctcttccatttcggtatcccgatggaagacggtcctcaccctggactttatcctcttacacaaccagttgccggcctacagacccagctcttagtcgaagtaacgggactggggtcacgcgccaatcctggtgacccgcagcctcatttcagccacgtcattctccggggcgtccctgaaggagctgaattaggacaggttcctctggagccagttggccccccggaaagggggctgctcgcagcatcactttccccaacattgctgagtacaccccggccattttctctggagctcatcggacaagatgccgcaggaagaagactgcatagagccgcaccccagccatctacagttgtgccagtgcttctcgaattatccggcccttccggtttcttagcccctgggagtaaggtgccgctgtctctgcggatagcatcattcagcggtccacaggacctcgaccttaggacgtttgtgaatccctcattcagcttaacaagcaacctgtccagagcccatttagagctgaatgaatcagcttgggggaggctgtggctggaggtccctgactcagcggcacccgattccgttgttatggtcactgtgacagcaggaggaagggaagcgaatcccgtgcctcctacccatgcatttctgcgattactggtaagtgccccagccccccaggtccggaatcattacttcccgagtcaggggcccgcacatcatccttataggttgatttag

SEQ ID NO: 6756 - DNA, 732 bp, Artificial Sequence
  Description of Artificial Sequence: Synthetic coding sequence
atgggccccgaggctctgtcatccctcttgctactactgttagtcgcctcaggtgacgcagatatgaagggtcacttcgatcccgctaaatgccgttacgccttagggatgcaagaccgaacaatacctgatagcgacattagcgcctcttctagctggtccgattccacagcagcccgccatagccgtctcgagagctcagacggtgacggggcgtggtgccccgccggcagcgtgtttcctaaggaggaggagtatctccaagtcgacctacagagattacacttagttgccctggtgggcacccagggacgccatgcaggtggactaggaaaggagttcagccgaagttaccggctgaggtacagccgcgacgggcgcagatggatggggtggaaggaccgatggggacaggaagtcataagcggcaatgaggacccagaaggcgttgtgttaaaggacctgggcccgccaatggtggctcgtcttgtgcggttttaccctcgggcggatcgggtgatgtctgtctgcctcagggttgaactttacgggtgcctgtggagggactgtagcatgggcgtgtgggcctcctggcaaatggtctggtggggctggatgaccttggggcgggtgcggtcttgcgggtcaggccaggccatgacgatgtgggatggggcaacgactgcatcacctgttgccatgtggcgctggtcactgtctctcactgggtag

SEQ ID NO: 6757 - DNA, 2760 bp, Artificial Sequence
  Description of Artificial Sequence: Synthetic coding sequence
atgggccctgaggctctttcatccttgctgcttctccttctggtcgcgagcggggatgcggacatgaagggacactttgatccggccaaatgccgctatgctttgggaatgcaggacaggacaatccctgactctgacattagcgccagcagcagttggtccgattccaccgcagcacgccacagcagactggagtccagcgacggggatggtgcctggtgtcccgccggctcagtgttcccaaaagaagaagaatacctacaagtggacctgcagcgactccatctggtggccttggttggcacccagggcaggcacgccggaggtttgggcaaggaattctctagaagctataggcttaggtactccagagacggccggagatggatgggctggaaagacaggtggggccaggaggttataagcggaaacgaagatcccgaaggggtggtgttaaaagacctcggacctcccatggtagcacgcctggtcagattttatccacgagcagacagagttatgagcgtctgtttaagggtagagctgtacggctgcttgtggagagatggcttgctaagctacacagcacccgtgggacaaactatgtaccttagtgaggcggtttatcttaatgactccacatatgacgggcatactgtgggcgggctgcagtacggcgggcttggccagctcgccgacggcgtagtaggcctcgacgatttccgcaaatcccaagagctgagggtatggccaggatacgactatgtcggttggtccaatcactccttctcatccggttatgtggaaatggagtttgaattcgatcggctgagagcctttcaggcaatgcaggtccactgcaacaacatgcacactctgggagcacggctgcctgggggagttgaatgccgtttccgccgaggacccgcaatggcttgggaaggcgaacctatgaggcataacctgggggggaacttaggcgatccaagggcccgcgccgtgtccgtgcccctgggcggccgggtggctagatttcttcagtgccgctttctgtttgccggtccctggctgctgtttagtgagattagcttcatttctgatgtggtaaacaattccagcccggcactgggaggtaccttccctcccgcaccatggtggcctccgggcccaccccccaccaatttctcaagtctggaattagagccaagaggccagcagcccgtggcaaaggctgagggctcaccaaccgcaattctcatcggatgtctggtggctatcatccttctgctgctccttatcattgcccttatgctctggaggttgcactggcggcgactgctctccaaagctgagaggcgggtgctcgaagaggagttgacagtgcacctgtctgttccgggggacacaattcttattaacaataggcccggtcctcgtgagcctcccccataccaagaaccgagaccaaggggtaaccctcctcacagtgccccttgtgttcctaacggatctgctctcctcctctcaaatcccgcttacaggctccttctagctacttacgccagaccgccccgtggacccggaccgcccactcccgcatgggccaaaccaactaacactcaggcgtactccggggactacatggagccggaaaaacctggagcacccctcctccctcccccaccccaaaacagtgtgccacactacgcagaggccgatatcgttacgctgcaaggagtgaccgggggcaatacatacgcagtgcctgccctgcctcctggcgctgtgggagatggcccccctcgggtcgacttccccaggagccgcttacggtttaaagagaaactgggcgagggacagtttggagaggttcatctgtgtgaagttgattcaccacaagatcttgtcagtctggacttcccactgaatgtgcgtaaggggcatccattgctggtagctgttaaaatcttgcgtccggacgctactaagaatgcgagcttttcactgtttagccgcaatgacttcttgaaagaggtgaagattatgagtcggctcaaagaccctaacattatccgtttgcttggagtctgcgtccaggatgatccactttgcatgattactgactatatggaaaacggggatctcaaccagttcttatccgcccatcaattagaggacaaggctgctgagggcgcgcccggcgacggccaggcggctcagggccctaccatttcttatcccatgctgcttcacgtggctgcacagatcgcctctggcatgcggtatctagcaaccctcaacttcgtgcaccgagacttagctacaagaaattgtctggtgggtgaaaatttcactatcaagattgcagactttggtatgagtcgaaatctgtatgcgggtgattattaccgggtgcaaggccgggctgtcctaccgatcagatggatggcatgggaatgcatccttatggggaagtttactaccgcctccgacgtgtgggcctttggcgtcacactctgggaagtcttaatgctgtgccgtgctcagcccttcgggcagcttacagatgaacaggtcattgaaaatgcaggcgagttctttagggatcaagggcggcaggtgtatctgagcaggcctcctgcttgtcctcaaggcctgtatgaattgatgttaagatgctggtctagagaaagcgagcaaaggccccctttcagtcagctgcaccgatttctcgctgaagatgcccttaatacggtgtag

SEQ ID NO: 6758 - DNA, 2700 bp, Artificial Sequence
  Description of Artificial Sequence: Synthetic coding sequence
atgttactcctgctcctcctggccccattgtttctgcggcctccaggggccggcggggctcagaccccaaatgccacctcagaaggatgtcagatcatccacccgccgtgggaggggggtattcggtacaggggcttgacacgggatcaggtgaaagccatcaattttctgcccgtcgattacgagattgagtatgtgtgccgtggcgagcgggaggttgtcgggccaaaagtaaggaaatgtttagcgaatggatcttggacagatatggatacaccgtcccgttgcgtcaaccgcactccacattccgagagacgcgcagtgtatattggcgctctgtttcctatgtccggagggtggccagggggtcaagcttgtcagcctgcagtggagatggctctggaggatgtcaactcacgacgcgacattctcccagattacgagttaaaactcattcatcatgattccaaatgcgaccccggacaggctactaagtacctctacgaactgctgtacaacgatcctatcaaaatcattctgatgcctggctgctcaagcgtgagcacgttggtcgccgaggccgctaggatgtggaacctgatcgtcctgtcgtatggaagcagtagccccgccctgagcaatagacaacgatttcctactttcttcagaacacatccctctgccaccctccacaacccaacccgggttaagctctttgagaaatggggctggaagaagatcgccacaatacagcaaaccaccgaagtatttacaagtacactggacgacttagaagaaagggtcaaggaggccggcattgaaattactttccgccaaagcttcttcagtgatcctgccgtgcccgtgaagaatttgaagaggcaagatgcaagaattattgtcggcctcttctatgagaccgaggctcgcaaggtcttttgtgaagtgtataaggagaggttgttcggaaagaagtacgtctggttccttatcggttggtacgccgacaattggtttaagatctacgatccgagtattaactgtacggttgacgagatgactgaggccgtcgagggccacatcacaactgagatagtgatgctgaatcctgcgaacacacgaagcataagtaacatgaccagccaggagttcgtggagaaactgacaaagcgtctgaagcggcatccagaagagacaggcggattccaggaggcccccctggcctacgacgcaatctgggcccttgccctggcccttaataaaactagtggtggcggggggagatccggcgtgaggttggaggatttcaactacaacaaccagacaattacagaccaaatatatagggctatgaactctagctcttttgaaggtgtgtccggccatgtggtctttgacgcatcaggttcaaggatggcgtggacccttattgagcaactacagggaggttcgtacaaaaagatcggatactacgacagtacaaaggatgatttgtcttggagcaagaccgataagtggatcggtgggagtcctccagccgaccagacccttgtaattaaaaccttccgctttttgagtcagaaactcttcatttctgtatccgtgctgtcgtccctgggaatcgtccttgcagtggtgtgcctgtcatttaatatatacaatagccacgtgagatacatccagaattcacagccgaacctgaataatctaactgccgtggggtgcagcctggctttagccgccgtgtttcctctgggcctggatggataccacattggccggaatcagtttcctttcgtgtgtcaggcacgcctatggcttctgggcctcggattttccctgggctacggctccatgttcaccaagatatggtgggttcataccgtcttcaccaagaaggaggagaaaaaggagtggcggaagacactggaaccatggaaactatacgccacagtcgggctcctggtcggaatggatgtgctcacactagccatctggcagatagtcgacccgctgcatagaaccatcgaaactttcgctaaggaggagcctaaggaagatatcgatgtttccatcctaccgcaactggaacactgcagttcaagaaagatgaatacgtggctgggaatcttctacgggtataaaggtttattacttctgcttggtatcttcctggcatatgagaccaaaagcgtcagcacagagaaaatcaacgaccaccgggctgttggcatggccatctacaacgtcgctgtgctttgtcttattacagctcccgttaccatgatcctatcttcccaacaagatgcagcttttgcttttgcctccttagcaatcgtgttttcctcctacatcactttggtggttctctttgtgccaaaaatgcgcaggctgatcactcggggagaatggcaaagtgaggctcaggacacaatgaagactggtagttcaacgaacaacaacgaagaagagaaaagtcgattacttgaaaaagagaatagagagttggagaaaatcatcgccgagaaagaggagagagtgtctgagttacgccaccagctgcagtcgcggcagcaacttaggagcagacggcatccccccaccccccccgaacccagtggtggactgccccgtggaccccctgagccaccggaccgtctgtcatgcgatggaagtagagtgcacctgctgtacaagtag

SEQ ID NO: 6759 - DNA, 447 bp, Artificial Sequence
  Description of Artificial Sequence: Synthetic coding sequence
atgcagacattcccagttgctggtgccctggatccagccatactggacaccagcagccctcaggccctctatacggtgctcttgatagtgctcgtgatgatgagcctggtgttcgggaagttcgtcccagtaaactgggagccgccacagccgttaccatttccgaaatatttacggtgctacaggtgcctcctcgaaacaaaagagctgggctgcctgcttggctctgacatttgcctgacgcccgcagggtcctcgtgcattactctgcataaaaagaactcctcagggtcagatgtgatggtgagtgattgtcggtccaaggagcaaatgagtgattgtagcaacactagaacaagccccgtctcgggcttctggatcttcagccagtattgtttcctcgacttttgcaatgatcctcagaacagaggcctttatactccatag

SEQ ID NO: 6760 - DNA, 516 bp, Artificial Sequence
  Description of Artificial Sequence: Synthetic coding sequence
atgagacacaatttaggaggtaacctcggggatccacgggcacgggctgtcagtgtacctctgggagggcgggttgcccggttcttgcagtgcaggtttctcttcgcaggaccctggttgctcttctccgaaatatcttttatatcagatgttgttaacaattccagccctgctctgggaggcactttcccccccgctccctggtggccccctggtccacctcctacaaacttttcaagcctggaactagaaccaagaggacaacaaccggtcgccaaagcggagggaagcccgactgcaatcctgattggctgccttgttgccattattttactgcttttgctgataattgctctgatgttgtggagattgcactggcgcaggctcctgtccaaggtattagagagccatccaagaacaagatcccccggattggtggggatccgcccaacccccttaccggtgagccctatggctctggtgcatctgtgtgaggtcgatagcccccaagattag

SEQ ID NO: 6761 - DNA, 666 bp, Artificial Sequence
  Description of Artificial Sequence: Synthetic coding sequence
atgactacccagctgcgcgtggtccacttactaccactgctcttagcatgtttcgtgcagacatcgcctaaacaggaaaagatgaagatggattgccataaagatgagaagggaaccatctacgactacgaggcaatcgccctaaacaaaaatgagtatgtatctttcaaacagtatgtgggaaaacatatcctgttcgttaacgtcgcaacttactgtggccttaccgcgcagtacccggaactaaacgccctccaggaagaattaaaaccttatggtctggtggtgctcggcttcccttgtaaccagtttggtaaacaggagcctggcgacaataaggaaattctgccaggcctcaagtacgtacgaccgggagggggtttcgtccccagcttccagttgtttgaaaaaggtgatgtgaatggcgagaaggagcagaaggtgttttccttcctcaagcacagctgccctcaccccagcgagatcttggggacctttaagtcaatctcgtgggaccctgtcaaagtgcatgacatccgatggaattttgaaaaattcttggtaggacctgacggaattcctgtcatgcgatggtcacaccgggctacggtgtcttctgtgaagaccgatattcttgcttatcttaaacagttcaagacaaagtag

SEQ ID NO: 6762 - DNA, 447 bp, Artificial Sequence
  Description of Artificial Sequence: Synthetic coding sequence
atgcagactttcccagtagcaggggctctggatcctgccatcttggacaccagtagtccacaggcactctacacagtattgcttatcgtactagtgatgatgtccctggtttttggaaaattcgtgcctgtgaactgggagccaccgcaacctctgcccttcccaaaatacttgagatgctatcgatgcttattggaaaccaaagaactgggatgcctgctgggttccgacatctgtttgaccccagcgggctcctcttgcattactttgcataagaaaaactctagcggcagtgatgttatggtctcagactgccgcagcaaggagcagatgtcagattgctctaacactcggacctcccccgtaagcgggttttggattttctcccaatactgcttcctagatttctgtaacgatccccagaacagggggttgtacacaccgtag

SEQ ID NO: 6763 - DNA, 1737 bp, Artificial Sequence
  Description of Artificial Sequence: Synthetic coding sequence
atgctgctgctgctgcttctggcccccctgtttctgcggcctccaggagcaggaggcgctcagaccccgaacgcaaccagcgagggctgtcaaattatccatcctccttgggagggcgggatccgatatcgcggtcttactagagaccaggtgaaagcgattaattttctccccgtggactatgagattgaatacgtgtgcagaggcgagcgtgaagttgtgggccccaaggtgagaaaatgtctggccaatggttcctggactgacatggacacgccaagtagatgtgtgaggatatgctctaagagctaccttacactcgaaaatggcaaggttttcctgaccggcggggatctgccagcactagacggcgccagggtggatttccggtgcgatcccgatttccatttggtagggagcagtaggtccatctgctctcaaggccagtggtccactcccaagccacattgccaggtcaatcgcactccacatagcgaaagacgtgctgtttacattggcgccctcttccccatgtcaggcgggtggccaggaggccaggcctgtcagccggccgttgagatggcgctcgaggacgtcaactcaaggcgcgatatccttcccgactacgagttgaagctgatccatcacgatagtaagtgcgatccagggcaagcgaccaaatatctgtacgagctgctttataacgatccgataaaaattatcttaatgccaggctgttcgtctgtgtctacccttgtcgccgaagcagcccggatgtggaacctgatagtgctctcctatgggtcctctagcccagcactgtccaaccggcagagattccctacgtttttcagaacacatccctctgccactctccataatcctactcgggttaagctgtttgagaagtgggggtggaaaaaaatcgccactatccagcagacgaccgaagtgttcacttccaccttagacgacttggaagaacgcgtgaaggaagctggtatcgaaattacttttagacagagcttcttttccgaccctgccgtcccagtaaagaatttgaaaagacaagatgcccgcatcatcgtcggactgttttatgagactgaggcacgaaaagtgttttgtgaagtctacaaggagaggcttttcggaaagaaatatgtgtggtttctgattggatggtacgccgataactggtttaaaatctatgaccctagcatcaattgtactgtagacgaaatgacagaagcagttgagggccatatcaccacagagatcgtcatgttaaaccctgccaatacacgcagcattagcaatatgacaagccaagaattcgtggagaagttgacaaaacgtctcaaaagacatcccgaagagactggcggattccaggaggccccactggcctacgatgccatttgggcactcgccttagccttgaataaaacatccgggggcggcggacgctctggcgtccgcctcgaagactttaactacaacaaccaaactattaccgaccagatctaccgcgccatgaatagctccagctttgaaggggtcagtgggcatgttgtgttcgacgcctccggctcccgcatggcatggacccttatagaacagttgcagggagggtcttacaaaaaaattggttattacgactcgactaaggacgatctaagttggtctaaaacggacaagtggatcgtgatttcacgaacccactctcctacatag

SEQ ID NO: 6764 - DNA, 1737 bp, Artificial Sequence
  Description of Artificial Sequence: Synthetic coding sequence
atgctgctactactcctgctggctcctttgtttctgaggccaccaggagcagggggggcccaaacaccaaacgcgacttccgaggggtgtcagatcatccaccccccttgggaggggggtatccggtaccgcgggctcactagggatcaagtaaaggcaattaattttttgccggtcgattatgaaatagaatatgtctgccggggcgagcgcgaggtggtggggcccaaagtacggaagtgtctggccaacgggagttggacagatatggacacgccgtctaggtgtgtgcgcatctgttcaaagtcctacctgactctcgagaatggcaaagtgttcctgaccggaggggacctgccagcattggacggtgcacgcgtggacttccgatgtgacccagattttcatcttgttggctctagcagatctatttgtagccagggacagtggtccaccccaaagccacactgtcaggttaatcggacacctcacagcgagcgtagagccgtgtacatcggggccctttttccgatgagtggagggtggccgggaggacaagcctgtcagccggctgttgaaatggccctagaggatgtcaacagcagaagagacatactccccgactatgaactcaagctaatccaccatgattcaaaatgcgatcccggacaggctacaaaatacctatatgagctcttgtacaacgaccccattaagatcattctaatgccagggtgcagttctgtgtctacactggttgccgaggcggcacgtatgtggaatctgatcgtgctgagttatggttcttcctcacccgctctgtcgaacagacagagattcccgacttttttcaggacgcatccaagtgccaccttacacaatcccactcgagtgaagctctttgagaaatggggttggaagaagatcgccaccatccagcaaacgaccgaagtattcacgtccaccctggatgacctcgaggagcgcgtgaaagaggctggcatagagatcaccttcaggcagtcctttttcagtgatcctgctgtgcccgtgaaaaacctaaaaagacaggacgccagaattattgtgggactcttttatgagactgaagcaaggaaggtcttctgcgaggtgtacaaggaacgcctctttggaaaaaaatacgtctggttcctgatcgggtggtacgctgataactggtttaaaatttatgacccaagcattaattgcacagtcgatgagatgacagaggccgtcgaaggccatattactactgagatagtcatgctgaatcccgcaaatactaggtccatcagcaatatgaccagtcaggagttcgtggagaaactcaccaaaaggctcaaaagacaccccgaagagacgggcggattccaggaggctccccttgcatatgatgcaatatgggccctggccctggctttgaataaaacctcgggcggcggcggccgatccggggtaagattagaagacttcaattataacaaccagacaattaccgatcagatctatagggccatgaactcgagttctttcgagggggtttctggacacgtcgtgttcgacgctagcggctctaggatggcttggacgctgattgaacaactccaaggcgggtcctacaaaaaaatcggctattacgacagtactaaggatgacctctcatggtccaaaacggacaagtggatcgtgatatctcgaacccatagcccaacttag

SEQ ID NO: 6765 - DNA, 756 bp, Artificial Sequence
  Description of Artificial Sequence: Synthetic coding sequence
atgcctcatctggcaagtctatttactgcatcttccagatgttgccctcaccctctccggccagagggaagtggcgcaatgggtcccgaagcgctctcctctctactcctcctgctccttgttgccagcggggatgcagatatgaagggccatttcgatcctgccaagtgtcggtacgcgttgggaatgcaagatcggaccattccagactcagatattagtgcaagctcatcatggagcgacagcacagccgcccgtcattctaggttagagtcatcggatggggatggggcatggtgccctgccggcagtgtattcccaaaggaggaggaatacctgcaggtagacctgcagcgcctacatctggtcgccctcgtgggcactcaaggtcggcatgctggcgggttagggaaggaattttcccgctcctatagactaaggtacagtagggatggaaggcggtggatgggttggaaggataggtggggtcaagaggtgatttctggaaatgaggatccagagggcgtcgtcctgaaggacctgggaccccctatggttgctagattggtgcgcttttacccaagagctgatcgggtaatgagcgtgtgcttgcgtgtggaactatatggttgcttatggcgcggtgaatggctgtcattcttgggcatctgctttttaagtcgcggactggaggggggggaatgtggcgaatgggcttctcgcatccctagccctgccggaaagttgagcctttag

SEQ ID NO: 6766 - DNA, 1764 bp, Artificial Sequence
  Description of Artificial Sequence: Synthetic coding sequence
atgaggcctcggggcctgccccctctcctcgtggtgctgctagggtgctgggctagtgtgagcgcccaaaccgacgctaccccagcggtgacaacagaaggactgaacagcacagaagccgccctcgctactttcgggaccttcccctctacaagacctcctggaactcctcgggccccgggccctagcagtggtcctcgccctacacccgtaactgacgttgccgttctgtgcgtatgcgatctcagcccagcacagtgcgacatcaattgttgctgtgatcccgactgctcaagcgtggattttagcgtgttctccgcctgcagtgttccagtggtgacgggagactcacagttctgctcccagaaagcggtgatctacagtctgaacttcactgctaacccaccccaacgcgtgtttgaactagtcgatcagattaacccgagtattttctgcatccatatcaccaactacaagccagctctgagtttcatcaaccccgaagtaccagacgagaataacttcgatacactgatgaagacatcagatggattcaccctaaacgccgagagctacgtgagttttacaacgaaactggatatacctactgctgctaaatatgaatatggggttcccctccagacttcagactccttcctgcgcttcccttcttctctgacctccagcctctgcacagacaacaatcctgcagcatttctggtcaaccaagccgtgaagtgtacccgtaaaatcaatttggaacaatgtgaggagatagaggctctgtcaatggctttttatagctcaccagaaattctcagagttcccgattctcggaagaaagttcccatcacggttcagtcaattgtgatacaatctctcaacaaaaccctgacacgcagagaggacaccgatgtcttgcagcccacactcgtgaatgcagggcactttagtctgtgcgtaaacgtcgtgctcgaggtgaagtactcactgacctatacagacgcaggagaagtgaccaaggctgacctttcttttgttttggggaccgtgagcagcgtggtggtgccactgcagcagaaattcgaaatacactttcttcaggagaatacccaaccggtccccctatccggcaaccctggatacgtggttggcctgccactggctgcgggcttccagcctcataagggttcaggcattattcagaccactaataggtacggccagctaacaatcctgcactctaccactgaacaggattgccttgcactcgaaggcgtgcgcactcccgtgctctttggctacaccatgcagtcaggctgcaaattgcgcttgactggtgccctcccatgccagctagtggctcagaaagtgaagtcattgctttggggccagggctttcccgattatgttgccccttttggaaactcgcaagctcaggacatgctcgactgggttccaatccactttatcacacagtccttcaatcgtaaggactcatgtcaactgcctggcgcgttggttattgaggtgaaatggaccaaatacggatccctgttgaatccccaggccaagatcgtgaacgtcacagcgaacctgatctctagctcgtttccagaggctaactctgggaacgaaaggacaattctgatttcaactgccgtcacattcgtggatgtttccgcccccgcagaagcgggcttccgagcccctcccgccatcaacgcaaggttgccctttaatttcttcttcccattcgtctag

SEQ ID NO: 6767 - DNA, 2067 bp, Artificial Sequence
  Description of Artificial Sequence: Synthetic coding sequence
atgctcccaactgaggttccgcagtctcaccccggcccctccgccctcctactgcttcagctgctgctcccccccaccagcgccttctttcccaatatttggagtctgctggctgctccaggaagtatcactcatcaagacctcacggaggaagccgctctcaacgtgacactccagctcttcctagaacaacctcctccagggcggcctccacttagattggaggactttctgggcaggacccttctggcggatgacctgtttgcggcctatttcggcccaggcagttcccgacgctttagagccgcactgggagaggtgtctcgagctaacgccgcacaagacttcctcccaactagcagaaacgacccggatctgcacttcgacgccgaacgattagggcagggcagggctcggctggtgggcgctctgcgggagaccgtggtggctgctagagcactggaccacacgctggctcggcaacggctgggagccgcactccatgccctccaagacttctattcacattccaattgggtggagctcggggagcagcaaccacacccccatctcttatggccccgtcaggagctgcagaatctggctcaggtggctgacccaacatgctctgactgcgaggaacttagctgcccccgcaactggctggggttcactctgctcacttctgggtacttcggcacccaccctcctaagcctcctggaaagtgttcccacggaggccacttcgataggtcatcaagtcagccacctagggggggaatcaataaggacagcacgagccctggattctctccccatcatatgctgcatctgcaggctgctaaactggcccttctcgcatctattcaggcgttcagcctccttcggtcgcgcctgggagatagggattttagccgcctgttagatatcacaccggccagctccctgtccttcgtgctcgatacaactgggtccatgggcgaagagattaatgccgcaaagatccaggccagacacctcgtcgaacagaggcgaggatctccaatggagcctgtgcattacgttctggtcccttttcatgaccctggctttggtcctgttttcactacaagtgatccagactccttctggcagcaactaaacgagatccatgctctgggcggtggagacgaaccagagatgtgcctgtcggctctacagctggccctcctgcacaccccaccactgagcgacatcttcgtctttacagacgcaagccccaaggacgctttcctgaccaaccaggtggaatcattgactcaggagcgccgttgtcgcgtgacattcctggtgactgaagacacgagtcgcgtgcaaggtagggcccggagggaaattctgagtccactgcgcttcgagccgtacaaggcggtggcccttgcctcagggggcgaagtcatattcacaaaggaccagcacatccgcgacgtagcagcgattgtgggcgaatctatggctgctcttgtgaccctcccgctagatccccctgtagtggtgcccggacagcccctggtgttctccgttgatggcctgctgcaaaagattaccgtccggatccacggcgatattagttccttctggattaagaacccggccggagtgagccagggacaggaggaaggtggcggtccactgggacacactaggagatttggacaattctggatggtgaccatggacgacccccctcagactggcacatgggagattcaggtcacggcagaggatacccccggtgtgcgtgtgcaggcccagactagcctggattttctctttcactttgggattcctatggaagatggcccacacccaggactatacccattgactcagcctgttgcaggattgcagacacagctgctagttgaatctcaaagctggggcagttcagcagcctttctcccccgccatccgtccagaggtcccagaggctgtcggacaaggcctggtgcgttgggcgcccggggaacttcaggggcccggtcaccaagaagcctggccgttgcccacgcggccgtccacccttag

SEQ ID NO: 6768 - DNA, 303 bp, Artificial Sequence
  Description of Artificial Sequence: Synthetic coding sequence
atgaccacccagttgcgagtggttcatctgctccctttgcttttggcctgttttgtgcagacgtccccaaagcaggagaagatgaaaatggactgccacaaggacgaaaaaggcaccatctacgactacgaagctatcgccctcaataaaaacgagtatgtcagcttcaagcagtatgtaggcaagcatatattattcgtcaatgtcgccacgtactgtggcctgacagcacagtatccaggcatgagtgtacagggagaagatttgtacttagtgtcgtcttttcttcggaaaggcatgtag

SEQ ID NO: 6769 - DNA, 705 bp, Artificial Sequence
  Description of Artificial Sequence: Synthetic coding sequence
atgaagaccctcgctgggcttgtcctgggacttgtcatattcgatgcggctgtaacagctcctacacttgaatccataaattacgattccgagacctacgacgccacactagaggatctcgataacctatacaactatgaaaacattcccgtggataaggttgagattgagattgcaactgtcatgccttccggaaatcgggaactgctgacacccccccctcagccagaaaaggcacaggaggaagaagaggaggaggagagcacacctagactgatcgatggcagctcccctcaggaacccgagttcacaggcgtgttgggaccacatacaaacgaagattttcccacatgccttttgtgcacatgcatcagcaccacagtgtactgcgatgatcacgaactcgatgccatcccaccactccccaagaacaccgcatacttttattcacggtttaaccgcataaaaaaaattaataaaaacgactttgcctcactgtccgacctcaagcgaatcgatctgacaagtaacctcatcagtgaaattgatgaagacgcatttagaaaattaccacagctccgggagttggtcctgagagataataagatcaggcagctccccgagctgccgaccaccttaactttcatcgacattagtaacaatcggctgggacggaagggcatcaagcaggaggcctttaaatag

SEQ ID NO: 6770 - DNA, 2559 bp, Artificial Sequence
  Description of Artificial Sequence: Synthetic coding sequence
atgctccctacagaggtcccccagtcccacccaggcccatctgctctcctgctcctacagttgcttctgcccccaacatcagccttctttcctaacatctggagccttcttgctgcaccaggatctatcacacatcaagacttgacagaagaggcagccctgaacgtcaccctgcagctgttcctggagcagccccccccaggccgaccacccctgagacttgaggactttctcggtcgcactttactggccgacgacctgttcgctgcttacttcggccccgggtcatctcgtaggtttcgagccgccctgggggaggtaagtagagcaaacgcagcacaagacttcctgcccacgtctcggaacgatcctgacctgcatttcgacgcggaacggctcggacaggggcgagcccggttagtgggggccttacgagagaccgttgtagcagcccgagctctggatcatacattggcccgccagcgcctcggtgccgccttacatgcactgcaggacttctactctcattccaattgggtagagctgggcgagcagcagccccacccccatcttctgtggccgcggcaggagttgcagaatttggctcaagtcgccgaccccacttgttcggactgcgaggaattatcttgtcccaggaactggcttggtttcactctcttaactagcggatatttcggaactcaccctccaaaaccccccggtaaatgttcacacggcgggcacttcgacaggtcttcctcacagcccccacgcggaggaatcaacaaggactctacttctcccgggtttagcccccaccacatgctccacctgcaagcggccaaattggcactgctggccagtatccaagcgttttctctgcttaggagccgtctgggtgatagggacttttccaggcttttggatatcaccccagcgagctccctgagttttgttctcgatactaccgggagtatgggggaagaaattaatgccgcaaaaattcaggcgcgccatcttgtcgagcagcgtcgtggatcgcccatggagcctgttcactatgttctggtgcctttccacgatccagggttcggcccagtgttcacgacatctgatcctgattctttctggcagcaactgaacgaaatccacgctcttggcggaggagatgagcccgagatgtgtctgagcgccctgcagctcgcccttctgcatactccccccttgtcagatatctttgtgtttactgacgcatcaccgaaagatgccttcctgactaaccaggtcgaaagtctgactcaagaaagaaggtgcagggttacctttctggttactgaagatacctccagagtgcaaggcagagccaggagggagatattgtcacctctgagattcgagccctacaaagccgtagctcttgcctctggcggggaagtcatcttcactaaggatcagcacatacgagatgtcgcagctattgtgggtgagtctatggcggcactggttacactgccattagatcctccagtggtggtgcctggccagcctttggtgttctccgttgatgggcttctacagaaaatcactgttagaattcatggtgatatatctagcttttggattaagaaccccgccggcgtgtcccaaggccaggaggagggcggcggccctctgggacacacgagaaggtttggacagttttggatggtgacaatggatgaccccccccagactgggacgtgggagatccaagtgaccgccgaggacacacctggggtgcgggttcaggcacagacttcactggacttcttgttccattttggcattcccatggaagatggccctcacccaggcctatatcccctgacgcagccggtcgccggcctacagacccagctgcttgttgaagtgaccggactcggcagccgtgcgaatccgggagacccccaaccgcacttctctcatgtcatcttgcggggagtgccagagggggctgagctagggcaggtcccactggagcctgtggggcccccagaaagaggacttttggccgcctccctgtctcccacgctgctgtcgacgcctagacccttctctcttgagctgatcggacaagacgcggcgggacgccgccttcaccgggctgcccctcagcctagcactgtagtgccggtcctgttggagctgagtggcccgtccggcttcctcgcacccggatctaaggtccctctgagccttcgtattgcgtcctttagcggcccgcaagacctcgatctgcgaaccttcgtaaacccctccttctcgctcacatccaaccttagtagggcccacctcgaactgaatgaatcagcctggggccggctgtggttagaagttcctgacagcgcggcacccgattccgtggtaatggtgactgtcactgccggaggccgcgaagcgaaccccgtgccaccaactcatgcgtttctccgtctgttagtgagtgctccggccccccaggtgaggaaccactattttccctctcaaggtccagctcaccacccttatcgccttatttag

SEQ ID NO: 6771 - DNA, 2760 bp, Artificial Sequence
  Description of Artificial Sequence: Synthetic coding sequence
atggggcccgaagcgttgtcctccttactgcttctgctgcttgtcgcatccggagacgctgacatgaagggtcactttgatcccgctaagtgtcgctacgccctgggaatgcaggatagaacaatacctgactcggatattagtgcttctagctcttggtcagactcgacggcagctcggcactctcggctcgagtctagcgatggcgacggtgcgtggtgccctgcaggaagcgtgttccctaaggaagaggagtatctgcaagtagacctgcagaggttgcaccttgtggccctggtgggaactcagggacggcacgctggtggcctgggtaaagaattcagccgttcctaccgccttcgctactcccgcgacgggcgccgatggatgggttggaaggaccggtgggggcaggaagtgatcagcggtaacgaagatcctgaaggcgtggttctgaaggatttgggtcctccaatggtggctcggctcgtacgcttctatcctcgggccgaccgcgtgatgagcgtgtgcctcagagtggaactttatggatgcctctggcgagacggcttactgtcctacacggcccctgtggggcagactatgtatctgagcgaagcagtgtacctgaacgactcaacatatgatgggcacactgtgggcggccttcaatacgggggtctgggccagctggcggatggcgtagtagggttagacgacttccgtaaatcccaggaactgagagtttggccaggatacgactacgttggatggtccaatcatagcttctccagtgggtatgtggagatggaatttgagttcgatcggctgagagcgtttcaagccatgcaggtccattgcaacaatatgcacaccctgggtgccaggttgccgggtggcgtcgaatgtagatttcggcgaggccctgccatggcctgggaaggagagccgatgcgccacaacctcggcggcaacctgggagatcccagggctcgtgcagtttctgtgccgctcggagggcgggtggcccggtttcttcagtgtaggttcctgttcgccgggccttggcttttattttcagagatatcttttatctcagacgtggttaacaatagctcaccagccctgggcggtaccttccctccagcgccatggtggccgcccggcccccctcctactaatttctctagtttggaattggaacctcggggccagcagccagttgcaaaagccgaggggagtcctacggcaattctcatcggctgcctagtcgccattatcctgctccttctactgattattgccctgatgttatggaggctgcattggcgccggctcctgagcaaggcagaaaggcgggtcttagaagaagagttaacagtccatttatccgtcccaggggacactatcctgatcaacaacagaccaggccccagagaaccccccccttaccaagagccccgcccaagaggcaatcctcctcattccgccccttgcgttccaaatggctctgctctgctactgagcaaccccgcctataggttgttgttggccacttacgcacgcccccctagaggaccagggcctcccaccccagcctgggctaagccaaccaacacccaagcgtacagcggcgattatatggaacccgagaagcctggagccccactgctcccaccacctccccagaactcggtgccccattacgcagaggctgatatcgtcaccctgcaaggggtgactggcggcaacacttatgcagtccctgccctgccccccggagccgttggtgatggacccccccgagtcgactttccgagatcccggttgcgtttcaaagagaaactgggcgaagggcagttcggcgaggtacacctttgcgaagtggacagtccgcaggatctcgtttcccttgatttccctttgaatgtccgcaaagggcacccactgttagtcgcggtgaagatcctcagacctgacgctaccaagaatgcgtcatttagcttattttctcggaacgatttcttgaaggaggtgaagataatgagtcgattaaaggatccaaacattattcgactcctcggggtttgcgtgcaagatgatcccctatgtatgattacagattacatggagaacggggacctgaatcagtttctgtccgcccatcagttggaggacaaggcagccgagggagcccccggtgatgggcaggcggcacagggacccacaatctcctacccaatgctcctccatgtggcggcacagattgcctcggggatgagatatctggcgacacttaacttcgtacacagggatctggccactcgcaactgcctggtgggtgagaacttcaccatcaaaattgccgatttcggaatgtctcgcaacctgtatgccggcgattactaccgagtccaagggagggctgtgctcccaatccgctggatggcctgggagtgcatccttatgggaaaattcactacagcttccgatgtgtgggccttcggtgtcaccctttgggaggtcttaatgctgtgtcgggcccagccatttggtcaacttactgacgaacaggtcatcgaaaacgcaggagagttcttccgcgaccaagggcgccaggtttacctgtctcgaccgccagcctgcccccagggcctgtacgagctgatgctgagatgttggtcaagggaatcggaacaaagacccccattttctcagctgcaccgttttctggcagaggatgctctgaacactgtgtag

SEQ ID NO: 6772 - DNA, 1737 bp, Artificial Sequence
  Description of Artificial Sequence: Synthetic coding sequence
atgctgctgctattgctccttgcccccttatttttacggccccctggggccgggggagcccaaacgcctaatgccacatctgaaggttgccaaatcatccatcccccctgggaggggggcatcagataccgcggcctgacgagagaccaggtgaaggccatcaactttctgccggtcgattatgagattgaatacgtgtgtaggggcgaacgcgaagtagtcgggcccaaggtccgtaagtgtttggctaacggatcctggaccgacatggatactcccagtagatgtgtaagaatttgctcaaagtcttaccttaccttggaaaacggcaaagtctttctgaccggcggtgacctgccagctctggatggcgcgagagtagacttccgctgcgaccctgatttccatctagtcggctcaagtaggagcatctgctcccagggacagtggagtacccccaaaccccattgccaggtgaaccggactccacactcagaacggcgcgcagtgtacattggtgcgctttttccaatgagtggcgggtggcctggagggcaggcctgtcaaccagccgtcgagatggcgctggaggacgtgaactctcggcgtgacatcctgcctgattacgagctgaaactgatacatcacgatagtaagtgtgatccaggacaggccactaagtacctctatgagctgctgtataacgatcctatcaagatcatcctaatgcctggatgttcaagcgtcagcaccctggtggcggaagccgccagaatgtggaatttaattgtcctgagctacggctcaagttcccctgctctcagtaaccggcagaggttccctacgtttttcagaacccacccctcagctaccctgcacaacccaactcgggtaaagctgtttgagaaatggggttggaagaaaatcgcaacaattcaacagacgacagaggttttcacctctacgctggacgacctggaagagcgtgttaaagaagcaggcattgaaatcacttttcggcagagcttcttcagtgatccagccgtaccagtgaaaaaccttaagagacaagatgctcgtatcatcgtgggtctattctacgaaacggaagctaggaaagtgttctgcgaggtttacaaggagcgacttttcggcaagaagtacgtctggttcctgattggatggtacgccgataactggtttaaaatttacgatccttccatcaattgtaccgtggacgaaatgactgaggccgtggaaggccacataaccacagaaattgtgatgcttaaccccgctaataccagaagcatatcaaatatgacctcccaggaatttgtggagaaattgacaaagaggctgaagcggcatcccgaagaaacaggtgggtttcaagaggctcccttggcctatgacgcgatctgggccctcgcattggcgcttaacaagacctcaggcggaggaggacgcagtggtgtaaggctcgaggatttcaactacaacaaccagacaattactgaccagatttatagggcaatgaactcatccagcttcgagggggtttccggccacgtggtgtttgatgcgagcggcagccgcatggcgtggacgctaatagaacagctacaaggcggaagttataagaagattggctactatgattccacaaaagatgacctttcatggagcaagacagataagtggattgtcatctcacgcacccattccccaacttag

SEQ ID NO: 6773 - DNA, 516 bp, Artificial Sequence
  Description of Artificial Sequence: Synthetic coding sequence
atgcgccataacctcggcggaaatctgggagacccccgggcccgcgctgtgtctgtgcccctggggggtcgggttgccagattcctgcaatgtcggttcctcttcgcgggaccttggttattgttttcagaaattagcttcatcagtgacgtagttaataacagttcgcccgctctaggcggtacctttcctcctgccccctggtggccacccggcccacctccaacaaatttttcttcactggaattagagcctcgggggcagcaaccagtcgcaaaggctgagggaagtcccacggcaatcttgattggatgcctggtggctattattcttcttctccttctgatcatcgccctgatgctgtggaggttacattggcgccgtctcctgagcaaggtgctggaatcacacccacggacccggtcccctgggctggtggggatccggccgacgccactccctgtctctcccatggccctggtgcacctgtgcgaagttgacagcccacaggattag

SEQ ID NO: 6774 - DNA, 2067 bp, Artificial Sequence
  Description of Artificial Sequence: Synthetic coding sequence
atgcttcctactgaggtccctcaatctcacccagggccctctgcacttcttctcctccagttgctgctgccacccacttctgcctttttccctaacatctggagcctgctcgctgcgcccggttctattactcatcaggaccttaccgaggaagcagccttgaatgtcactctccaactgttcctcgagcagcctcctccaggtcgccctcctctgcgactcgaggactttctgggccggaccctcctggcggatgacctgtttgctgcatacttcggaccagggtcgagtcgaagattccgggccgccctcggagaagtctcaagggccaatgctgcccaggacttcttgcccacctcaaggaacgatccggacttgcattttgacgctgaacgactaggccagggtcgcgcccggctggtgggcgctctcagggagacagtcgtagccgctagggcgttagatcacactctggccagacagcgtctgggcgctgctctccatgctttgcaagacttctactcccactctaattgggtcgagctaggcgagcaacaaccgcatcctcatttactatggccccggcaggagcttcagaacctcgcacaggtggccgaccctacgtgttctgattgcgaggagctaagctgcccccgcaattggttagggttcacactcctcaccagcggctacttcggaacccacccccctaagccccccgggaagtgttcacacggaggacatttcgatagatcctcctcccagccgcctagaggcggaattaataaggacagtacaagtcccggattcagcccccatcacatgctccatctgcaggctgccaagcttgccctgctggcttccatccaggccttctctcttttgcgaagtcgcctgggtgaccgcgatttctcccgtctgttggacattacacccgcaagttctctgtctttcgtgctggacactactggttcaatgggggaggagattaatgccgcaaagatccaggcaagacatctcgtggagcaaagacgggggtcgcccatggagccagtacactatgtgctagtcccgttccacgatccaggctttgggcccgtcttcactacgtctgacccggatagtttttggcaacaattaaacgaaattcatgctttaggcggcggcgacgagcccgaaatgtgtctctcagctctgcagttggcgttactccatactccacctctgtcagatattttcgtttttactgatgccagtcctaaagacgccttcctgacaaatcaggtcgaaagtctgacacaggaaagaaggtgccgggttacgttccttgtgaccgaggatacctcacgggtgcaaggccgggctaggcgcgaaatactttctcccctgaggttcgagccctataaggccgtggccctggcatcaggcggtgaggttatctttaccaaagaccaacacatcagagatgtcgcagcgatagtaggtgagtcaatggccgcactcgtgaccctaccattagatccacccgtagtggtcccaggacaacctctagtgttcagtgtggacggcctgctgcagaagatcacggtacgaatccatggagacatttctagcttctggatcaagaatcctgctggcgtgagtcaaggccaggaagagggaggcggacccctggggcatactcggagatttggacaattttggatggttacaatggacgatcctccccagacagggacctgggaaatccaggttacggccgaggacaccccaggagtccgagtgcaggcccaaacctccctggacttcttattccactttggaattccaatggaagacgggccgcacccgggcttgtaccccctcacccaacctgtggctggactgcaaacgcagcttctcgttgagtcccaatcttggggcagtagcgctgctttcctacctcgacacccttcaaggggccctcgcggctgtcgcaccaggcctggagccttgggagcgcggggcaccagcggtgcgagatcaccaagaagcttggccgtggcacatgctgcagtacacccatag

SEQ ID NO: 6775 - DNA, 5097 bp, Artificial Sequence
  Description of Artificial Sequence: Synthetic coding sequence
atgagactgctctggggtcttatttgggcctctagtttctttacattaagcctgcagaaaccacgtttactgctgtttagcccctcagtggttcaccttggagtcccactgagtgtgggagtgcagttgcaggacgtcccccggggacaagtggtgaagggctctgtcttcctgcgaaatccctcgcgtaataatgtcccttgctcacctaaggtcgacttcacactctccagtgaacgggactttgctctgttgtctttgcaagtaccgcttaaagatgcaaaatcatgtgggctgcatcagctcttacgcggtcccgaagtgcagctcgtcgcccacagtccatggttaaaagattccctctctaggaccaccaacatacaggggattaacctgctctttagcagcagacgcggacacctgttcctgcagaccgatcagccaatttacaatcccgggcagcgtgtacggtaccgggtatttgcgctcgaccagaaaatgaggccatcaacagacactataaccgtcatggtggagaactcccatggccttagagtcagaaaaaaggaggtctacatgccatcttccattttccaggatgactttgtgataccagatatcagcgagccaggaacatggaaaataagtgcccgtttctcagacggcctggaaagcaattcttccacacaattcgaagtgaaaaagtatgtgctcccaaactttgaggtgaagatcaccccgggcaagccctatattctgaccgtcccgggacacttggacgaaatgcaactggatattcaggctcggtacatatatggcaagcccgtgcaaggcgtcgcctatgtgcgctttggtctgctggacgaggatggcaagaagaccttttttcgggggcttgaatctcaaactaagttggtcaacgggcaatctcacatttccttatcaaaagccgagtttcaggatgcccttgagaaacttaacatggggatcacggaccttcagggcctccggttgtacgtagcagcagctatcattgaatatccaggaggcgagatggaggaggccgagctgacatcttggtatttcgtgtcaagcccttttagtctagacctgtccaagacaaagcgccacttggtgccaggcgccccttttctactacaggcactggtgcgggaaatgtccggctcacccgcttcgggcattccagtcaaagtttccgccaccgtaagtagtcctggatccgtacctgaggtgcaggatattcagcagaatacagacggaagcggccaggtctcaatccctataataattccacagacaatatctgaacttcagctgagtgtcagtgccggcagtccacacccagccatcgccagactcacagtggctgcacctcctagtggcggcccaggatttctgtcaattgaacgccctgactcccgcccaccacgtgtgggtgacaccctgaaccttaatttgcgagccgtgggttcaggagcaaccttctcccattattactatatgattctgtctaggggccagattgtttttatgaaccgggagccaaaaaggactcttaccagcgtgtccgtcttcgtcgaccatcatctggcgccctccttctattttgttgccttctactaccatggagaccaccccgtagccaattctctccgggttgacgttcaagccggggcatgtgaaggtaagcttgagcttagcgtagacggggccaaacaatataggaacggggagtctgtgaagctgcacttggagaccgattctctggctctcgtggctctgggagctctagacaccgccctgtacgctgcggggagtaaaagccataagcctctgaacatgggcaaagtgttcgaggctatgaacagctatgacctgggttgtggtcctggaggaggggactcagcgctgcaagtgtttcaagcagcaggcctggctttctccgatggagaccagtggacactgtcccggaaacggctctcctgccccaaagaaaaaactacgcggaaaaaacggaatgtgaatttccaaaaagcgattaatgagaaactcggccaatacgccagcccaactgcaaaacgatgttgtcaggacggtgtgacccgcctaccaatgatgagaagctgtgaacagcgcgctgctagagtgcagcagcctgattgcagggagcctttcctttcctgttgtcaatttgccgagtctttgcgtaaaaagtcaagagataaaggacaagctggcctgcagagagcccttgaaatacttcaggaagaggatctgatagatgaagatgacatcccggtgagatccttcttcccagagaattggttatggagggtcgaaactgtggatcgttttcagattttgactctgtggcttcccgatagtttgacaacctgggaaatccacggactgtctttgagcaagacaaaaggtctgtgcgtcgccactccagtgcaactccgagtgtttagagagtttcacttacacctgagattacccatgagcgtgcgccgattcgagcagctggagttgaggccagtcctgtacaattaccttgacaagaacctaaccgtaagtgtccatgttagtccagtggaaggcttgtgcctcgccggaggcggcgggcttgcccagcaagtgctcgtcccagcaggtagtgccaggcccgtggctttctccgtagtcccaactgcagcggctgctgtctcactgaaagtggttgctcggggctcctttgaattcccagtgggggatgccgtctccaaggttctccagattgaaaaagaaggcgcgattcacagggaagagctggtttacgagctgaatccattagatcaccggggaagaacactggagatcccgggcaactcagatcctaacatgatccccgacggagatttcaacagctatgtcagagtgacggcctctgacccgcttgacactctgggatccgagggcgccttgtcccccggcggcgtggcgtcattgttacggttacctcgtggctgtggggaacagactatgatatatttagccccaacactggctgcgtcgcggtacctcgacaagactgaacagtggtctacactaccccctgaaacgaaggatcatgctgttgatcttattcaaaaggggtatatgagaatccaacagtttaggaaggctgacgggtcttatgctgcttggctctctcggggatcctctacgtggctgacggcctttgttcttaaggtgctcagtctggcccaggaacaggtgggtgggtcgcccgagaagctccaggaaacctccaactggctgctgagtcaacagcaggctgatgggtcattccaggacctttcacctgtcatacatcgatccatgcaaggcgggctggtaggcaacgatgagactgtggctctcacggcgttcgttaccatcgctctgcaccacggtcttgccgtatttcaggacgagggtgcagaacccctcaagcagcgcgtggaggccagcatttctaaggcaagcagctttctgggggagaaagcgtccgcaggtctgctaggcgcacatgccgcggcaatcactgcctacgcgttgaccctcacaaaggccccagccgatttgcgcggtgtggcccataacaacctgatggccatggcgcaggaaaccggcgacaacctctactggggtagcgttaccggttctcagtccaatgctgtcagccccactcccgccccccgcaacccttccgaccctatgccgcaagcaccagcactctggatcgagacgacagcttacgcccttctacacttactgctccatgaaggaaaggccgagatggccgaccaggctgcggcatggctgaccagacagggatcttttcaggggggtttccgttctacacaggatacagtgatcgcccttgatgctctttccgcttactggatcgcttcacacacaacagaagaacgggggctcaatgtcaccctcagcagtactgggagaaacggttttaagtcccacgcactgcagctcaataatagacagatccggggtttggaagaggaattacagttcagcctaggatctaagattaacgtcaaagtcggtgggaacagtaagggcacgttgaaagtcctccggacatataatgtgctcgacatgaaaaacacaacctgtcaggacttacaaatcgaggtgaccgtcaaagggcatgtggaatacacaatggaggcaaacgaggattacgaagactatgagtacgacgaattgccagctaaggatgaccctgacgcacctctgcagcctgtgaccccgcttcagttatttgagggaaggcggaataggaggagaagagaggcccccaaactgacatccctatcagataggtacgtcagtcattttgaaactgaagggccccacgtactgctatactttgattccgtgcctacttctcgggagtgcgttgggtttgaggctgtgcaggaagtacccgtcggacttgtgcaaccagcaagcgcaacgttgtacgattattacaacccggaacgtagatgctctgtgttctatggagcgccatctaagtcacgcctgctcgcgaccctctgctccgctgaagtatgtcagtgtgcggagggaaagtgcccaaggcaacgccgagccttggagcgtggcctgcaggacgaagacggatatcggatgaaatttgcatgttactatccccgtgtggagtacggcttccaagtcaaagtgttacgcgaagattcacgtgccgcattccgcctgttcgagacaaagatcacacaggtgctccacttcactaaagacgtcaaggctgccgctaaccaaatgagaaactttctagtgagagcttcttgccgcttgcggctagaacccggcaaggagtacctgataatgggattagatggagccacctacgacctggaggggcacccccagtatctcctggattctaattcctggattgaggagatgccaagcgagcggctctgccgttctactagacagagagctgcttgtgcccaactgaatgacttcctgcaagagtacggtacacagggatgtcaagtttag

SEQ ID NO: 6776 - DNA, 726 bp, Artificial Sequence
  Description of Artificial Sequence: Synthetic coding sequence
atgaagttcatcctgttatgggccctgttaaatttgacagtcgctctggcttttaatccagactatactgtgtcttcaacccccccttatctggtgtatctgaaatctgactacttgccctgcgctggcgttctaatccatccattatgggtgattactgccgcgcactgcaatttgcccaaactgagggtgatattaggagtgactatccccgctgattccaacgagaagcacctgcaggtgattggctacgagaaaatgatccaccacccccacttttcggtgactagtatagatcacgacatcatgctaattaaattgaaaactgaagcagagctgaacgactacgtaaaactggcaaacctaccttatcaaactatttccgaaaacaccatgtgttcagtgagcacctggagctataacgtttgcgacatctataaagagcctgattcactgcagaccgtgaatataagcgtgatttctaagcctcagtgtcgcgatgcctacaaaacatacaacattaccgaaaacatgctgtgcgtgggcattgtgcctgggcgtcggcagccctgcaaagaggtatcggcagcacccgccatatgcaacggtatgctgcagggaattctgtctttcgccgatgggtgcgtgctgcgagctgatgtcggtatttatgcaaagatattctattacatcccatggatcgagaatgtgatccagaacaactag

SEQ ID NO: 6777 - DNA, 732 bp, Artificial Sequence
  Description of Artificial Sequence: Synthetic coding sequence
atgggaccggaagccctgagtagcctcctattactcctactggtcgcttccggcgatgcagatatgaaaggacatttcgatcccgccaaatgcaggtacgccctgggaatgcaggatcgaactatcccagacagcgacatttccgcatcgtcctcctggtcggattccacagccgctagacacagccgacttgagagtagcgacggcgatggggcctggtgtccagcgggatccgtcttccctaaggaggaggagtatttacaagtggatctgcagaggttgcacttggtggccttggttgggactcaaggccgccacgcaggaggcctgggcaaggagttttcccggtcctaccggcttcgctacagcagagacggacgaagatggatgggttggaaagaccggtgggggcaggaggttattagtggtaacgaggatcccgaaggagttgtgcttaaggatctcgggccacccatggtcgctaggctggtgcgattctatccccgggctgatagagtgatgagtgtttgcctgagagttgagctatatgggtgcttgtggcgggactgcagcatgggagtctgggcctcgtggcagatggtgtggtggggctggatgactctgggcagagtacggagttgtggctcaggtcaggctatgacgatgtgggatggagccaccactgcttctcctgtagctatgtggaggtggtctctctccctgactggctag

SEQ ID NO: 6778 - DNA, 1986 bp, Artificial Sequence
  Description of Artificial Sequence: Synthetic coding sequence
atggacctggtgctgaaaagatgcctcctgcacttggccgttatcggagcacttctggctgttggggccacaaaggtgcctagaaatcaggactggttgggagtgtcccgccagctccgcaccaaagcttggaacaggcaactgtaccctgagtggacggaagctcagaggctggattgttggcgcggtggccaagtgagtctgaaggttagcaacgacgggcctacactgattggcgctaacgcttcattcagcatcgctctcaatttccctggaagccagaaggttttacccgacgggcaagtgatctgggtgaacaacaccattataaatggcagccaagtctgggggggacaacctgtttaccctcaggagaccgatgatgcatgcatcttccctgatggaggcccttgcccgagcggttcgtggtcccagaaaagatcttttgtttatgtgtggaaaacgtggggacagtattggcaagtactgggtggcccagtgagtggattatccatcggtactgggcgggccatgctggggacccacactatggaagtgaccgtctatcaccgacgcggcagtcgttcttatgtcccattggcccactcctcttctgctttcacgataaccgaccaagtgcctttctctgtgtccgtctcccaactgagggctctggatggaggcaacaagcattttttgcggaaccaacccctcactttcgcactgcagctgcacgacccctcgggatacctggcagaggccgatctttcttacacttgggatttcggagattcttcaggcacattgattagccgggcactagtggtgacacacacatatttggaacctggccctgtcactgcacaagtcgtgcttcaggccgccatcccactgacatcatgcggctcatcaccagttcccggcactacagacggccatcgccccacagccgaggcccccaacacaaccgccggccaggtccccacaaccgaggttgtgggcacaaccccggggcaagcacccactgccgaaccttcgggcacaacctctgtgcaggtacctaccaccgaggtgattagtaccgctccagtacagatgccgaccgctgaaagcacaggtatgacaccggagaaggtcccagtttccgaagtgatggggacaacactggcagagatgagtacacccgaggccacaggcatgactccagccgaggtgagcattgtggttctctccggcaccaccgcagcccaagtgaccaccacggagtgggtagaaaccactgcgcgcgagctgcccatcccggaaccagaagggcccgacgctagtagcatcatgtcgacagagtcaattacaggcagtcttggacccctgctcgacggaacagctacactgcggctagtgaagcgccaagtcccactggattgcgtgctgtatagatacgggtccttttctgtgaccctcgacattgttcaagggatagagtcagcagagattttacaagccgtgcccagcggcgagggggacgcctttgagttgacagtgtcttgccagggaggcctacccaaggaggcttgtatggagatctcttcgcccggctgtcagcccccggctcaaaggttatgtcagccagtgttaccttcccctgcctgtcagttagtcctccaccaaatcctcaaaggcggctccggcacctactgccttaatgtgtccctggctgacaccaactctcttgccgtcgtaagcacccagttaatcatgccgggccaggaagccgggcttggccaggtgccgctcatagtcggaatactcttagtgcttatggcagtggtactcgcatcattaatctaccgacgtcggctgatgaaacaggattttagcgtgccacagctgccccattcatcctcacattggctgcggctgcccagaatcttctgctcttgtccgatcggggaaaactctccccttctgagcggacagcaggtgtag

SEQ ID NO: 6779 - DNA, 2760 bp, Artificial Sequence
  Description of Artificial Sequence: Synthetic coding sequence
atgggacctgaggcattgtcaagcctgttgttgcttctcctggttgcaagcggagatgccgacatgaaaggccacttcgatccagccaaatgtcggtatgcgctaggtatgcaagaccgcactattccagactccgacatctcagcgtccagcagctggtcagatagcacagctgcccgacactcgcggcttgaatcgtcagacggcgacggagcatggtgtcccgctggctctgtgttcccaaaggaggaagagtatctgcaggttgatcttcagcgcctccacttagtggcactagtaggcacccagggtcgtcatgctggcgggctcggaaaggaattttcacggtcttacagactgcgctactcccgagatggacgccgatggatgggttggaaggacagatggggtcaggaagttatctcaggcaatgaggatcctgaaggggtggtgttgaaggatctggggcctccaatggtggccagactagtgcgtttttaccctcgagcagacagagttatgagcgtgtgccttagagtggagctgtacggatgtctctggcgagatgggctgttaagctacactgcaccggttggccaaacaatgtacttgtccgaggccgtctacctgaatgacagtacatatgacggccatacagtgggcggactgcaatacggagggctcgggcagttggctgatggggttgtgggactggacgatttcagaaaatctcaagaactgagggtttggccaggatatgactatgtagggtggtctaaccactcttttagcagtggatacgtggaaatggagttcgaatttgacagacttcgggcatttcaggcgatgcaggtccattgtaataatatgcacaccttaggggctagactgccaggcggggtagagtgccggttcaggcgaggaccggccatggcttgggaaggtgagcctatgcgccataatttgggaggtaacctgggggatccaagagccagagccgtaagtgtgcctctcggcggaagggtggctagatttcttcaatgccggttcctgtttgcgggaccatggctcttgttcagcgagataagcttcatatccgacgtggtgaataatagttcccccgctcttggaggcacatttccccctgccccgtggtggcctcctggcccccctcccaccaacttttcaagcctggagttagaaccaaggggacagcagccagtcgcgaaggccgaagggtctccaactgccatcctgattggatgcctagtcgcgattatcttgctgcttctgcttattatcgctcttatgctgtggcgccttcattggcggaggctgctcagcaaagccgagagacgcgttcttgaggaggagctaacagtacacctaagtgtacctggagacacaattctgataaataaccgccccggccccagagagcctcctccgtatcaagagcctcggccaaggggcaatcctccccactcggcaccctgtgtgccaaacggctctgcactgctcctgtctaaccctgcctatcggctgctgcttgcaacttacgctcgacccccaaggggaccaggaccccctacgccagcttgggctaaacccacaaacactcaggcgtacagcggagattacatggaacccgaaaagcccggcgcccctctgcttccccccccgcctcagaatagcgtccctcattacgcagaagctgacatcgtgaccctccaaggagtgacaggtgggaatacctatgctgtgccagccctccctcccggggctgttggcgacggacccccacgtgtagacttccctaggagcagattgagattcaaggagaaacttggggagggccagttcggagaagtccacctatgtgaagtagacagtccacaggacctggtgagcttagatttccccctcaatgtaaggaaaggacaccctttactggttgccgttaaaatccttcggccagatgcgactaagaatgccagttttagcctgttcagcaggaacgactttctgaaggaagtcaagattatgtcccggctgaaggacccaaacatcattaggctgcttggtgtgtgcgtccaggacgacccgctctgtatgattaccgactacatggagaatggagatctgaaccaatttctctccgcccaccaactggaagacaaggctgcagagggcgctcctggggacggacaggccgcacagggccctactatcagctatccaatgcttctgcacgtggcagcccagattgccagtggtatgcgctacctcgccacactgaactttgtccacagggatctcgcaactaggaactgcctggtcggggaaaactttaccataaaaatagctgacttcggaatgagcagaaatttgtatgctggcgactattacagggtccagggccgcgcagtcctgccgattcgatggatggcctgggagtgcatcctaatgggaaaattcacgacggccagtgatgtctgggcctttggagtgacactatgggaagtgcttatgttgtgcagagcacagccatttggacagctgacagatgagcaagtgatcgaaaacgccggggaattctttcgggatcaaggtcgccaggtttatttaagccgtccccccgcttgtccgcagggactgtatgagctgatgctcaggtgctggtcccgcgaatcagagcagaggcctccattctcccagctgcaccggtttctagccgaggacgccctcaacaccgtttag

SEQ ID NO: 6780 - DNA, 216 bp, Artificial Sequence
  Description of Artificial Sequence: Synthetic coding sequence
atgcccgcaggggtgcccatgagtacgtatctcaagatgtttgcagcttcactcctggccatgtgtgctggtgccgaagtggtccataggtactatcggcccgacctgacaatcccagagatcccgccaaagagaggtgagctgaaaaccgagctgctgggcctgaaggagcgtaaacacaagccccaagtgtcgcaacaggaggaattgaaatag

SEQ ID NO: 6781 - DNA, 2685 bp, Artificial Sequence
  Description of Artificial Sequence: Synthetic coding sequence
atgtccctcccccgatgttgccctcatccactccggccagaaggctccggcgccatgggcccagaagcactgtcctcactactcctgctgcttcttgtggccagcggggatgctgacatgaagggtcactttgatcccgccaaatgtcgttacgcacttggcatgcaggaccggactattcccgacagtgatatctctgcctcatctagctggtctgattcaacggctgccaggcattctcggctggagtcatcagatggtgacggggcttggtgtcctgctggctccgttttccctaaagaagaagagtacttgcaagttgaccttcagcgcctgcacttggtggctcttgtgggcacccaaggcagacacgctgggggcctcggtaaggaattcagtcgcagctatcgcctgcgatacagccgtgatggcaggcgctggatggggtggaaggatagatggggtcaagaagtcatctcagggaacgaagaccctgagggcgtcgtccttaaagacctcggaccacccatggtggcccgcctcgtgcgcttctatcctcgcgctgaccgcgtgatgtcagtgtgccttcgtgttgagctgtacgggtgcctgtggcgggatggtttgttgtcttatactgcgcccgtgggtcagacaatgtatctgagcgaagcagtctacttgaatgatagcacatacgacggacacaccgtcggcgggctgcaatacggcgggctgggacagctggctgacggcgttgtcggactggatgactttaggaaatcccaggagctgcgagtctggcccggttacgactatgtgggatggtccaatcatagcttttcatctggttatgtggaaatggagtttgagttcgacaggctgcgagccttccaggctatgcaggttcactgcaacaatatgcataccctgggggctcgccttcctggaggcgtggaatgtcggttcaggaggggccctgctatggcttgggaaggggaaccaatgcggcacaatctcggcggcaatctgggagatcccagagcacgggccgtatcagtgcctcttggagggcgggtggcacgctttctgcagtgtcgctttctcttcgcaggcccctggctgctcttcagtgagatcagcttcattagcgacgtggtgaataactccagtcccgcccttggaggcactttcccacccgccccctggtggccccctgggcctccccctaccaacttttcatcactggagctcgagcctagggggcagcaaccagtcgcaaaggccgaagggtcacccactgcaatcctcatagggtgcttggtggccatcattctcctgcttcttctcataattgcgctgatgctctggaggctccattggaggcggcttctgagtaaagctgaaagacgggtcctcgaggaggagctgaccgtgcacctatctgtgccaggtgataccatcctcattaacaatcggcccgggcccagggagccacccccttaccaggagcccagacccagggggaatccacctcactcagcaccttgtgtgccaaatgggtcagcctactctggcgactatatggagcccgaaaagcccggcgctccacttctgccaccccccccacagaactctgtaccacattatgccgaagctgacattgtcacactgcaaggcgtgaccggtggaaatacatatgctgtcccagcccttcctccgggcgcagtgggtgacggaccaccccgcgttgatttcccccggtcccgacttcgctttaaggaaaagctgggggagggccaattcggagaggtgcacctgtgtgaagtggatagccctcaggacctggtgtcgttggattttcctcttaatgtcagaaaaggtcatccgttgctagttgcagttaaaatcctgaggcccgacgctacaaagaatgcaagaaacgatttcctcaaggaggtcaagatcatgtcaaggttgaaggaccccaacataatcaggctgctgggagtctgcgtgcaggatgatccactgtgcatgatcacggattacatggaaaatggtgacctgaatcagttcttgtcagctcatcagctggaggataaagcagctgagggtgctccaggtgatgggcaggctgcccagggccctactatctcctaccccatgcttctacacgtggctgctcagattgcatccggcatgaggtacctcgccacgctcaactttgtgcaccgggacctggctacccgaaactgcctggtgggcgagaactttactatcaaaatcgcagacttcgggatgtctaggaacctgtacgctggggactattaccgcgtgcaggggagagccgtccttcctatccgttggatggcatgggaatgtatcctaatggggaagttcaccactgcgtccgacgtttgggctttcggagtgaccctgtgggaagtgctgatgctatgcagagcccaaccattcgggcagctaacagatgaacaggtgattgaaaatgcaggagagtttttccgagaccagggccgacaggtgtacctttccaggccgcccgcctgtccccaaggactatacgaactgatgctacgttgttggtcgcgagagtccgaacagcggccaccatttagccagctgcatcgattccttgcagaggacgctctgaatacagtgtag

SEQ ID NO: 6782 - DNA, 273 bp, Artificial Sequence
  Description of Artificial Sequence: Synthetic coding sequence
atgcagttgttcctacttctgtgcttggttctgttgtctccgcagggggcttcattacacaggcaccatccaagggagatgaagaaaagagtggaagacttgcacgtgggggctacagtggcaccatcttctcgaagggattttacgttcgacctgtacagagctctggcatcagccgccccttcccaaagtatatttttttcccccgtatcaatttcaatgtctctggcaatgctgtctctgggtgctggctctagcacaaagatgcaatag

SEQ ID NO: 6783 - DNA, 618 bp, Artificial Sequence
  Description of Artificial Sequence: Synthetic coding sequence
atgatgaggacattgatcacaacacaccctctgccactgctcctcctgcctcaacagctgctgcagctggtgcagtttcaggaagtcgatactgattttgattttcccgaggaagataagaaggaggagttcgaggagtgcttggagaagttctttagcaccgggcccgcgcggccacctactaaggagaaggtcaaaagacgggtcttgatcgaaccaggtatgcccctgaaccatattgagtattgcaatcacgagataatggggaagaacgtgtactacaagcatagatgggtagccgagcactactttctgctgatgcaatacgatgagctccagaagatctgctacaatagattcgtcccatgcaagaatgggatccggaagtgcaacagatctaaaggcctggtggaaggagtgtattgcaaccttaccgaagctttcgagatcccagcctgtaaatatgagtccctctaccgcaagggatacgtgctgatcacgtgttcgtggcagaatgaaatgcaaaaaagaatcccacacactattaacgatttggtcgaaccaccagaacatcgaagcttcttgagcgaggatggggtcttcgtgatctccccatag

SEQ ID NO: 6784 - DNA, 30 bp, Artificial Sequence
  Description of Artificial Sequence: Synthetic coding sequence
atgtccttctccgctacgattctcttttag

SEQ ID NO: 6785 - DNA, 600 bp, Artificial Sequence
  Description of Artificial Sequence: Synthetic coding sequence
atgtcctttagtgccacaattcttttctcccccccctccgggagtgaagctcgttgctgttgctgtgcctgcaaaagtgagacaaatggcggtaacaccggttctcaaggcggtaatcctcctcctagtacccctatcaccgttacaggacatgggcttgctgttcagagctccgaacagttactacacgtaatctaccagcgggtggataaagccgtgggactggcggaagcggcattgggcctggcacgggccaacaatgaattactgaagcgccttcaggaggaggtgggcgatctgagacagggaaaggtatccattccagatgaggatggggaaagcagggcccattccagtccccctgaagaaccaggccctctgaaagaatcccctggagaagctttcaaggctctgagtgctgtggaagaagaatgtgactctgttggctccggggtccaggttgtgatcgaagagctgaggcaacttggggctgcctccgtgggcccaggaccactggggttccctgccacacagcgcgacatgcgattacccggatgtacattagcagcatccgaggctgcccctcttctcaatccttag

SEQ ID NO: 6786 - DNA, 633 bp, Artificial Sequence
  Description of Artificial Sequence: Synthetic coding sequence
atgagtgcggggaagatgatgaggacactcattaccacacacccacttccacttctgctcttaccccagcagttgcttcaacttgtccaattccaagaggtggataccgatttcgatttcccagaggaggataaaaaagaagagttcgaggagtgcttagaaaaatttttctctaccggacctgcccggccgcctacaaaggagaaagtcaagcgtcgcgtgctcatcgaacccggaatgccactcaaccacatcgagtactgtaaccacgagatcatgggaaaaaacgtgtactataagcacagatgggtggctgagcattattttctcttgatgcagtatgatgagctccagaaaatctgttacaaccggtttgtaccttgcaaaaacggtataagaaagtgcaaccgcagcaaaggtctggtggaaggcgtgtactgtaacctgactgaggcctttgagataccagcttgcaaatacgaaagtctttacagaaaagggtacgtgttgattacttgttcctggcaaaatgagatgcaaaaaaggattccacacaccattaacgacttggtcgaaccccccgagcacagatcttttctctctgaggatggcgtattcgtgatcagtccctag

SEQ ID NO: 6787 - DNA, 1221 bp, Artificial Sequence
  Description of Artificial Sequence: Synthetic coding sequence
atgcagctcttccttttgctgtgcctcgttctcctgagcccccagggtgccagcttgcatcgccatcacccacgggaaatgaagaagcgagtggaagacctgcacgtgggtgctacagtggccccgtcaagccgacgtgattttactttcgatctgtaccgagcacttgcaagcgctgcaccatcgcagtcgattttcttcagccccgtgagcattagtatgagcctggctatgctgtctctgggtgctggttcttccacaaaaatgcaaatccttgaaggtctgggcttaaatttgcagaaaagtagtgaaaaagagctgcaccggggctttcagcagctattgcaggaactcaatcagcctcgcgatggctttcagctctcactgggcaacgccctgtttaccgacctggtggtagatctgcaggacaccttcgtatcagccatgaaaaccctttatctggccgacaccttcccaacaaactttcgtgactccgctggggccatgaagcagatcaatgattatgtggctaaacagacaaaagggaagattgtggatctgctgaagaaccttgacagtaacgccgtggtgatcatggtcaactatattttctttaaggcgaagtgggagactagcttcaaccataaaggcacccaagagcaggatttttatgtgactagcgagacagtggtcagggtacccatgatgagcagagaggatcagtaccactacctattggacagaaatctgagctgtcgggtagtgggcgtgccatatcaaggtaatgctacagccctcttcatcctgccgtcagagggcaaaatgcaacaggtggagaacggactgtctgagaaaacactgagaaagtggttgaagatgttcaagaagcggcagcttgagctttacttgcctaagttctcaatcgagggatcttaccaattggaaaaggttctcccctctctaggaatcagcaacgtgtttacttcccacgccgatttgagtgggataagcaaccacagtaacatccaagtctcagaaatggttcataaggccgtcgtggaggtggatgagagcggaactcgcgctgccgcagctacaggcactatcttcaccttccggagcgcccgccttaatagccagcgcttggtcttcaacaggccctttttaatgttcattgtagacaacaacattctatttcttggaaaagtcaataggccatag

SEQ ID NO: 6788 - DNA, 600 bp, Artificial Sequence
  Description of Artificial Sequence: Synthetic coding sequence
atggagacgtttccactcctgctcctgtccctgggtctggtgttagcagaagcttctgaatccaccatgaagattattaaggaggagttcactgacgaggaaatgcagtacgacatggctaaaagcggccaggaaaagcagaccattgagatcctgatgaatcccatcttgctcgtgaagaacacgtcactgtcaatgagtaaggatgatatgtcgagtactttattaacctttcgctcactgcattacaatgatccaaaaggcaacagttccggcaacgacaaggagtgttgcaatgatatgaccgtatggcgaaaagtcagcgaggcgaacggttcctgcaaatggtccaataactttattcgcagttctaccgaagtcatgagacgggtgcaccgagcacctagttgtaagtttgttcaaaatccaggtatttcgtgttgtgaatccctggaattagaaaatactgtgtgccagttcaccaccgggaagcagttcccgagatgtcaatatcacagtgtgacgtccctggaaaaaatacttacagtcctgacgggacattctctgatgtcgtggctcgtgtgcgggtccaagctctag

SEQ ID NO: 6789 - DNA, 411 bp, Artificial Sequence
  Description of Artificial Sequence: Synthetic coding sequence
atgtccttttctgcaacaattctcttcagcccaccttctgggagtgaagcccgctgctgctgctgcgcctgcaaatctgaaaccaacggggggaataccggctcccaaggtggcaatccacccccttctaccccgataactgtgacgggccacggtctggctgtccagtcatcagaacaactgctgcacgttatctaccagcgcgttgataaagcggtggggttggccgaggcagcgttaggactagctcgcgctaataatgaactgctaaaacgcctccaggaagaggtcggcgatctgcggcaagggaaggtttctatccccgatgaggatggggagagccgcgctcactctagtccaccggaggaaccaggtcctctgaaagagtcacctggagaagcctttaaatag

SEQ ID NO: 6790 - DNA, 252 bp, Artificial Sequence
  Description of Artificial Sequence: Synthetic coding sequence
atgagcttcagtgctaccatcctctttagccccccttctgggagcgaagccaggtgctgttgctgcgcttgtaagtccgagacaaacggtggcaataccggcagccaggggggcaatccccccccttcaacgcccatcactgtcacaggccatgggctcgccgtccagagctcagagcagctcctacacgtgatttaccaacgggtggataaagccgtaggactggccgaggctgcactggggctagcttag

SEQ ID NO: 6791 - DNA, 30 bp, Artificial Sequence
  Description of Artificial Sequence: Synthetic coding sequence
atgagtttttcagcaaccatcctgttttag

SEQ ID NO: 6792 - DNA, 519 bp, Artificial Sequence
  Description of Artificial Sequence: Synthetic coding sequence
atgcagctctttttgctgctctgtctagtccttctgtcaccccaaggagcttctcttcatcgtcatcatcctcgcgaaatgaaaaaaagagtggaagacctgcatgtaggcgccactgtggccccctctagtcgtcgggattttacttttgatttatatagggccctggccagcgccgctcctagccagagcatcttcttttcgcccgtgtcaatatccatgtccctggcaatgctatccctgggcgcagggagctctacaaagatgcagatcttggaaggactggggctaaacttgcagaagtcgtcagagaaagagctccatagagggttccagcaattgctccaagagcttaaccagccgcgtgatggctttcagctaagcctcggcaacgccttgtttactgacttggtggtggatctgcaggacaccttcgtgagcgcgatgaagaccttataccttgcggatacctttccaacaaacttccgcgacagtgccggagcaatgaaacaaatatag

SEQ ID NO: 6793 - DNA, 615 bp, Artificial Sequence
  Description of Artificial Sequence: Synthetic coding sequence
atgccaggcggtaagaaggtcgcaggaggtggctcttccggagcgactcccacttctgcggcagcaaccgccccatctggtgtcaggagactagagaccagcgaagggacctcggcgcaaagggacgaggaacccgaagaagaaggtgaggaggatttacgggacggcggcgttccttttttcgtcaatcgcggagggctcccggtggatgaagctacctgggagcgcatgtggaaacatgttgcaaagatacatcccgatggagagaaagtcgcccagcggatccgaggcgccacagatttgcccaaaatccccatcccttcagtacctaccttccagccaagtacccctgtgcccgagcgactcgaggctgtgcagaggtatatcagagagctgcagtacaatcatactggtactcagttctttgagatcaaaaagtcacggccacttactgggcttatggacctggccaaagagatgacaaaggaggcgctcccaattaaatgcttagaagctgtgatccttgggatgtatccctcttcacccgagggagaaggctcaggactcctgtgggcgagcgctagttgttcagaatccgagggcggggtgggatag

SEQ ID NO: 6794 - DNA, 1221 bp, Artificial Sequence
  Description of Artificial Sequence: Synthetic coding sequence
atgcagctgtttctgctcttatgtctggtactgctgtcgccccaaggcgcttctctccatagacaccatccccgggaaatgaagaaacgcgtcgaagacctccacgttggggccacagttgcaccttcatcgcggagggatttcactttcgatctctaccgggctcttgcaagtgctgctcccagccagtctatttttttctcccccgtgtccataagcatgtctcttgcaatgttatctctgggcgccggcagttccacgaagatgcagatactggaaggactggggctaaatctgcaaaagtcgtccgaaaaggagctacaccgcggatttcaacagttgttacaggagctgaatcaaccgcgagatggctttcagcttagcctaggaaatgccctgttcaccgatctggtagtggacttgcaggacacatttgtgagcgccatgaagactctttaccttgctgacacttttcctactaatttccgggattcagctggggccatgaaacaaattaatgattatgtggccaaacagactaaaggcaagattgtggaccttctgaaaaatctagactcaaacgcagtagtcattatggtcaactatatcttctttaaggcaaagtgggagacctcctttaaccacaaggggacccaagagcaggatttttacgtcacctccgagaccgtggtgcgggtaccgatgatgagccgtgaggaccagtaccactacctgctggacagaaacctgtcatgtagggtggtgggagtgccttaccaagggaacgctacagcactgtttattctgcccagtgaagggaagatgcagcaggtggaaaacggattgtccgagaagactctccgcaagtggctcaagatgttcaaaaagagacagctcgaactgtacctgcccaagttcagtatagaaggctcttaccagctggaaaaggtgcttcccagcctgggaatttccaatgtctttacatcccatgctgatctctctggcatcagcaatcacagtaatattcaggtctcagaaatggtacataaggccgttgtggaagtggacgagtctgggacgcgtgccgccgccgctactggtactatattcacctttaggagcgcccgattaaacagccagcggctagtcttcaacagacctttcctgatgttcattgtcgataacaatatcctctttctaggtaaagttaacagaccttag

SEQ ID NO: 6795 - DNA, 3837 bp, Artificial Sequence
  Description of Artificial Sequence: Synthetic coding sequence
atgcgtctccttttactggttcccctcctgcttgcgcccgctcccggatcatctgcccccaaagttcggaggcagtctgacacgtggggaccatggagccagtggtccccctgctccaggacctgtggcggcggggtcagctttcgggaaaggccctgttacagccagcgcagagacggagggagtagctgtgttggcccggcccgaagccaccggtcatgcagaaccgaaagttgtccagacggagcccgtgatttccgtgccgagcagtgcgccgagttcgatggagcagagtttcagggacgtaggtatcggtggctgccctactacagtgcacccaataagtgtgaactcaactgtatccccaagggagaaaatttttactacaagcaccgagaggctgtagttgatggaacaccgtgcgaacccgggaagcgtgacgtatgcgtcgacggatcttgccgagtagttggatgtgatcatgagcttgatagctcaaaacaggaggacaagtgcctcagatgcggaggcgacgggaccacctgttatcccgtcgccggaacctttgacgcaaacgaccttagccgggggtataatcagatcttgatcgtgccaatgggcgccacatcgatcctgatcgatgaggccgcggccagcagaaacttcctggccgttaaaaacgtccgcggcgagtactacctgaatggccattggaccatcgaggcagccagggccctgcccgccgcgtccactattctgcattatgagcgcggagccgaaggcgacctggcacccgaacggctgcacgcccggggacccacctccgaaccccttgttattgagttgattagccaggagcctaatcctggtgtgcactacgagtaccacctcccactgcgtagacctagtcctggcttctcttggagccatggctcatggtcggattgcagtgccgaatgcggcgggggtcatcaatcaaggctggtgttctgtactatagatcatgaagcctatccggatcacatgtgccaacggcagccgagaccagctgatcgccggtcctgtaacttacatccatgcccagagacgaagagatggaaggctggaccctgggccccctgctccgcaagttgtggcgggggctctcagtcccgtagcgtctactgtatttccagcgacggtgctggaattcaagaagcagtggaggaggccgaatgcgccgggctgccggggaaaccccccgcaattcaagcctgcaacctgcagagatgtgcggcatggtccccggaaccctggggcgagtgttcggtgagctgtggagttggggtgcgcaagcgctcagtaacctgtcgtggcgagagggggagcctgttacacaccgccgcctgcagcctggaagataggccacctttgaccgaaccatgtgtgcatgaggattgccctctgttgtcagaccaggcttggcacgtcgggacctggggtctgtgcagcaaatcctgttcttcaggtacaaggcggcgacaagtaatctgcgccatcggccctccatcccattgcgggtctctgcagcattcaaaacccgtcgacgtggagccttgtaacacccagccttgtcatctccctcaggaagtcccatccatgcaagatgtgcatacccccgccagtaacccctggatgccgttgggacctcaggagtcacctgcctcggactcaagaggccagtggtgggctgcccaggagcacccgagcgcccggggtgaccacaggggcgaacgaggtgaccctagaggggaccagggaacgcacttatccgctctcggcccggcccccagtctccagcagcctccttaccagcagcccctgaggtccgggtctggccctcatgactgtcgtcattcccctcacggctgctgccccgatgggcatacagcctccctgggcccccagtggcagggatgtcctggggccccttgtcagcaaagccgctacgggtgctgtccggacagggtgtccgtggccgaaggacctcatcacgctgggtgtaccaaatcttatggaggcgacagtacaggcggcatgccccgttccagggctgtggcaagcaccgtgcataatactcatcaaccccaggcccaacaaaacgagcccagtgaatgcaggggatcacagttcggctgctgttatgataacgtcgccactgcggcggggcctctaggtgaaggctgtgttgggcagccgagccacgcctaccctgtgagatgcctgttgccatccgcccatggatcatgcgccgattgggcagccagatggtattttgtagccagtgtggggcagtgcaatcgcttttggtacgggggatgccacgggaatgccaataacttcgctagcgaacaggagtgtatgtcttcatgccagggcagtcttcatggccctaggaggccacagccaggcgcaagtggaagatccacacataccgatgggggtggaagtagccccgctggcgagcaggagccttcacagcaccgcacaggggctgctgttcagagaaagccctggccttccggaggtttatggcgccaagaccagcagccaggacccggcgaggcccctcacacacaagcttttggagaatggccatgggggcaggagctgggatcccgggcacccgggttaggaggcgacgccgggtctcctgctcccccatttcacagctcatcttataggatttctcttgctggagtggaaccgtctcttgtgcaggcagccctgggtcagctggtgagactctcctgttcggacgacaccgcacctgaatcgcaagccgcctggcagaaggatgggcagccaattagttccgacagacaccggttacagtttgacggatccctgattattcatccactgcaagctgaggacgcaggaacatattcctgcggttctactaggcctggcagggactctcagaaaatccagctccggattattggaggtgatatggcagtgctctccgaggctgagctgagtagattcccacaaccaagggatcccgcacaggatttcggccaggcaggcgccgcaggacctctaggggcgatcccaagctcccatcctcaaccagccaatcgtctgcgcttagatcagaatcaaccccgcgtcgttgacgctagtcctgggcagaggattaggatgacctgccgagccgagggatttcctccgcccgctatcgaatggcaaagagatgggcagccagtgagtagtcctaggcaccagcttcaacccgacggctctctcgtgattagtcgagttgccgtggaagatgggggtttctacacgtgtgtggcatttaatggccaagaccgagatcagagatgggttcagctgcgagtccttggcgaactgacaatttcggggctgcctccaaccgttaccgtacctgagggagatacagctcgactcctatgtgtggtggccggagaatcggttaatatacgatggtctcgcaacggactccccgtccaggctgatggccatcgggtgcaccaaagccctgatgggaccctgttgatttacaacctgcgagcaagggatgagggcagctacacatgtagcgcctaccagggcagccaggccgtgagcagaagcacagaagtgaaagtcgtgtctccagcgccgaccgctcagcctagggacccgggtcgagactgtgtggaccagccagagttggccaactgtgacctgatcctccaggcccaactctgtggaaacgagtattactcatcattttgttgtgcctcttgttctagatttcagccccatgcacagcctatctggcagtag

SEQ ID NO: 6796 - DNA, 261 bp, Artificial Sequence
  Description of Artificial Sequence: Synthetic coding sequence
atgcaacttttcctgctcctgtgcctggtcttactgtcacctcagggagcctccctgcacaggcaccacccacgcgaaatgaagaagagggtggaggatctccacgtgggggccaccgtagctccaagtagccggagagatttcacttttgacctgtacagggcccttgcatcagcggcaccctcacagtcaattttttttagtcccgtgagcataagtatgtccctagccatgctgagccttggggccgggagctcttag

SEQ ID NO: 6797 - DNA, 906 bp, Artificial Sequence
  Description of Artificial Sequence: Synthetic coding sequence
atgcagctgtttcttctgctgtgcctggtactgttgtcccctcagggcgctagcctgcataggcatcaccctagagagatgaagaagcgcgttgaggacctgcacgtaggggcaacagttgcgcccagttctcggagggatttcacttttgacttatatcgcgctctcgcttccgcagccccatcccagtctatcttctttagccccgtctcaattagcatgtcactggccatgctctcgctgggcgcaggaagtagcaccaagatgcagatcttagaaggactgggcttgaatctgcaaaagtcttctgagaaggagttacatcgcggctttcagcagctgctgcaggagctgaaccagccccgcgatggctttcaattatccctggggaatgcactgttcaccgacctggtggtggatctgcaagatactttcgttagtgcaatgaaaacgttatatctggctgacacttttcccactaattttagggattcagcaggggccatgaaacaaatcaacgactacgtagccaaacaaaccaaggggaaaatcgtggacttgcttaaaaatctggactccaatgccgtggtgatcatggtgaactacatcttcttcaaggccaaatgggagacaagtttcaatcacaaaggcactcaggaacaggatttctacgtgacaagcgaaacggtagtgagagtgcctatgatgtctcgggaggaccagtatcactacttgctggatcgcaacctaagctgcagagtcgtcggggtgccataccagggtaatgccaccgcactgtttatcctgcctagcgaaggtaaaatgcagcaggttgagaatggcctgtccgagaagaccttgcgtaagtggctgaagatgttcaaaaagcgatactttcagacttag

SEQ ID NO: 6798 - DNA, 411 bp, Artificial Sequence
  Description of Artificial Sequence: Synthetic coding sequence
atggaaacttttcccctgctgctgctgagcttgggcctggtgctggcagaagcctccgaaagcactatgaagataataaaagaggaattcactgacgaggaaatgcaatacgacatggctaagtccggtcaggaaaaacagactatagaaattctcatgaatccaattttattggtgaagaacacctcactcagcatgtccaaggacgatatgtcgagtacactgctgactttccgcagcctgcactacaatgatcccaaaggtaattcaagtgggaacgacaaggagtgctgtaacgatatgacagtctggcggaaagtatccgaggctaatggatcatgtaaatggtccaataacttcattcgaagttcaacggaagtgatgaggagggtgcaccgtgctcctagttag

SEQ ID NO: 6799 - DNA, 1221 bp, Artificial Sequence
  Description of Artificial Sequence: Synthetic coding sequence
atgcaactgttccttcttctatgcctggtgctccttagtccccagggtgccagtttgcaccgccatcatcctagggagatgaagaagcgcgtggaagacttgcatgtgggcgctacagtcgctcctagctccagacgggattttacattcgacttatacagggctcttgcatctgcagctccaagccagtcaatctttttcagccccgtctccattagtatgagccttgcaatgctttccctgggtgccggttctagtacaaagatgcagattcttgagggactcggcctgaacctccagaaaagctccgagaaggagctccaccgggggttccagcaactacttcaggagcttaatcagccgcgagatggatttcaactctcactgggcaacgctttatttaccgacctcgtcgttgacttgcaggacacttttgtgagcgcaatgaagactctgtaccttgctgatacattcccaaccaatttcagagacagtgccggggccatgaaacaaattaatgattatgtggccaaacagacaaaaggcaaaatcgtcgacctgctgaaaaatttagactccaatgctgtcgtgatcatggtaaattatatattcttcaaagccaaatgggaaaccagcttcaaccataaagggacccaggagcaggacttctacgtgacgagtgagactgttgtcagagtgccaatgatgtctcgcgaggatcagtaccattacctgctggaccgaaatctctcctgccgggttgtgggtgtaccctatcaaggaaatgccacagccctgttcatcttgccaagcgaggggaagatgcaacaggttgagaacggactgtctgagaagacgctgcggaaatggttaaagatgttcaagaaacggcaactggagttgtatctgccaaaattctctatagagggcagctatcaacttgagaaggtcctgccaagtctcggcatctctaacgtcttcacctcccatgctgaccttagtggaatatcaaaccacagtaacatccaagtgtcagagatggttcacaaagcagtcgtggaggtcgatgaaagtggcactagagcagccgccgcaacaggcacaatctttacatttcgcagcgctagattgaactcacagcgtctggtatttaacaggcctttccttatgtttatcgtggataacaatattctgttcctggggaaagtcaaccgtccatag

SEQ ID NO: 6800 - DNA, 618 bp, Artificial Sequence
  Description of Artificial Sequence: Synthetic coding sequence
atgatgcgaaccctgattactacacacccactccctctcctgcttctccctcaacagctcctgcaactcgtgcagttccaggaagtggacacagatttcgactttcctgaggaggacaagaaggaggagttcgaggagtgcctagaaaaatttttttcaaccgggcctgcacggccacctacaaaggagaaggtcaaaagaagagtgctgattgagcccggcatgcctctaaatcacattgagtactgtaaccatgaaatcatgggcaagaacgtgtactataagcacaggtgggtggcggagcattactttcttctcatgcaatacgacgaactgcaaaagatctgttataacaggtttgtgccctgcaagaatggcataaggaagtgcaaccggtcaaagggtttggttgagggcgtctactgtaatctcacggaggcctttgagatccctgcctgcaaatatgagagcctatatcgaaaagggtacgtcctaatcacatgcagttggcagaacgaaatgcagaaaaggatccctcatacaatcaatgatttagtggagccccctgagcatcggtccttccttagcgaggacggcgtcttcgtcatttctccatag

SEQ ID NO: 6801 - DNA, 240 bp, Artificial Sequence
  Description of Artificial Sequence: Synthetic coding sequence
atgtccttttctgcgactattttattcagccctccttcaggttcagaggcgcgctgttgttgttgcgcttgcaaaagtgaaaccaacggggggaacacaggttcacaagggggtaacccgcccccctcaacccccattactgtcaccgggcacggcctggcagtccagtcatccgagcaactgctacatgtcatctatcagagggtcgataaagctgtggggctcgccgaagctgcctag

SEQ ID NO: 6802 - DNA, 618 bp, Artificial Sequence
  Description of Artificial Sequence: Synthetic coding sequence
atgatgagaacgcttattacaacacaccctcttccattgctgctgctgccccaacagctcctgcagctcgtgcagttccaggaagtagacacagatttcgattttccggaggaagacaagaaagaggaattcgaagaatgcctggagaaattcttctccaccggtccagcacggccccctacaaaagagaaggtgaagagaagggtacttatcgaacctgggatgcctcttaatcacatcgagtactgtaaccacgaaataatgggaaagaatgtatattacaaacatcgctgggtggctgagcactactttcttctgatgcagtatgatgagcttcaaaaaatctgctataatcgattcgtgccttgcaagaacggcatcaggaagtgtaacagatcaaagggtctggtggagggggtctactgcaatcttaccgaggctttcgagattcctgcttgcaaatacgagtcattataccgcaagggctacgtgcttatcacatgcagctggcaaaatgaaatgcagaagaggattccccatacaatcaacgatttagtggaaccaccagagcaccgctcatttctgtccgaagatggagtgttcgtgatttctccatag

SEQ ID NO: 6803 - DNA, 3789 bp, Artificial Sequence
  Description of Artificial Sequence: Synthetic coding sequence
atgagactcctgctgttagtgcccttacttctggctccagcacccggcagcagtgctcccaaagttcgccggcaaagcgacacctggggtccttggtcccaatggagtccttgttcaagaacctgcggtggcggagtgtcttttcgtgagaggccatgttactcgcagcgtcgagacggcggttccagctgtgttggtccagctcgatcgcacagaagctgccgcacggagtcatgtcccgacggagcccgcgacttcagagcagagcaatgcgcagagttcgacggggccgagttccagggaaggaggtaccgttggctgccatactattccgcgcccaataagtgcgaactgaactgcatccctaagggagagaacttttactacaagcaccgagaagcagtggttgacggcacaccctgtgagcccggcaagcgcgatgtctgcgtcgacggcagctgcagagtggtgggatgtgaccacgaactggatagctcaaagcaagaagataagtgtctgcgatgcggaggcgatggtactacctgctacccagttgccggcacattcgacgccaacgacctgagtcggggatacaatcagatactcatcgttcctatgggggcgactagcattctcatcgatgaggccgccgcaagccggaactttctggccgttaagaatgtgagaggtgaatattatttgaatggacactggaccattgaagccgcccgggccctccccgccgccagcacaatactccattatgagagaggagccgagggcgatctagctcctgagaggctacacgcccgggggccaacctcagaacctctggtgattgaactgatcagccaggaacctaatcccggcgttcactatgaataccacttgcccttgagacgcccttcccctggtttttcgtggtcacacggcagctggtctgactgtagtgctgagtgcggtggcgggcatcagtcacgcttagtattttgcacaatcgatcatgaggcctacccagatcatatgtgtcagcgccagccccgccccgcagacagacgatcatgcaacctgcacccctgtccagaaactaaaagatggaaagcaggtccttgggccccatgctccgcctcatgcggcgggggatcacagtcccggtccgtgtactgtataagttccgacggcgccggtatccaggaggccgtcgaggaggccgagtgtgccggtctccccggcaagccacctgctatccaggcgtgtaatctccaacgctgtgctgcctggagtccggaaccgtggggtgaatgctctgtgagttgcggcgtcggagtgcgcaaaagatctgtgacttgcaggggcgagagaggttccttgctccatacggctgcctgttctctcgaggatcgtccccccctcacagagccgtgcgtccatgaggattgtccactgttgtcagatcaggcctggcacgtggggacctggggcctctgctccaagagctgcagcagcggaacccgcaggcggcaggttatttgcgcaattggccccccaagccactgtgggagccttcaacacagcaagccagtggacgtagaaccttgcaacacccagccatgtcatttgcctcaggaagttccctccatgcaggacgtgcatacgccagcaagtaatccttggatgccgctggggccccaggagagccctgcttccgattcccggggacaatggtgggcagctcaggaacacccatctgctcgaggcgatcaccgcggagaacgaggagaccccagaggtgaccagggtactcacctatctgccctgggaccagcaccttcattgcagcagcccccgtatcagcagcctctgagatctggtagtggcccacacgactgcagacattcccctcatggctgttgccctgatggccacacagcttctctcggcccacagtggcagggctgcccaggagcaccctgccagcaatctaggtacgggtgttgtccagaccgggtttcagtagccgagggaccccatcatgcgggttgtaccaaaagttacggtggcgattccactggcgggatgccaaggagtagggccgtagccagcaccgtgcacaatacccatcaaccccaggcacagcagaatgagccctcggagtgtcgaggcagccagttcggctgctgttacgacaatgtggccactgctgctggccctctgggagagggctgcgtgggacagccatcacacgattgggccgcccggtggtactttgtcgctagcgtcggccagtgcaaccggttttggtatggaggatgtcacgggaatgctaataacttcgcgtccgaacaagagtgtatgagctcgtgccagggatccctgcacgggccccgcaggccacagcctggcgcctccgggcgcagtacacacaccgatggagggggctcgtccccagctggcgagcaagaaccctcacaacataggaccggggcagcagtgcagaggaaaccctggccaagcggagggctttggcgccaggatcaacaacctggtccaggcgaggctccccacacgcaggcctttggcgaatggccatgggggcaggaattaggatcccgggccccaggtctgggcggtgatgccggatcacctgctccaccttttcattcatcttcctaccgaattagcctggctggggtcgagccatcgctggtgcaagccgccctgggccagttagtgaggctgagttgctccgatgacaccgccccagagtcacaggccgcttggcaaaaagacgggcaaccaatttcttctgacaggcatagattgcagtttgacggaagtctcatcattcaccccctacaagccgaagatgcagggacatattcttgcggatccactcggcctggccgcgactcccagaagatacagttgcggatcataggaggggacatggcagttctgtccgaggctgaactgagtcgcttcccccagccacgagatccagctcaggactttgggcaagcaggcgccgctggcccactgggcgcaatcccctcctcacacccccagcctgccaacaggctcagactggatcagaaccaacccagagtggtggatgccagccccggccaacggatcagaatgacctgcagggcggagggctttcctcctccagctatcgagtggcagcgagacggccagccagtcagctctccgcggcatcaactgcagccggacggcagtttggtgataagtcgtgtggccgtagaggacgggggcttttacacgtgtgtcgcctttaacggccaggaccgcgatcaaaggtgggtgcagcttagagtgcttggcgaattgactattagcgggctgcctcctacggtgacggttccggaaggagatactgctcggttactctgtgtagtggctggcgaatccgtcaatatccggtggtcccgcaacggcctccctgttcaggctgacggacatcgcgtgcatcagtcacccgatggtaccctgttaatctacaatttgagagccagagacgaagggtcctacacatgcagcgcataccaaggtagccaggccgtcagtagatcaaccgaagtcaaagtggtgtccccagcacctactgcccagccccgagaccccggcagggactgcgttgatcaacccgaactggccaattgcgaccttatcttacaagcccagctgtgtggaaacgaatactactcatccttttgttgcgccagctgttctagattccagcctcacgcccagccaatatggcaatag

SEQ ID NO: 6804 - DNA, 321 bp, Artificial Sequence
  Description of Artificial Sequence: Synthetic coding sequence
atgagttttagtgctactattctgtttagcccgcccagcggaagcgaagcaagatgctgttgctgcgcatgtaagagtgagacaaacggaggcaataccggttcccagggcggcaacccccccccttctactcctatcacagtgactggtcacgggttagccgtgcagtcttcagaacagctacttcatgtcatttatcaaagagtggacaaggcagtgggtttagctgaggccgcactagggctggccagagccaacaacgagttactgaagcggctgcaggaggaagttggtgacctccgtcagggcaaggtgtcctag

SEQ ID NO: 6805 - DNA, 444 bp, Artificial Sequence
  Description of Artificial Sequence: Synthetic coding sequence
atggctctgcaaagaacacactccttgctcctactcttactgctgactttgcttggcctgggacttgttcagccatcctacggccaggatggtatgtaccagcgattcctcaggcagcacgtgcaccccgaggagactggcggaagtgacaggtattgtaacctcatgatgcaaagacgtaagatgactctataccactgtaaacggtttaacactttcatccatgaggatatctggaatatccgctctatctgttcaactacaaacatccaatgcaaaaatggcaagatgaattgccatgagggagtggtgaaagtgaccgattgccgtgacactgggagctctcgcgcccccaactgccgatacagggctattgcttctacgagaagggtggtgattgcctgtgaggggaatccccaggtccctgtgcactttgatggctag

SEQ ID NO: 6806 - DNA, 435 bp, Artificial Sequence
  Description of Artificial Sequence: Synthetic coding sequence
atgcagctgttccttttgctatgtttagtactcctctcgccccagggagcttctctccacagacatcacccgcgcgagatgaaaaagcgagtcgaggatctgcacgtgggggccacagtggctccatcttcacggcgcgattttacattcgacctgtaccgagccctggccagtgcagcccctagtcagagtatattcttttcacctgtgtcaatcagcatgtcactagccatgttgagtctgggggcagggagcagcaccaagatgcagatactggaggggttgggcctcaatctccagaagtctagtgagaaggagttgcatcggggttttcagcagttgcttcaggagctgaaccagccccgggacgggtttcaactttccctagggaacgccctgttcaccgacctcgtggtggatcttcaagacacttag

SEQ ID NO: 6807 - DNA, 540 bp, Artificial Sequence
  Description of Artificial Sequence: Synthetic coding sequence
atgggatcatctggactgctcagtttgctcgttctgtttgttctgttggccaatgttcagggaccaggcttgactgattggcttttcccccggaggtgcccaaagataagggaggagtgtgaattccaggagagagacgtctgcaccaaggatagacagtgccaggataataagaaatgctgcgtattctcatgcggaaaaaagtgtctggacctaaaacaggatgtctgcgagatgccaaaagaaactggtccctgtttggcctacttcctacattggtggtatgataaaaaagataatacctgttccatgttcgtatatggaggatgccaaggtaacaataataattttcagtccaaagccaactgcctcaacacttgtaaaaacaagcaaccttgccccaaaattaaagtggagtgtgaggtggaagagattgatcaatgcacaaagcccagggactgcccagagaatatgaagtgttgccccttttcacgcggaaaaaagtgtctcgatttccgcaaagcatcattatctacctag

SEQ ID NO: 6808 - DNA, 444 bp, Artificial Sequence
  Description of Artificial Sequence: Synthetic coding sequence
atggcactgcagcgaacacacagcctgctcttgctgctcctgctcactcttctcggcttagggcttgtgcagcccagttacggccaggatggcatgtaccagaggtttcttcgtcagcacgtgcatcccgaggagacaggaggatcggacaggtattgcaatttaatgatgcagagaagaaaaatgacactatatcattgcaaacgcttcaatacgttcattcacgaggatatttggaatatcaggagcatatgtagcaccaccaatattcagtgtaagaacgggaaaatgaactgccacgaaggggtagtgaaggtgaccgactgccgggatactgggagttccagagccccaaactgcagatatagagctatagcctccacccggcgcgtggtgatcgcttgcgaggggaatccacaagtccccgtgcatttcgacggttag

SEQ ID NO: 6809 - DNA, 600 bp, Artificial Sequence
  Description of Artificial Sequence: Synthetic coding sequence
atggagacattcccactgctcctgctgtctttgggtctggtactggccgaggcaagcgagtccactatgaaaataatcaaagaggagttcaccgatgaggaaatgcagtatgacatggccaaaagtggccaggaaaagcagaccatcgaaattcttatgaacccaatactgctggtcaaaaatacaagcctcagtatgtccaaggatgatatgagttcaactctgctgaccttcaggtctctgcattataacgaccccaaggggaacagctcagggaacgataaagaatgctgtaatgatatgacagtatggagaaaggttagtgaggccaacggttcgtgcaaatggtccaataacttcatccggtcctccacggaggtgatgagacgggtgcatcgcgccccttcctgcaagttcgtgcagaaccctggcatttcatgctgcgagtcactggaactggagaacacagtatgccagttcacaactggcaaacagttccccaggtgtcagtaccattctgtcacatctcttgaaaaaattctaacagttctgacaggccattccctcatgtcctggctggtgtgcgggagcaaactatag

SEQ ID NO: 6810 - DNA, 153 bp, Artificial Sequence
  Description of Artificial Sequence: Synthetic coding sequence
atgagcttttctgccacaatcttattctccccgcccagcggatccgaggcccggtgttgctgttgcgcctgtaagtctgagactaacggtggcaatacggggtctcaggggggcaaccccccaccaagcacccccataaccgtaactgggtag

SEQ ID NO: 6811 - DNA, 75 bp, Artificial Sequence
  Description of Artificial Sequence: Synthetic coding sequence
atgcagctctttctgttattatgtcttgtcctgctaagtccccagggcgcctccctgcaccgtcaccatccctag

SEQ ID NO: 6812 - DNA, 633 bp, Artificial Sequence
  Description of Artificial Sequence: Synthetic coding sequence
atgagcgccgggaaaatgatgcgaacactgataaccacacacccactaccactactcctgctgcctcaacagctcctgcagctcgtccagtttcaggaagttgacacagattttgactttcccgaagaagataagaaggaagaatttgaggagtgcttggagaagttcttttcgactggaccagcccgacctccaactaaagagaaagttaagcgtagagtcttaatcgaacccggcatgccactgaatcatatagaatattgtaaccacgagataatgggaaaaaatgtttattataagcatcgttgggtggcggagcactatttcctcctgatgcagtatgatgaattacaaaaaatttgctacaaccggttcgtgccgtgtaagaatgggattcgtaaatgtaacagatccaaaggtctggtggagggcgtttactgcaacctgaccgaggccttcgagattcccgcttgtaaatacgaatcgctctatagaaagggttatgtccttatcacttgctcatggcagaacgagatgcagaagaggatcccgcacaccattaacgacctggtagagcccccggaacacaggagttttctcagcgaggatggcgttttcgtaatcagtccctag

SEQ ID NO: 6813 - DNA, 36 bp, Artificial Sequence
  Description of Artificial Sequence: Synthetic coding sequence
atgagcttttcggccaccatcttgttctcaccatag

SEQ ID NO: 6814 - DNA, 444 bp, Artificial Sequence
  Description of Artificial Sequence: Synthetic coding sequence
atgataatcatggtgatcattttcctcgtgctgcttttctgggaaaatgaagtgaacgatgaggcagtgatgagcacactggagcacctgcatgttgattacccccagaacgacgttccagtacctgcccggtactgtaatcacatgatcatacaaagggtgatccgcgagcctgatcacacgtgtaaaaaagaacacgtcttcatacacgaacggccccggaagattaatggcatatgtattagtcccaagaaagtggcgtgtcaaaatctgagcgcaatcttctgtttccaatcagagaccaagttcaaaatgactgtgtgccagctcatcgagggaacaaggtaccccgcttgtcggtaccactatagccccactgaaggcttcgttttagtaacatgtgatgacctccggcctgatagcttcctgggctatgtgaaatag

SEQ ID NO: 6815 - DNA, 696 bp, Artificial Sequence
  Description of Artificial Sequence: Synthetic coding sequence
atgcaactctttctgctactttgtctggtcctgttgtcccctcagggggccagtctacatcgccatcacccacgcgaaatgaagaagcgcgttgaggacttgcacgtgggcgctactgtcgctccgagttcaaggcgtgatttcaccttcgatctgtaccgggccttggcttctgccgcccccagccagagcatcttttttagtcccgtctctataagcatgtccctcgccatgctttctttgggcgctgggtcctccaccaagatgcagatccttgaagggctaggcctaaatctgcagaagtcatctgagaaggagctccatcgcggatttcagcaattacttcaggaactgaaccagccccgggatggatttcagctctcactcgggaacgcattgttcacagacctggtcgtggacttgcaggatacattcgtgagcgcgatgaagactctttatcttgcagacacttttccgaccaatttcagggattccgccggtgcaatgaaacagattaacgattacgtggccaaacaaacgaaggggaagatcgtggacctgctaaagaatctggacagcaacgccgtggttattatggtcaactacatattttttaaggctaaatgggaaactagcttcaaccacaagggcacccaggagcaagacttttacgtgactagcgagaccgttgtgtag

SEQ ID NO: 6816 - DNA, 1626 bp, Artificial Sequence
  Description of Artificial Sequence: Synthetic coding sequence
atggccaagttcggagttcatcggattcttcttttagccatctccctgactaagtgtctcgaatcaaccaaactgttggctgacctgaagaagtgcggagacctggaatgtgaagccctaattaaccgcgtctctgcaatgcgagattataggggacctgattgccgctacttgaattttactaagggtgaggagatcagcgtgtacgttaaattagccggcgagagggaggatctgtgggccggcaagggcaaggagtttggatacttccctcgagacgctgtgcagattgaggaagtgttcattagcgaggagatacagatgtctactaaagaatcagacttcctttgtttgctgggggttagctacactttcgataacgaggacagcgaactgaatggggattacggagagaatatctacccctacgaggaggacaaggacgagaagtcatccatttatgaatctgattttcagatcgaacctggcttttacgctacctatgagtccaccctgtttgaagaccaggtgcccgcactcgaggcaccggaggacatcggaagcaccagcgagtcaaaggactgggaagaggtggtagtggaatcaatggagcaggatagaatccctgaggtacacgtccccccctcgtctgccgtctctggcgtgaaagagtggttcgggctgggaggcgagcaggcagaagagaaagccttcgagtccgttattgaacctgttcaggagtcatcatttaggtccaggaaaatagctgtagaagacgaaaatgatctcgaagagctgaataatggtgagccacagacagaacatcaacaggagtcggaatctgagattgattcagttcctaagacacagagcgaacttgctagcgaatccgaacacatacccaaacctcagtctacagggtggtttgggggaggtttcacgtcatatttggggtttggggacgaggacaccggcctggagctgatcgccgaagagagcaatccacctctgcaggattttccaaattctattagtagtgacaaagaggctaccgtgccatgtaccgaaatcttgaccgagaagaaggatactataaccaacgattccttaagtcttaaaccttcatggtttgatttcggatttgcgatcctggggtttgcttacgctaaagaagataagatcatgctagacgataggaagaatgaagaagatggaggcgctgatgaacatgagcaccccctcacgagcgagttagaccctgaaaaagagcaggaaattgaaactattaagatcattgagaccgaagaccagattgacaagaaaccagtctccgaaaaaacagacgagtccgatacaattccttacctcaagaagtttttatacaactttgacaatccttggaattttcagaatatacctaaggagaccgagttaccgttccctaagcagatactggaccagaacaacgtgattgagaatgaggaaaccggagaattctcaattgataactatccaacagataacactaaggtcatgatcttcaaatcttcctattcccttagcgggtggtatgagaatatctatattcgaatctactttattttcaagcataacttattcctgtag

SEQ ID NO: 6817 - DNA, 1245 bp, Artificial Sequence
  Description of Artificial Sequence: Synthetic coding sequence
atgaacccaaccctaggcctcgcaatctttttggcggtcttactaactgtcaaggggctgcttaagccctcctttagcccgcgcaactacaaagctttgtccgaggtgcagggatggaaacagagaatggctgccaaggaactagcacggcaaaatatggacctggggttcaagctgttaaaaaaactggctttttataacccagggcgcaacatctttctgtcccctctgagtatcagcacagctttctccatgttgtgtctcggtgcccaggactctacgctcgatgaaattaagcagggcttcaactttcgtaagatgccagagaaggatttgcatgaggggttccactatatcattcacgaactaacccagaagacgcaggacctcaagctgtcaatagggaacaccctgtttatagatcagcgcttgcagccacagcgcaaatttctcgaagatgccaaaaacttttactctgccgagacaatcctcacaaactttcaaaatctggaaatggctcagaagcagatcaacgactttatttcgcaaaaaactcatggcaaaattaataacttaattgaaaatatagaccctggcacagtaatgctgcttgcgaattatatttttttcagagctcgatggaaacatgaatttgaccctaatgtgacaaaggaggaggattttttcctcgagaagaattcatctgtcaaggtgcccatgatgtttcgcagtggcatctaccaggtgggctatgacgataaactctcatgcacgatcctcgagatcccctaccagaagaacattacagcgatctttatcctcccggacgaaggcaaactgaaacacctggagaagggactgcaggtggacacatttagccgctggaagacactgctctcacggagagtggtggacgtctcagttcctcggttacatatgactggcacattcgacttgaaaaaaaccctctcttacataggagtttctaagatttttgaggagcatggagatctgaccaaaatcgccccacaccggtctctgaaggttggggaagccgtccacaaggctgagctcaagatggatgagagaggcacagagggagccgctggaaccggagcccagacgctccccatggaaacccccctcgtggtgaagattgataagccctacctccttctgatatatagcgaaaagatccctagtgtgctcttcctcgggaaaatcgtcaaccctatcggaaaatag

SEQ ID NO: 6818 - DNA, 618 bp, Artificial Sequence
  Description of Artificial Sequence: Synthetic coding sequence
atgatgcggactctgattactacacaccctctgcctttactactcctaccacagcagctgctgcagttagtccagtttcaggaggtagacacagacttcgacttccctgaggaggacaagaaagaggaattcgaggagtgtctggagaagttcttctctacaggcccagcgagacctcccacgaaggagaaggttaaaaggcgtgtcctcatagagcctggcatgcctttgaaccacatcgagtactgcaaccatgagatcatgggaaagaatgtgtactacaagcataggtgggtcgccgagcactactttctgcttatgcaatacgatgagctgcagaaaatttgctataacagattcgtgccctgcaagaacgggattaggaagtgcaaccggtctaaagggctcgttgagggggtatattgcaaccttactgaggcctttgagatccccgcctgcaaatacgaatctctgtatagaaagggatatgtcttgataacctgctcatggcagaacgagatgcagaaaagaatcccccatacaattaacgacctcgtagaacccccagagcacagatcctttctgagtgaggatggagtcttcgtcatctccccttag

SEQ ID NO: 6819 - DNA, 516 bp, Artificial Sequence
  Description of Artificial Sequence: Synthetic coding sequence
atggagacatttcccctactcttactaagcttaggtttggtcctcgccgaggctagcgagtcaacaatgaaaatcattaaggaagaatttacagacgaggaaatgcagtacgacatggctaagtcagggcaagagaagcagacaatagaaatccttatgaatccgatcctgctggtgaaaaatacttcactgagcatgagcaaggatgatatgagttccacgttacttacatttcggtccctccactacaacgacccaaaggggaacagctcagggaatgacaaagaatgctgtaacgatatgacagtatggcgaaaggtctccgaagctaacgggagttgcaaatggtccaacaatttcatacgcagcagcactgaggtgatgagacgcgtccaccgtgctccctcctgcaagttcgtacagaaccctggaatcagctgctgtgagtccctggaactagaaaataccgtgtgccaattcactactggtaagcagtttccacggtgtcagtactag

SEQ ID NO: 6820 - DNA, 633 bp, Artificial Sequence
  Description of Artificial Sequence: Synthetic coding sequence
atgagcgctggcaagatgatgcgaacattaatcactacccaccccctgccccttctgctgcttccacagcagctgctccagctcgtacagtttcaggaggtcgacaccgactttgacttcccagaagaggataaaaaagaggagttcgaggagtgcctggagaagttcttctctacggggcccgcacggccacccactaaggaaaaggtgaaaaggcgggtccttatcgaaccagggatgccactgaaccatattgagtattgcaatcatgaaattatgggaaagaatgtgtactacaagcatagatgggtggctgaacactattttctgctgatgcagtatgatgaactgcaaaagatctgttacaatagattcgtgccctgcaaaaatggtattcgtaaatgcaatcgaagcaagggacttgtcgagggcgtttactgtaacttaactgaggcattcgagatcccagcctgcaaatatgagtcactctaccggaaaggatatgtgctaatcacctgcagttggcagaatgagatgcagaaacgcattccacacaccattaatgatctggtggagcccccagagcacaggagcttcttgtccgaggacggagtttttgtcatcagcccctag

SEQ ID NO: 6821 - DNA, 537 bp, Artificial Sequence
  Description of Artificial Sequence: Synthetic coding sequence
atggagactttccctctcttactcctgagcttagggttggttctcgccgaagctagtgaaagcacaatgaagattattaaggaagaattcacggatgaagaaatgcagtatgacatggctaagtcagggcaggagaagcagactattgagattctcatgaaccctatcctgcttgttaagaacacgtctctgagcatgtctaaggacgatatgagttccaccttgctgacatttcgctcgctgcactacaatgatccaaaagggaatagcagcggcaacgataaggagtgctgcaacgatatgacagtttggcgcaaagtgtcagaggccaacggcagttgcaagtggagcaacaacttcatccgatctagtacagaggtgatgaggagagtgcaccgtgccccgtcgtgcaagttcgtgcaaaacccgggaatttcctgttgtgagagtctggagttggagaacaccgtgtgccagtttactacggggaagcagtttccaagatgccaataccattctgtcacttctctggaatag

SEQ ID NO: 6822 - DNA, 474 bp, Artificial Sequence
  Description of Artificial Sequence: Synthetic coding sequence
atgcagctttttctacttctctgccttgtacttctcagcccccagggggcgtccttgcatcgacaccacccgcgcgagatgaagaaacgtgtggaagacctacatgtgggcgcaactgttgccccttcctcaaggcgtgattttacattcgatctgtacagagcgctagccagcgctgcgcctagccagtcaatttttttttctccggtgtccatctcaatgtccctggccatgttaagcttaggcgccgggagttctacgaaaatgcaaatcctggagggtctcgggctaaatttgcaaaagagttccgagaaagaactccacagggggtttcagcagctgctgcaagagctaaatcaaccacgggatggtttccagctctcacttgggaatgcactcttcaccgacctggttgtggatctccaggataccttcgtttctgcaatgaagaccctttacctggccgacacttag

SEQ ID NO: 6823 - DNA, 1035 bp, Artificial Sequence
  Description of Artificial Sequence: Synthetic coding sequence
atgcccccacgcatgctggtcgctcccctgccattacacttcctgctagccgcagtgagctcggaaaatcggtctggaagacggcagtggcagcaagccgttgccgcaggctcaggcccaggaagaaatagctcacgcgccatacactggtccctccctagggcactcgtccctgccacggggactcgagcttcggggtctcagaagagacagaggcctccgaagggacaggaagccctatggtcccgcccccattctcgccactcagctgagcgagccggcggctctcactccgatcccggaagactctcggctcctctgggcctgggtctcccctcaggacgaggacgtcttacagccatgcccggaagggccccacttaggaccgttccaggagccctcggcgcctggctgctgggtggcctgtgggcgtggacgctgtgtggcctatgttctctcggagctgtcggagcccctaggccatgccaggctccccagcagtgggaaggtagacaggtgatgtatcaacagagttctggacgcaattctcgtgccctcctgagttatgacggtctgaaccagagagtccgggtgctcgacgaacggaaggctcttatcccatgcaagcggctcttcgagtatattctattatataaagatggagtgatgttccagattgaccaggcaactaaacagtgcagcaagatgactctgacacagccttgggatccactggatataccacagaactccacatttgaggaccaatactcaatcggggggcctcaagaacagatcacagtgcaggaatggagcgataggaagtctgcccgcagttacgagacttggatagggatctatactgtgaaagactgttatcccgtgcaggagactttcaccatcaactactccgtaattcttagcacacgattctttgatatccagttggggattaaggacccctctgtgttcaccccaccgtccacgtgccagatggcacaactggagaagatgtctgaggattgttcttggtag

SEQ ID NO: 6824 - DNA, 321 bp, Artificial Sequence
  Description of Artificial Sequence: Synthetic coding sequence
ggacaacctaaggccgctcccagcgtcacgctcttccctccctctagcgaggagctccaggcgaacaaagctacccttgtgtgtcttgtttcagatttctatcctggagctgtaaccgtggcttggaaagccgacggctctcccgtgaaggtgggcgtcgagacgactaaaccctccaagcaaagcaataacaaatacgccgcctctagttatctgagtttgacgcccgagcagtggaagagtcaccgttcatattcttgcagggtgacgcatgagggcagtactgtcgaaaagacagtggcccccgcggaatgcagctag

SEQ ID NO: 6825 - DNA, 672 bp, Artificial Sequence
  Description of Artificial Sequence: Synthetic coding sequence
atgcgcctgcagagacctcggcaggccccagcaggtgggagacgggcacctcgcgggggaagggggagtccctaccggccagacccaggccgtggcgcgaggcggcttcgcaggttccagaaaggcggggaaggagctccacgtgccgaccctccttgggccccacttggcacaatggcactgctggctcttctccttgtggtagccttacctagagtttggacagatgccaatctcacggcgcggcaacgcgatcctgaagacagccaaagaacggatgaaggcgataatcgggtttggtgccacgtatgtgagagagagaatactttcgagtgtcaaaatccacgaaggtgcaagtggaccgaaccctattgcgtgatcgccgctgtgaagatttttccaagattttttatggtggccaaacagtgctccgctggctgtgcggccatggagcgtccaaaacccgaggagaagcggttcctcctcgaggaaccaatgcccttcttctatctgaaatgttgcaagattcgttattgtaatctggaggggcctcctatcaattcctccgtatttaaagagtatgcaggcagtatgggtgagtcctgcgggggcctgtggctggccatactgttgctgctggctagtattgccgctggcttaagtcttagctag

SEQ ID NO: 6826 - DNA, 408 bp, Artificial Sequence
  Description of Artificial Sequence: Synthetic coding sequence
atgacgccaactccaactgccgcttggacacctcccccacctctgcggccttccgcagccgctgcaggtgcacagtgtaggagttgtcccttccgcggaggctgcgccccaagcacagctagaacaccccccgcatgcatgcgccccgccggcccatgcgccccccctacatggccagcgcccagcacaaccacaagcacttgtacctctaggagagctgggtgtacagccagcagtgcaagctactctacccttgcagccgcctgctccctgcggcggtctggggtccgttggcctcccagcagtgcatatagtacatgggcctttgcaagctgttgtgcctcaagcgcgagttgccgctgttgttgttgttgctgggcggcaggtgcctggacctccgcttggtag

SEQ ID NO: 6827 - DNA, 1542 bp, Artificial Sequence
  Description of Artificial Sequence: Synthetic coding sequence
atggccccagcacgcacaatggcccgcgcacggcttgcacccgcaggcataccggctgtggccctctggcttctgtgcacgctggggctacagggcacgcaggccggccccccccctgctcctcccgggctcccggccggcgcggactgtcttaactcctttacagcaggggttccaggctttgtgctcgataccaatgcctcggtgtctaatggtgcgacatttctagagagtccgacagtaagaagggggtgggactgtgtccgggcctgctgcacaactcagaactgcaatttggccctcgttgagctgcagccagataggggcgaggatgctattgcggcctgcttccttataaactgtctgtacgaacagaacttcgtgtgtaagtttgctcctcgagagggtttcatcaattacctgacccgggaggtgtaccgcagctatcgccagctgcgcactcagggatttggtgggtccggtatccctaaggcctgggcaggcatcgacctcaaagtccagcctcaggaaccgctggtccttaaggatgtggaaaacactgattggcgactccttcggggagatactgacgtgagagtcgaaagaaaggatcccaatcaggtggaactgtgggggctgaaggagggaacttacctgttccagttgactgtgacctcttcagaccacccggaagacaccgcaaacgtcacagtaaccgtactgagcactaagcagacggaggattactgcctggcgagcaataaagtcgggcgttgtagggggagcttccccaggtggtactatgaccctactgagcagatttgcaaatcgtttgtttacggtggatgtctaggtaacaaaaataattacttacgggaagaggaatgcattctggcttgtaggggagttcagggccccagcatggagcgtcggcatcctgtgtgttcgggtacctgtcagccaacccagtttcgttgctcaaacggctgctgtatcgacagctttctggaatgtgacgatacacccaattgccctgatgcgtctgacgaagccgcttgcgagaagtacacatctgggttcgatgagctccagcggatccactttcccagcgataagggtcattgtgtagacctccctgacaccggcctgtgcaaagagtccatacccaggtggtattacaacccttttagtgagcattgcgcccgcttcacctacggaggatgttatggcaacaaaaacaactttgaggaagagcagcagtgcctggaatcctgtagggggatctccaaaaaagatgtgtttggtctgaggcgcgagattccaatcccatcaacaggctctgtggagatggccgttgctgtgtttctggtgatctgcatagtggtggtcgtggcaatactggggtattgtttcttcaaaaaccagagaaaggactttcacggccatcaccatcacccaccccccacgcctgcttcctctactgttagcacgactgaagatacggaacatctggtgtacaatcacaccacaagaccactgtag

SEQ ID NO: 6828 - DNA, 1341 bp, Artificial Sequence
  Description of Artificial Sequence: Synthetic coding sequence
atgctccatccagaaacctctcccggcagaggtcatctgctcgctgtacttttagctctgctgggaacagcctgggctgaagtgtggccccctcaactgcaggagcaggctccaatggctggggccttgaaccgtaaagaaagttttctgctgttgagcctacataaccgcttaaggtcatgggtacagcccccggccgccgatatgaggagactcgattggtccgattcactcgctcagctggcccaggctcgggctgctctgtgcggaattcctactccaagcctggcatcaggattgtggaggaccctgcaggtcggctggaatatgcaactgctgccagcgggcttagcctctttcgtggaagtagtgtccctctggtttgcggagggccagagatactcgcatgccgctggcgagtgcgctagaaacgccacatgtactcactacacccagctggtgtgggcaacaagctcccagttagggtgcggaagacacctgtgcagtgccgggcaggccgctatcgaggcttttgtgtgcgcttactcccccagagggaattgggaggttaatggaaaaacaattgtcccttataagaaaggggcttggtgttcgctttgcactgccagtgtaagcggatgctttaaggcctgggaccacgcgggagggctctgcgaggtgcctagaaatccatgccggatgtcttgtcagaatcacgggagactgaatatctctacttgccactgtcactgccctccaggatatacaggcagatattgccaggttcgatgttctttgcagtgtgtgcacggtaggtttcgtgaggaggaatgtagttgtgtatgcgacattggttacggaggtgcccagtgtgccacaaaagtccacttcccctttcatacatgcgatctgcggatagatggtgattgtttcatggtgagttctgaggctgatacttactaccgggctaggatgaagtgtcagcggaagggaggcgtcctcgctcagatcaaatcccagaaggtgcaggatatcctggccttttatttggggcgcctcgagaccaccaacgaggtgattgacagcgactttgagactcggaacttttggataggcctaacttataaaacagccaaagacagttttagatgggcaacgggcgaacaccaggcgtttactagcttcgcatttggccagcccgacaaccatgggttcggcaattgcgtggagctgcaggcttcagctgccttcaattggaacaatcaacgctgcaagacacggaacaggtacatctgccaattcgctcaagagcatatttccagatggggccctggctcttag

SEQ ID NO: 6829 - DNA, 936 bp, Artificial Sequence
  Description of Artificial Sequence: Synthetic coding sequence
atgggagtgatggcgatgctgatgttaccactgctgctgctgggcattagcggtttgctcttcatctatcaggaggtctcccggttatggtccaagtcagcagtgcagaacaaagtcgtcgtgatcaccgatgcgatatctggcctcggcaaagaatgtgccagagtgtttcacacgggaggggctcgcctagtgctctgtggaaagaattgggagcgcctggagaatctgtacgatgcacttatcagtgtggcagacccaagcaaaaccttcacccccaaacttgtcctgctcgacctcagtgacatctcctgcgtgcctgatgtcgccaaagaagtgctggattgttacggctgcgtagacattctgataaacaatgcaagcgtcaaggtaaagggcccagcccacaagatctcactcgagctcgacaagaagattatggatgccaactatttcgggccaatcacgctgacgaaagccctgctgcccaatatgatctcccgacggacgggtcaaatcgtgctagtgaataacattcaaggcaaatttggcataccattcagaactacctacgcggctagcaaacacgccgcccttggttttttcgactgcctacgggcagaggtagaggaatatgacgtggtaatttctacagtaagtcccacatttattcggagttatcatgtgtaccccgaacaaggcaactgggaagccagcatctggaaattctttttcagaaaacttacttacggagttcacccagttgaagtggccgaagaggtgatgagaacagtgcgtcgcaagaaacaggaggtgtttatggcaaatcctatccccaaagctgctgtgtacgtgagaaccttcttcccagaattcttctttgccgtggttgcctgcggtgtcaaagagaaacttaatgtgccagaagaagggtag

SEQ ID NO: 6830 - DNA, 594 bp, Artificial Sequence
  Description of Artificial Sequence: Synthetic coding sequence
atggccaaaaacggcttggtgatctgcatactggttattactctcctcctggaccagacaacatcgcatactagcaggctgaaagcaagaaagcacagtaaacgcagggtgagagacaaagacggggacttgaagacccagattgagaagctctggacggaggtgaatgcactaaaggaaatccaggcactgcagaccgtgtgtcttagggggacgaaggtccacaagaagtgctaccttgcctccgaaggcctgaagcacttccacgaggcaaatgaggactgtatatctaagggtggaatccttgtgattccaaggaacagcgatgaaattaacgcccttcaggactatgggaagcgtagtttaccaggcgtgaacgacttttggttggggatcaatgacatggtcaccgaaggcaaatttgtggatgtgaatgggattgctattagttttctcaattgggacagagcccagcctaatgggggaaagcgagagaactgcgtgctttttagccaaagtgcccaagggaagtggagtgatgaagcttgtagatcctccaaacgctacatctgcgaatttacgatccctcaatag

SEQ ID NO: 6831 - DNA, 705 bp, Artificial Sequence
  Description of Artificial Sequence: Synthetic coding sequence
atgaaggtactgctgcttaccggccttggggcactgtttttcgcctactactgggacgataatttcgacccgggcggcctggattatctcgtgttgaatcacattggtggtgccccagccggtacaagggcacggtcccctcaagcgactcgctggctgatgcaagtcaactttgtgtcctacgttcaattgacttcccgcgctctgccctctttgactgactccaaagggtctctggtggtggtcagtagcctgctgggcagagtaccaacgtctttcagcaccccgtactcggctgccaaattcgctctcgacggattcttcggaagcctgagacgcgagctggacgtccaagatgtgaatgtcgccatcaccatgtgcgtgcttggattgcgcgatcgtgcatctgccgccgaggctgtgcgctccagcactagccggccaagacagcccgaacataggggagtgcctctacagtcccagacagccatgtttctgccacccacagtcccgggcgctcgaacgctcactgaaactccgcttcgggggtggcctcagcctaaaatgaagtcgtctagacagaagagcaagaccgaaaagaacgatggtcacttagaaccagtcaccgcttgggaggtgcaggtgcccagagttcggcgcctgtgccgcggcctggccaggccccaccttttcggacacgattag

SEQ ID NO: 6832 - DNA, 228 bp, Artificial Sequence
  Description of Artificial Sequence: Synthetic coding sequence
atgaaagtcctgctactcactggactaggggccttattcttcgcatattattgggacgataattttgatcccgcttccctgcagggagcccgagttttattgacaggtgccaacgctggtgtgggcgaggagcttgcctaccactatgccagactcggatcacaccttgtactgaccgcacacacagaagcattactgcagaaagctgggtggactactagttgctag

SEQ ID NO: 6833 - DNA, 225 bp, Artificial Sequence
  Description of Artificial Sequence: Synthetic coding sequence
atgcagccttcagagatggttatgaacccgaaacaggtttttcttagcgtcctgatcttcggtgtggcaggcctgctgctgtttatgtatttgcaggtgtggatcgaggagcaacataccggaagagtggagaaacgacgtgagcagaaggtgaccagtggttggggccccgtgaaatacctgcggcccgtcccaaggattaagccacaggtctcacacgcttag

SEQ ID NO: 6834 - DNA, 861 bp, Artificial Sequence
  Description of Artificial Sequence: Synthetic coding sequence
atgaaggtcctgctgctcaccgggctgggggccctgtttttcgcttactactgggacgataactttgacccagcttccctgcagggagctagagtactcctgacgggagcaaatgctggagtcggggaagagctggcttaccattacgctcggttaggctcgcaccttgttttgaccgctcataccgaagctctcctgcagaaagtggtgggcaattgtagaaagctgggcgcccctaaggtcttttatatcgctgccgatatggcttctcctgaagcgcctgagtccgtggtgcagtttgccttggataaattgggaggccttgactacctggtcctgaatcacataggcggtgctcctgcaggcacccgagcccgctcccctcaggctacgcgatggttaatgcaggtgaatttcgtctcatatgtacagttaacatcaagggccctgccttcattgactgatagtaagggatcattagttgtggtctccagtctgttaggccgggttcccacgagcttctcaacgccgtattctgctgctaagtttgctctggacggcttttttggatctctgaggagagagctggatgtacaggacgtgaacgttgctatcaccatgtgcgtgctgggactcagggacagagcctccgccgctgaggcagttcggggcgtgacgcgtgtgaaagccgcaccgggacccaaggctgctttagctgtcatacgcggaggtgcaactcgggccgctggagtcttctacccatggcgctttcgtctgctttgcctgcttcggaggtggctgccccgacccagagcttggtttattaggcaggagctcaacgtgacggccgctgcggcgtag

SEQ ID NO: 6835 - DNA, 459 bp, Artificial Sequence
  Description of Artificial Sequence: Synthetic coding sequence
atgcaagtgaacttcgtcagctacgtacagctcacgtcacgagcgctaccatctctaacagattctaagggcagtcttgtggtcgtgtcatcccttttaggccgagtcccaacttccttctcaactccctattctgctgcaaagttcgccctcgatggtttttttggaagcctgcgtagggagctggatgtgcaggatgtcaatgtcgcgataactatgtgtgtgttgggattgcgggacagggctagtgcggccgaggctgtcaggggggtcacccgggtgaaggcggccccagggcccaaagccgccctagcagttattcgcgggggcgcaacacgggccgctggagtgttttacccatggcggtttaggctgctctgtctcctgagacgatggctcccccgaccacgggcctggtttatcaggcaggaactgaatgttacagcggccgccgcctag

SEQ ID NO: 6836 - DNA, 2856 bp, Artificial Sequence
  Description of Artificial Sequence: Synthetic coding sequence
atgagggtgctggcctgtctcttggccgctttggttggaatacaggcagttgagcgcctgaggctcgctgacggaccccatggttgtgccggaaggctggaagtgtggcatgggggccgttgggggacagtgtgcgatgacggctgggacctgcgggatgctgcagtggcttgtcggcaacttggatgtggcggcgcattagctgctcctggcggggctttcttcggtgagggggccggcccagtgtggctttctgaactcgcttgccggggcaacgaggggcagttagggctgtgtcatcatcgtggatggaaggcccatatctgtagccacgaggaggatgccggtgtcgtatgtgcaggacagcgagtggccaactcaagagatgattccacatctcccctggatggcgctccctggccggggctgttactggagctcagtcccagtaccgaggaacccctcgtgactcacgctcctcgccccgccgggaacccacagaatgcttcccggaagaagtcccctcggccaaagcaggctaaaagcactcgtgcacctctgctgaccactggcgcgccaaggcaggagaggctgagactcgttagtggccctcatagatgtgcaggccgccttgaggtgtggcacgggggtcgctggggcacagtgtgtgatgatgggtgggacttgcgcgatgcggccgtggcgtgtagggaactcggctgtgggggcgcattggcagcacctgggggtgctaggtttggtcccggtgccgggcccgtctggatggacgatgtcggctgcgggggcggagagcaggccctccgggactgtccacggtcaccatggggaaggtcaaactgtgatcacagcgaggatgcgggacttgtgtgtaccggcccagccccccggcttcgccttgctgacggaccgcatggatgcgcaggaagactcgaagtgtggcacggcggacgatgggggtccgtgtgcgatgatgcttgggacctgagggacgccgccgtagcttgtcgggaactgggctgcggaggggccctggccgcgcctggcggagctttttttggagagggaagcgggcccatcatcctagacgacctccggtgtagaggcaatgagaccgctctgcgattctgtcccgccaggccctgggggcagcacgactgccatcacagagaagacgcaggagccgtgtgtgatggcatgcctttggggtatgtgccccctactgcccccacggatagcaacaatagcacgcccagagaagcagcatcccggcctccgtctaccatgacctcccaagcgcccggcacggctggagtgtcgcccccccccgccagccccactgtgctgtgggaaccagggcccgaagccggaagccctcaactgcggctggtggcaggacctagcaagtgctccggcaggctggaagtctggcatgatcagaggtgggggaccgtctgcgacgacagctgggatatgcgagatagcgctgtggtgtgcagggaattgggctgtggtggtccccaacagcccgatccagccgctggtagatttggatggggtgccggtccaatttggctggacgatgtagggtgtgtcggcacagaagcatccttgagcgattgcccggccgcaccctggggaaagcacaattgtgcacacaatgaagacgtgggcgtcacatgtacaggccctccaggattggattcgatttccgatccctttagctggtcctggatcccaggactgggacgagatcgtgatgcttggttgccgggtgagctggcaactaagcctagcgcatctgtgaccgcctctgtgttagagaaaactaccaccaaagcacccggaaaaatgccaaagtctacgaagaaatgggtgacgaaaaacgccaagagacctacaacccagccgcccgtgatgcctactaccaaacactccagagcccagtcaccacctgacctcactagccagacaactgccgccctgaccactgaagcttcgcggaggccaaccagcgagttcacccgacggcctacaaccgaagcaccacaaagatggaccagtcacacaacagccaccctaaccccgcaagctccacgggaacgcacaactaagaccatggctatgttgacgacccaagggccccaagaaatgacttccgaatctaccatcaaaagtatcccccaagcctctctggaaccctcagcggaaatacctgaaggaagccccgaatccccaaaggacccagctcctagtccatccgtcagcactaccggcgaaagcgggctctttcgcgtgcggctggctgacggccccaacaggtgtgccggtaggctggaagtgtggcatgcagggaggtggggcaccgtttgcgacgacaattgggacctgcgtgatgctaccgtcgcctgctgggaattggggtgcgggaaggtaagaccccgcgtgggtaagactcactatgggcccggcactggcccaatttggctggatgacatgggatgtaaaggttctgaggcatccttgagcgattgtccaagcggtgcgtgggggaaacacaattgtgatcatgaagaagacgttgggctgacttgcaccggatatactgattatgatgattacccgccgtggacttgggatcccacatctagagaggatttggcaaaggggacgacaactgcaggggtgcccggtcataccttaccttggaggactactcggagaccaggcagtagcagcccggcaattaggaggctcccagatactgagcctgaagcgggagccccccgaggggacgcgccaaggtcccggactgcgagagtggcagcccctccttag

SEQ ID NO: 6837 - DNA, 8430 bp, Artificial Sequence
  Description of Artificial Sequence: Synthetic coding sequence
atgaccttggaaggactgtatctggcacggggacccctggcccggttgttgctagcctggagcgcccttctctgcatggctggtggccagggtcgctgggatggtgctctggaggccgccggccctggcagagtgcggcgaagaggaagcccaggcatcctgcaaggtcccaacgtgtgcggaagcaggttccatgcatactgctgtcctgggtggagaacgttccctggccggagccagtgcgtcgtcccaatctgcagacgagcatgcggcgaagggttctgttctcagcccaacctctgcacctgtgccgacggaacgctcgctccgtcctgcggagtgtcgaggggaagtggctgttccgtgtcttgcatgaatggcggtacatgcagaggagcatcatgcctctgtcaaaagggctatacaggcacagtgtgcggccaacctatatgtgatcgcggctgccacaatggcgggcgatgcattggtcccaatcgctgcgcgtgtgtctacggattcatggggccacagtgtgagcgggattatagaaccggaccgtgttttgggcaggtgggtcctgagggatgccaacatcagttaaccggcctggtgtgcacaaaagctctgtgctgcgccactgtgggcagggcatggggcctgccctgcgagttgtgccccgcgcagcctcatccttgtcgtcgcgggtttattccaaacatccacacaggtgcctgtcaagacgtcgatgaatgccaggccgtgcccgggctttgccagggcgggtcctgtgtgaatatggtgggtagcttccactgccggtgccccgttggtcatcggcttagtgattcctcggcggcgtgcgaggactacagagctggggcgtgcttttcagttctgttcggaggtaggtgcgccggggaccttgccgggcattacactagaagacagtgctgttgtgaccgcggccgatgttgggccgctgggccagtgcccgaactctgtccccctcgaggctcaaacgagtttcagcagctttgtgcacagcgtttgcccctactcccgggacaccctggacttttccctgggttgctggggtttggatcaaatggaatggggccacctttaggacctgctcgtctgaaccctcacggtagtgatgcgcggggcattccttctctgggtccaggtaatagcaatatcggcactgctactctgaaccagaccattgatatatgtcgtcatttcaccaacttgtgtctgaatggcagatgcctcccaaccccttctagctaccggtgcgagtgcaatgtgggatacactcaggacgtgagaggagagtgtatagacgtggacgaatgcacgtccagcccctgccatcatggcgactgcgttaacataccaggtacgtaccattgccgctgttatcccggcttccaggccacccccactagacaagcctgtgtggacgtggatgagtgtatcgtttccggcggcctgtgccacctagggcgttgtgtcaataccgaaggctccttccagtgtgtgtgtaatgcaggctttgaactgtccccggacgggaagaattgcgtcgaccataacgagtgcgccacctccaccatgtgcgtgaacggcgtgtgcttaaatgaggatgggagtttttcatgcctctgcaaacccgggttccttcttgccccagggggtcactattgcatggatatcgacgaatgtcagactcctggtatctgcgtcaacggacattgcaccaacaccgaggggtcattccggtgtcagtgcctcgggggccttgctgtggggaccgacggcagggtttgtgttgatacacacgtgcgttccacctgctatggggctattgaaaaaggttcttgtgcacgcccgttcccaggaaccgttacaaagtccgaatgttgttgcgccaaccccgatcacgggttcggcgagccttgtcagctgtgccccgcaaaggacagcgccgaatttcaggccctatgttcttctggtctgggtattaccaccgacggccgggacatcaacgagtgcgcactggatcctgaggtgtgtgccaacggggtgtgtgagaacctgagagggtcctacagatgtgtatgcaatctgggctatgaggccggtgcctcaggcaaggactgcacggacgtggacgagtgtgctctgaattcgttactgtgcgacaacggatggtgtcagaatagccccggtagttattcctgtagttgcccccctggatttcacttttggcaagataccgagatttgtaaggacgtggatgaatgcctgtcctcgccttgcgtttctggcgtatgtcgaaaccttgcgggcagttatacctgcaagtgtgggcctgggagtaggctagatcccagcggcactttctgcttggactctacaaaggggacatgttggctgaaaattcaggaatcgcgctgcgaggtgaacctgcagggtgcctccctgcggtccgagtgttgcgccactctcggggcagcctggggatctccatgtgaacgctgcgaaatcgatccagcctgtgccagaggattcgccaggatgactggcgtgacgtgcgacgatgttaatgaatgcgagtcctttcccggcgtttgtcctaatggaaggtgcgtaaataccgctggctcttttcggtgtgaatgcccggaagggctgatgctggatgccagcggtcgcctgtgcgtcgacgtccggctggaaccatgctttctcaggtgggatgaagatgaatgcggtgtaacgctgcccgggaaatacaggatggacgtgtgctgctgttcaatcggcgcagtgtggggcgttgagtgtgaggcttgccccgacccggagagtctggagttcgcaagcctgtgtcctcgcggcttaggctttgcttcccgggattttctgtccggtcggcccttttacaaggacgttaacgagtgtaaagtgtttcccgggctttgtacccatggaacatgccgcaacacagtggggagctttcattgtgcctgtgccggaggttttgcgctggatgctcaagagaggaactgcactgatattgatgagtgccggatcagcccggacctctgtggacaaggtacctgcgtgaatacacctggtagcttcgagtgcgaatgttttcccgggtacgagagcgggtttatgctgatgaagaactgtatggatgtcgatgaatgtgcaagggatccgctgctttgcagggggggtacctgtactaatactgatgggtcctacaagtgccagtgtcctcccgggcatgagctgacagcaaaaggtaccgcatgcgaagacatcgacgagtgctctctgtccgatggtctctgcccacacggccagtgtgttaacgttattggggcattccagtgctcttgccatgccggattccagtctacccccgatcgccagggctgtgtggacatcaacgagtgtcgcgtgcagaatggtggttgtgacgtccactgcatcaatacagagggcagctatcggtgctcttgcgggcaggggtacagccttatgccagatggaagggcttgtgctgacgtggacgaatgtgaggagaacccacgagtatgcgaccagggtcactgcaccaacatgccagggggacatagatgcttatgctacgacggatttatggccaccccagatatgaggacatgtgtggacgtcgacgagtgcgatttaaatccccacatttgcttacacggcgattgtgagaatacgaagggctcatttgtgtgtcactgccagctgggatacatggtgcgcaaaggagcaacagggtgcagcgacgtggacgaatgtgaagtgggcggacataactgcgattcacatgctagctgcctcaacataccagggtccttctcctgtcggtgcctgcccgggtgggtgggtgatggcttcgagtgtcacgacttagacgagtgcgtatcccaggaacatcggtgcagtccacgcggagattgcttgaacgtgccgggtagctaccggtgtacttgcagacagggatttgccggcgatggtttcttttgcgaagatcgcgacgaatgcgctgagaacgtggatctgtgtgataatggccaatgccttaacgcaccgggcggctatcgatgtgaatgtgagatggggtttgatccaaccgaggaccatagggcttgccaggacgttgatgaatgtgcgcagggtaatttatgtgcctttggttcgtgtgagaacctgcctggtatgttcagatgtatctgtaacggtgggtatgagctggacagaggcggtggaaactgcaccgatatcaatgaatgtgccgaccccgttaactgcattaatggtgtgtgcattaatacccccggcagttacttatgttcttgcccccaggactttgagctcaatccaagcggcgtggggtgtgttgatacccgggcgggaaactgctttctggaaactcacgaccgaggcgacagtggcatcagctgcagcgctgaaattggtgtgggcgtgacccgcgcaagttgttgttgctccctgggacgcgcatgggggaacccatgcgaactttgcccaatggctaacacgaccgagtaccgtacactgtgccctggcggtgaggggtttcagccgaatcgtataaccgttattctcgaagatatagacgagtgccaggagctacctggcctgtgccagggaggagattgcgtgaacacatttgggagctttcagtgcgaatgtcctccaggataccatttgagcgagcacacccggatttgcgaggatatagacgagtgttctacccattcaggaatctgtgggcctgggacctgctacaataccctgggcaactacacatgtgtctgcccagccgagtatctgcaggttaatggggggaacaactgcatggacatgcggaaatcggtttgtttcagacattacaacggaacatgtcagaatgaactagcatttaatgttacacgaaagatgtgctgctgttcctataatataggacaggcctggaatcgcccttgcgaggcctgtcctaccccaatatccccagattatcagatactctgcggcaaccaggcccccgggtttctgacagacatacatactggtaaacccctggacattgacgagtgcggggaaattccggctatctgtgcaaatgggatttgtatcaaccaaattgggagcttcaggtgcgaatgcccggccggatttaattacaacagcatcctgcttgcctgcgaggatgtcgatgagtgcggaagcagggagtcgccctgtcagcagaatgccgactgcatcaatattcctggatcttaccgttgcaaatgcacacgcggctacaagttgagtcccggcggggcctgcgttgggcgtaacgaatgcagagagatcccaaatgtctgctcacacggagactgtatggacacagaagggtcttacatgtgtctatgtcacaggggattccaagcttctgcagaccagacgctctgtatggatattgatgaatgtgaccggcagccctgtggcaacggtacgtgtaagaatatcatagggtcttacaactgcctctgcttcccagggttcgtcgtgacgcacaacggcgattgtgtggactttgatgaatgcaccacattggtgggccaggtctgcaggttcggtcactgccttaataccgcagggagttttcattgcctgtgccaggatggctttgagctgaccgcggatggtaaaaattgcgttgacactaacgagtgtctttctctggctgggacttgccttcccggtacttgccagaatttggagggctcttttaggtgtatttgtcctcccggctttcaggtgcagagcgaccattgtattgatattgacgagtgtagcgaagaaccaaacctgtgcctatttggcacatgtacaaatagtcctggtagtttccagtgtctgtgcccaccaggatttgttttgagcgacaatggacaccgatgtttcgacacaagacagtctttctgtttcacaagattcgaggcagggaagtgttctgtcccaaaggccttcaatacaactaaaacccggtgctgctgtagcaagagaccaggagagggttggggagacccctgcgagctttgtccacaggagggaagcgctgcttttcaggagctttgtcccttcggacatggcgctgtaccagggccagacgactcaagagaggatgtgaacgaatgtgctgaaaaccccggagtatgcaccaacggcgtttgcgttaataccgacggctcattccgatgcgagtgtcccttcggctactctctggactttaccggaatcaattgcgttgacacagacgagtgttcagtgggacacccgtgtggacagggaacatgcaccaatgtgattggagggttcgagtgtgcttgcgctgacggatttgaaccgggactgatgatgacatgcgaggatatcgatgaatgcagcctcaatcctcttctatgcgcctttcgctgtcataacaccgaggggtcttacctctgtacttgtcctgccggatacacattgcgggaggacggagccatgtgccgcgatgtagatgagtgtgccgacgggcagcaggattgccatgcccgtggcatggagtgcaagaacctgatcgggacgttcgcttgcgtttgccccccaggaatgcgcccattgcccggcagtggggaaggatgtactgacgataacgagtgtcacgcacagccagacttatgcgtgaatggtaggtgtgtcaacacagctggctccttcagatgcgattgcgacgaaggctttcaaccgtctcctacattaactgaatgccacgacattcgtcagggcccctgtttcgccgaagttctacagaccatgtgcaggagcctgtccagctcctccgaggcggtgaccagggccgagtgctgctgtggaggcggacgcgggtggggcccacgctgcgaactctgcccgctgcctgggacaagtgcctaccgtaagctctgcccacatggttcaggctatacagctgaggggcgcgatgtcgatgaatgtcgcatgctcgcccatctctgcgcacacggtgagtgtatcaattcactcggttcgtttcggtgtcattgtcaggccggctacactcctgatgccacagcgaccacatgcttagatatggatgagtgctcccaggtaccaaagccatgtactttcttgtgcaaaaacacaaagggaagtttcctttgttcttgcccgcgcggatatctcctggaggaggatgggcggacatgcaaagatctggatgagtgtaccagcaggcagcacaattgccaattcttgtgtgttaacactgtcggcgccttcacctgtaggtgccctcctgggtttacacagcatcaccaggcatgctttgataacgatgagtgctcggctcagcccggaccctgtggggcgcacggacactgtcataacaccccaggctccttcagatgtgaatgccaccagggcttcactctggtgtcttcaggacacggttgtgaggacgtaaatgaatgcgacggtcctcaccgctgccagcatggctgccaaaaccaactcggcgggtatcgctgcagctgtccacaagggttcacgcagcattctcagtgggctcagtgtgtggatgagaatgagtgtgccctgtcccccccgacatgcggcagtgccagctgtaggaacactctcgggggattccgatgcgtgtgtccatccggtttcgatttcgaccaggccctgggcgggtgtcaggaagttgacgagtgtgctggcaggaggggaccctgctcttactcatgcgccaacactccaggaggctttttgtgcggttgccctcagggctacttccgggcaggccagggccattgcgtgagtggcctggggttcagcccaggaccccaggacacacccgacaaagaggaactcctatcgtcagaagcctgttacgagtgcaagataaacgggctgtccccacgggatcgccctagacggtcagctcaccgagaccatcaggtcaatctggcaaccctggattcggaggcgcttctaactttaggactgaaccttagtcacttgggcagggcggagagaatcctggaattgaggcccgcccttgagggcttagaaggaagaatccggtatgtaatcgtacggggaaacgagcagggatttttccggatgcatcatctacgtggggtgtcatccttgcaactgggtagacgacgacctggaccaggcacctacaggcttgaggtggtcagtcacatggccggtccatggggcgtccagcccgaaggccagcccggcccttggggacaagctttgcggcttaaagtacagttgcagttgctctag

SEQ ID NO: 6838 - DNA, 291 bp, Artificial Sequence
  Description of Artificial Sequence: Synthetic coding sequence
atgagagtgacgtcagcaacctgtgccctgcttctcgcgctgatctgttccgtgcagctaggagatgcctgtctcgatatcgataaactattggccaacgtggttttcgacgtgtcccaggacctgcttaaggaagagctcgcccgttacaacccgagccccctgactgaagaaagcttcctgaacgttcagcagtgtttcgccaacgtgagcgtgaccgaaagatttgcccatagcgtggtgatcaagaagatccttcaatccaatgactgcatcgaagctgctttttag

SEQ ID NO: 6839 - DNA, 1890 bp, Artificial Sequence
  Description of Artificial Sequence: Synthetic coding sequence
atgcaacaagatggattgggcgttggtactagaaatggttcaggtaagggcagatcagttcaccccagctggccttggtgcgctcccagacctctgcgatacttcgggcgcgacgcccgcgcacgaagggctcagacggccgccatggccttacttgccggcggtctttctcgtggtcttggatcacatcccgccgcagccggccgggacgcagtagtttttgtctggctactgctgtccacctggtgtaccgcccccgcccgggccatccaggtgaccgtgagcaatccctaccacgttgttatcctgtttcagccagttacgctcccttgcacataccagatgacatccactcccacgcagcccatcgtcatctggaagtacaagagtttttgcagagatcgaattgctgacgcattctcacctgcgtccgtggacaatcaactgaatgcccagttggcagccggaaaccccggatacaatccgtatgtcgagtgccaggacagcgtcaggactgtccgggttgtcgccaccaaacagggaaacgccgttaccctgggcgactactaccagggtagacgaattactataaccggaaacgcagatcttacgttcgatcagaccgcgtggggagattctggagtctactattgcagcgtggtgagcgcgcaggaccttcaggggaataacgaggcttacgccgagctcattgtgctagattggcttttcgtggttgttgtgtgcctggcagcattcttaatcttccttctgctgggcatatgttggtgtcagtgttgcccccacacttgttgttgctacgttcgctgtccgtgctgccccgataaatgttgttgcccggaggccttatatgcagccggaaaagccgcgacatctggcgtcccatcgatttacgccccatctacatacgctcaccttagccccgcgaaaactccgccacccccagctatgattcctatgggacctgcttataacggctatcccggcgggtacccaggcgatgtcgaccggagctcctccgctggcggacaaggatcttacgtgcctctcctcagggatacagattccagtgtggcatcagtgcggagcgggtacagaattcaggcttcccagcaggacgactctatgcgggtgctgtactatatggaaaaggaactcgcgaactttgacccttcacgccccggacccccctcaggaagagtggagagggctatgagtgaggttacgtctctacacgaagatgactggcgatcgaggccctcccgtgggccagccttaactcctatccgagatgaggaatggggggggcacagccccagatcaccacggggctgggatcaggagccagcgcgtgagcaggccggcggtgggtggcgtgctcgcagaccgagggcccggtcagtggacgcgctagatgatcttacccccccctccacagccgaatctggtagccggtctccgacctctaacggtggcaggtcgagagcatatatgccgccacgatctcggagccgggacgatttgtacgaccaggatgactcccgggattttcctcggtctcgcgacccacattacgacgattttagaagccgtgaaagaccaccggccgacccccggtctcatcatcataggactagggatcccagggataatggatctaggagcggcgatttgccgtatgatgggaggctgctggaggaggccgtacgcaaaaagggcagcgaggagcggcgtaggccccacaaggaggaggaggaagaagcatactaccccccagcacctccaccttatagtgaaacggattcacaggcctccagggagcgcaggttgaagaagaatctggccctgagcagggagtctttagtggtgtag

SEQ ID NO: 6840 - DNA, 591 bp, Artificial Sequence
  Description of Artificial Sequence: Synthetic coding sequence
atgagcagaagatccatgctgctggcctgggccctgcccagcctgctgcggctgggcgccgcccaggagacagaagatcctgcctgctgcagccccatcgtgcccagaaatgagtggaaggccctggcctctgaatgtgcccagcacctgagcctgcccctgcgctacgtggtggtgagccacacagctggcagcagctgcaacaccccagccagctgccagcagcaggccagaaatgtgcagcactaccacatgaagaccctgggctggtgtgatgtgggctacaacttcctgattggagaagatggcctggtgtatgagggccggggctggaacttcaccggggcccacagcggccacctgtggaaccccatgagcatcggcatctccttcatgggcaactacatggacagagtgcccaccccccaggccatccgggccgcccagggcctgctggcctgtggggtggcccagggcgccctgcggagcaactacgtgctgaagggccacagagatgtgcagaggaccctgagccctggcaaccagctgtaccacctgatccagaactggccccactaccgcagcccctag

SEQ ID NO: 6841 - DNA, 1056 bp, Artificial Sequence
  Description of Artificial Sequence: Synthetic coding sequence
atggaggcctttgccctgggccctgcccggcggggcagaagaaggaccagggctgctggcagcctgctgagccgggccgccatcctgctcttcatcagcgccttcctggtgcgggtgcccagctctgtgggccacctggtgcggctgccccgggccttccggctgaccaaggacagcgtgaagatcgtgggcagcaccagcttccctgtgaaggcctacgtgatgctgcaccagaagagcccccacgtgctgtgtgtgacccagcagctgagaaatgctgagctgattgaccccagcttccagtggtacggccccaagggcaaggtggtgtctgtggagaacagaacagcccagatcaccagcacaggcagcctggtgttccagaactttgaggagagcatgagcggcatctacacctgcttcctggagtacaagcccaccgtggaggagatcgtgaagaggctgcagctgaagtatgccatctatgcctaccgggagccccactactactaccagttcaccgcccgctaccacgccgccccctgcaacagcatctacaacatcagctttgagaagaagctgctgcagatcctgagcaagctgctgctggacctgagctgtgagatcagcctgctgaagtctgagtgccaccgggtgaagatgcagagagctggcctgcagaatgagctgttctttgccttctctgtgagcagcctggacacagagaagggccccaagcgctgcacagaccacaactgtgagccctacaagaggctcttcaaggccaagaacctgattgagcgcttcttcaaccagcaggtggagatcctgggcagaagagctgagcagctgccccagatctactacatcgagggcaccctgcagatggtgtggatcaaccgctgcttccctggctacggcatgaatgtgcagcagcaccccaagtgcccagagtgctgcgtcatctgcagccctggcagctacaaccccagagatggcatccactgcctgcagtgcaacagcagcctggtgtatggagccaagacctgcctgtag

SEQ ID NO: 6842 - DNA, 420 bp, Artificial Sequence
  Description of Artificial Sequence: Synthetic coding sequence
atggagaccaacgtgttccacctgatgctgtgtgtgaccagcgcccggacccacaagagcaccagcctgtgcttcggccacttcaacagctaccccagcctgcccctcatccatgacctgctgctggagatctccttccagctgagcgcccctcatgaagatgcccggctgaccccagaggagctggagcgggccagcctgctgcagatcctgcctgagatgctgggcgctgagcggggggacatcctgaggaaggctgacagcagcaccaacatcttcaacccccggggcaacctgaggaagttccaggacttcagcggccaggaccccaacatcctgctgagccacctgctggcccgcatctggaagccctacaagaagcgggagaccccagactgcttctggaagtactgtgtgtag

SEQ ID NO: 6843 - DNA, 606 bp, Artificial Sequence
  Description of Artificial Sequence: Synthetic coding sequence
atgggcagcggcagaagagccctgtctgctgtgcctgctgtgctgctggtgctgaccctgcccggcctgcctgtgtgggcccagaatgacacagagcccatcgtgctggagggcaagtgcctggtggtgtgtgacagcaacccagccacagacagcaagggcagcagcagcagccccctgggcatctctgtgcgggccgccaacagcaaggtggccttctctgctgtgcgcagcaccaaccacgagcccagcgagatgagcaacaagacccgcatcatctactttgaccagatcctggtgaatgtgggcaacttcttcaccctggagagcgtgtttgtggcccccaggaagggcatctacagcttctccttccacgtgatcaaggtgtaccagagccagaccatccaggtgaacctgatgctgaatggcaagcctgtgatcagcgcctttgctggggacaaggatgtgacccgggaggccgccaccaatggagtgctgctgtacctggacaaggaggacaaggtgtacctgaagctggagaagggcaacctggtgggcggctggcagtacagcaccttcagcggcttcctggtgttccccctgtag

SEQ ID NO: 6844 - DNA, 264 bp, Artificial Sequence
  Description of Artificial Sequence: Synthetic coding sequence
atgaaggtgctgcgggcctggctgctgtgcctgctgatgctgggcctggccctgcggggagctgccagcaggacccaccgccacagcatggagatccgcaccccagacatcaacccagcctggtacgccagccggggcatccggcctgtgggccgctttggaagaagaagagccaccctgggagatgtgcccaagccaggcctgcggccccggctgacctgcttccccctggagggcggggccatgagcagccaggacggctag

SEQ ID NO: 6845 - DNA, 1098 bp, Artificial Sequence
  Description of Artificial Sequence: Synthetic coding sequence
atgcctgggggcaagaaggtggccggcggcggcagcagcggggccacccccaccagcgctgctgccacagcccccagcggcgtgcggcggctggagaccagcgagggcaccagcgcccagagagatgaggagcctgaggaggagggggaggaggacctgagagatggaggagtgcccttctttgtgaacagaggaggcctgcctgtggatgaggccacctgggagaggatgtggaagcacgtggccaagatccacccagatggagagaaggtggcccagaggatccggggggccacagacctgcccaagatccccatccccagcgtgcccaccttccagcccagcacccctgtgcctgagcggctggaggccgtgcagcgctacatccgggagctgcagtacaaccacacaggcacccagttctttgagatcaagaagagccggcccctgaccggcctgatggacctggccaaggagatgaccaaggaggccctgcccatcaagtgcctggaggccgtcatcctgggcatctacctgaccaacagcatgcccaccctggagcgcttccccatctccttcaagacctacttcagcggcaactacttccgccacatcgtgctgggcgtgaactttgctggccgctatggagccctgggcatgagccggcgggaggacctgatgtacaagcccccagccttccgcaccctgtctgagctggtgctggactttgaagctgcctacggccgctgctggcacgtgctgaagaaggtgaagctgggccagagcgtgtcccatgacccccacagcgtggagcagatcgagtggaagcacagcgtgctggatgtggagcggctgggcagagatgacttcaggaaggagctggagagacatgcccgggacatgaggctgaagattggaaaaggaactggaccacccagccccaccaaggacaggaagaaggatgtgagcagcccccagagggcccagagcagcccccacagaagaaacagccgctcagaaagaagacccagcggggacaagaagaccagcgagcccaaggccatgccagacctgaatggctaccagatccgggtgtag

SEQ ID NO: 6846 - DNA, 1377 bp, Artificial Sequence
  Description of Artificial Sequence: Synthetic coding sequence
atggcctgggccagccggctgggcctgctgctggccctgctgctgcctgtggtgggcgccagcaccccaggcaccgtggtgcggctgaacaaggccgccctgtcctatgtgtctgagatcggcaaggcccccctgcagagggccctgcaggtgacagtgccccacttcctggactggagcggggaggccctgcagcccacccgcatccgcatcctgaatgtgcacgtgccccggctgcacctgaagttcatcgccggctttggagtgcggctgctggccgccgccaacttcaccttcaaggtgttccgggcccctgagcccctggagctgaccctgcctgtggagctgctggccgacaccagggtgacccagagcagcatccgcacccctgtggtgtccatcagcgcctgcagcctcttcagcggccacgccaatgaatttgatggcagcaacagcaccagccacgccctgctggtgctggtgcagaagcacatcaaggctgtgctgagcaacaagctgtgcctgagcatcagcaacctggtgcagggcgtgaatgtgcacctgggcaccctcatcggcctgaaccctgtgggccctgagagccagatccgctacagcatggtgtctgtgcccaccgtgaccagtgactacatcagcctggaggtgaatgctgtgctcttcctgctgggcaagcccatcatcctgcccacagatgccaccccatttgtgctgcccaggcatgtgggcacagagggctccatggccaccgtgggcctgagccagcagctgtttgacagcgccctgctgctgctgcagaaggccggggccctgaacctggacatcaccggccagctgcggagtgatgacaacctgctgaacaccagcgccctgggccgcctcatccctgaggtggcccggcagtttcctgagcccatgcctgtggtgctgaaggtgcggctgggcgccacccctgtggccatgctgcacaccaacaatgccaccctgcggctgcagccctttgtggaggtgctggccacagccagcaacagcgccttccagagcctcttcagcctggatgtggtggtgaacctgcggctgcagctgtctgtgtccaaggtgaagctgcagggcaccacctctgtgctgggagatgtgcagctgactgtggccagcagcaatgtgggcttcatcgacacagaccaggtgaggaccctgatgggcaccgtgtttgagaagcccctgctggaccacctgaatgccctgctggccatgggcatcgccctgcccggggtggtgaacctgcactacgtggcccctgagatctttgtgtatgagggctacgtggtgatcagcagcggcctcttctaccagagctag

SEQ ID NO: 6847 - DNA, 1815 bp, Artificial Sequence
  Description of Artificial Sequence: Synthetic coding sequence
atgatgagagctgtgtgggaggccctggccgccctggccgctgtggcctgcctggtgggcgctgtgcggggcggccctggcctgtccatgtttgctggccaggccgcccagcctgacccctgcagtgatgaaaatggccacccccggcgctgcatcccagactttgtgaatgctgccttcggcaaggatgtgcgggtgagcagcacctgtggccggcccccagcccgctactgtgtggtgtctgagcggggggaggagcggctgcggagctgccacctgtgcaatgccagtgaccccaagaaggcccaccccccagccttcctgacagacctgaacaacccccacaacctgacctgctggcagagcgagaactacctgcagttcccccacaacgtgaccctgaccctgagcctgggcaagaagtttgaggtgacctacgtgtccctgcagttctgcagccccaggcctgagagcatggccatctacaagtccatggactatggccgcacctgggtgcccttccagttctacagcacccagtgcaggaagatgtacaaccggccccaccgggcccccatcaccaagcagaatgagcaggaggccgtgtgcacagacagccacacagacatgaggcccctgagcggcggcctcatcgccttcagcaccctggatggccggcccagcgcccatgactttgacaacagccctgtgctgcaggactgggtgacagccacagacatccgggtggccttcagccggctgcacacctttggagatgaaaatgaagatgattctgagctggcccgggacagctacttctatgctgtgtctgacctgcaggtgggcggccgctgcaagtgcaatggacatgctgcccgctgtgtgcgggacagagatgacagcctggtgtgtgactgccgccacaacacagctggcccagaatgtgaccgctgcaagcccttccactatgaccggccctggcagagggccacagcccgggaggccaatgaatgtgtggcctgcaactgcaacctgcacgcccggcgctgccgcttcaacatggagctgtacaagctgagcggcaggaagagcggcggcgtgtgcctgaactgccgccacaacacagctggccgccactgccactactgcaaggagggctactacagagacatgggcaagcccatcacccacaggaaggcctgcaaggcctgtgactgccaccctgtgggcgccgccggcaagacctgcaaccagaccaccggccagtgcccctgcaaggatggagtgacaggcatcacctgcaacagatgtgccaagggctaccagcagagccgcagccccatcgccccctgcatcaagatccctgtggccccacccaccacagctgccagctctgtggaggagcctgaggactgtgacagctactgcaaggccagcaagggcaagctgaagatcaacatgaagaagtactgcaagaaggactatgctgtgcagatccacatcctgaaggctgacaaggccggggactggtggaagttcaccgtgaacatcatctctgtgtacaagcagggcaccagccgcatcagaagaggagaccagagcctgtggatccgcagccgggacatcgcctgcaagtgccccaagatcaagcccctgaagaagtacctgctgctgggcaatgctgaggacagcccagaccagagcggcatcgtggccgacaagagcagcctggtgatccagtggagggacacctgggcccggcggctgaggaagttccagcagcgggagaagaagggcaagtgcaagaaggcctag

SEQ ID NO: 6848 - DNA, 675 bp, Artificial Sequence
  Description of Artificial Sequence: Synthetic coding sequence
atgcctggccgggcccccctgaggacagtgcctggggccctgggcgcctggctgctgggcggcctgtgggcctggaccctgtgtggcctgtgcagcctgggcgctgtgggcgccccccggccctgccaggccccccagcagtgggagggccggcaggtgatgtaccagcagagcagtggaagaaacagccgggccctgctgtcctatgatggcctgaaccagagggtgcgggtgctggatgagaggaaggccctgatcccctgcaagaggctgtttgagtacatcctgctgtacaaggatggagtgatgttccagattgaccaggccaccaagcagtgcagcaagatgaccctgacccagccctgggaccccctggacatcccccagaacagcacctttgaggaccagtacagcattggaggcccccaggagcagatcaccgtgcaggagtggagcgacaggaagagcgcccggagctatgagacctggattggcatctacacagtgaaggactgctaccctgtgcaggagaccttcaccatcaactacagcgtcatcctgagcacccgcttctttgacatccagctgggcatcaaggaccccagcgtcttcaccccacccagcacctgccagatggcccagctggagaagatgtctgaggactgctcctggtag

SEQ ID NO: 6849 - DNA, 5106 bp, Artificial Sequence
  Description of Artificial Sequence: Synthetic coding sequence
atgggcttcctgcccaagctgctgctgctggccagcttcttccctgctggccaggcctcctggggcgtgagcagcccccaggatgtgcagggcgtgaagggcagctgcctgctgatcccctgcatcttctccttcccagcagatgtggaggtgcctgatggcatcacagccatctggtactatgactacagcggccagaggcaggtggtgagccacagcgctgaccccaagctggtggaggcccgcttccggggccgcacagagttcatgggcaaccctgagcaccgggtgtgcaacctgctgctgaaggacctgcagcctgaggacagcggcagctacaacttccgctttgagatcagcgaggtgaaccgctggagcgatgtgaagggcaccctggtgacagtgacagaggagccccgggtgcccaccatcgccagccctgtggagctgctggagggcacagaggtggacttcaactgcagcaccccctacgtgtgcctgcaggagcaggtgcggctgcagtggcagggccaggaccctgcccggtctgtgaccttcaacagccagaagtttgagcccaccggggtgggccacctggagaccctgcacatggccatgtcctggcaggaccacggccgcatcctgcgctgccagctgtctgtggccaaccaccgggcccagagcgagatccacctgcaggtgaagtatgcccccaagggcgtgaagatcctgctgagccccagcggcaggaacatcctgcccggggagctggtgaccctgacctgccaggtgaacagcagctacccagctgtgagcagcatcaagtggctgaaggatggagtgcggctgcagaccaagacaggagtgctgcacctgccccaggccgcctggagcgatgctggggtgtacacctgccaggccgagaatggagtgggcagcctggtgtccccacccatcagcctgcacatcttcatggccgaggtgcaggtgtccccagctggccccatcctggagaaccagacagtgaccctggtgtgcaacaccccaaatgaggcccccagcgacctgcgctacagctggtacaagaaccacgtgctgctggaggatgcccacagccacaccctgcggctgcacctggccaccagggctgacaccggcttctacttctgtgaggtgcagaatgtgcacggcagcgagaggagcggccctgtgtctgtggtggtgaaccacccccccctgacccctgtgctgacagccttcctggagacccaggccggcctggtgggcatcctgcactgcagcgtggtgtctgagcccctggccaccctggtgctgagccatggaggccacatcctggccagcaccagcggggacagcgaccacagcccccgcttcagcggcaccagcggccccaacagcctgcggctggagatccgggacctggaggagacagacagcggggagtacaagtgcagcgccaccaacagcctgggcaatgccaccagcaccctggacttccacgccaatgctgcccggctgctgatcagccctgctgctgaggtggtggagggccaggccgtgaccctgagctgccgcagcggcctgagccccaccccagatgcccgcttctcctggtacctgaatggagccctgctgcacgagggccctggcagcagcctgctgctgcctgctgccagcagcacagatgctggcagctaccactgccgggccagagatggccacagcgccagcggccccagcagccctgctgtgctgactgtgctgtacccaccccggcagcccaccttcaccacccggctggacctggatgctgctggggccggggccggccggcggggcctgctgctgtgccgggtggacagcgaccccccagcccggctgcagctgctgcacaaggacagagtggtggccaccagcctgcccagcggcggcggctgcagcacctgtggcggctgcagccccaggatgaaggtgaccaaggcccccaacctgctgcgggtggagatccacaaccccctgctggaggaggagggcctgtacctgtgtgaggccagcaatgccctgggcaatgccagcaccagcgccaccttcaacggccaggccaccgtgctggccatcgcccccagccacaccctgcaggagggcacagaggccaacctgacctgcaatgtgtcccgggaggccgccggcagccctgccaacttctcctggttcagaaatggagtgctgtgggcccagggccccctggagaccgtgaccctgctgcctgtggccaggacagatgctgccctgtatgcctgccgcatcctgacagaggccggggcccagctgagcacccctgtgctgctgtctgtgctgtaccccccagaccggcccaagctgagcgccctgctggacatgggccagggccacatggccctcttcatctgcaccgtggacagccggcccctggccctgctggccctcttccatggagagcacctgctggccaccagcctgggcccccaggtgcccagccacggccgcttccaggccaaggccgaggccaacagcctgaagctggaggtgcgggagctgggcctgggggacagcggcagctaccgctgtgaggccaccaacgtgctgggcagcagcaacaccagcctcttcttccaggtgcggggggcctgggtgcaggtgagccccagccctgagctgcaggagggccaggccgtggtgctgagctgccaggtgcacactggagtgcctgagggcaccagctaccgctggtacagagatggccagcccctgcaggagagcaccagcgccaccctgcgctttgctgccatcaccctgacccaggccggggcctaccactgccaggcccaggcccctggcagcgccaccaccagcctggccgcccccatcagcctgcacgtgtcctatgcccccaggcatgtgaccctgaccaccctgatggacaccggccctggccgcctgggcctgctgctgtgccgggtggacagcgaccccccagcccagctgcggctgctgcatggagaccggctggtggccagcaccctgcagggcgtgggcggccctgagggcagcagcccccggctgcacgtggccgtggcccccaacaccctgcggctggagatccatggagccatgctggaggatgaaggagtgtacatctgtgaggccagcaacaccctgggccaggccagcgccagcgctgactttgatgcccaggccgtgaatgtgcaggtgtggccaggggccaccgtgcgggagggccagctggtgaacctgacctgcctggtgtggaccacccacccagcccagctgacctacacctggtaccaggacggccagcagaggctggatgcccacagcatccccctgcccaacgtgacagtgagagatgccaccagctaccgctgtggggtgggccccccaggccgggccccccggctgagccggcccatcaccctggatgtgctgtatgcccccaggaacctgcggctgacctacctgctggagagccacggcggccagctggccctggtgctgtgcaccgtggacagccggcccccagcccagctggccctgagccacgccggccgcctgctggccagcagcacagctgcctctgtgcccaacaccctgcggctggagctgcggggcccccagcccagagatgagggcttctacagctgcagcgcccggagccccctgggccaggccaacaccagcctggagctgcggctggagggcgtgcgggtcatcctggcccctgaggccgctgtgcctgagggcgcccccatcaccgtgacctgtgccgaccctgctgcccacgcccccaccctgtacacctggtaccacaacggccgctggctgcaggagggccctgctgccagcctgtccttcctggtggccacccgggcccatgctggggcctacagctgccaggcccaggatgcccagggcaccaggagcagcaggcctgctgccctgcaggtgctgtatgccccccaggatgctgtgctgagcagcttccgggacagccgggcccgctccatggctgtgatccagtgcaccgtggacagcgagcccccagctgagctggccctgagccatgatggcaaggtgctggccaccagcagcggcgtgcacagcctggccagcggcactggacatgtgcaggtggccagaaatgccctgcggctgcaggtgcaggatgtgcctgctggagatgacacctacgtgtgcacagcccagaacctgctgggcagcatcagcaccatcggccgcctgcaggtggagggcgcccgggtggtggccgagcccggcctggatgtgcctgagggcgccgccctgaacctgagctgccgcctgctgggcggccctggccctgtgggcaacagcacctttgcctggttctggaatgaccggcggctgcacgccgagcctgtgcccaccctggccttcacccacgtggcccgggcccaggccggcatgtaccactgcctggccgagctgcccactggagctgctgccagcgcccctgtgatgctgcgggtgctgtacccacccaagacccccaccatgatggtgtttgtggagcctgagggcggcctgcggggcatcctggactgccgggtggacagcgagcccctggccagcctgaccctgcacctgggcagccggctggtggccagcagccagccccagggcgccccagctgagccccacatccacgtgctggccagccccaatgccctgcgggtggacatcgaggccctgcggcccagcgaccagggcgagtacatctgcagcgccagcaatgtgctgggcagcgccagcaccagcacctactttggagtgcgggccctgcaccggctgcaccagttccagcagctgctgtgggtgctgggcctgctggtgggcctgctgctgctgctgctgggcctgggcgcctgctacacctggagcagcctcatcctgatgcagccccacgtgcggccccagcctgtgccccacccctgggccgaccagtggtgctgcctgcccagcggcggggagagcggccagaacctgtag

SEQ ID NO: 6850 - DNA, 708 bp, Artificial Sequence
  Description of Artificial Sequence: Synthetic coding sequence
atgacagtgctggccccagcctggagccccaccacctacctgctgctgctgctgctgctgagcagcggcctgagcggcacccaggactgcagcttccagcacagccccatcagcagtgactttgctgtgaagatccgggagctgagtgactacctgctgcaggactaccctgtgacagtggccagcaacctgcaggatgaggagctgtgtggcggcctgtggaggctggtgctggcccagcgctggatggagcggctgaagacagtggccggcagcaagatgcagggcctgctggagcgggtgaacacagagatccactttgtgaccaagtgtgccttccagcccccacccagctgcctgcgctttgtgcagaccaacatcagccggctgctgcaggagaccagcgagcagctggtggccctgaagccctggatcacccggcagaacttcagccgctgcctggagctgcagtgccagcctgacagcagcaccctgcccccaccctggagcccccggcccctggaggccacagcccccacagccccccagccccccctgctgctgctgctgctgctgcctgtgggcctgctgctgctggccgccgcctggtgcctgcactggcagaggaccaggaggaggacccccaggcctggagagcaggtgccccctgtgcccagcccccaggacctgctgctggtggagcactag

SEQ ID NO: 6851 - DNA, 3297 bp, Artificial Sequence
  Description of Artificial Sequence: Synthetic coding sequence
atgaccctgcaggagctggtgcacaaggccgccagctgctacatggacagagtggccgtgtgctttgatgagtgcaacaaccagctgcctgtgtactacacctacaagacagtggtgaatgctgccagcgagctgagcaacttcctgctgctgcactgtgacttccagggcatccgggagatcggcctgtactgccagcccggcatcgacctgcccagctggatcctgggcatcctgcaggtgcctgctgcctacgtgcccatcgagccagacagcccccccagcctgagcacccacttcatgaagaagtgcaacctgaagtacatcctggtggagaagaagcagatcaacaagttcaagagcttccacgagaccctgctgaactatgacaccttcaccgtggagcacaatgacctggtgctcttccggctgcactggaagaacacagaggtgaacctgatgctgaatgatggcaaggagaagtatgagaaggagaagatcaagagcatcagcagcgagcacgtgaatgaggagaaggccgaggagcacatggacctgcggctgaagcactgcctggcctacgtgctgcacaccagcggcaccaccggcatccccaagatcgtgcgggtgccccacaagtgcatcgtgcccaacatccagcacttccgggtgctgtttgacatcacccaggaggatgtgctcttcctggccagccccctgacctttgaccccagcgtggtggagatcttcctggccctgagcagcggggccagcctgctgattgtgcccacctctgtgaagctgctgcccagcaagctggcctctgtgctcttcagccaccaccgggtgacagtgctgcaggccacccccaccctgctgcggcgcttcggcagccagctgatcaagagcacagtgctgagcgccaccaccagcctgcgggtgctggccctgggcggggaggccttccccagcctgactgtgctgcgctcctggagaggagagggcaacaagacccagatcttcaacgtgtatggcatcacagaggtgtcctcctgggccaccatctaccgcatccctgagaagaccctgaacagcaccctgaagtgtgagctgcctgtgcagctgggcttccccctgctgggcaccgtggtggaggtgcgggacaccaacggcttcaccatccaggagggcagcggccaggtgttcctgggcggcaggaacagagtgtgcttcctggatgatgaggtgacagtgcccctgggcaccatgagggccaccggggactttgtgacagtgaaggatggagagatcttcttcctgggcaggaaggacagccagatcaagagacatggcaagaggctgaacatcgagctggtgcagcaggtggccgaggagctgcagcaggtggagagctgtgctgtgacctggtacaaccaggagaagctgatcctcttcatggtgtccaaggatgcctctgtgaaggagtacatcttcaaggagctgcagaagtacctgcccagccatgctgtgcctgatgagctggtgctgattgacagcctgcccttcaccagccacggcaagattgatgtgtctgagctgaacaagatctacctgaactacatcaacctgaagtctgagaacaagctgagcggcaaggaggacctgtgggagaagctgcagtacctgtggaagagcaccctgaacctgcctgaggacctgctgcgggtgcctgatgagagcctcttcctgaacagcggcggggacagcctgaagagcatccggctgctgtctgaaattgagaagctggtgggcacctctgtgcccggcctgctggagatcatcctgagcagcagcatcctggagatctacaaccacatcctgcagacagtggtgcctgatgaagatgtgaccttcaggaagagctgtgccaccaagaggaagctgagtgacatcaaccaggaggaggccagcggcaccagcctgcaccagaaggccatcatgaccttcacctgccacaatgagatcaatgcctttgtggtgctgagccggggcagccagatcctgagcctgaacagcacccgcttcctgaccaagctgggccactgcagcagcgcctgccccagcgacagcgtgtcccagaccaacatccagaacctgaagggcctgaacagccctgtgctgattggcaagagcaaggaccccagctgtgtggccaaggtgtctgaggagggcaagccagccatcggcacccagaagatggagctgcacgtgcgctggaggagtgacacaggaaaatgtgtggatgccagccccctggtggtgatccccacctttgacaagagcagcaccaccgtgtacatcggcagccacagccacaggatgaaggctgtggacttctacagcggcaaggtgaagtgggagcagatcctgggggaccgcatcgagagcagcgcctgtgtgtccaaatgtggcaacttcatcgtggtgggctgctacaacggcctggtgtatgtgctgaagagcaacagcggggagaagtactggatgttcaccacagaagatgctgtgaagagcagcgccaccatggaccccaccaccggcctcatctacatcggcagccatgaccagcacgcctatgccctggacatctacaggaagaagtgtgtgtggaagagcaaatgtggcggcaccgtcttcagcagcccctgcctgaacctgatcccccaccacctgtactttgccaccctgggcggcctgctgctggccgtgaacccagccactggaaatgtcatctggaagcacagctgtgggaagcccctcttcagcagcccccagtgctgcagccagtacatctgcatcggctgtgtggatggcaacctgctgtgcttcacccactttggagagcaggtgtggcagttcagcaccagcggccccatcttcagcagcccctgcaccagccccagcgagcagaagatcttcttcggcagccatgactgcttcatctactgctgcaacatgaagggccacctgcagtggaagtttgagaccaccagccgggtgtatgccaccccatttgccttccacaactacaacggcagcaatgagatgctgctggccgccgccagcacagatggcaaggtgtggatcctggagagccagagcggccagctgcagagcgtgtatgagctgcccggggaggtgttcagcagccctgtggtgctggagagcatgctgatcatcggctgccgggacaactacgtgtactgcctggacctgctgggcggcaaccagaagtag

SEQ ID NO: 6852 - DNA, 774 bp, Artificial Sequence
  Description of Artificial Sequence: Synthetic coding sequence
atggccagcaagattggcagccgccgctggatgctgcagctgatcatgcagctgggctctgtgctgctgacccgctgccccttctggggctgcttcagccagctgatgctgtatgcagagcgggcagaggcccggaggaagccagacatccctgtgccctacctgtactttgacatgggcgctgctgtgctgtgtgccagcttcatgagctttggagtgaagaggcgctggtttgccctgggcgccgccctgcagctggccatcagcacctacgccgcctacatcggcggctacgtgcactatggagactggctgaaggtgaggatgtacagcaggacagtggccatcattggaggcttcctggtgctggccagcggggccggggagctgtacagaaggaagcccaggagccgcagcctgcagagcacaggccaggtgttcctgggcatctacctgatctgtgtggcctacagcctgcagcacagcaaggaggaccggctggcctacctgaaccacctgcccggcggggagctgatgatccagctgttctttgtgctgtatggcatcctggccctggccttcctgagcggctactacgtgaccctggccgcccagatcctggccgtgctgctgccccctgtgatgctgctgattgatggaaatgtggcctactggcacaacaccaggagagtggagttctggaaccagatgaagctgctgggggagagcgtgggcatctttggaacagctgtgatcctggccacagatggatag

SEQ ID NO: 6853 - DNA, 2118 bp, Artificial Sequence
  Description of Artificial Sequence: Synthetic coding sequence
atggagaagcccaggagcattgaggagacccccagcagcgagcccatggaggaggaggaggatgatgacctggagctgtttggaggctatgacagcttccgcagctacaacagctctgtgggcagcgagagcagcagctacctggaggagagcagcgaggctgaaaatgaagatcgggaggccggggagctgcccaccagccccctgcacctgctgagccctggcacccccaggagcctggatggcagcggcagcgagcctgctgtgtgtgagatgtgtggcatcgtgggcacccgggaggccttcttcagcaagaccaagcgcttctgcagcgtgtcctgcagccgcagctacagcagcaacagcaagaaggccagcatcctggcccggctgcagggcaagccacccaccaagaaggccaaggtgctgcacaaggccgcctggagcgccaagatcggggccttcctgcacagccagggcaccggccagctggctgatggcacccccaccggccaggatgccctggtgctgggctttgactggggcaagttcctgaaggaccacagctacaaggccgcccctgtgtcctgcttcaagcacgtgcccctgtatgaccagtgggaggatgtgatgaagggcatgaaggtggaggtgctgaacagtgatgctgtgctgcccagccgggtgtactggatcgccagcgtcatccagacagctggctacagagtgctgctgcgctatgagggctttgaaaatgatgccagccatgacttctggtgcaacctgggcaccgtggatgtgcaccccatcggctggtgtgccatcaacagcaagatcctggtgccccccaggaccatccacgccaagttcacagactggaagggctacctgatgaagaggctggtgggcagcaggaccctgcctgtggacttccacatcaagatggtggagagcatgaagtaccccttccggcagggcatgaggctggaggtggtggacaagagccaggtgtccaggaccaggatggctgtggtggacacagtgattggaggccgcctgcggctgctgtatgaagatggagacagtgatgatgacttctggtgccacatgtggagccccctcatccaccctgtgggctggagccggcgggtgggccacggcatcaagatgtctgaaagaagaagtgacatggcccaccaccccaccttcaggaagatctactgtgatgctgtgccctacctgttcaagaaggtgcgggctgtgtacacagaaggaggctggtttgaggagggcatgaagctggaggccatcgaccccctgaacctgggcaacatctgtgtggccaccgtgtgcaaggtgctgctggatggctacctgatgatctgtgtggatggcggccccagcacagatggcctggactggttctgctaccacgccagcagccacgccatcttccctgccaccttctgccagaagaatgacatcgagctgaccccacccaagggctatgaggcccagaccttcaactgggagaactacctggagaagaccaagagcaaggccgcccccagccgcctcttcaacatggactgccccaaccacggcttcaaggtgggcatgaagctggaggccgtggacctgatggagcccaggctcatctgtgtggccaccgtgaagagggtggtgcaccggctgctgagcatccactttgatggctgggacagtgaatatgaccagtgggtggactgtgagagcccagacatctaccctgtgggctggtgtgagctgaccggctaccagctgcagccccctgtggccgctgagcccgccacccccctgaaggccaaggaggccaccaagaagaagaagaagcagtttgggaagaagaggaagaggatcccccccaccaagacccggcccctgcggcagggcagcaagaagcccctgctggaggatgacccccagggcgccaggaagatcagcagcgagcctgtgcctggagagatcatcgctgtgcgggtgaaggaggagcacctggatgtggccagcccagacaaggccagcagccctgagctgcctgtgtctgtggagaacatcaagcaggagacagatgactag

SEQ ID NO: 6854 - DNA, 2103 bp, Artificial Sequence
  Description of Artificial Sequence: Synthetic coding sequence
atgagcaggaggacccgctgtgaggacctggatgagctgcactaccaggacacagacagtgatgtgcctgagcagagggacagcaagtgcaaggtgaagtggacccatgaggaggatgagcagctgcgggccctggtgcggcagtttggccagcaggactggaagttcctggccagccacttccccaacagaacagaccagcagtgccagtaccgctggctgcgggtgctgaacccagacctggtgaagggcccctggaccaaggaggaggaccagaaggtgattgagctggtgaagaagtatggcaccaagcagtggaccctgattgccaagcacctgaagggccgcctgggcaagcagtgccgggagcgctggcacaaccacctgaaccctgaggtgaagaagagctgctggacagaggaggaggaccgcatcatctgtgaggcccacaaggtgctgggcaaccgctgggccgagatcgccaagatgctgcccggccgcacagacaatgctgtgaagaaccactggaacagcaccatcaagaggaaggtggacaccggcggcttcctgtctgagagcaaggactgcaagccccctgtgtacctgctgctggagctggaggacaaggatggcctgcagagcgcccagcccacagagggccagggcagcctgctgaccaactggcccagcgtgccccccaccatcaaggaggaggagaacagcgaggaggagctggccgccgccaccaccagcaaggagcaggagcccatcggcacagacctggatgctgtgaggaccccagagcccctggaggagttccccaagcgggaggaccaggagggcagccccccagagaccagcctgccctacaagtgggtggtggaggccgccaacctgctgatcccagctgtgggcagcagcctgtctgaggccctggacctgattgaaagtgaccctgatgcctggtgtgacctgagcaagtttgacctgcctgaggagcccagcgcagaagattccatcaacaacagcctggtgcagctgcaggccagccaccagcagcaggtgctgcccccccggcagcccagcgccctggtgcccagcgtgacagagtaccgcctggatggccacaccatcagtgacctgagccgcagcagcagaggagagctgatccccatcagccccagcacagaggtgggcggcagcggcatcggcaccccacccagcgtgctgaagaggcagaggaagagaagagtggccctgagccctgtgacagagaacagcaccagcctgtccttcctggacagctgcaacagcctgacccccaagagcacccctgtgaagaccctgcccttcagccccagccagttcctgaacttctggaacaagcaggacaccctggagctggagagccccagcctgaccagcacccctgtgtgcagccagaaggtggtggtgaccacccccctgcaccgggacaagacccccctgcaccagaagcatgctgcctttgtgaccccagaccagaagtacagcatggacaacaccccccacacccccacccccttcaagaatgccctggagaagtatggccccctgaagcccctgccccagaccccccacctggaggaggacctgaaggaggtgctgcggtctgaggccggcatcgagctgatcattgaagatgacatccggcctgagaagcagaagaggaagccaggcctgcggcgcagccccatcaagaaggtgaggaagagcctggccctggacatcgtggatgaagatgtgaagctgatgatgagcaccctgcccaagagcctgagcctgcccaccacagcccccagcaacagcagcagcctgaccctgagcggcatcaaggaggacaacagcctgctgaaccagggcttcctgcaggccaagccagagaaggctgctgtggcccagaagcccaggagccacttcaccaccccagcccccatgagcagcgcctggaagacagtggcctgtggcggcacccgggaccagctgttcatgcaggagaaggcccggcagctgctgggccgcctgaagcccagccacaccagcaggaccctcatcctgtcctag

SEQ ID NO: 6855 - DNA, 528 bp, Artificial Sequence
  Description of Artificial Sequence: Synthetic coding sequence
atgctgaggacagaggtgccccggctgcccaggagcaccacagccatcgtgtggagctgccacctgatggccacagccagcgccatggccggccccagcagcgagaccaccagcgaggagcagctgatcacccaggagcccaaggaggccaacagcaccaccagccagaagcagagcaagcagaggaagagaggaagacatggcccccggcgctgccacagcaactgccgcggggacagctttgccacctacttccggcgggtgctgaagcaggtgcaccagggcctgagcctgagccgggaggccgtgtctgtgatggacagcctggtgcatgacatcctggacagaattgccacagaagctggccgcctggcccggagcaccaagaggcagaccatcacagcctgggagaccaggatggctgtgcggctgctgctgcccggccagatgggcaagctggccgagagcgagggcaccaaggctgtgctgcggaccagcctgtatgccatccagcagcagaggaagtag

SEQ ID NO: 6856 - DNA, 624 bp, Artificial Sequence
  Description of Artificial Sequence: Synthetic coding sequence
atggccccctttgagcccctggccagcggcatcctgctgctgctgtggctgattgcccccagccgggcctgcacctgtgtgcccccccacccccagacagccttctgcaacagcgacctggtgatccgggccaagtttgtgggcaccccagaggtgaaccagaccaccctgtaccagagatatgagatcaagatgaccaagatgtacaagggcttccaggccctgggagatgctgctgacatccgctttgtgtacaccccagccatggagagcgtgtgtggctacttccacaggagccacaacagaagtgaggagttcctgattgctgggaagctgcaggacggcctgctgcacatcaccacctgcagctttgtggccccctggaacagcctgagcctggcccagaggcggggcttcaccaagacctacacagtgggctgtgaagaatgtactgtgttcccctgcctgagcatcccctgcaagctgcagagcggcacccactgcctgtggacagaccagctgctgcagggcagcgagaagggcttccagagccgccacctggcctgcctgccccgggagcccggcctgtgcacctggcagagcctgcggagccagatcgcctag

SEQ ID NO: 6857 - DNA, 1686 bp, Artificial Sequence
  Description of Artificial Sequence: Synthetic coding sequence
atggctgaccacaacccagacagcgacagcacccccaggaccctgctgcggcgggtgctggacacagctgaccccaggaccccaagaagacccaggtctgcccgggccggggcccggcgggccctgctggagacagccagccccaggaagctgagcggccagaccaggaccatcgcccggggccgcagccacggggcccggtctgtgggccgcagcgcccacatccaggccagcggccacctggaggagcagacccccaggaccctgctgaagaacatcctgctgacagcccctgagagcagcatcctgatgcctgagagcgtggtgaagcctgtgcctgccccccaggccgtgcagcccagccggcaggagagcagctgtggcagcctggagctgcagctgcctgagctggagccccccaccaccctggcccctggcctgctggcccctggccgcaggaagcagaggctgcggctgagcgtcttccagcagggcgtggaccagggcctgagcctgagccaggagccccagggcaatgctgatgccagcagcctgaccaggagcctgaacctgacctttgccacccccctgcagccccagagcgtgcagaggcctggcctggcccggcggcccccagcccggcgggctgtggatgtgggcgccttcctgcgggacctgcgggacaccagcctggccccacccaacatcgtgctggaggacacccagcccttcagccagcccatggtgggcagccccaacgtgtaccacagcctgccctgcaccccccacactggagcagaagatgctgagcaggccgccggcaggaagacccagagcagcggccctggcctgcagaagaacagccctgggaagccagcccagttcctggccggggaggccgaggaggtgaatgcctttgccctgggcttcctgagcaccagcagtggagtgtctggagaagatgaggtggagcccctgcatgatggagtggaggaggccgagaagaagatggaggaggagggcgtgtctgtgtctgagatggaggccaccggggcccagggccccagccgggtggaggaggccgagggccacacagaggtgacagaggccgagggcagccagggcacagctgaggctgatggccctggggccagcagtggagatgaagatgccagcggccgggccgccagccctgagagcgccagcagcaccccagagagcctgcaggcccggcggcaccaccagttcctggagcccgccccagcccctggagctgctgtgctgagcagcgagcctgctgagcccctgctggtgcgccaccccccccggcccaggaccaccggcccccggccccggcaggacccccacaaggccggcctgagccactacgtgaagctgttctccttctacgccaagatgcccatggagaggaaggccctggagatggtggagaagtgcctggacaagtacttccagcacctgtgtgatgacctggaggtgtttgctgcccatgctggcaggaagacagtgaagccagaggacctggagctgctgatgaggcggcagggcctggtgacagaccaggtgtccctgcacgtgctggtggagcggcacctgcccctggagtaccggcagctgctgatcccctgtgcctacagcggcaacagcgtcttccctgcccagtag

SEQ ID NO: 6858 - DNA, 1134 bp, Artificial Sequence
  Description of Artificial Sequence: Synthetic coding sequence
atgacagatgatgagagcgagagcgtgctgagtgacagccatgagggcagcgagctggagctgcccgtcatccagctgtgtggcctggtggaggagctgtcctatgtgaacagcgccctgaagacagaaacagagatgtttgagaagtactatgccaagctggagccccgggaccagaggcctccccggctgtctgagatcaagatctctgctgctgactatgcccagttccggggcagaagaagaagcaagagcaggacaggcatggaccggggcgtgggcctgacagctgaccagaagctggagctggtgcagaaggaggtggccgacatgaaggatgacctgcggcacacccgggccaatgctgagcgggacctgcagcaccacgaggccatcatcgaggaggccgagatccgctggagcgaggtgtcccgggaggtgcatgaatttgagaaggacatcctgaaggccatcagcaagaagaagggcagcatcctggccacccagaaggtgatgaagtacatcgaggacatgaacagaagaagagacaacatgaaggagaagctgcggctgaagaatgtgtccctgaaggtgcagaggaagaagatgctgctgcagctgcggcagaaggaggaggtgtctgaggccctgcatgatgtggacttccagcagctgaagattgaaaatgcccagttcctggagaccatcgaggccaggaaccaggagctgacccagctgaagctgagcagcggcaacaccctgcaggtgctgaatgcctacaagagcaagctgcacaaggccatggagatctacctgaacctggacaaggagatcctgctgaggaaggagctgctggagaagattgagaaggagaccctgcaggtggaggaggaccgggccaaggccgaggccgtgaacaagaggctgaggaagcagctggccgagttccgggccccccaggtgatgacctacgtgcgggagaagatcctgaatgctgacctggagaagagcatccgcatgtgggagaggaaggtggagattgctgagatgagcctgaagggccacaggaaggcctggaacaggatgaagatcaccaatgagcagctgcaggccgactacctggccggcaagtag

SEQ ID NO: 6859 - DNA, 1548 bp, Artificial Sequence
  Description of Artificial Sequence: Synthetic coding sequence
atggaggcccgggagcccggccggcccacccccacctaccacctggtgcccaacaccagccagagccaggtggaggaggatgtgagcagccccccccagaggagcagcgagaccatgcagctgaagaaggagatcagcctgctgaatggagtgtccctggtggtgggcaacatgattggcagcggcatctttgtgagccccaagggcgtgctggtgcacacagccagctatggcatgagcctcatcgtgtgggccatcggcggcctcttctctgtggtgggcgccctgtgctacgccgagctgggcaccaccatcaccaagagcggggccagctatgcctacatcctggaggcctttggaggcttcatcgccttcatccggctgtgggtgtccctgctggtggtggagcccaccggccaggccatcatcgccatcacctttgccaactacatcatccagcccagcttccccagctgtgaccccccctacctggcctgccgcctgctggccgccgcctgcatctgcctgctgacctttgtgaactgtgcctacgtgaagtggggcaccagggtgcaggacaccttcacctacgccaaggtggtggccctgattgccatcatcgtgatgggcctggtgaagctgtgccagggccacagcgagcacttccaggatgcctttgagggcagctcctgggacatgggcaacctgagcctggccctgtacagcgccctcttctcctacagcggctgggacaccctgaactttgtgacagaggagatcaagaaccctgagaggaacctgcccctggccatcggcatctccatgcccatcgtgaccctcatctacatcctgaccaacgtggcctactacacagtgctgaacatcagtgatgtgctgagcagtgatgctgtggccgtgacctttgctgaccagaccttcggcatgttctcctggaccatccccatcgctgtggccctgagctgctttggaggcctgaatgccagcatctttgccagcagccgcctcttctttgtgggcagccgggagggccacctgcctgacctgctgtccatgatccacatcgagcgcttcacccccatcccagccctgctcttcaactgcaccatggccctgatctacctgattgtggaggatgtgttccagctgatcaactacttctccttctcctactggttctttgtgggcctgtctgtggtgggccagctgtacctgcgctggaaggagcccaagaggccccggcccctgaagctgtctgtgttcttccccatcgtgttctgcatctgcagcgtcttcctggtgattgtgcccctcttcacagacaccatcaacagcctgattggaattggaattgccctgagcggcgtgcccttctacttcatgggcgtgtacctgcctgagagcagaagacccctcttcatcagaaatgtgctggccgccatcacccggggcacccagcagctgtgcttctgtgtgctgacagagctggatgtggccgaggagaagaaggatgagaggaagacagactag

SEQ ID NO: 6860 - DNA, 1623 bp, Artificial Sequence
  Description of Artificial Sequence: Synthetic coding sequence
atgaatggagaggccatctgcagcgccctgcccaccatcccctaccacaagctggccgacctgcgctacctgagcagaggagccagcggcaccgtgagcagcgcccggcatgctgactggagggtgcaggtggccgtgaagcacctgcacatccacacccccctgctggacagcgagaggaaggatgtgctgcgggaggccgagatcctgcacaaggcccgcttctcctacatcctgcccatcctgggcatctgcaatgaacctgagttcctgggcatcgtgacagagtacatgcccaacggcagcctgaatgagctgctgcacaggaagacagagtacccagatgtggcctggcccctgcgcttccgcatcctgcacgagatcgccctgggcgtgaactacctgcacaacatgaccccacccctgctgcaccacgacctgaagacccagaacatcctgctggacaatgagttccacgtgaagattgctgactttggcctgagcaagtggaggatgatgagcctgagccagagccgcagcagcaagagcgcccctgagggcggcaccatcatctacatgcctcctgagaactatgagcccggccagaagagccgggccagcatcaagcatgacatctacagctatgctgtgatcacctgggaggtgctgagcaggaagcagccctttgaagatgtgaccaaccccctgcagatcatgtacagcgtgtcccagggccacaggcctgtgatcaatgaggagagcctgccctatgacatcccccaccgggccaggatgatcagcctgattgaaagtggctgggcccagaacccagatgagcggcccagcttcctgaagtgcctgattgagctggagcctgtgctgcggacctttgaggagatcaccttcctggaggccgtcatccagctgaagaagaccaagctgcagagcgtgtcctctgccatccacctgtgtgacaagaagaagatggagctgagcctgaacatccctgtgaaccacggcccccaggaggagagctgtggcagcagccagctgcatgaaaattctggcagccctgagaccagccgcagcctgcctgccccccaggacaatgacttcctgagcaggaaggcccaggactgctacttcatgaagctgcaccactgccccggcaaccacagctgggacagcaccatcagcggcagccagagagctgccttctgtgaccacaagaccaccccctgcagcagcgccatcatcaaccccctgagcacagctggcaacagcgagcggctgcagcccggcatcgcccagcagtggatccagagcaagagagaagatattgtgaaccagatgacagaggcctgcctgaaccagagcctggatgccctgctgagccgggacctgatcatgaaggaggactatgagctggtgtccaccaagcccaccaggaccagcaaggtgcggcagctgctggacaccacagacatccagggcgaggagtttgccaaggtgattgtgcagaagctgaaggacaacaagcagatgggcctgcagccctacccagagatcctggtggtgagccgcagccccagcctgaacctgctgcagaacaagtccatgtag

SEQ ID NO: 6861 - DNA, 2079 bp, Artificial Sequence
  Description of Artificial Sequence: Synthetic coding sequence
atgagggcctgtgccggcagcacccgggaggccggcagcggggcccaggacctgagcaccctgctgtgcctggaggagagcatggaggagcaggatgagaagcccccagagccccccaaggcctgtgcccaggacagcttcctgccccaggagatcatcatcaaggtggagggggaggacaccggcagcctgaccatccccagccaggagggcgtgaacttcaagatcgtgacagtggacttcacccgggaggagcagggcacctggaacccagcccagaggaccctggacagagatgtgatcctggagaaccaccgggacctggtgtcctgggacctggccacagctgtgggcaagaaggacagcaccagcaagcagaggatctttgatgaggagcccgccaatggagtgaagattgagcgcttcaccagagatgacccctggctgagcagctgtgaggaggtggatgactgcaaggaccagctggagaagcagcaggagaagcaggagatcctgctgcaggaggtggccttcacccagaggaaggctgtgatccacgagcgggtgtgcaagagtgatgaaacaggagagaagagcggcctgaacagcagcctcttcagcagccctgtgatccccatccggaaccacttccacaagcacgtgtcccatgccaagaagtggcacctgaatgctgctgtgaacagccaccagaagatcaatgaaaatgagaccctgtatgaaaataatgaatgtgggaagccaccccagagcatccacctgatccagttcaccaggacccagaccaaggacaagtgctacggcttcagtgaccgcatccagagcttctgccacggcacccccctgcacatccacgagaagatccatggaggcggcaagacctttgacttcaaggaatgtggccaggtgctgaaccccaagatcagccacaatgagcagcagaggatcccctttgaggagagccagtacaagtgcagcgagaccagccacagcagcagcctgacccagaacatgaggaacaacagcgaggagaagccctttgagtgcaaccagtgtgggaagagcttctcctggagcagccacctggtggcccaccagaggacccacactggagagaagccctatgagtgcagtgaatgtgggaagagcttcagccgcagcagccacctggtgagccaccagaggacccacactggagagaagccctaccgctgcaaccagtgtgggaagagcttcagccagagctatgtgctggtggtgcaccagaggacccacactggagagaagccctatgagtgcaaccagtgtgggaagagcttccggcagagctacaagctgattgcccaccagaggacccacactggagagaagccctatgagtgcaaccagtgtgggaagagcttcatccagagctacaagctgattgcccaccagaggatccacactggagagaagccctatgagtgcaaccagtgtgggaagagcttcagccagagctacaagctggtggcccaccagaggacccacactggagagaagccctttgagtgcaaccagtgtgggaagagcttctcctggagcagccagctggtggcccaccagaggacccacactggagagaagccctatgagtgcagtgaatgtgggaagagcttcaacagaagcagccacctggtgatgcaccagaggatccacactggagagaagccctatgagtgcaaccagtgtgggaagagcttcagccagagctatgtgctggtggtgcaccagaggacccacactggagagaagccctatgagtgcagccagtgtgggaagagcttccggcagagcagctgcctgacccagcaccagaggacccacactggagagaagccctttgagtgcaaccagtgtgggaagaccttcagcctgagcgcccggctgattgtgcaccagaggacccacactggagagaagcccttcacctgcatccagtgtgggaaggccttcatcaacagctacaagctgatccgccaccaggccacccacacagaggagaagctgtatgagtgcaactag

SEQ ID NO: 6862 - DNA, 942 bp, Artificial Sequence
  Description of Artificial Sequence: Synthetic coding sequence
atggacaacaagaagaggctggcctatgccatcatccagttcctgcatgaccagctgcggcatggaggcctgagcagtgatgcccaggagagcctggaggtggccatccagtgcctggagacagcctttggagtgacagtggaggacagcgacctggccctgccccagaccctgcctgagatctttgaggccgccgccaccgggaaggagatgccccaggacctgcggagccctgcccggaccccacccagcgaggaggacagcgctgaggccgagcggctgaagacagagggcaatgagcagatgaaggtggagaactttgaagctgctgtgcacttctacggcaaggccatcgagctgaacccagccaatgctgtgtacttctgcaacagagctgctgcctacagcaagctgggcaactatgctggagctgtgcaggactgtgagcgggccatctgcatcgaccctgcctacagcaaggcctacggccgcatgggcctggccctgagcagcctgaacaagcacgtggaggccgtggcctactacaagaaggccctggagctggaccctgacaatgagacctacaagagcaacctgaagattgctgagctgaagctgcgggaggcccccagccccactggaggagtgggcagctttgatattgctggcctgctgaacaaccctggcttcatgtccatggccagcaacctgatgaacaacccccagatccagcagctgatgagcggcatgatcagcggcggcaacaaccccctgggcaccccaggcaccagccccagccagaatgacctggccagcctcatccaggccggccagcagtttgcccagcagatgcagcagcagaaccctgagctgattgagcagctgcggagccagatccgcagcaggaccccatctgccagcaatgatgaccagcaggagtag

SEQ ID NO: 6863 - DNA, 1584 bp, Artificial Sequence
  Description of Artificial Sequence: Synthetic coding sequence
atgtaccagccagaagatgacaacaacagtgatgtgaccagtgatgatgacatgaccaggaacagaagagagagcagccccccccacagcgtgcacagcttcagcggggaccgggactgggaccggcggggccgcagccgggacatggagccccgggaccgctggagccacaccaggaaccccaggagcaggatgccaccccgggacctgagcctgcctgtggtggccaagaccagctttgagatggacagagaagatgaccgggacagccgggcctatgagagccgcagccaggatgctgagagctaccagaatgtggtggacctggccgaggacaggaagccccacaacaccatccaggacaacatggagaactacaggaagctgctgagcctgggcttcctggcccaggacagcgtgcctgctgagaagaggaacacagagatgctggacaacctgcccagcgctggcagccagttcccagacttcaagcacctgggcaccttcctggtgtttgaggagctggtgacctttgaagatgtgctggtggacttcagccctgaggagctgagcagcctgtctgctgcccagaggaacctgtaccgggaggtgatgctggagaactacagaaacctggtgtccctgggccaccagttcagcaagccagacatcatcagccggctggaggaggaggagagctatgccatggagacagacagccgccacacagtcatctgccagggcgagagccatgatgaccccctggagccccaccagggcaaccaggagaagctgctgacccccatcaccatgaatgaccccaagaccctgaccccagagaggagctatggcagtgatgaatttgagaggagcagcaacctgagcaagcagagcaaggaccccctgggcaaggacccccaggagggcacagcccctggcatctgcaccagcccccagagcgccagccaggagaacaagcacaacagatgtgagttctgcaagaggaccttcagcacccaggtggccctgcggagacatgagcgcatccacacaggcaagaagccctatgagtgcaagcagtgtgccgaggccttctacctgatgccccacctgaacagacaccagaagacccacagcggcaggaagaccagcggctgcaatgaaggaaggaagcccagcgtgcagtgtgccaacctgtgtgagcgggtgcgcatccacagccaggaggactactttgagtgcttccagtgtgggaaggccttcctgcagaatgtgcacctgctgcagcacctgaaggcccacgaggccgcccgggtgctgcccccaggcctgagccacagcaagacctacctgatccgctaccagaggaagcatgactatgtgggggagcgggcctgccagtgctgtgactgtggccgggtcttcagcagaaattcctacctgatccagcactaccgcacccacacccaggagcggccctaccagtgccagctgtgtgggaaatgttttggccggcccagctacctgacccagcactaccagctgcacagccaggagaagacagtggagtgtgaccactgctag

SEQ ID NO: 6864 - DNA, 444 bp, Artificial Sequence
  Description of Artificial Sequence: Synthetic coding sequence
atggccctgaagaggatccagaaggagctgacagacctgcagagggaccccccagcccagtgcagcgctggccctgtgggagatgacctcttccactggcaggccaccatcatgggccccaatgacagcccctaccagggcggcgtcttcttcctgaccatccacttccccacagactaccccttcaagccacccaaggtggccttcaccaccaagatctaccaccccaacatcaacagcaatggcagcatctgcctggacatcctgcggagccagtggagccctgccctgactgtgtccaaggtgctgctgagcatctgcagcctgctgtgtgaccccaacccagatgaccccctggtgcctgagatcgcccacacctacaaggctgaccgggagaagtacaaccggctggcccgggagtggacccagaagtatgccatgtag

SEQ ID NO: 6865 - DNA, 3072 bp, Artificial Sequence
  Description of Artificial Sequence: Synthetic coding sequence
atgttccacctgcggacctgtgccgccaagctgcggcccctgacagccagccagacagtgaagaccttcagccagaacagacctgctgctgcccggaccttccagcagatccgctgctacagcgcccctgtggccgctgagcccttcctgagcggcaccagcagcaactacgtggaggagatgtactgtgcctggctggagaaccccaagtctgtgcacaagtcctgggacatcttcttcaggaacaccaatgctggggcccctcctggaacagcctaccagagccccctgcccctgagccggggcagcctggccgctgtggcccacgcccagagcctggtggaggcccagcccaacgtggacaagctggtggaggaccacctggccgtgcagagcctcatccgggcctaccagatccggggccaccacgtggcccagctggaccccctgggcatcctggatgctgacctggacagctctgtgcctgctgacatcatcagcagcacagacaagctgggcttctacggcctggatgaaagtgacctggacaaggtgttccacctgcccaccaccaccttcatcggcggccaggagagcgccctgcccctgcgggagatcatccggcggctggagatggcctactgccagcacatcggcgtggagttcatgttcatcaatgacctggagcagtgccagtggatccggcagaagtttgagaccccaggcatcatgcagttcaccaatgaggagaagaggaccctgctggcccggctggtgcgcagcaccaggtttgaggagttcctgcagaggaagtggagcagcgagaagcgcttcggcctggagggctgtgaggtgctgatcccagccctgaagaccatcatcgacaagagcagtgaaaatggagtggactatgtgatcatgggcatgccccaccggggccgcctgaatgtgctggccaacgtcatcaggaaggagctggagcagatcttctgccagtttgacagcaagctggaggccgcagatgagggcagcggagatgtgaagtaccacctgggcatgtaccaccggcgcatcaacagagtgacagacaggaacatcaccctgagcctggtggccaaccccagccacctggaggccgctgaccctgtggtgatgggcaagaccaaggccgagcagttctactgtggggacacagagggcaagaaggtgatgagcatcctgctgcatggagatgctgcctttgctggccagggcatcgtgtatgagaccttccacctgagtgacctgcccagctacaccacccatggaacagtgcacgtggtggtgaacaaccagatcggcttcaccacagaccccaggatggcccggagcagcccctaccccacagatgtggcccgggtggtgaatgcccccatcttccacgtgaacagtgatgatcctgaggccgtgatgtatgtgtgcaaggtggccgctgagtggaggagcaccttccacaaggatgtggtggtggacctggtgtgctacagaagaaatggccacaatgagatggatgagcccatgttcacccagcccctgatgtacaagcagatcaggaagcagaagcctgtgctgcagaagtatgcagagctgctggtgtcccagggcgtggtgaaccagccagaatatgaggaggagatcagcaaatatgacaagatctgtgaggaggcctttgcccggagcaaggatgagaagatcctgcacatcaagcactggctggacagcccctggccaggcttcttcaccctggatggccagcccaggtccatgagctgccccagcacaggcctgacagaggacatcctgacccacatcggaaatgtggccagctctgtgcctgtggagaacttcaccatccacggcggcctgagccgcatcctgaagaccagaggagagatggtgaagaacagaacagtggactgggccctggccgagtacatggccttcggcagcctgctgaaggagggcatccacatccggctgagcggccaggatgtggagcggggcaccttcagccaccgccaccacgtgctgcatgaccagaatgtggacaagaggacctgcatccccatgaaccacctgtggcccaaccaggccccctacacagtgtgcaacagcagcctgtctgaatatggagtgctgggctttgagctgggctttgccatggccagccccaatgccctggtgctgtgggaggcccagtttggagacttccacaacacagcccagtgcatcatcgaccagttcatctgccccggccaggccaagtgggtgcggcagaatggaattgtgctgctgctgccccacggcatggagggcatgggccctgagcacagcagcgcccggcctgagcgcttcctgcagatgtgcaatgatgatcctgatgtgctgcctgacctgaaggaggccaactttgacatcaaccagctgtatgactgcaactgggtggtggtgaactgcagcaccccaggcaacttcttccacgtgctgcggcggcagatcctgctgcccttcaggaagcccctcatcatcttcacccccaagagcctgctgcggcaccctgaggcccggagcagctttgatgagatgctgcccggcacccacttccagagggtcatcccagaagatggccctgctgcccagaacccagaaaatgtgaagaggctgctcttctgcaccgggaaggtgtactatgacctgacccgggagaggaaggcccgggacatggtgggccaggtggccatcacccgcatcgagcagctgagccccttcccctttgacctgctgctgaaggaggtgcagaagtacccaaatgctgagctggcctggtgccaggaggagcacaagaaccagggctactatgactatgtgaagccccggctgcggaccaccatcagccgggccaagcctgtgtggtacgccggccgggaccctgctgctgccccagccaccggcaacaagaagacccacctgacagagctgcagaggctgctggacacagcctttgacctggatgtgttcaagaacttctcctag

SEQ ID NO: 6866 - DNA, 2667 bp, Artificial Sequence
  Description of Artificial Sequence: Synthetic coding sequence
atggagggagatgactgtgagttccgctatggagatggcaccaatgaggcccaggacaatgacttccccaccgtggagaggagccggctgcaggagatgctgagcctgctgggcctggagacctaccaggtgcagaagctgagcctgcaggacagcctgcagatcagctttgacagcatgaagaactgggccccccaggtgcccaaggacctgccctggaacttcctgaggaagctgcaggccctgaatgctgatgccaggaacaccaccatggtgctggatgtgctgcctgatgcccggcctgtggagaaggagagccagatggaggaggagatcatctactgggaccctgcagatgacctggccgctgacatctacagcttcagcgagctgcccaccccagacacccctgtgaaccccctggacctgctgtgtgccctgctgctgagcagtgacagcttcctgcagcaggagatcgccctgaagatggccctgtgccagtttgccctgcccctggtgctgcctgattctgagaaccactaccacaccttcctgctgtgggccatgaggggcatcgtgaggacctggtggagccagcccccccggggcatgggcagcttcagagaagattctgtggtgctgagccgggccccagcctttgcctttgtgaggatggatgtgagcagcaacagcaagagccagctgctgaatgctgtgctgagccctggccaccggcagtgggactgcttctggcaccgggacctgaacctgggcaccaatgcccgggagatcagtgatggcctggtggagatctcctggttcttccccagcggccgggaggacctggacatcttccctgagcctgtggccttcctgaacctgcggggggacatcggcagccactggctgcagttcaagctgctgacagagatcagcagcgctgtgttcatcctgacagacaacatcagcaagaaggagtacaagctgctgtacagcatgaaggagagcaccaccaagtactacttcatcctgagcccctaccggggcaagaggaacaccaacctgcgcttcctgaacaagctgatccctgtgctgaagattgaccacagccacgtgctggtgaaggtgagcagcacagacagcgacagctttgtgaagaggatccgggccatcgtgggcaatgtgctgcgggccccctgcagaagagtgtctgtggaggacatggcccatgctgccaggaagctgggcctgaaggtggatgaggactgtgaggagtgccagaaggccaaggacaggatggagcgcatcaccaggaagatcaaggacagtgatgcctacagaagagatgagctgcggctgcagggcgacccctggaggaaggccgcccaggtggagaaggagttctgccagctgcagtgggccgtggaccccccagagaagcacagagctgagctgcggcggcggctgctggagctgaggatgcagcagaatggacatgaccccagcagtggagtgcaggagttcatcagcggcatcagcagccccagcctgtctgagaagcagtacttcctgcgctggatggagtggggcctggcccgggtggcccagccccggctgcggcagcccccagagaccctgctgaccctgcggcccaagcatggaggcaccacagatgtgggggagcccctgtggccagagcccctgggcgtggagcacttcctgcgggagatgggccagttctatgaagctgagagctgcctggtggaggccggccgcctgcctgctggccagaggagatttgcccacttccctggcctggccagcgagctgctgctgaccggcctgcccctggagctgattgatggcagcaccctgtccatgcctgtgcgctgggtgacaggcctgctgaaggagctgcacgtgcggctggagaggaggagccggctggtggtgctgagcacagtgggcgtgcccggcaccgggaagagcaccctgctgaacaccatgtttggcctgcgctttgccaccgggaagagctgtggccccaggggggccttcatgcagctgatcaccgtggccgagggcttcagccaggacctgggctgtgaccacatcctggtgattgacagcggcggcctcatcggcggggccctgaccagcgctggggacagatttgagctggaggccagcctggccaccctgctgatgggcctgagcaatgtgaccgtcatcagcctggccgagaccaaggacatcccagctgccatcctgcacgccttcctgcggctggagaagacaggccacatgcccaactaccagtttgtgtaccagaacctgcatgatgtgtctgtgcccggcccccggccccgggacaagaggcagctgctggaccccccaggggacctgagcagagctgctgcccagatggagaagcagggagatggcttccgggccctggccggcctggccttctgtgaccctgagaagcagcacatctggcacatccctggcctgtggcacggggccccacccatggctgctgtgtccctggcctacagcgaggccatctttgagctgaagcgctgcctgctggagaacatcagaaatggcctgagcaaccagaacaagaacatccagcagctgattgagctggtgcggcggctgtag

SEQ ID NO: 6867 - DNA, 3744 bp, Artificial Sequence
  Description of Artificial Sequence: Synthetic coding sequence
atgatgagggagtgggtgctgctgatgtctgtgctgctgtgtggcctggccggccccacccacctgttccagcccagcctggtgctggacatggccaaggtgctgctggacaactactgcttccctgagaacctgctgggcatgcaggaggccatccagcaggccatcaagagccatgagatcctgagcatcagtgacccccagaccctggcctctgtgctgacagctggggtgcagagcagcctgaatgacccccggctggtgatctcctatgagcccagcaccccagagcccccaccccaggtgcctgccctgaccagcctgtctgaggaggagctgctggcctggctgcagaggggcctgcggcatgaggtgctggagggcaatgtgggctacctgcgggtggacagcgtgcccggccaggaggtgctgtccatgatgggagagttcctggtggcccacgtgtggggcaacctgatgggcaccagcgccctggtgctggacctgcggcactgcacaggaggccaggtgtctggcatcccctacatcatctcctacctgcaccctggcaacaccatcctgcacgtggacaccatctacaaccggcccagcaacaccaccacagagatctggaccctgccccaggtgctgggggagagatatggagctgacaaggatgtggtggtgctgaccagcagccagacccggggcgtggccgaggacatcgcccacatcctgaagcagatgaggcgggccatcgtggtgggggagaggactggaggaggagccctggacctgaggaagctgagaattggagagagtgacttcttcttcaccgtgcctgtgagccgcagcctgggccccctgggcggcggcagccagacctgggagggcagcggcgtgctgccctgtgtgggcaccccagctgagcaggccctggagaaggccctggccatcctgaccctgcggagcgccctgcccggggtggtgcactgcctgcaggaggtgctgaaggactactacaccctggtggacagagtgcccaccctgctgcagcacctggcctccatggacttcagcacagtggtgtctgaggaggacctggtgaccaagctgaatgccggcctgcaggccgccagcgaggacccccggctgctggtgcgggccatcggccccacagagacccccagctggccagccccagatgctgctgctgaggacagccctggggtggcccctgagctgcctgaagatgaggccatccggcaggccctggtggacagcgtcttccaggtgtctgtgctgcctggaaatgtgggctacctgcgctttgacagctttgctgatgcctctgtgctgggcgtgctggccccctacgtgctgcggcaggtgtgggagcccctgcaggacacagagcacctgatcatggacctgcggcacaaccctgggggccccagcagcgctgtgcccctgctgctgagctacttccagggccctgaggccggccctgtgcacctgttcaccacctatgacaggaggaccaacatcacccaggagcacttcagccacatggagctgcccggcccccgctacagcacccagaggggcgtgtacctgctgaccagccacaggacagccacagctgctgaggagtttgccttcctgatgcagagcctgggctgggccaccctggtgggggagatcacagctggcaacctgctgcacaccaggacagtgcccctgctggacaccccagagggcagcctggccctgactgtgcctgtgctgaccttcatcgacaaccacggggaggcctggctgggcggcggcgtggtgcctgatgccatcgtgctggccgaggaggccctggacaaggcccaggaggtgctggagttccaccagagcctgggcgccctggtggagggcaccggccacctgctggaggcccactacgcccggcctgaggtggtgggccagaccagcgccctgctgcgggccaagctggcccagggcgcctacagaacagctgtggacctggagagcctggccagccagctgacagctgacctgcaggaggtgtctggggaccaccggctgctggtgttccacagccctggagagctggtggtggaggaggcccctcctcctcctcctgctgtgcccagccctgaggagctgacctacctgattgaggccctcttcaagacagaggtgctgcccggccagctgggctacctgcgctttgatgccatggccgagctggagaccgtgaaggctgtgggcccccagctggtgcggctggtgtggcagcagctggtggacacagctgccctggtgattgacctgcgctacaaccctggcagctacagcacagccatccccctgctgtgcagctacttctttgaagctgagccccggcagcacctgtacagcgtgtttgaccgggccaccagcaaggtgacagaggtgtggaccctgccccaggtggccggccagagatatggcagccacaaggacctgtacatcctgatgagccacaccagcggcagcgctgctgaggcctttgcccacaccatgcaggacctgcagagggccaccgtcatcggggagcccacagctggaggagccctgtctgtgggcatctaccaggtgggcagcagccccctgtatgcctccatgcccacccagatggccatgtctgccaccaccgggaaggcctgggacctggccggcgtggagccagacatcaccgtgcccatgtctgaggccctgagcatcgcccaggacatcgtggccctgcgggccaaggtgcccaccgtgctgcagacagctgggaagctggtggccgacaactatgccagcgctgagctgggcgccaagatggccaccaagctgagcggcctgcagagccgctacagccgggtgaccagcgaggtggccctggccgagatcctgggcgctgacctgcagatgctgagcggggacccccacctgaaggccgcccacatcccagaaaatgccaaggaccgcatccctggcatcgtgcccatgcagatccccagccctgaggtgtttgaggagctgatcaagttctccttccacaccaacgtgctggaggacaacatcggctacctgcgctttgacatgtttggagatggagagctgctgacccaggtgtcccggctgctggtggagcacatctggaagaagatcatgcacacagatgccatgatcatcgacatgaggttcaacattggaggccccaccagcagcatccccatcctgtgcagctacttctttgatgagggcccccctgtgctgctggacaagatctacagcaggccagatgacagcgtgtctgagctgtggacccacgcccaggtggtgggggagagatatggcagcaagaagtccatggtgatcctgaccagctctgtgacagctggaacagctgaggagttcacctacatcatgaagaggctgggccgggccctggtgattggagaggtgaccagcggcggctgccagcccccccagacctaccacgtggatgacaccaacctgtacctgaccatccccacagcccggtctgtgggcgccagtgatggcagctcctgggagggcgtgggcgtgaccccccacgtggtggtgcctgctgaggaggccctggcccgggccaaggagatgctgcagcacaaccagctgcgggtgaagaggagccctggcctgcaggaccacctgtag

SEQ ID NO: 6868 - DNA, 885 bp, Artificial Sequence
  Description of Artificial Sequence: Synthetic coding sequence
atgaacagcgagctggactactatgagaagtttgaggaggtgcacggcatcctgatgtacaaggactttgtgaagtactgggacaacgtggaggccttccaggcccggccagatgacctggtgattgccacctaccccaagagcggcaccacctgggtgtctgagatcgtgtacatgatctacaaggagggagatgtggagaagtgcaaggaggatgtgatcttcaaccgcatccccttcctggagtgcaggaaggagaacctgatgaatggagtgaagcagctggatgagatgaacagccccagaattgtgaagacccacctgcccccagagctgctgcctgccagcttctgggagaaggactgcaagatcatctacctgtgcagaaatgccaaggatgtggccgtgtccttctactacttcttcctgatggtggccggccaccccaaccctggcagcttccctgagtttgtggagaagttcatgcagggccaggtgccctacggctcctggtacaagcacgtgaagtcctggtgggagaagggcaagagcccccgggtgctcttcctgttctatgaggacctgaaggaggacatcaggaaggaggtgatcaagctgatccacttcctggagaggaagcccagcgaggagctggtggaccgcatcatccaccacaccagcttccaggagatgaagaacaaccccagcaccaactacaccaccctgcctgatgagatcatgaaccagaagctgagccccttcatgaggaagggcatcaccggggactggaagaaccacttcaccgtggccctgaatgagaagtttgacaagcactatgagcagcagatgaaggagagcaccctgaagttcagaacagagatctag

SEQ ID NO: 6869 - DNA, 1446 bp, Artificial Sequence
  Description of Artificial Sequence: Synthetic coding sequence
atggcctacaatgacacagacaggaaccagacagagaagctgctgaagagggtgcgggagctggagcaggaggtgcagaggctgaagaaggagcaggccaagaacaaggaggacagcaacatcagagaaaattctgctggggccggcaagaccaagagggcctttgacttcagcgcccacggccgccgccacgtggccctgagaattgcctacatgggctggggctaccagggctttgccagccaggagaacaccaacaacaccatcgaggagaagctgtttgaggccctgaccaagacccggctggtggagagccggcagaccagcaactaccaccgctgtggccgcacagacaagggcgtgtctgccttcggccaggtgatcagcctggacctgcggagccagttcccccggggccgggacagcgaggacttcaacgtgaaggaggaggccaatgctgctgctgaggagatccgctacacccacatcctgaacagagtgctgcccccagacatccgcatcctggcctgggcccctgtggagcccagcttcagcgcccgcttcagctgcctggagaggacctaccgctacttcttccccagggctgacctggacatcgtgaccatggactatgctgcccagaagtatgtgggcacccatgacttcaggaacctgtgcaagatggatgtggccaacggggtcatcaacttccagaggaccatcctgagcgcccaggtgcagctggtgggccagagccctggagagggccgctggcaggagcccttccagctgtgccagtttgaggtgacaggccaggccttcctgtaccaccaggtgcgctgcatgatggccatcctcttcctgattggccagggcatggagaagccagagatcattgatgagctgctgaacatcgagaagaacccccagaagccccagtacagcatggctgtggagttccccctggtgctgtatgactgcaagtttgaaaatgtgaagtggatctatgaccaggaggcccaggagttcaacatcacccacctgcagcagctgtgggccaaccacgctgtgaagacccacatgctgtacagcatgctgcagggcctggacacagtgcctgtgccctgtggcatcggccccaagatggatggcatgacagagtggggcaatgtgaagcccagcgtcatcaagcagaccagcgcctttgtggagggcgtgaagatgaggacctacaagcccctgatggaccggcccaagtgccagggcctggagagccgcatccagcactttgtgcggcggggccgcatcgagcacccccacctgttccacgaggaggagaccaaggccaagagggactgcaatgacaccctggaggaggagaacaccaacctggagacccccaccaagagggtgtgtgtggacacagagatcaagagcatcatctag

SEQ ID NO: 6870 - DNA, 618 bp, Artificial Sequence
  Description of Artificial Sequence: Synthetic coding sequence
atgagcaacttcctgcacctgaagtacaatgagaagtctgtgtctgtgaccaaggccctgactgtgcgcttcctgaccaagcgcttcatcggggagtatgccagcaactttgagagcatctacaagaagcacctgtgcctggagaggaagcagctgaacctggagatctatgacccctgcagccagacccagaaggccaagttcagcctgaccagcgagctgcactgggcagatggcttcgtcatcgtgtatgacatcagtgacaggagcagctttgcctttgccaaggccctgatctaccgcatccgggagccccagaccagccactgcaagagagctgtggagagcgctgtgttcctggtgggcaacaagagggacctgtgccacgtgcgggaggtgggctgggaggagggccagaagctggccctggagaaccgctgccagttctgtgagctgtctgctgctgagcagagcctggaggtggagatgatgttcatccgcatcatcaaggacatcctgatcaacttcaagctgaaggagaagaggcggcccagcggcagcaagtccatggccaagctgatcaacaacgtgtttgggaagaggaggaagtctgtgtag

SEQ ID NO: 6871 - DNA, 1008 bp, Artificial Sequence
  Description of Artificial Sequence: Synthetic coding sequence
atgggcaaggtgaaggtgggcgtgaatggatttggccgcatcggccgcctggtgaccagggctgccttcaacagcggcaaggtggacatcgtggccatcaatgaccccttcatcgacctgaactacatggtgtacatgttccagtatgacagcacccacggcaagttccatggaacagtgaaggcagaaaatggcaagctggtgatcaatggaaaccccatcaccatcttccaggagcgggaccccagcaagatcaagtggggagatgctggagcagaatatgtggtggagagcactggagtcttcaccaccatggagaaggccggggcccacctgcagggcggggccaagagggtcatcatcagcgcccccagcgcagatgcccccatgtttgtgatgggcgtgaaccacgagaagtatgacaacagcctgaagatcatcagcaatgccagctgcaccaccaactgcctggcccccctggccaaggtgattcatgacaactttggcatcgtggagggcctgatgaccaccgtgcacgccatcacagccacccagaagacagtggatggccccagcggcaagctgtggagagatggccgcggggccctgcagaacatcatcccagccagcactggagctgccaaggctgtgggcaaggtgattcctgagctgaatggcaagctgaccggcatggccttccgggtgcccacagccaacgtgtctgtggtggacctgacctgccgcctggagaagccagccaagtatgatgacatcaagaaggtggtgaagcaggccagcgagggccccctgaagggcatcctgggctacacagagcaccaggtggtgtccagtgacttcaacagcgacacccacagcagcacctttgatgctggagctggcatcgccctgaatgaccactttgtgaagctgatctcctggtatgacaatgaatttggctacagcaacagagtggtggacctgatggcccacatggccagcaaggagtag

SEQ ID NO: 6872 - DNA, 597 bp, Artificial Sequence
  Description of Artificial Sequence: Synthetic coding sequence
atggacagcctgctgatgaacagaaggaagttcctgtaccagttcaagaatgtgcgctgggccaagggccggcgggagacctacctgtgctacgtggtgaagagaagagacagcgccaccagcttcagcctggactttggctacctgaggaacaagaatggctgccacgtggagctgctcttcctgcgctacatcagtgactgggacctggaccccggccgctgctacagagtgacctggttcacctcctggagcccctgctatgactgtgcccggcacgtggccgacttcctgcggggcaaccccaacctgagcctgcgcatcttcaccgcccggctgtacttctgtgaggacaggaaggccgagcctgagggcctgcggcggctgcaccgggccggcgtgcagatcgccatcatgaccttcaaggactacttctactgctggaacacctttgtggagaaccacgagaggaccttcaaggcctgggagggcctgcatgaaaattctgtgcggctgagccggcagctgcggcgcatcctgctgcccctgtatgaggtggatgacctgagagatgccttccgcaccctgggcctgtag

SEQ ID NO: 6873 - DNA, 5472 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgagaagtgcaatgccggcttcttccacaccctgagcggggagtgtgtgccctgtgactgcaatggaaacagcaatgaatgtctggatggcagcggctactgtgtgcactgccagaggaacaccaccggggagcactgtgagaagtgcctggatggctacatcggggacagcatccggggggccccccagttctgccagccctgcccctgccccctgccccacctggccaactttgctgagagctgctacaggaagaatggagctgtgcgctgcatctgcaatgaaaattatgccggccccaactgtgagcgctgtgcccctggctactacggcaaccccctgctgattggcagcacctgcaagaagtgtgactgcagcggcaacagcgaccccaacctgatctttgaggactgtgatgaggtgacaggccagtgcaggaactgcctgaggaacaccaccggcttcaagtgtgagcgctgtgcccctggctactatggagatgcccgcatcgccaagaactgtgctgtgtgcaactgtggcggcggcccctgtgacagcgtgactggagagtgcctggaggagggctttgagccccccaccggcatggactgccccaccatcagctgtgacaagtgtgtgtgggacctgacagatgccctgcggctggccgccctgagcattgaggagggcaagagcggcgtgctgtctgtgtcctctggagctgctgcccaccgccacgtgaatgagatcaatgccaccatctacctgctgaagaccaagctgtctgaaagagagaaccagtatgccctgaggaagatccagatcaacaatgctgagaacaccatgaagagcctgctgagtgatgtggaggagctggtggagaaggagaaccaggccagcaggaagggccagctggtgcagaaggagagcatggacaccatcaaccacgccagccagctggtggagcaggcccatgacatgagggacaagatccaggagatcaacaacaagatgctgtactatggagaggagcacgagctgagccccaaggagatcagcgagaagctggtgctggcccagaagatgctggaggagatccgcagccggcagcccttcttcacccagcgggagctggtggatgaggaggctgatgaggcctatgagctgctgagccaggccgagagctggcagaggctgcacaatgagaccaggaccctcttccctgtggtgctggagcagctggatgactacaatgccaagctgagtgacctgcaggaggccctggaccaggccctgaactacgtgagagatgctgaggacatgaacagagccacagctgcccggcagagggaccacgagaagcagcaggagcgggtgcgggagcagatggaggtggtgaacatgagcctgagcaccagcgctgacagcctgaccaccccccggctgaccctgtctgagctggatgacatcatcaagaatgccagcggcatctatgcagaaattgatggagccaagtctgagctgcaggtgaagctgagcaacctgagcaacctgagccatgacctggtgcaggaggccatcgaccacgcccaggacctgcagcaggaggccaatgagctgagcaggaagctgcacagcagtgacatgaatggcctggtgcagaaggccctggatgccagcaatgtgtatgagaacatcgtgaactacgtgtctgaggccaatgaaacagctgagtttgccctgaacaccacagaccgcatctatgatgctgtgtctggcatcgacacccagatcatctaccacaaggatgaaagtgagaacctgctgaaccaggcccgggagctgcaggccaaggccgagagcagcagtgatgaggccgtggccgacaccagccggcgggtgggcggggccctggccaggaagagcgccctgaagacccggctgagtgatgctgtgaagcagctgcaggccgctgagagaggagatgcccagcagaggctgggccagagccgcctcatcacagaggaggccaacagaaccaccatggaggtgcagcaggccacagcccccatggccaacaacctgaccaactggagccagaacctgcagcactttgacagcagcgcctacaacacagctgtgaacagcgccagagatgctgtgaggaacctgacagaggtggtgccccagctgctggaccagctgaggacagtggagcagaagaggcctgccagcaatgtgtctgccagcatccagaggatccgggagctgattgcccagaccaggtctgtggccagcaagatccaggtgtccatgatgtttgatggccagagcgctgtggaggtgcacagcaggacctccatggatgacctgaaggccttcaccagcctgagcctgtacatgaagccccctgtgaagaggcctgagctgacagaaacagctgaccagttcatcctgtacctgggcagcaagaatgccaagaaggagtacatgggcctggccatcaagaatgacaacctggtgtatgtgtacaacctgggcaccaaggatgtggagatccccctggacagcaagcctgtgtcctcctggccagcctacttcagcatcgtgaagattgaaagagtgggcaagcacggcaaggtgttcctgactgtgcccagcctgagcagcacagctgaggagaagttcatcaagaagggggagttctctggagatgacagcctgctggacctggaccctgaggacaccgtcttctacgtgggcggcgtgcccagcaacttcaagctgcccaccagcctgaacctgcccggctttgtgggctgcctggagctggccaccctgaacaatgatgtgatcagcctgtacaacttcaagcacatctacaacatggaccccagcacctctgtgccctgtgcccgggacaagctggccttcacccagagcagagctgccagctacttctttgatggcagcggctatgctgtggtgcgggacatcacccggcggggcaagtttggccaggtgaccaggtttgatattgaggtgaggaccccagctgacaatggcctcatcctgctgatggtgaatggctccatgttcttccggctggagatgagaaatggctacctgcacgtgttctatgactttggcttcagcggcggccctgtgcacctggaggacaccctgaagaaggcccagatcaatgatgccaagtaccacgagatcagcatcatctaccacaatgacaagaagatgatcctggtggtggacagaagacatgtgaagtccatggacaatgagaagatgaagatccccttcacagacatctacatcggcggggcccctcctgagatcctgcagagccgggccctgcgggcccacctgcccctggacatcaacttccggggctgcatgaagggcttccagttccagaagaaggacttcaacctgctggagcagacagagaccctgggcgtgggctacggctgcccagaggacagcctcatcagcagaagagcctacttcaacggccagagcttcatcgccagcatccagaagatctccttctttgatggctttgaaggaggcttcaacttccgcaccctgcagcccaacggcctgctcttctactatgccagcggcagtgatgtgttcagcatcagcctggacaatggcaccgtcatcatggatgtgaagggcatcaaggtgcagagcgtggacaagcagtacaatgatggcctgagccacttcgtcatcagctctgtgagccccaccaggtatgagctgattgtggacaagagccgggtgggcagcaagaaccccaccaagggcaagattgagcagacccaggccagcgagaagaagttctactttggaggcagccccatcagcgcccagtatgccaacttcaccggctgcatcagcaatgcctacttcaccagggtggacagagatgtggaggtggaggacttccagcgctacacagagaaggtgcacaccagcctgtatgaatgtcccatcgagagcagccccctcttcctgctgcacaagaagggcaagaacctgagcaagcccaaggccagccagaacaagaagggcggcaagagcaaggatgcccccagctgggaccctgtggccctgaagctgcctgagaggaacaccccaagaaacagccactgccacctgagcaacagcccccgggccatcgagcacgcctaccagtatggaggaacagccaacagccggcaggagtttgagcacctgaagggggactttggagccaagagccagttcagcatccggctgcggaccaggagcagccacggcatgatcttctacgtgtctgaccaggaggagaatgacttcatgaccctcttcctggcccacggccgcctggtgtacatgttcaacgtgggccacaagaagctgaagatccgcagccaggagaagtacaatgatggcctgtggcatgatgtgatcttcatccgggagaggagcagcggccgcctggtgattgatggcctgcgggtgctggaggagagcctgcccccaacagaggccacctggaagatcaagggccccatctacctgggcggcgtggcccctgggaaggctgtgaagaatgtgcagatcaacagcatctacagcttcagcggctgcctgagcaacctgcagctgaatggagccagcatcaccagcgccagccagaccttctctgtgaccccctgctttgagggccccatggagaccggcacctacttcagcacagaaggaggctacgtggtgctggatgagagcttcaacatcggcctgaagtttgagatcgcctttgaggtgcggcccaggagcagcagcggcaccctggtgcacggccacagcgtgaatggagagtacctgaatgtgcacatgaagaatggccaggtgattgtgaaggtgaacaacggcatccgggacttcagcacctctgtgacccccaagcagagcctgtgtgatggccgctggcaccgcatcaccgtcatccgggacagcaatgtggtgcagctggatgtggacagcgaggtgaaccacgtggtgggccccctgaaccccaagcccatcgaccaccgggagcctgtgtttgtgggcggcgtgcctgagagcctgctgaccccccggctggcccccagcaagcccttcaccggctgcatccgccactttgtgattgatggccaccctgtgtccttcagcaaggccgccctggtgtctggagctgtgtccatcaacagctgcccagctgcctag

SEQ ID NO: 6874 - DNA, 1434 bp, Artificial Sequence
  Description of Artificial Sequence: Synthetic coding sequence
atgaccagcaagttcctgctggtgtccttcatcctggccgccctgagcctgagcaccaccttcagcctgcagcctgaccagcagaaggtgctgctggtgtcctttgatggcttccgctgggactacctgtacaaggtgcccaccccccacttccactacatcatgaagtatggagtgcacgtgaagcaggtgaccaacgtgttcatcaccaagacctaccccaaccactacaccctggtgacaggcctgtttgctgagaaccacggcatcgtggccaatgacatgtttgaccccatccggaacaagagcttcagcctggaccacatgaacatctatgacagcaagttctgggaggaggccacccccatctggatcaccaaccagagagctggccacaccagcggggccgccatgtggccaggcacagatgtgaagatccacaagcgcttccccacccactacatgccctacaatgaatctgtgtcctttgaggacagagtggccaagatcatcgagtggttcaccagcaaggagcccatcaacctgggcctgctgtactgggaggaccctgatgacatgggccaccacctgggccctgacagccccctgatgggccctgtgatcagtgacatcgacaagaagctgggctacctgatccagatgctgaagaaggccaagctgtggaacaccctgaacctgatcatcaccagtgaccacggcatgacccagtgcagcgaggagcggctcatcgagctggaccagtacctggacaaggaccactacaccctgattgaccagagccctgtggccgccatcctgcccaaggagggcaagtttgatgaggtgtatgaggccctgacccacgcccaccccaacctgactgtgtacaagaaggaggatgtgcctgagcgctggcactacaagtacaacagccgcatccagcccatcatcgctgtggctgatgagggctggcacatcctgcagaacaagagtgatgacttcctgctgggcaaccacggctatgacaatgccctggccgacatgcaccccatcttcctggcccacggccctgccttcaggaagaacttcagcaaggaggccatgaacagcacagacctgtaccccctgctgtgccacctgctgaacatcacagccatgccccacaacggcagcttctggaatgtgcaggacctgctgaacagcgccatgccccgggtggtgccctacacccagagcaccatcctgctgcccggctctgtgaagccagcagaatatgaccaggagggcagctacccctacttcatcggcgtgtccctgggcagcatcatcgtgattgtgttcttcgtcatcttcatcaagcacctgatccacagccagatcccagccctgcaggacatgcacgccgagatcgcccagcccctgctgcaggcctag

SEQ ID NO: 6875 - DNA, 1254 bp, Artificial Sequence
  Description of Artificial Sequence: Synthetic coding sequence
atgagatttgcctggacagtgctgctgctgggccccctgcagctgtgtgccctggtgcactgtgcccctcctgctgctggccagcagcagcccccccgggagcccccagctgcccctggggcctggaggcagcagatccagtgggagaacaacggccaggtgttcagcctgctgagcctgggcagccagtaccagccccagaggagaagagaccccggggctgctgtgcctggagctgccaatgccagcgcccagcagcccaggacccccatcctgctgatccgggacaacagaacagctgctgcccggaccaggacagctggcagcagcggcgtgacagctggccggccccggcccacagcccggcactggttccaggccggctacagcaccagccgggcccgggaggccggggccagcagagctgagaaccagacagcccctggagaggtgcctgccctgagcaacctgcggccccccagccgggtggatggcatggtgggagatgacccctacaacccctacaagtacagtgatgacaacccctactacaactactatgacacctatgaaagacccaggcctgggggccgctacagacctggctatggaacaggctacttccagtatggcctgcctgacctggtggccgacccctactacatccaggccagcacctacgtgcagaagatgtccatgtacaacctgcgctgtgccgctgaggagaactgcctggccagcacagcctacagagcagatgtgcgggactatgaccaccgggtgctgctgcgcttcccccagagggtgaagaaccagggcaccagtgacttcctgcccagccggccccgctacagctgggagtggcacagctgccaccagcactaccacagcatggatgagttcagccactatgacctgctggatgccaacacccagaggagagtggccgagggccacaaggccagcttctgcctggaggacaccagctgtgactatggctaccacagaagatttgcctgcacagcccacacccagggcctgagccctggctgctatgacacctatggagctgacatcgactgccagtggattgacatcacagatgtgaagccaggcaactacatcctgaaggtgtctgtgaaccccagctacctggtgcctgagagtgactacaccaacaacgtggtgcgctgtgacatccgctacacaggccaccacgcctatgccagcggctgcaccatcagcccctactag

SEQ ID NO: 6876 - DNA, 879 bp, Artificial Sequence
  Description of Artificial Sequence: Synthetic coding sequence
atgggagagaagtctgagaactgtggggtgcctgaggacctgctgaatggcctgaaggtgacagacacccaggaggctgaatgtgccggcccccctgtgcctgaccccaagaaccagcacagccagagcaagctgctgagagatgatgaggcccacctgcaggaggaccagggcgaggaggagtgcttccatgactgcagcgccagctttgaggaggagcccggggctgacaaggtggagaacaagagcaatgaagatgtgaacagcagcgagctggatgaggagtacctgattgagctggagaagaacatgtctgatgaggagaagcagaagaggcgggaggagagcacccggctgaaggaggagggcaatgagcagttcaagaagggggactacattgaagctgagagcagctacagccgggccctggagatgtgccccagctgcttccagaaggagaggagcatcctcttcagcaacagagctgctgccaggatgaagcaggacaagaaggagatggccatcaatgactgcagcaaggccatccagctgaaccccagctacatccgggccatcctgcggcgggcagagctgtatgagaagacagacaagctggatgaggccctggaggactacaagagcatcctggagaaggaccccagcatccaccaggcccgggaggcctgcatgaggctgcccaagcagatcgaggagagaaatgaaaggctgaaggaggagatgctgggcaagctgaaggacctgggcaacctggtgctgcggcccttcggcctgagcacagagaacttccagatcaagcaggacagcagcacaggcagctacagcatcaactttgtgcagaaccccaacaacaacagatag

SEQ ID NO: 6877 - DNA, 2316 bp, Artificial Sequence
  Description of Artificial Sequence: Synthetic coding sequence
atgagcggcttcttcaccagcctggaccccaggagagtgcagtggggcgccgcctggtacgccatgcacagccgcatcctgcggaccaagcctgtggagagcatgctggagggcaccggcaccaccacagcccacggcaccaagctggcccaggtgctgaccaccgtggacctgatcagcctgggcgtgggcagctgtgtgggcaccggcatgtatgtggtgtctggcctggtggccaaggagatggccggccctggggtcatcgtgtccttcatcatcgctgctgtggccagcatcctgtctggagtgtgctacgccgagtttggagtgcgggtgcccaagaccaccggcagcgcctacacctacagctatgtgacagtgggggagtttgtggccttcttcatcggctggaacctgatcctggagtacctgattggaacagctgctggggccagcgccctgagctccatgtttgacagcctggccaaccacaccatcagccgctggatggctgacagcgtgggcaccctgaatggcctgggcaagggggaggagagctacccagacctgctggccctgctgattgctgtgattgtgaccatcatcgtggccctgggcgtgaagaacagcatcggcttcaacaacgtgctgaatgtgctgaacctggccgtgtgggtgttcatcatgattgctggcctcttcttcatcaatggcaagtactgggccgagggccagttcctgccccacggctggagcggcgtgctgcagggcgccgccacctgcttctacgccttcatcggctttgacatcatcgccaccaccggggaggaggccaagaaccccaacaccagcatcccctatgccatcacagccagcctggtgatctgcctgacagcctacgtgtctgtgtctgtcatcctgaccctgatggtgccctactacaccatcgacacagagagccccctgatggagatgtttgtggcccacggcttctatgctgccaagtttgtggtggccatcggctctgtggccggcctgactgtgtccctgctgggcagcctcttccccatgcccagggtcatctatgccatggctggagatggcctgctcttccgcttcctggcccacgtgtcctcctacacagagacccctgtggtggcctgcatcgtgtctggcttcctggccgccctgctggccctgctggtgtccctgcgggacctgattgagatgatgagcatcggcaccctgctggcctacaccctggtgtctgtgtgtgtgctgctgctgcgctaccagcctgagagtgacattgatggctttgtgaagttcctgtctgaggagcacaccaagaagaaggagggcatcctggccgactgtgagaaggaggcctgcagccctgtgtctgaaggagatgagttcagcggccctgccaccaacacctgtggggccaagaacctgcccagcctgggggacaatgagatgctgattggcaagagtgacaagagcacctacaacgtgaaccaccccaactatggaacagtggacatgaccaccggcatcgaggctgatgaaagtgagaacatctacctgatcaagctgaagaagctgattggcccccactactacaccatgaggatccggctgggcctgcccgggaagatggaccggcccacagctgccaccggccacacagtgaccatctgtgtgctgctgctcttcatcctgatgttcatcttctgcagcttcatcatctttggaagtgactacatcagcgagcagagctggtgggccatcctgctggtggtgctgatggtgctgctgatcagcaccctggtgtttgtgatcctgcagcagcctgagaaccccaagaagctgccctacatggccccctgcctgccctttgtgcctgcctttgccatgctggtgaacatctacctgatgctgaagctgagcaccatcacctggatccgctttgctgtgtggtgctttgtgggcctgctgatctacttcggctacggcatctggaacagcaccctggagatcagcgcccgggaggaggccctgcaccagagcacctaccagagatatgatgtggatgaccccttctctgtggaggagggcttctcctatgccacagaaggagagagccaggaggactggggcggccccacagaagataaaggcttctactaccagcagatgtctgatgccaaggccaacggccgcaccagcagcaaggccaagagcaagagcaagcacaagcagaacagcgaggccctgattgccaatgatgagctggactacagccctgagtag

SEQ ID NO: 6878 - DNA, 513 bp, Artificial Sequence
  Description of Artificial Sequence: Synthetic coding sequence
atgggaaatgaggccagctaccccctggagatgtgcagccactttgatgctgatgagatcaagaggctgggcaagcgcttcaagaagctggacctggacaacagcggcagcctgtctgtggaggagttcatgagcctgcctgagctgcagcagaaccccctggtgcagagggtgattgacatctttgacacagatggaaatggagaggtggacttcaaggagttcatcgagggcgtgtcccagttctctgtgaagggggacaaggagcagaagctgcgctttgccttccgcatctatgacatggacaaggatggctacatcagcaatggagagctgttccaggtgctgaagatgatggtgggcaacaacctgaaggacacccagctgcagcagatcgtggacaagaccatcatcaatgctgacaaggatggagatggccgcatcagctttgaggagttctgtgctgtggtgggcggcctggacatccacaagaagatggtggtggatgtgtag

SEQ ID NO: 6879 - DNA, 1218 bp, Artificial Sequence
  Description of Artificial Sequence: Synthetic coding sequence
atgagcagctctgtgaagaccccagccctggaggagctggtgcccggcagcgaggagaagcccaagggccgcagccccctgtcctggggcagcctgtttggccacaggtctgagaagatcgtgtttgccaagagtgatggcggcacagatgaaaatgtgctgactgtgaccatcacagagaccaccgtcatcgagagtgacctgggcgtgtggagcagccgggccctgctgtacctgaccctgtggttcttcttctccttctgcaccctcttcctgaacaagtacatcctgagcctgctgggcggggagcccagcatgctgggcgctgtgcagatgctgagcaccaccgtcatcggctgtgtgaagaccctggtgccctgctgcctgtaccagcacaaggcccggctgagctacccacccaacttcctgatgaccatgctgtttgtgggcctgatgagatttgccaccgtggtgctgggcctggtgtccctgaagaatgtggccgtgtcctttgctgagaccgtgaagagcagcgcccccatcttcaccgtcatcatgagcaggatgatcctgggggagtacacaggcctgctggtgaacctgagcctcatccctgtgatgggcggcctggccctgtgcacagccacagagatctccttcaacgtgctgggcttctctgctgccctgagcaccaacatcatggactgcctgcagaatgtgttcagcaagaagctgctgagcggggacaagtaccgcttcagcgcccctgagctgcagttctacaccagcgctgctgctgtggccatgctggtgcctgcccgggtcttcttcacagatgtgcctgtgattggccgcagcggcaagagcttctcctacaaccaggatgtggtgctgctgctgctgacagatggagtgctcttccacctgcagagcgtgacagcctatgccctgatgggcaagatcagccctgtgaccttctctgtggccagcacagtgaagcacgccctgagcatctggctgtctgtgattgtgtttggaaacaagatcaccagcctgtctgctgtgggcacagccctggtgacagtgggcgtgctgctgtacaacaaggcccggcagcaccagcaggaggccctgcagagcctggccgccgccaccggccgggccccagatgacacagtggagcccctgctgccccaggacccccggcagcacccctag

SEQ ID NO: 6880 - DNA, 1131 bp, Artificial Sequence
  Description of Artificial Sequence: Synthetic coding sequence
atgctgaagaagatctctgtgggcgtggccggggacctgaacacagtgaccatgaagctgggctgtgtgctgatggcctgggccctgtacctgagcctgggcgtgctgtgggtggcccagatgctgctggccgccagctttgagaccctgcagtgtgagggccctgtgtgcacagaggagagcagctgccacacagaagatgacctgacagatgcccgggaggccggcttccaggtgaaggcctacaccttcagcgagcccttccacctgattgtgtcctatgactggctgatcctgcagggccctgccaagcctgtgtttgaaggagacctgctggtgctgcgctgccaggcctggcaggactggcccctgacccaggtgaccttctacagagatggcagcgccctgggccccccaggccccaaccgggagttcagcatcaccgtggtgcagaaggctgacagcggccactaccactgcagcggcatcttccagagccctggccctggcatccctgagacagcctctgtggtggccatcaccgtgcaggagctgtttcctgcccccatcctgcgggctgtgcccagcgctgagccccaggccggcagccccatgaccctgagctgccagaccaagctgcccctgcagaggtctgctgcccggctgctcttctccttctacaaggatggccgcatcgtgcagagccggggcctgagcagcgagttccagatccccacagccagcgaggaccacagcggcagctactggtgtgaggccgccacagaggacaaccaggtgtggaagcagagcccccagctggagatccgggtgcagggcgccagcagcagcgctgccccacccaccctgaacccagccccccagaagtctgctgcccctggaacagcccctgaggaggcccctggccccctgcccccaccacccacccccagcagtgaagatcctggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 6881 - DNA, 1572 bp, Artificial Sequence
  Description of Artificial Sequence: Synthetic coding sequence
atggccaggaaggccctgaagctggcctcctggacctccatggccctggccgccagcggcatctacttctacagcaacaagtacctggaccccaatgactttggagctgtgcgggtgggccgggctgtggccaccacagctgtgatctcctatgactacctgaccagcctgaagtctgtgccctacggcagcgaggagtacctgcagctgcggagcaaggtgcacctgcggagcgcccggcggctgtgtgagctgtgctgtgccaacagaggcaccttcatcaaggtgggccagcacctgggcgccctggactacctgctgcctgaggagtacaccagcaccctgaaggtgctgcacagccaggccccccagagctccatgcaggagatccggcaggtgatccgggaggacctgggcaaggagatccatgacctcttccagagctttgatgacacccccctgggcacagccagcctggcccaggtgcacaaggctgtgctgcatgatggccgcacagtggccgtgaaggtgcagcaccccaaggtgcgggcccagagcagcaaggacatcctgctgatggaggtgctggtgctggccgtgaagcagctgtttcctgagtttgagttcatgtggctggtggatgaggccaagaagaacctgcccctggagctggacttcctgaatgaaggaagaaatgctgagaaggtgtcccagatgctgcggcactttgacttcctgaaggtgccccgcatccactgggacctgagcacagagcgggtgctgctgatggagtttgtggatggcggccaggtgaatgaccgggactacatggagaggaacaagattgatgtgaatgagatcagccgccacctgggcaagatgtacagcgagatgatctttgtgaatggatttgtgcactgtgacccccaccctggaaatgtgctggtgaggaagcaccctggcaccgggaaggccgagatcgtgctgctggaccacggcctgtaccagatgctgacagaggagttccggctgaactactgccacctgtggcagagcctcatctggacagacatgaagagggtgaaggagtacagccagaggctgggcgctggggacctgtaccccctgtttgcctgcatgctgacagcccgctcctgggacagcgtgaacagaggcatcagccaggcccctgtgacagccacagaggacctggagatcagaaataatgctgccaactacctgccccagatcagccacctgctgaaccacgtgccccggcagatgctgctgatcctgaagaccaatgacctgctgcggggcattgaagctgccctgggcacccgggccagcgccagcagcttcctgaacatgagccgctgctgcatccgggccctggccgagcacaagaagaagaacacctgcagcttcttccggaggacccagatctccttcagcgaggccttcaacctgtggcagatcaacctgcacgagctgatcctgcgggtgaagggcctgaagctggccgacagagtgctggccctgatctgctggctgtttcctgcccccctgtag

SEQ ID NO: 6882 - DNA, 1197 bp, Artificial Sequence
  Description of Artificial Sequence: Synthetic coding sequence
atgtggctgctgctgaccatggccagcctcatctctgtgctgggcaccacccacggcctgtttgggaagctgcaccctggcagccctgaggtgaccatgaacatcagccagatgatcacctactggggctacccaaatgaggagtatgaggtggtgacagaagatggctacatcctggaggtgaaccgcatcccctacggcaagaagaacagcggcaacacaggccagaggcctgtggtgttcctgcagcacggcctgctggccagcgccaccaactggatcagcaacctgcccaacaacagcctggccttcatcctggctgatgctggctatgatgtgtggctgggcaacagccggggcaacacctgggcccggaggaacctgtactacagcccagacagcgtggagttctgggccttctcctttgatgagatggccaagtatgacctgcctgccaccatcgacttcatcgtgaagaagacaggccagaagcagctgcactacgtgggccacagccagggcaccaccatcggcttcatcgccttcagcaccaaccccagcctggccaagaggatcaagaccttctacgccctggcccctgtggccaccgtgaagtacaccaagagcctcatcaacaagctgcgctttgtgccccagagcctcttcaagttcatctttggagacaagatcttctacccccacaacttctttgaccagttcctggccacagaggtgtgcagccgggagatgctgaacctgctgtgcagcaatgccctcttcatcatctgtggctttgacagcaagaacttcaacaccagccggctggatgtgtacctgagccacaacccagctggcacctctgtgcagaacatgttccactggacccaggccgtgaagagcggcaagttccaggcctatgactggggcagccctgtgcagaacaggatgcactatgaccagagccagcccccctactacaacgtgacagccatgaatgtgcccatcgctgtgtggaatggaggcaaggacctgctggccgacccccaggatgtgggcctgctgctgcccaagctgcccaacctgatctaccacaaggagatccccttctacaaccacctggacttcatctgggccatggatgccccccaggaggtgtacaatgacatcgtgtccatgatcagcgaggacaagaagtag

SEQ ID NO: 6883 - DNA, 555 bp, Artificial Sequence
  Description of Artificial Sequence: Synthetic coding sequence
atgaggggccagggcaggaaggagagcctgagtgacagccgggacctggatggcagctatgaccagctgacagacagcgtggatgatgaatttgagctgagcacagtgtgccacaggcctgagggcctggagcagctgcaggagcagaccaagttcaccaggaaggagctgcaggtgctgtaccggggcttcaagaatgaatgtcccagcggcatcgtgaatgaggagaacttcaagcagatctacagccagttcttcccccagggcgacagcagcacctacgccaccttcctgttcaatgcctttgacaccaaccatgatggctctgtgtcctttgaggagatgctggacatcatgaagagcatctatgacatgatgggcaagtacacctacccagccctgcgggaggaggccccccgggagcacgtggagagcttcttccagaagatggacaggaacaaggatggagtggtgaccatcgaggagttcatcgagagctgccagaaggtgcagctgcctgccctgtacatcaccctgacctggacccaggcctag

SEQ ID NO: 6884 - DNA, 3900 bp, Artificial Sequence
  Description of Artificial Sequence: Synthetic coding sequence
atgagcctgcaggagatgttccgcttccccatgggcctgctgctgggctctgtgctgctggtggccagcgccccagccaccctggagcccccaggctgcagcaacaaggagcagcaggtgacagtgagccacacctacaagattgatgtgcccaagagcgccctggtgcaggtggatgctgacccccagcccctgagtgatgatggagccagcctgctggccctgggggaggcccgggaggagcagaacatcatcttccgccacaacatccggctgcagaccccccagaaggactgtgagctggccggctctgtgcaggacctgctggcccgggtgaagaagctggaggaggagatggtggagatgaaggagcagtgcagcgcccagcgctgctgccagggcgtgacagacctgagccgccactgcagcggccacggcaccttcagcctggagacctgcagctgccactgtgaggagggccgggagggccctgcctgtgagcggctggcctgccctggggcctgcagcggccacggccgctgtgtggatggccgctgcctgtgccacgagccctacgtgggcgctgactgtggctacccagcctgcccagagaactgcagcggccatggagaatgtgtgcggggcgtgtgccagtgccacgaggacttcatgtctgaggactgcagcgagaagcgctgccctggggactgcagcggccacggcttctgtgacacaggagagtgctactgtgaggagggcttcaccggcctggactgtgcccaggtggtgaccccccagggcctgcagctgctgaagaacacagaggacagcctgctggtgtcctgggagcccagcagccaggtggaccactacctgctgagctactaccccctgggcaaggagctgagcggcaagcagatccaggtgcccaaggagcagcacagctatgagatcctgggcctgctgcccggcaccaagtacatcgtgaccctgagaaatgtgaagaatgaggtgagcagcagcccccagcacctgctggccaccacagacctggccgtgctgggcacagcctgggtgacagatgaaacagagaacagcctggatgtggagtgggagaaccccagcacagaggtggactactacaagctgcgctatggccccatgacaggccaggaggtggccgaggtgacagtgcccaagagcagtgaccccaagagccgctatgacatcaccggcctgcaccctggaacagagtacaagatcaccgtggtgcccatgagaggagagctggagggcaagcccatcctgctgaatggccgcacagaaattgacagccccaccaacgtggtgacagacagagtgacagaggacacagccaccgtgtcctgggaccctgtgcaggccgtcatcgacaagtatgtggtgcgctacaccagcgcagatggagacaccaaggagatggctgtgcacaaggatgagagcagcacagtgctgaccggcctgaagccaggagaggcctacaaggtgtatgtgtgggccgagcggggcaaccagggcagcaagaaggctgacaccaatgccctgacagaaattgacagccctgccaacctggtgacagacagagtgacagagaacacagccaccatctcctgggaccctgtgcaggccaccatcgacaagtatgtggtgcgctacaccagcgcagatgaccaggagacccgggaggtgctggtgggcaaggagcagagcagcacagtgctgaccggcctgcggcctggggtggagtacacagtgcacgtgtgggcccagaagggggaccgggagagcaagaaggctgacaccaatgcccccacagacatcgacagccccaagaacctggtgacagacagagtgacagagaacatggccaccgtgtcctgggaccctgtgcaggccgccatcgacaagtatgtggtgcgctacaccagcgctggaggagagacccgggaggtgcctgtgggcaaggagcagagcagcacagtgctgaccggcctgcggcccggcatggagtacatggtgcacgtgtgggcccagaagggggaccaggagagcaagaaggctgacaccaaggcccagacagacatcgacagcccccagaacctggtgacagacagagtgacagagaacatggccaccgtgtcctgggaccctgtgcgggccaccatcgaccgctacgtggtgcgctacaccagcgccaaggatggagagacccgggaggtgcctgtgggcaaggagcagagcagcacagtgctgaccggcctgcggcctggggtggagtacacagtgcacgtgtgggcccagaagggggcccaggagagcaagaaggctgacaccaaggcccagacagacatcgacagcccccagaacctggtgacagactgggtgacagagaacacagccaccgtgtcctgggaccctgtgcaggccaccatcgacagatatgtggtgcactacaccagcgccaatggagagacccgggaggtgcctgtgggcaaggagcagagcagcacagtgctgaccggcctgcggcccggcatggagtacacagtgcacgtgtgggcccagaagggcaaccaggagagcaagaaggctgacaccaaggcccagacagaaattgatggccccaagaacctggtgacagactgggtgacagagaacatggccaccgtgtcctgggaccctgtgcaggccaccatcgacaagtacatggtgcgctacaccagcgcagatggagagacccgggaggtgcctgtgggcaaggagcacagcagcacagtgctgaccggcctgcggcccggcatggagtacatggtgcacgtgtgggcccagaagggggcccaggagagcaagaaggctgacaccaaggcccagacagagctggaccccccaagaaacctgcggcccagcgctgtgacccagagcggcggcatcctgacctggaccccaccttctgcccagatccacggctacatcctgacctaccagttcccagatggcaccgtgaaggagatgcagctgggccgggaggaccagagatttgccctgcagggcctggagcagggcgccacctaccctgtgtccctggtggccttcaagggcggccgccgcagcagaaatgtgtccaccaccctgagcacagtgggcgcccgcttcccccaccccagcgactgcagccaggtgcagcagaacagcaatgctgccagcggcctgtacaccatctacctgcatggagatgccagccggcccctgcaggtgtactgtgacatggagacagatggcggcggctggatcgtgttccagaggaggaacacaggccagctggacttcttcaagcgctggaggagctatgtggagggctttggagaccccatgaaggagttctggctgggcctggacaagctgcacaacctgaccaccggcaccccagcccgctatgaggtgcgggtggacctgcagacagccaatgaaagtgcctatgccatctatgacttcttccaggtggccagcagcaaggagcgctacaagctgactgtgggcaagtaccggggcacagctggagatgccctgacctaccacaacggctggaagttcaccacctttgaccgggacaatgacatcgccctgagcaactgtgccctgacccaccacggcggctggtggtacaagaactgccacctggccaaccccaacggccgctacggggagaccaagcacagcgagggcgtgaactgggagccctggaagggccacgagttcagcatcccctacgtggagctgaagatccggccccacggctacagccgggagcctgtgctgggcaggaagaagaggaccctgcggggccgcctgcggaccttctag

SEQ ID NO: 6885 - DNA, 1662 bp, Artificial Sequence
  Description of Artificial Sequence: Synthetic coding sequence
atgacccggggcggccctgggggccggcccggcctgccccagcccccacccctgctgctgctgctgctgctgctgcccctgctgctggtgacagctgagccccccaagccagctggggtgtactatgccacagcctactggatgcctgctgagaagacagtgcaggtgaagaatgtgatggacaagaatggagatgcctacggcttctacaacaacagcgtgaagaccaccggctggggcatcctggagatccgggccggctacggcagccagaccctgagcaatgagatcatcatgtttgtggccggcttcctggagggctacctgacagccccccacatgaatgaccactacaccaacctgtacccccagctgatcaccaagcccagcatcatggacaaggtgcaggacttcatggagaagcaggacaagtggaccaggaagaacatcaaggagtacaagacagacagcttctggaggcacacaggctacgtgatggcccagattgatggcctgtatgtgggcgccaagaagagggccatcctggagggcaccaagcccatgaccctcttccagatccagttcctgaacagcgtgggggacctgctggacctgatccccagcctgagccccaccaagaatggcagcctgaaggtgttcaagcgctgggacatgggccactgcagcgccctgatcaaggtgctgcccggctttgagaacatcctgtttgcccacagctcctggtacacctacgccgccatgctgcgcatctacaagcactgggacttcaacgtcatcgacaaggacaccagcagcagccggctgtccttcagcagctacccaggcttcctggagagcctggatgacttctacatcctgagcagcggcctcatcctgctgcagaccaccaacagcgtcttcaacaagaccctgctgaagcaggtgattcctgagaccctgctgtcctggcagagggtgcgggtggccaacatgatggctgacagcggcaagcgctgggccgacatcttcagcaagtacaacagcggcacctacaacaaccagtacatggtgctggacctgaagaaggtgaagctgaaccacagcctggacaagggcaccctgtacatcgtggagcagatccccacctacgtggagtacagcgagcagacagatgtgctgaggaagggctactggcccagctacaacgtgcccttccacgagaagatctacaactggagcggctaccccctgctggtgcagaagctgggcctggactacagctatgacctggccccccgggccaagatcttccggcgggaccagggcaaggtgacagacacagcctccatgaagtacatcatgagatacaacaactacaagaaggacccctacagcagaggagacccctgcaacaccatctgctgccgggaggacctgaacagccccaaccccagccctgggggctgctatgacaccaaggtggccgacatctacctggccagccagtacaccagctatgccatcagcggccccaccgtgcagggcggcctgcccgtcttccgctgggaccgcttcaacaagaccctgcaccagggcatgcctgaggtgtacaactttgacttcatcaccatgaagcccatcctgaagctggacatcaagtag

SEQ ID NO: 6886 - DNA, 2271 bp, Artificial Sequence
  Description of Artificial Sequence: Synthetic coding sequence
atgagccggcccggcacagccaccccagccctggccctggtgctgctggccgtgaccctggccggcgtgggcgcccagggcgccgccctggaggaccctgactactacggccaggagatctggagccgggagccctactatgcccggcctgagcctgagctggagaccttcagcccccccctgcctgctggccctggagaggagtgggagcggcggccccaggagccccggccccccaagagggccaccaagcccaagaaggcccccaagcgggagaagagcgcccctgagcccccacctcctgggaagcacagcaacaagaaggtgatgaggaccaagagcagcgagaaggccgccaatgatgaccacagcgtgcgggtggcccgggaggatgtgcgggagagctgcccccccctgggcctggagaccctgaagatcacagacttccagctgcacgccagcacagtgaagagatatggcctgggcgcccaccggggccgcctgaacatccaggccggcatcaatgaaaatgacttctatgatggagcctggtgtgccggcagaaatgacctgcagcagtggattgaggtggatgcccggcggctgacccgcttcaccggggtcatcacccagggcaggaacagcctgtggctgagtgactgggtgaccagctacaaggtgatggtgtccaatgacagccacacctgggtgacagtgaagaatggaagtggggacatgatctttgagggcaacagcgagaaggagatccctgtgctgaatgagctgcctgtgcccatggtggcccgctacatccgcatcaacccccagagctggtttgacaatggcagcatctgcatgaggatggagatcctgggctgccccctgcctgaccccaacaactactaccacagaagaaatgagatgaccaccacagatgacctggacttcaagcaccacaactacaaggagatgaggcagctgatgaaggtggtgaatgagatgtgccccaacatcacccgcatctacaacatcggcaagagccaccagggcctgaagctgtatgctgtggagatcagtgaccaccctggagaacatgaggtgggggagcctgagttccactacatcgccggggcccatggaaatgaggtgctgggccgggagctgctgctgctgctggtgcagtttgtgtgccaggagtacctggccagaaatgccagaattgtgcacctggtggaggagacccgcatccacgtgctgcccagcctgaacccagatggctatgagaaggcctatgaaggaggcagcgagctgggcggctggagcctgggccgctggacccatgatggcatcgacatcaacaacaacttcccagacctgaacaccctgctgtgggaggctgaagatcggcagaatgtgcccaggaaggtgcccaaccactacatcgccatccctgagtggttcctgtctgaaaatgccaccgtggccgctgagacccgggccgtcatcgcctggatggagaagatcccctttgtgctgggcggcaacctgcagggcggggagctggtggtggcctacccctatgacctggtgcgcagcccctggaagacccaggagcacacccccaccccagatgaccacgtgttccgctggctggcctacagctatgccagcacccaccggctgatgacagatgccaggagaagagtgtgccacacagaggacttccagaaggaggagggcaccgtgaatggagcctcctggcacacagtggccggcagcctgaatgacttctcctacctgcacaccaactgctttgagctgagcatctacgtgggctgtgacaagtacccccatgagagccagctgcctgaggagtgggagaacaaccgggagagcctcatcgtgttcatggagcaggtgcaccggggcatcaagggcctggtgcgggacagccacggcaagggcatccccaatgccatcatctctgtggagggcatcaaccacgacatcagaacagccaatgatggagactactggaggctgctgaaccctggagaatatgtggtgacagccaaggccgagggcttcaccgccagcaccaagaactgcatggtgggctatgacatgggcgccacccgctgtgacttcaccctgagcaagaccaacatggcccgcatccgggagatcatggagaagtttgggaagcagcctgtgtccctgcctgcccggcggctgaagctgcggggccagaagaggcggcagaggggctag

SEQ ID NO: 6887 - DNA, 702 bp, Artificial Sequence
  Description of Artificial Sequence: Synthetic coding sequence
atggccaccccacccttccgcctcatcaggaagatgttctccttcaaggtgagccgctggatgggcctggcctgcttccgcagcctggccgccagcagccccagcatccggcagaagaagctgatgcacaagctgcaggaggagaaggccttccgggaggagatgaagatcttccgggagaagattgaggacttccgggaggagatgtggaccttccggggcaagatccacgccttccggggccagatcctgggcttctgggaggaggagcggcccttctgggaggaggagaagaccttctggaaggaggagaagagcttctgggagatggagaagagcttccgggaggaggagaagaccttctggaagaagtaccgcaccttctggaaggaggacaaggccttctggaaggaggacaatgccctgtgggagcgggacaggaacctgctgcaggaggacaaggccctgtgggaggaggagaaggccctgtgggtggaggagcgggccctgctggagggggagaaggccctgtgggaggacaagaccagcctgtgggaggaggagaatgccctgtgggaggaggagcgggccttctggatggagaacaacggccacatcgccggggagcagatgctggaggatggcccccacaatgccaacagaggccagaggctgctggccttcagccggggccgggcctag

SEQ ID NO: 6888 - DNA, 696 bp, Artificial Sequence
  Description of Artificial Sequence: Synthetic coding sequence
atgatgctgagctgcctcttcctgctgaaggccctgctggccctgggcagcctggagagctggatcacagctggggagcacgccaaggagggggagtgccccccccacaagaacccctgcaaggagctgtgccagggagatgagctgtgcccagctgagcagaagtgctgcaccaccggctgcggccgcatctgccgggacatccccaagggcaggaagagggactgccccagggtcatcaggaagcagagctgcctgaagcgctgcatcacagatgagacctgccctggggtgaagaagtgctgcaccctgggctgcaacaagagctgtgtggtgcccatcagcaagcagaagctggccgagtttggaggagaatgtcctgctgaccccctgccctgtgaggagctgtgtgatggagatgccagctgcccccagggccacaagtgctgcagcacaggctgcggccgcacctgcctgggggacatcgagggcggccggggcggggactgccccaaggtgctggtgggcctgtgcatcgtgggctgtgtgatggatgagaactgccaggccggggagaagtgctgcaagagcggctgcggccgcttctgtgtgccccctgtgctgccccccaagctgaccatgaaccccaactggacagtgcggagtgacagcgagctggagatccctgtgccctag

SEQ ID NO: 6889 - DNA, 1050 bp, Artificial Sequence
  Description of Artificial Sequence: Synthetic coding sequence
atgggccccatcagcgcccccagctgccgctggaggatcccctggcagggcctgctgctgacagccagcctcttcaccttctggaacccccccaccacagcccagctgaccatcgaggccgtgcccagcaatgctgctgagggcaaggaggtgctgctgctggtgcacaacctgccccaggacccccggggctacaactggtacaagggggagaccgtggatgccaacagacgcatcatcggctacgtgatcagcaaccagcagatcaccccaggccctgcctacagcaaccgggagaccatctacccaaatgccagcctgctgatgagaaatgtgaccagaaatgacaccggcagctacaccctgcaggtgatcaagctgaacctgatgtctgaggaggtgacaggccagttctctgtgcaccctgagacccccaagcccagcatcagcagcaacaacagcaaccctgtggaggacaaggatgctgtggccttcacctgtgagcctgagacccagaacaccacctacctgtggtgggtgaatggccagagcctgcctgtgagcccccggctgcagctgagcaatggaaacagaaccctgaccctgctgtctgtgaccagaaatgatgtgggcccctatgaatgtgagatccagaacccagccagcgccaacttcagtgaccctgtgaccctgaatgtgctgtatggcccagatgcccccaccatcagccccagcgacacctactaccacgccggcgtgaacctgaacctgagctgccacgccgccagcaacccccccagccagtacagctggagcgtgaatggcaccttccagcagtacacccagaagctgttcatccccaacatcaccaccaagaacagcggcagctatgcctgccacaccaccaacagcgccaccggcaggaacagaaccaccgtgaggatgatcaccgtgtctgatgccctggtgcagggcagcagccctggcctgagcgcccgggccaccgtgtccatcatgattggagtgctggcccgggtggccctgatctag

SEQ ID NO: 6890 - DNA, 510 bp, Artificial Sequence
  Description of Artificial Sequence: Synthetic coding sequence
atgacagctggaagaaggatggagatgctgtgtgccggccgggtgcctgccctgctgctgtgcctgggcttccacctgctgcaggccgtgctgagcaccaccgtcatccccagctgcatccctggagagagcagtgacaactgcacagccctggtgcagacagaggacaacccccgggtggcccaggtgtccatcaccaagtgcagcagtgacatgaatggctactgcctgcacggccagtgcatctacctggtggacatgagccagaactactgccgctgtgaggtgggctacacaggagtgcgctgtgagcacttcttcctgactgtgcaccagcccctgagcaaggagtatgtggccctgaccgtcatcctgatcatcctcttcctgatcaccgtggtgggcagcacctactacttctgccgctggtacagaaacaggaagagcaaggagcccaagaaggagtatgaaagagtgaccagcggggaccctgagctgccccaggtgtag

SEQ ID NO: 6891 - DNA, 273 bp, Artificial Sequence
  Description of Artificial Sequence: Synthetic coding sequence
atgaagctgtctgtgtgcctgctgctggtgaccctggccctgtgctgctaccaggccaatgctgagttctgcccagccctggtgtctgagctgctggacttcttcttcatcagcgagcccctcttcaagctgagcctggccaagtttgatgcccctcctgaggccgtggccgccaagctgggcgtgaagcgctgcacagaccagatgagcctgcagaagaggagcctgattgctgaggtgctggtgaagatcctgaagaagtgcagcgtgtag

SEQ ID NO: 6892 - DNA, 429 bp, Artificial Sequence
  Description of Artificial Sequence: Synthetic coding sequence
atgccccgctgccgctggctgagcctcatcctgctgaccatccccctggccctggtggccaggaaggaccccaagaagaatgaaacaggagtgctgaggaagctgaagcctgtgaatgccagcaatgccaacgtgaagcagtgcctgtggtttgccatgcaggagtacaacaaggagagcgaggacaagtatgtgttcctggtggtgaagaccctgcaggcccagctgcaggtgaccaacctgctggagtacctgattgatgtggagatcgcccggagtgactgcaggaagcccctgagcaccaatgagatctgtgccatccaggagaacagcaagctgaagaggaagctgagctgcagcttcctggtgggcgccctgccctggaatggagagttcaccgtgatggagaagaagtgtgaagatgcctag

SEQ ID NO: 6893 - DNA, 438 bp, Artificial Sequence
  Description of Artificial Sequence: Synthetic coding sequence
atgggcatcggctgctggaggaaccccctgctgctgctgattgccctggtgctgagcgccaagctgggccacttccagcgctgggagggcttccagcagaagctgatgagcaagaagaacatgaacagcaccctgaacttcttcatccagagctacaacaatgccagcaatgacacctacctgtacagagtgcagaggctcatccgcagccagatgcagctgaccaccggggtggagtacatcgtgacagtgaagattggctggaccaagtgcaagagaaatgacaccagcaacagcagctgccccctgcagagcaagaagctgaggaagagcctcatctgtgagagcctcatctacaccatgccctggatcaactacttccagctgtggaacaacagctgcctggaggccgagcacgtgggcaggaacctgaggtag

SEQ ID NO: 6894 - DNA, 552 bp, Artificial Sequence
  Description of Artificial Sequence: Synthetic coding sequence
atgaagctgctcttccccatctttgccagcctgatgctgcagtaccaggtgaacacagagttcatcggcctgcggcgctgcctgatgggcctgggccgctgccgggaccactgcaatgtggatgagaaggagatccagaagtgcaagatgaagaagtgctgcgtgggccccaaggtggtgaagctgatcaagaactacctgcagtatggcaccccaaatgtgctgaatgaagatgtgcaggagatgctgaagccagccaagaacagcagcgctgtgatccagaggaagcacatcctgtctgtgctgccccagatcaagagcaccagcttctttgccaacaccaacttcgtcatcatccccaatgccacccccatgaacagcgccaccatcagcaccatgaccccaggccagatcacctacacagccaccagcaccaagagcaacaccaaggagagccgggacagcgccacagccagccccccaccagcccctcctccacccaacatcctgcccacccccagcctggagctggaggaggccgaggagcagtag

SEQ ID NO: 6895 - DNA, 609 bp, Artificial Sequence
  Description of Artificial Sequence: Synthetic coding sequence
atgaggggccaccccagcctgctgctgctgtacatggccctgaccacctgcctggacaccagccccagcgaggagacagaccaggaggtgttcctgggccccccagaggcccagagcttcctgagcagccacacccgcatcccccgggccaaccactgggacctggagctgctgaccccaggcaacctggagcgggagtgcctggaggagcgctgctcctgggaggaggcccgggagtactttgaggacaacaccctgacagagcgcttctgggagagctacatctacaatggaaaaggaggccggggccgggtggatgtggccagcctggccgtgggcctgactggaggcatcctgctgattgtgctggccggcctgggcgccttctggtacctgcgctggaggcagcaccggggccagcagccctgcccccaggaggccggcctcatcagccccctgagccccctgaaccccctgggcccccccacccccctgcccccacctcctcctcctcctcctggcctgcccacctatgagcaggccctggccgccagcggcgtgcatgatgcccctcctccaccctacaccagcctgcggcggccccactag

SEQ ID NO: 6896 - DNA, 558 bp, Artificial Sequence
  Description of Artificial Sequence: Synthetic coding sequence
atgaggctgctgatcctgacctgcctggtggccgtggccctggcccggcccaagctgcccctgcgctacccagagcggctgcagaaccccagcgagagcagcgagcccatccccctggagagccgggaggagtacatgaatggcatgaaccggcagaggaacatcctgcgggagaagcagacagatgagatcaaggacaccagaaatgaaagcacccagaactgtgtggtggccgagcctgagaagatggagagcagcatcagcagcagcagcgaggagatgagcctgagcaaatgtgccgagcagttctgccgcctgaatgagtacaaccagctgcagctgcaggccgcccacgcccaggagcagatccggaggatgaatgaaaacagccacgtgcaggtgcccttccagcagctgaaccagctggccgcctacccctatgctgtgtggtactacccccagatcatgcagtatgtgcccttcccccccttcagtgacatcagcaaccccacagcccacgagaactatgagaagaacaacgtgatgctgcagtggtag

SEQ ID NO: 6897 - DNA, 1410 bp, Artificial Sequence
  Description of Artificial Sequence: Synthetic coding sequence
atgatcacagaaggagcccaggccccccggctgctgctgccccccctgctgctgctgctgaccctgcctgccactggaagtgaccctgtgctgtgcttcacccagtatgaggagagcagcggcaagtgcaagggcctgctgggcggcggcgtgtctgtggaggactgctgcctgaacacagcctttgcctaccagaagaggtctgggggcctgtgccagccctgccgcagcccccgctggagcctgtggagcacctgggccccctgcagcgtgacctgcagcgagggcagccagctgcgctaccgccgctgtgtgggctggaatggccagtgcagcggcaaggtggcccctggcaccctggagtggcagctgcaggcctgtgaggaccagcagtgctgcccagagatgggcggctggagcggctggggcccctgggagccctgcagcgtgacctgcagcaagggcaccaggacccggcggcgggcctgcaaccacccagcccccaagtgtggcggccactgccccggccaggcccaggagagcgaggcctgtgacacccagcaggtgtgccccacccatggagcctgggccacctggggcccctggaccccctgcagcgccagctgccacggcggcccccatgagcccaaggagaccaggagcaggaaatgttctgcccctgagcccagccagaagcccccaggcaagccctgccccggcctggcctatgagcagaggcgctgcaccggcctgcccccctgccctgtggccggcggctggggcccctggggccctgtgagcccctgccctgtgacctgtggcctgggccagaccatggagcagaggacctgcaaccaccctgtgccccagcacggcggccccttctgtgctggagatgccaccaggacccacatctgcaacacagctgtgccctgccctgtggatggagagtgggacagctggggcgagtggagcccctgcatcagaagaaacatgaagagcatcagctgccaggagatccctggccagcagagccggggccgcacctgccggggcaggaagtttgatggccaccgctgtgccggccagcagcaggacatccgccactgctacagcatccagcactgccccctgaagggctcctggagcgagtggagcacctggggcctgtgcatgccaccctgtggccccaaccccacccgggcccggcagaggctgtgcacccccctgctgcccaagtacccacccaccgtgtccatggtggagggccagggcgagaagaatgtgaccttctggggccggcccctgccccgctgtgaggagctgcagggccagaagctggtggtggaggagaagaggccctgcctgcacgtgcctgcctgcaaggaccctgaggaggaggagctgtag

SEQ ID NO: 6898 - DNA, 453 bp, Artificial Sequence
  Description of Artificial Sequence: Synthetic coding sequence
atgctgattgccaccagcttcttcctgttcttcagctctgtggtggccgcccccacccacagcagcttctggcagttccagaggagagtgaagcacatcaccggccgcagcgccttcttctcctactacggctacggctgctactgcggcctgggggacaagggcatccctgtggatgacacagacagccccagcagccccagcccctatgagaagctgaaggagttcagctgccagcctgtgctgaacagctaccagttccacatcgtgaatggagctgtggtgtgtggctgcaccctgggccctggggccagctgccactgccgcctgaaggcctgtgaatgtgacaagcagagcgtgcactgcttcaaggagagcctgcccacctatgagaagaacttcaagcagttcagcagccagccccgctgtggccgccacaagccctggtgctag

SEQ ID NO: 6899 - DNA, 1347 bp, Artificial Sequence
  Description of Artificial Sequence: Synthetic coding sequence
atgagggagtgcatctctgtgcacgtgggccaggccggcgtgcagatgggaaatgcctgctgggagctgtactgcctggagcacggcatccagccagatggccagatgcccagcgacaagaccatcggcggcggagatgacagcttcaccaccttcttctgtgagaccggggccggcaagcacgtgcccagggctgtgtttgtggacctggagcccaccgtgattgatgagatcagaaatggcccctaccggcagctgttccaccctgagcagctgatcaccgggaaggaggatgctgccaacaactatgcccggggccactacaccatcggcaaggagatcattgatcctgtgctggaccgcatcaggaagctgagtgaccagtgcaccggcctgcagggcttcctggtgttccacagctttggaggcggcactggaagtggcttcaccagcctgctgatggagcggctgtctgtggactatggcaagaagagcaagctggagttcagcatctacccagccccccaggtgtccacagctgtggtggagccctacaacagcatcctgaccacccacaccaccctggagcacagcgactgtgccttcatggtggacaatgaggccatctatgacatctgcagaagaaacctggacatcgagcggcccacctacaccaacctgaacagactcatcagccagatcgtgagcagcatcacagccagcctgcgctttgatggagccctgaatgtggacctgacagagttccagaccaacctggtgccctacccccgcatccacttccccctggccacctacgcccctgtgatctctgctgagaaggcctaccacgagcagctgtctgtggccgagatcaccaatgcctgctttgagcccgccaaccagatggtgaagtgtgaccccaggcatggcaagtacatggcctgctgcctgctgtacagaggagatgtggtgcccaaggatgtgaatgctgccatcgccgccatcaagaccaagaggagcatccagtttgtggactggtgccccaccggcttcaaggtgggcatcaactaccagcccccaacagtggtgcctggaggagacctggccaaggtgcagagagctgtgtgcatgctgagcaacaccacagccatcgccgaggcctgggcccggctggaccacaagtttgacctgatgtatgccaagagggcctttgtgcactggtacgtgggggagggcatggaggagggggagttcagcgaggcccgggaggacatggccgccctggagaaggactatgaggaggtgggcatcgacagctatgaagatgaagatgaaggagaggagtag

SEQ ID NO: 6900 - DNA, 942 bp, Artificial Sequence
  Description of Artificial Sequence: Synthetic coding sequence
atgagggtggtgaccatcgtcatcctgctgtgcttctgcaaggctgctgagctgaggaaggccagccctggctctgtgcgcagccgggtgaaccacggccgggccggcggcggcagaagaggcagcaaccctgtgaagagatatgcccctggcctgccctgtgatgtgtacacctacctgcacgagaagtacctggactgccaggagaggaagctggtgtatgtgctgcccggctggccccaggacctgctgcacatgctgctggccaggaacaagatccgcaccctgaagaacaacatgttcagcaagttcaagaagctgaagagcctggacctgcagcagaatgagatcagcaagattgagagcgaggccttcttcggcctgaacaagctgaccaccctgctgctgcagcacaaccagatcaaggtgctgacagaggaggtgttcatctacacccccctgctgagctacctgcggctgtatgacaacccctggcactgcacctgtgaaattgagaccctcatctccatgctgcagatccccaggaacagaaacctgggcaactatgccaagtgtgagagcccccaggagcagaagaacaagaagctgcggcagatcaagtctgagcagctgtgcaatgaggaggagaaggagcagctggaccccaagccccaggtgtctggccggccccctgtgatcaagccagaggtggacagcaccttctgccacaactacgtgttccccatccagaccctggactgcaagaggaaggagctgaagaaggtgcccaacaacatccccccagacatcgtgaagctggacctgagctacaacaagatcaaccagctgcggcccaaggagtttgaagatgtgcatgagctgaagaagctgaacctgagcagcaatggcatcgagttcattgatcctggcagcctgaggtag

SEQ ID NO: 6901 - DNA, 972 bp, Artificial Sequence
  Description of Artificial Sequence: Synthetic coding sequence
atgcaggccgcctggctgctgggcgccctggtggtgccccagctgctgggcttcggccacggggcccggggagctgagcgggagtgggagggcggctggggcggggcccaggaggaggagcgggagcgggaggccctgatgctgaagcacctgcaggaggccctgggcctgcctgctggaagaggagatgagaacccagctggcaccgtggagggcaaggaggactgggagatggaggaggaccagggcgaggaggaggaggaggaggccacccccacccccagcagcggccccagccccagccccaccccagaagatattgtgacctacatcctgggccgcctggccggcctggatgctggcctgcaccagctgcacgtgcggctgcacgccctggacaccagggtggtggagctgacccagggcctgcggcagctgagaaatgctgctggggacaccagagatgctgtgcaggccctgcaggaggcccagggccgggcagagcgggagcacggccgcctggagggctgcctgaagggcctgcggctgggccacaagtgcttcctgctgagccgggactttgaggcccaggccgccgcccaggcccgctgcacagcccggggcggcagcctggcccagcctgctgaccggcagcagatggaggccctgacccgctacctgcgggccgccctggccccctacaactggcctgtgtggctgggcgtgcatgacagaagagctgagggcctgtacctgtttgaaaatggccagagggtgtccttctttgcctggcacaggagccccaggcctgagctgggcgcccagcccagcgccagcccccaccccctgagcccagaccagcccaatggaggcaccctggagaactgtgtggcccaggccagtgatgatggctcctggtgggaccatgactgccagaggcggctgtactacgtgtgtgagttccccttctag

SEQ ID NO: 6902 - DNA, 1086 bp, Artificial Sequence
  Description of Artificial Sequence: Synthetic coding sequence
atgaatggcctgagcctgtctgagctgtgctgcctcttctgctgccccccctgccccggcagaattgctgccaagctggccttcctgcccccagaggccacctacagcctggtgcctgagcctgagcccggccctggaggagctggggccgcccccctgggcaccctgcgggccagcagcggggcccctggccgctggaagctgcacctgacagaaagagctgacttccagtacagccagcgggagctggacaccatcgaggtgttccccaccaagagcgcccggggcaacagagtgtcctgcatgtatgtgcgctgtgtgcctggggcccggcagggccaccaggcccagggcggccacccccagctggcctgggtgggccgcctgggggacagcaacaacccagcccctgggggctgcctgctgggcaagtcctggggcaccggggccgccctggcctgtggctacatccacctgctggcccgctacacagtgctcttcagccatggaaatgctgtggacctgggccagatgagcagcttctacatcggcctgggcagccggctgcactgcaacatcttctcctatgactacagcggctatggagccagcagcggccggcccagcgagaggaacctgtatgctgacattgatgctgcctggcaggccctgcggaccaggtatggcatcagcccagacagcatcatcctgtatggccagagcatcggcaccgtgcccaccgtggacctggccagccgctatgaatgtgccgctgtggtgctgcacagccccctgaccagcggcatgagggtggccttcccagacaccaagaagacctactgctttgatgccttccccaacatcgagaaggtgtccaagatcaccagccctgtgctgatcatccacggcacagaagatgaggtgattgacttcagccacggcctggccctgtatgagcgctgccccaaggctgtggagcccctgtgggtggagggcgccggccacaatgacatcgagctgtacagccagtacctggagcggctgcggcgcttcatcagccaggagctgcccagccagagggcctag

SEQ ID NO: 6903 - DNA, 1404 bp, Artificial Sequence
  Description of Artificial Sequence: Synthetic coding sequence
atgaggacagcccccagcctgcggcgctgtgtgtgcctgctgctggccgccatcctggacctggcccggggctacctgactgtgaacatcgagcccctgccccctgtggtggccggagatgctgtgaccctgaagtgcaacttcaagacagatggccgcatgagagaaattgtgtggtacagagtgacagatggcggcaccatcaagcagaagatcttcacctttgatgccatgttcagcaccaactacagccacatggagaactacaggaagcgggaggacctggtgtaccagagcacagtgcggctgcctgaggtgcgcatcagtgacaatggcccctatgaatgtcatgtgggcatctatgaccgggccacccgggagaaggtggtgctggccagcggcaacatcttcctgaatgtgatggccccacccaccagcattgaggtggtggccgctgacaccccagcccccttcagccgctaccaggcccagaacttcaccctggtgtgcatcgtgtctgggggcaagccagcccccatggtgtacttcaagagagatggagagcccattgatgctgtgcccctgtctgagcccccagctgccagcagcggccccctgcaggacagccggcccttccgcagcctgctgcaccgggacctggatgacaccaagatgcagaagagcctgagcctgctggatgctgaaaatagaggaggccggccctacacagagcggcccagccggggcctgaccccagaccccaacatcctgctgcagcccaccacagagaacatccctgagaccgtggtgtcccgggagttcccccgctgggtgcacagcgctgagcccacctacttcctgcggcacagcaggacccccagcagtgatggcaccgtggaggtgcgggccctgctgacctggaccctgaacccccagattgacaatgaggccctcttcagctgtgaggtgaagcacccagccctgtccatgcccatgcaggccgaggtgaccctggtggcccccaagggccccaagatcgtgatgacccccagccgggcccgggtgggggacacagtgcgcatcctggtgcacggcttccagaatgaggtgtttcctgagcccatgttcacctggaccagggtgggcagccggctgctggatggcagcgctgagtttgatggcaaggagctggtgctggagcgggtgcctgctgagctgaatggctccatgtaccgctgcacagcccagaaccccctgggcagcacagacacccacacccggctgattgtgtttgagaaccccaacatcccccggggcacagaggacagcaatggcagcatcggccccaccggggcccggctgaccctggtgctggccctgaccgtcatcctggagctgacctag

SEQ ID NO: 6904 - DNA, 783 bp, Artificial Sequence
  Description of Artificial Sequence: Synthetic coding sequence
atggcccggcccggcatggagcgctggagggaccggctggccctggtgactggagccagcggcggcattggagctgctgtggcccgggccctggtgcagcagggcctgaaggtggtgggctgtgccaggacagtgggcaacatcgaggagctggccgctgagtgcaagtctgctggctacccaggcaccctcatcccctaccgctgtgacctgagcaatgaggaggacatcctgtccatgttcagcgccatccgcagccagcacagcggcgtggacatctgcatcaacaatgccggcctggcccggccagacaccctgctgagcggcagcaccagcggctggaaggacatgtttaatgtgaatgtgctggccctgagcatctgcacccgggaggcctaccagagcatgaaggagagaaatgtggatgatggccacatcatcaacatcaacagcatgagcggccaccgggtgctgcccctgtctgtgacccacttctacagcgccaccaagtatgctgtgacagccctgacagagggcctgcggcaggagctgcgggaggcccagacccacatccgggccacctgcatcagccctggggtggtggagacccagtttgccttcaagctgcatgacaaggaccctgagaaggccgccgccacctatgagcagatgaagtgcctgaagccagaagatgtggccgaggccgtcatctacgtgctgagcaccccagcccacatccagatcggggacatccagatgaggcccacagagcaggtgacctag

SEQ ID NO: 6905 - DNA, 1218 bp, Artificial Sequence
  Description of Artificial Sequence: Synthetic coding sequence
atgagcagccctgccctgacagctggggccagcggcaaggtgatggacttcaacaacggcacctacctggtgtccttcaccctcttctgggagggccaggtgtccctgagcctgctgctgatccaccccagcgagggcgccagcgccctgtggagggccaggaaccagggctatgacaagatcatcttcaagggcaagtttgtgaatggcaccagccacgtgttcacagaatgtggcctgaccctgaacagcaatgctgagctgtgtgagtacctggatgaccgggaccaggaggccttctactgcatgaagccccagcacatgccctgtgaggccctgacctacatgaccaccaggaaccgggaggtgtcctacctgacagacaaggagaacagcctcttccacaggagcaaggtgggcgtggagatgatgaaggacaggaagcacattgatgtgaccaactgcaacaagcgggagaagattgaggagacctgccaggtgggcatgaagccccctgtgcctgggggctacaccctgcagggcaagtggatcaccaccttctgcaaccaggtgcagctggacaccatcaagatcaatggctgcctgaagggcaagctgatctacctgctgggggacagcaccctgcggcagtggatctactacttccccaaggtggtgaagaccctgaagttctttgacctgcatgaaacaggcatcttcaagaagcacctgctgctggatgctgagcggcacacccagatccagtggaagaagcacagctacccctttgtgaccttccagctgtacagcctgattgaccatgactacatcccccgggagattgaccggctgagcggggacaagaacacagccatcgtcatcaccttcggccagcacttccggcccttccccatcgacatcttcatccggcgggccatcggcgtgcagaaggccatcgagcggctcttcctgcggagccctgccaccaaggtgatcatcaagacagagaacatccgggagatgcacattgaaacagaaagatttggagacttccacggctacatccactacctgatcatgaaggacatcttcaaggacctgaatgtgggcatcattgatgcctgggacatgaccatcgcctatggaacagacaccatccaccccccagaccacgtgattggcaaccagatcaacatgttcctgaactacatctgctag

SEQ ID NO: 6906 - DNA, 597 bp, Artificial Sequence
  Description of Artificial Sequence: Synthetic coding sequence
atgcctgtgcctgccctgtgcctgctgtgggccctggccatggtgaccaggcctgccagcgctgcccccatgggcggccctgagctggcccagcacgaggagctgaccctgctcttccacggcaccctgcagctgggccaggccctgaatggagtgtaccgcaccacagagggccgcctgaccaaggccaggaacagcctgggcctgtatggccgcaccatcgagctgctgggccaggaggtgtcccggggcagagatgctgcccaggagctgcgggccagcctgctggagacccagatggaggaggacatcctgcagctgcaggccgaggccacagctgaggtgctgggggaggtggcccaggcccagaaggtgctgcgggacagcgtgcagaggctggaggtgcagctgcggagcgcctggctgggccctgcctaccgggagtttgaggtgctgaaggcccacgccgacaagcagagccacatcctgtgggccctgactggacatgtgcagaggcagaggcgggagatggtggcccagcagcaccggctgcggcagatccaggagcggctgcacacagctgccctgcctgcctag

SEQ ID NO: 6907 - DNA, 1455 bp, Artificial Sequence
  Description of Artificial Sequence: Synthetic coding sequence
atggccggcccctggaccttcaccctgctgtgtggcctgctggccgccaccctcatccaggccaccctgagccccacagctgtgctgatcctgggccccaaggtgatcaaggagaagctgacccaggagctgaaggaccacaatgccaccagcatcctgcagcagctgcccctgctgagcgccatgagggagaagccagctgggggcatccctgtgctgggcagcctggtgaacacagtgctgaagcacatcatctggctgaaggtgatcacagccaacatcctgcagctgcaggtgaagcccagcgccaatgaccaggagctgctggtgaagatccccctggacatggtggccggcttcaacacccccctggtgaagaccatcgtggagttccacatgaccacagaggcccaggccaccatccgcatggacaccagcgccagcggccccacccggctggtgctgagtgactgtgccaccagccacggcagcctgcgcatccagctgctgcacaagctgtccttcctggtgaatgccctggccaagcaggtgatgaacctgctggtgcccagcctgcccaacctggtgaagaaccagctgtgccctgtgattgaggccagcttcaacggcatgtatgctgacctgctgcagctggtgaaggtgcccatcagcctgagcattgaccggctggagtttgacctgctgtacccagccatcaagggggacaccatccagctgtacctgggcgccaagctgctggacagccagggcaaggtgaccaagtggttcaacaacagcgctgccagcctgaccatgcccaccctggacaacatccccttcagcctgattgtgtcccaggatgtggtgaaggctgctgtggccgctgtgctgagccctgaggagttcatggtgctgctggacagcgtgctgcctgagagcgcccaccggctgaagagcagcatcggcctcatcaatgagaaggctgctgacaagctgggcagcacccagatcgtgaagatcctgacccaggacaccccagagttcttcatcgaccagggccacgccaaggtggcccagctgattgtgctggaggtgttccccagcagcgaggccctgcggcccctcttcaccctgggcatcgaggccagcagcgaggcccagttctacaccaagggggaccagctgatcctgaacctgaacaacatcagcagtgaccgcatccagctgatgaacagcggcatcggctggttccagccagatgtgctgaagaacatcatcacagagatcatccacagcatcctgctgcccaaccagaatggcaagctgcggtctggagtgcctgtgtccctggtgaaggccctgggctttgaggccgctgagagcagcctgaccaaggatgccctggtgctgaccccagccagcctgtggaagcccagcagccctgtgtcccagtag

SEQ ID NO: 6908 - DNA, 750 bp, Artificial Sequence
  Description of Artificial Sequence: Synthetic coding sequence
atgctgcagctgtggaagctggtgctgctgtgtggggtgctgaccggcaccagcgagagcctgctggacaacctgggcaatgacctgagcaatgtggtggacaagctggagcctgtgctgcacgagggcctggagaccgtggacaacaccctgaagggcatcctggagaagctgaaggtggacctgggcgtgctgcagaagagcagcgcctggcagctggccaagcagaaggcccaggaggccgagaagctgctgaacaacgtcatcagcaagctgctgcccaccaacacagacatcttcggcctgaagatcagcaacagcctcatcctggatgtgaaggccgagcccattgatgatggcaagggcctgaacctgtccttccctgtgacagccaacgtgacagtggccggccccatcatcggccagatcatcaacctgaaggccagcctggacctgctgacagctgtgaccatcgagacagacccccagacccaccagcctgtggccgtgctgggagaatgtgccagtgaccccaccagcatcagcctgagcctgctggacaagcacagccagatcatcaacaagtttgtgaacagcgtcatcaacaccctgaagagcacagtgagcagcctgctgcagaaggagatctgccccctcatccgcatcttcatccacagcctggatgtgaatgtcatccagcaggtggtggacaacccccagcacaagacccagctgcagaccctcatctag

SEQ ID NO: 6909 - DNA, 1959 bp, Artificial Sequence
  Description of Artificial Sequence: Synthetic coding sequence
atgcagggccccctgctgctgcccggcctgtgcttcctgctgagcctgtttggagctgtgacccagaagaccaagaccagctgtgccaagtgccccccaaatgccagctgtgtgaacaacacccactgcacctgcaaccacggctacaccagcggcagcggccagaagctgttcaccttccccctggagacctgcaatgacatcaatgaatgtaccccaccctacagcgtgtactgcggcttcaatgctgtgtgctacaacgtggagggcagcttctactgccagtgtgtgcccggctaccgcctgcacagcggaaatgagcagttcagcaacagcaatgaaaacacctgccaggacaccaccagcagcaagaccacagagggcaggaaggagctgcagaagatcgtggacaagtttgagagcctgctgaccaaccagaccctgtggaggacagagggccggcaggagatcagcagcacagccaccaccatcctgagagatgtggagagcaaggtgctggagacagccctgaaggaccctgagcagaaggtgctgaagatccagaatgattctgtggccatcgagacccaggccatcacagacaactgcagcgaggagaggaagaccttcaacctgaatgtgcagatgaacagcatggacatccgctgcagcgacatcatccagggcgacacccagggccccagcgccatcgccttcatctcctacagcagcctgggcaacatcatcaatgccaccttctttgaggagatggacaagaaggaccaggtgtacctgaacagccaggtggtgtctgctgccatcggccccaagagaaatgtgtccctgagcaagtctgtgaccctgaccttccagcacgtgaagatgacccccagcaccaagaaggtgttctgtgtgtactggaagagcacaggccagggcagccagtggagcagagatggctgcttcctgattcatgtgaacaagagccacaccatgtgcaactgcagccacctgagcagctttgctgtgctgatggccctgaccagccaggaggaggaccctgtgctgaccgtcatcacctacgtgggcctgtctgtgtccctgctgtgcctgctgctggccgccctgaccttcctgctgtgcaaggccatccggaacaccagcaccagcctgcacctgcagctgagcctgtgcctcttcctggcccacctgctcttcctggtgggcatcgacagaacagagcccaaggtgctgtgcagcatcatcgccggggccctgcactacctgtacctggccgccttcacctggatgctgctggagggcgtgcacctgttcctgacagccaggaacctgactgtggtgaactacagcagcatcaaccggctgatgaagtggatcatgtttcctgtgggctacggcgtgcctgctgtgacagtggccatctctgctgcctcctggccccacctgtatggaacagctgaccgctgctggctgcacctggaccagggcttcatgtggagcttcctgggccctgtgtgtgccatcttcagcgccaacctggtgctcttcatcctggtgttctggatcctgaagaggaagctgagcagcctgaacagcgaggtgtccaccatccagaacaccaggatgctggccttcaaggccacagcccagctgttcatcctgggctgcacctggtgcctgggcctgctgcaggtgggccctgctgcccaggtgatggcctacctgttcaccatcatcaacagcctgcagggcttcttcatcttcctggtgtactgcctgctgagccagcaggtgcagaagcagtaccagaagtggttccgggagatcgtgaagagcaagtctgagagcgagacctacaccctgagcagcaagatgggccctgacagcaagcccagtgaaggagatgtgtttcctggccaggtgaagaggaagtactag

SEQ ID NO: 6910 - DNA, 1263 bp, Artificial Sequence
  Description of Artificial Sequence: Synthetic coding sequence
atgagccccccacccctgctgcagcccctgctgctgctgctgcccctgctgaatgtggagcccagcggggccaccctcatccgcatccccctgcaccgggtgcagcccggccgccgcatcctgaacctgctgcggggctggagggagcctgctgagctgcccaagctgggcgcccccagccctggggacaagcccatctttgtgcccctgagcaactacagagatgtgcagtactttggagagatcggcctgggcaccccaccccagaacttcaccgtggcctttgacaccggcagcagcaacctgtgggtgcccagccgccgctgccacttcttctctgtgccctgctggctgcaccacagatttgaccccaaggccagcagcagcttccaggccaacggcaccaagtttgccatccagtatggaacaggccgggtggatggcatcctgtctgaggacaagctgaccatcggcggcatcaagggggccagcgtcatctttggagaggccctgtgggagcccagcctggtgtttgcctttgcccactttgatggcatcctgggcctgggcttccccatcctgtctgtggagggcgtgcggccccccatggatgtgctggtggagcagggcctgctggacaagcctgtgttctccttctacctgaacagagatcctgaggagccagatggaggagagctggtgctgggcggcagtgaccctgcccactacatcccccccctgacctttgtgcctgtgacagtgcctgcctactggcagatccacatggagcgggtgaaggtgggccctggcctgaccctgtgtgccaagggctgtgccgccatcctggacaccggcaccagcctcatcaccggccccacagaggagatccgggccctgcatgctgccatcggcggcatccccctgctggccggggagtacatcatcctgtgcagcgagatccccaagctgcctgctgtgtccttcctgctgggcggcgtgtggttcaacctgacagcccatgactatgtgatccagaccaccagaaatggagtgcggctgtgcctgagcggcttccaggccctggatgtgcccccacctgctggccccttctggatcctgggagatgtgttcctgggcacctacgtggccgtgtttgacagaggagacatgaagagcagcgcccgggtgggcctggcccgggcccggaccagaggagctgacctgggctggggcgagacagcccaggcccagtttcctggatag

SEQ ID NO: 6911 - DNA, 1293 bp, Artificial Sequence
  Description of Artificial Sequence: Synthetic coding sequence
atggcctggacctttgagtgcagcaggaccaccagccctgagcccctgagcaccagcccctgcaggaccaccagcagcaggaacagccccaccatgagctgcccagcctctgtggcctgtgagcccagcaccagcaccaccaccagcagcccccccaagctgtctgtggccccccagttcctgcccaggagcctgcgggtggccgacctggccgccaaccaggtgatggagatcttccccctgacctttggagagaagccagccctgcggtctgtgtacctgcacaacaaccagctgagcaatgccggcctgcccccagatgccttccggggcagcgaggccatcgccaccctgagcctgagcaacaaccagctgagctacctgccccccagcctgccccccagcctggagcggctgcacctgcagaacaacctgatcagcaaggtgcccaggggggccctgagccggcagacccagctgcgggagctgtacctgcagcacaaccagctgacagattctggcctggatgccaccaccttcagcaagctgcacagcctggagtacctggacctgagccacaaccagctgaccaccgtgcctgctggcctgcccaggaccctggccatcctgcacctgggcaggaaccgcatccggcaggtggaggccgcccggctgcacggggcccggggcctgcgctacctgctgctgcagcacaaccagctgggcagcagcggcctgcctgctggggccctgcggcccctgcggggcctgcacaccctgcacctgtatggaaatggcctggacagagtgcccccagccctgccccggcggctgcgggccctggtgctgccccacaaccacgtggccgccctgggcgcccgggacctggtggccaccccaggcctgacagagctgaacctggcctacaaccggctggccagcgcccgggtgcaccaccgggccttccggcggctgcgggccctgcggagcctggacctggccggcaaccagctgacccggctgcccatgggcctgcccaccggcctgcggaccctgcagctgcagaggaaccagctgaggatgctggagcctgagcccctggccggcctggaccagctgcgggagctgagcctggcccacaaccggctgcgggtgggggacatcggccctggcacctggcatgagctgcaggccctgcaggtgcgccaccggctggtgagccacacagtgccccgggccccacccagcccctgcctgccctgccacgtgcccaacatcctggtgtcctggtag

SEQ ID NO: 6912 - DNA, 3162 bp, Artificial Sequence
  Description of Artificial Sequence: Synthetic coding sequence
atgtggcagccccggcggccctggccccgggtgccctggcgctgggccctggccctgctggccctggtgggcgccggcctgtgccacgccggcccccagcccggctacccagcccggcccagcgccaggaacaagaactggtgtgcctacatcgtgaacaagaatgtgtcctgcagcgtgctggagggcagcgagagcttcatccaggcccagtacaactgtgcctggaaccagatgccctgccccagcgccctggtgtacagagtgaacttccggcccaggtatgtgacccgctacaagacagtgacccagctggagtggcgctgctgccccggcttccggggcggggactgccaggagggccccaaggaccctgtgaagaccctgcggcccaccccagcccggcccaggaacagcctgaagaaggccacagacaatgagcccagccagttcagcgagcccaggaagaccctgagccccactggaacagcccagcccagctggggcgtggaccccaaggagggcccccaggagctgcaggagaagaagatccaggtgctggaggagaaggtgctgcggctgaccaggacagtgctggacctgcagagcagcctggccggcgtgtctgagaacctgaagcacgccacccaggatgatgccagcaggacccgggcccctggcctgagcagccagcaccccaagccagacaccaccgtgtctggggacacagaaacaggccagagccctggggtcttcaacaccaaggagagcggcatgaaggacatcaagtctgagctggccgaggtgaaggacaccctgaagaacaagagtgacaagctggaggagctggatggcaaggtgaagggctatgagggccagctgcggcagctgcaggaggccgcccagggccccaccgtgaccatgaccaccaatgagctgtaccaggcctacgtggacagcaagattgatgccctgcgggaggagctgatggagggcatggacaggaagctggccgacctgaagaacagctgtgagtacaagctgaccggcctgcagcagcagtgtgatgattatggcagcagctacctgggcgtcatcgagctgattggagagaaggagaccagcctgaggaaggagatcaacaacctgcgggcccggctgcaggagcccagcgcccaggccaactgctgtgacagcgagaagaatggagacatcggccagcagatcaagaccctggaccagaagattgaaagagtggccgaggccaccaggatgctgaatggccgcctggacaatgaatttgacaggctcatcgtgcctgagccagatgtggactttgatgccaagtggaatgagctggatgcccgcatcaacgtgacagagaagaatgctgaggagcactgcttctacatcgaggagaccctgcggggggccatcaacggggaggtgggggacctgaagcagctggtggaccagaagatccagagcctggaggaccggctgggctctgtgctgctgcagatgaccaacaacacaggagctgagctgagccccccaggagctgctgccctgcccggggtgtctggcagcggagatgagcgggtgatgatggagctgaaccacctgaaggacaaggtgcaggtggtggaggacatctgcctgctgaacatccagggcaagccccacggcatggagggcgccctgcccaaccgggaggacagagctgtgcgggacagcctgcacctgctgaagagcctgaatgacaccatgcacaggaagttccaggagacagagcagaccatccagaagctgcagcaggacttctccttcctgtacagccagctgaaccacacagaaaatgatgtgacccacctgcagaaggagatgagcaactgccgggccggggagaatgccggcatgggccgcttcaccaaggtgggggagcaggagaggacagtggacaccctgcccagcccccagcaccctgtggcccactgctgcagccagctggaggagcgctggcagaggctgcagagccaggtgatcagcgagctggatgcctgcaaggagtgcacccagggcgtgcagcgggaggtgtccatggtggagggccgggtgagccacatggagaagacctgcagcaagctggacagcatcagcggcaacctgcagaggatcaaggagggcctgaacaagcacgtgagcagcctgtggaactgtgtgcggcagatgaatggcaccctgcggagccacagccgggacatcagcggcctgaagaacagcgtgcagcagttctacagccacgtgttccagatcagcacagacctgcaggacctggtgaagttccagcccagcgccaaggcccccagccccccacctcctgctgaggcccccaaggagcccctgcagcctgagcccgccccaccccggcccagcggccctgccacagctgaggaccccggccggcggcctgtgctgccccagaggcctcctgaggagaggcctccccagcccccaggcagcactggagtgattgctgagaccggccaggccggccccccagctggagctggggtgtctggccggggcctgccccggggcgtggatggccagacaggcagcggcaccgtgcctggagctgagggctttgctggggcccctggctaccccaagagcccccctgtggccagccctggggcccctgtgcccagcctggtgtccttctctgctggcctgacccagaagcccttccccagtgatggcggcgtggtgctcttcaacaaggtgctggtgaatgatggagatgtgtacaaccccagcactggagtcttcaccgccccctatgatggccgctacctgatcacagccaccctgaccccagagagagatgcctacgtggaggccgtgctgtctgtgtccaatgcctctgtggcccagctgcacacagctggctaccgccgggagttcctggagtaccacaggcctcctggggccctgcacacctgtggcggccctggggccttccacctgattgtgcacctgaaggctggagatgctgtgaatgtggtggtgactggaggcaagctggcccacacagactttgatgagatgtacagcaccttcagcggggtcttcctgtaccccttcctgagccacctgtag

SEQ ID NO: 6913 - DNA, 1548 bp, Artificial Sequence
  Description of Artificial Sequence: Synthetic coding sequence
atggcccagctgttcctgcccctgctggccgccctggtgctggcccaggccccagctgccctggctgatgtgctggagggggacagcagtgaagatcgggccttccgggtgagaattgctggagatgcccccctgcagggcgtgctgggcggggccctgaccatcccctgccacgtgcactacctgcggcccccacccagccggcgggctgtgctgggcagcccccgggtgaagtggaccttcctgagccggggccgggaggccgaggtgctggtggcccggggcgtgcgggtgaaggtgaatgaggcctaccgcttccgggtggccctgcctgcctacccagccagcctgacagatgtgtccctggccctgtctgagctgcggcccaatgacagcggcatctaccgctgtgaggtgcagcacggcattgatgacagcagtgatgctgtggaggacagccagctgtaccccatccagaccccccgggaggcctgctacggggacatggatggcttccctggggtgaggaactacggcgtggtggaccctgatgacctgtatgatgtgtactgctacgccgaggacctgaatggagagctgttcctgggggaccccccagagaagctgaccctggaggaggcccgggcctactgccaggagagaggagctgagatcgccaccaccggccagctgtatgctgcctgggatggcggcctggaccactgcagccctggctggctggctgatggctctgtgcgctaccccatcgtgacccccagccagagatgtggcggcggcctgcccggggtgaagaccctcttcctgttccccaaccagacaggcttccccaacaagcacagccgcttcaacgtgtactgcttccggggcagcacctgcctgctgcccagcctgcggccccccacccagccccccacccaggacggcctggaggccatcgtgacagtgacagagaccctggaggagctgcagctgccccaggaggccacagagagcgagagcagaggagccatctacagcatccccatcatggaggatggcggcggcggcagcagcaccccagaagatcctgctgaggcccccaggaccctgctggagtttgagacccagagcatggtgccccccaccggcttcagcgaggaggagggcaaggccctggaggaggaggagaagtatgaagatgaggaggagaaggaggaggaggaggaggaggaggaggtggaggatgaggccctgtgggcctggcccagcgagctgagcagccctggccctgaggccagcctgcccacagagcctgctgcccaggaggagagcctgagccaggccccagcccgggctgtgctgcagcccggggccagccccctgcctgatggagagagcgaggccagcaggcctccccgggtgcacggccccccaacagagaccctgcccaccccccgggagaggaacctggccagccccagccccagcaccctggtggaggcccgggaggtgggggaggccaccggcggccctgagctgagcggctag

SEQ ID NO: 6914 - DNA, 1023 bp, Artificial Sequence
  Description of Artificial Sequence: Synthetic coding sequence
atgcctggctggctgaccctgcccaccctgtgccgcttcctgctgtgggccttcaccatcttccacaaggcccagggcgaccctgccagccaccctggcccccactacctgctgccccccatccacgaggtgatccacagccacagaggagccacagccaccctgccctgtgtgctgggcaccaccccacccagctacaaggtgcgctggagcaaggtggagcctggagagctgcgggagaccctcatcctgatcaccaacggcctgcacgcccggggctacggccccctgggcggccgggccaggatgaggcggggccaccggctggatgccagcctggtgattgctggggtgcggctggaggatgagggccgctaccgctgtgagctgatcaatggaattgaagatgagagcgtggccctgaccctgagcctggagggcgtggtgttcccctaccagcccagccggggccgctaccagttcaactactatgaggccaagcaggcctgtgaggagcaggacggccgcctggccacctacagccagctgtaccaggcctggacagagggcctggactggtgcaatgccggctggctgctggagggctctgtgcgctaccctgtgctgacagcccgggccccctgtggcggccggggccggcccggcatccgctcctatggcccccgggacaggatgagggacagatatgatgccttctgcttcaccagcgccctggccggccaggtgttctttgtgcccggccgcctgaccctgtctgaggcccatgctgcctgcagaagaagaggagctgtggtggccaaggtgggccacctgtatgctgcctggaagttcagcggcctggaccagtgtgatggcggctggctggctgatggctctgtgcgcttccccatcaccaccccccggccccgctgtggcggcctgcctgaccccggggtgcgcagctttggcttcccccggccccagcaggccgcctacggcacctactgctacgcagaaaattag

SEQ ID NO: 6915 - DNA, 690 bp, Artificial Sequence
  Description of Artificial Sequence: Synthetic coding sequence
atggacctgctgcagttcctggccttcctgtttgtgctgctgctgagcggcatgggcgccaccggcaccctgcggaccagcctggaccccagcctggagatctacaagaagatgtttgaggtgaagagaagagagcagctgctggccctgaagaacctggcccagctgaatgacatccaccagcagtacaagatcctggatgtgatgctgaagggcctcttcaaggtgctggaggacagcaggacagtgctgacagctgctgatgtgctgcctgatggccccttcccccaggatgagaagctgaaggatgccttcagccacgtggtggagaacacagccttctttggagatgtggtgctgcgcttccccagaattgtgcactactactttgaccacaacagcaactggaacctgctgatccgctggggcatctccttctgcaaccagacaggagtcttcaaccagggcccccacagccccatcctgagcctgatggcccaggagctgggcatcagcgagaaggacagcaacttccagaaccccttcaagattgacagaacagagttcatccccagcacagaccccttccagaaggccctgcgggaggaggagaagaggaggaagaaggaggagaagaggaaggagatcaggaagggcccccgcatcagccgcagccagagcgagctgtag

SEQ ID NO: 6916 - DNA, 465 bp, Artificial Sequence
  Description of Artificial Sequence: Synthetic coding sequence
atgtctgtgggcaccagcctggagcaggcccagatgagcaccctgacctgccccctcttcatccccaccgtgggcaggaagacagccctgcacagcggggaggacttccagaccctgctgtttgagcgggtgtttgtgaacctggatggctgctttgacatggccaccggccagtttgctgcccccctgcggggcatctacttcttcagcctgaatgtgcacagctggaactacaaggagacctacgtgcacatcatgcacaaccagaaggaggccgtcatcctgtatgcccagcccagcgagaggagcatcatgcagagccagagcgtgatgctggacctggcctacggggacagagtgtgggtgcggctcttcaagaggcagcgggagaatgccatctacagcaatgactttgacacctacatcaccttcagcggccacctgatcaaggccgaggatgactag

SEQ ID NO: 6917 - DNA, 900 bp, Artificial Sequence
  Description of Artificial Sequence: Synthetic coding sequence
atgaggtctgtgggggagggcgcccgggagtggatccgggagtgccagcaccagttccgccaccaccgctggaactgcaccaccctggaccgggaccacacagtgtttggccgggtgatgctgcggagcagccgggaggccgcctttgtgtatgccatcagcagcgctggggtggtgcacgccatcacccgggcctgcagccagggcgagctgtctgtgtgcagctgtgacccctacacccggggccgccaccacgaccagagaggagactttgactggggcggctgcagcgacaacatccactacggcgtgcgctttgccaaggcctttgtggatgccaaggagaagaggctgaaggatgcccgggccctgatgaacctgcacaacaacagatgtggccgcacagctgtgcggcgcttcctgaagctggagtgcaagtgccacggcgtgtctggcagctgcaccctgcggacctgctggagggccctgagtgacttcagaagaactggagactacctgcggaggagatatgatggagctgtgcaggtgatggccacccaggatggagccaacttcaccgctgcccggcagggctaccgccgggccaccaggacagacctggtgtactttgacaacagcccagactactgtgtgctggacaaggctgctggcagcctgggcacagctggccgggtgtgcagcaagaccagcaagggcacagatggctgtgagatcatgtgctgcggccggggctatgacaccaccagggtgaccagggtgacccagtgtgagtgcaagttccactggtgctgtgctgtgcgctgcaaggaatgtagaaacacagtggatgtgcacacctgcaaggcccccaagaaggccgagtggctggaccagacctag

SEQ ID NO: 6918 - DNA, 1710 bp, Artificial Sequence
  Description of Artificial Sequence: Synthetic coding sequence
atgctgctgctcttcagcgtcatcctgatctcctgggtgtccacagtgggcggggagggcaccctgtgtgacttccccaagatccaccacggcttcctgtatgatgaggaggactacaaccccttcagccaggtgcccactggagaggtgttctactacagctgtgagtacaactttgtgagccccagcaagagcttctggacccgcatcacctgcacagaggagggctggagccccacccccaagtgcctgaggatgtgcagcttcccctttgtgaagaatggccacagcgagagcagcggcctcatccacctggagggggacacagtgcagatcatctgcaacacaggctacagcctgcagaacaatgagaagaacatcagctgtgtggagcggggctggagcaccccacccatctgcagcttcaccaagggggagtgccacgtgcccatcctggaggccaacgtggatgcccagcccaagaaggagagctacaaggtgggagatgtgctgaagttcagctgcaggaagaacctgatccgggtgggcagtgacagcgtgcagtgctaccagtttggctggagccccaacttccccacctgcaagggccaggtgcgcagctgtggccccccaccccagctgagcaatggagaggtgaaggagatcaggaaggaggagtatggccacaatgaggtggtggagtatgactgcaaccccaacttcatcatcaatggccccaagaagatccagtgtgtggatggagagtggaccaccctgcccacctgtgtggagcaggtgaagacctgtggctacatccctgagctggagtatggctacgtgcagcccagcgtgcccccctaccagcacggcgtgtctgtggaggtgaactgcagaaatgaatatgccatgattggcaacaacatgatcacctgcatcaatggcatctggacagagctgcccatgtgtgtggccacccaccagctgaagcgctgcaagattgctggggtgaacatcaagaccctgctgaagctgagcggcaaggagttcaaccacaacagccgcatccgctaccgctgcagcgacatcttccgctaccgccacagcgtgtgcatcaacgggaagtggaaccctgaggtggactgcacagagaagcgggagcagttctgccccccaccaccccagatccccaatgcccagaacatgaccaccaccgtgaactaccaggatggagagaaggtggccgtgctgtgcaaggagaactacctgctgcctgaggccaaggagatcgtgtgcaaggatggccgctggcagagcctgccccgctgtgtggagagcacagcctactgcggccccccacccagcatcaacaatggagacaccaccagcttccccctgtctgtgtacccacctggcagcacagtgacctaccgctgccagagcttctacaagctgcagggctctgtgacagtgacctgcaggaacaagcagtggagcgagcccccacgctgcctggacccctgtgtggtgtctgaggagaacatgaacaagaacaacatccagctgaagtggagaaatgatggcaagctgtatgccaagacaggagatgctgtggagttccagtgcaagttcccccacaaggccatgatcagcagcccccccttccgggccatctgccaggagggcaagtttgagtaccccatctgtgagtag

SEQ ID NO: 6919 - DNA, 351 bp, Artificial Sequence
  Description of Artificial Sequence: Synthetic coding sequence
atgaagggcctgcggagcctggccgccaccaccctggccctcttcctggtgtttgtgttcctgggcaacagcagctgtgccccccagaggctgctggagaggaggaactggaccccccaggccatgctgtacctgaagggggcccagggccgccgcttcatcagtgaccagagcaggaggaaggacctgagtgaccggcccctgcctgagaggaggagccccaacccccagctgctgaccatccctgaggccgccaccatcctgctggccagcctgcagaagagcccagaagatgaggagaagaactttgaccagacccgcttcctggaggacagcctgctgaactggtag

SEQ ID NO: 6920 - DNA, 192 bp, Artificial Sequence
  Description of Artificial Sequence: Synthetic coding sequence
atgaagcacgtgctgaacctgtacctgctgggcgtggtgctgaccctgctgagcatctttgtgcgggtgatggagagcctggagggcctgctggagagccccagccctggcacctcctggaccaccaggagccagctggccaacacagagcccaccaagggcctgcctgaccaccccagccgctccatgtag

SEQ ID NO: 6921 - DNA, 567 bp, Artificial Sequence
  Description of Artificial Sequence: Synthetic coding sequence
atggtgcctggagctgctggctggtgctgcctggtgctgtggctgcctgcctgtgtggccgcccacggcttccgcatccatgactacctgtacttccaggtgctgagccctggggacatccgctacatcttcaccgccaccccagccaaggactttggaggcatcttccacaccaggtatgagcagatccacctggtgcctgctgagcccccagaggcctgtggggagctgagcaatggcttcttcatccaggaccagatcgccctggtggagcggggcggctgcagcttcctgagcaagaccagggtggtgcaggagcacggcggccgggctgtgatcatcagtgacaatgctgtggacaatgacagcttctacgtggagatgatccaggacagcacccagaggacagctgacatcccagccctcttcctgctgggcagagatggctacatgatcagaagaagcctggagcagcacggcctgccctgggccatcatcagcatccctgtgaatgtgaccagcatccccacctttgagctgctgcagcccccctggaccttctggtag

SEQ ID NO: 6922 - DNA, 2559 bp, Artificial Sequence
  Description of Artificial Sequence: Synthetic coding sequence
atgaagcccatgctgaaggacttcagcaacctgctgctggtggtgctgtgtgactatgtgctgggggaggccgagtacctgctgctgcgggagcccggccacgtggccctgagcaatgacacagtgtatgtggacttccagtactttgatggagccaacggcaccctgagaaatgtgtctgtgctgctgctggaggccaacaccaaccagacagtgaccaccaagtacctgctgaccaaccagagccagggcaccctgaagtttgagtgcttctacttcaaggaggccggggactactggttcaccatgaccccagaggccacagacaacagcacccccttcccctggtgggagaagagcgccttcctgaaggtggagtggcctgtgttccacgtggacctgaacagaagtgccaaggctgctgagggcaccttccaggtgggcctcttcaccagccagcccctgtgccccttccctgtggacaagcccaacatcgtggtggatgtgatcttcaccaacagcctgcctgaggcccggaggaacagccggcagcccctggagatccgcaccagcaagaggacagagctggcccagggccagtgggtggagtttggctgtgcccccctgggccctgaggcctacgtgacagtggtgctgaagctgctgggccgggacagcgtcatcaccagcacaggccccatcgacctggcccagaagtttggctacaagctggtgatggtgcctgagctgacctgtgagagcggcgtggaggtgacagtgctgcccccaccctgcacctttgtgcagggcgtggtgacagtgttcaaggaggccccccgctacccaggcaagaggaccatccacctggccgagaacagcctgcccctgggggagaggaggaccatcttcaactgcaccctgtttgacatgggcaagaacaagtactgctttgattttggcatcagcagccgcagccacttcagcgccaaggaggagtgcatgctgatccagaggaacacagagacctggggcctgtggcagccctggagccagtgcagcgccacctgtggagatggagtgcgggagcggcggcgggtgtgcctgaccagcttccccagcagccctgtgtgccccggcatgagcctggaggccagcctgtgcagcctggaggagtgtgccgccttccagcccagcagccccagccccctgcagccccagggccctgtgaagagcaacaacatcgtgacagtgacaggcatcagcctgtgcctcttcatcatcatcgccaccgtgctgatcaccctgtggaggagatttggccggcctgccaagtgcagcaccccagcccggcacaacagcatccacagccccagcttcaggaagaacagtgatgaggagaacatctgtgagctgtctgagcagaggggcagcttcagtgatggaggagatggccccaccggcagccctggggacaccggcatccccctgacctacagaagaagtggccctgtgcccccagaagatgatgccagcggcagcgagagcttccagagcaatgcccagaagatcatccccccactcttctcctaccgcctggcccagcagcagctgaaggagatgaagaagaagggcctgacagagaccaccaaggtgtaccacgtgtcccagagccccctgacagacacagccattgatgctgcccccagcgcccccctggacctggagagccctgaggaggccgccgccaacaagttccgcatcaagagccccttccctgagcagcctgctgtgtctgctggggagaggcctcccagccggctggacctgaatgtgacccaggccagctgtgccatcagccccagccagaccctcatcaggaagagccaggcccggcacgtgggcagcagaggaggccccagcgagaggagccacgccagaaatgcccacttcagaagaacagccagcttccacgaggcccggcaggcccggcccttccgggagaggtccatgagcaccctgaccccccggcaggccccagcctacagcagcaggaccaggacctgtgagcaggccgaggaccgcttccggccccagagcagaggagcccacctgtttcctgagaagctggagcacttccaggaggccagcggcacccggggccccctgaaccccctgcccaagagctacaccctgggccagcccctgaggaagccagacctgggggaccaccaggccggcctggtggccggcattgaaagaacagagccccaccgggcccggcggggccccagccccagccacaagtctgtgtccaggaagcagagcagccccatcagccccaaggacaactaccagagggtgagcagcctgagccccagccagtgcaggaaggacaagtgccagagcttccccacccaccctgagtttgccttctatgacaacaccagctttggcctgacagaggccgagcagaggatgctggacctgcccggctacttcggcagcaatgaggaggatgagaccaccagcaccctgtctgtggagaagctggtgatctag

SEQ ID NO: 6923 - DNA, 369 bp, Artificial Sequence
  Description of Artificial Sequence: Synthetic coding sequence
atgggcttccacttctgcatctggatcatcttcctgctgcccccaccctgcaagaagtgcctgagcccccccaccatgaacctgcggccccccaagagctgtggaaatgtgttctactgggtgctggtgctgaacagcggcctgctgtacaagttctgccagaccatcaagtgccgggccaactggaggcctgcccgggccccccggggctggaatgaggccacagagcggcaccaggagaggaggacccagatggagacagagatgggcggcatcagcaccacctactggcaccggctgtgcacctgcacagaccggcgggcagagaagctggtgatggatggcaacaactgctggttccacaagtag

SEQ ID NO: 6924 - DNA, 978 bp, Artificial Sequence
  Description of Artificial Sequence: Synthetic coding sequence
atgcagggccgggtggccggcagctgtgcccccctgggcctgctgctggtgtgcctgcacctgcccggcctgtttgcccggagcattggagtggtggaggagaaggtgtcccagaacctgggcaccaacctgccccagctgggccagcccagcagcacaggccccagcaacagcgagcacccccagcctgccctggaccccaggagcaatgacctggcccgggtgcccctgaagctgtctgtgcctgccagtgatggcttccccccagctgggggcagcgctgtgcagcgctggcccccatcctggggcctgcctgccatggacagctggcccccagaggacccctggcagatgatggctgctgctgctgaggaccggctgggggaggccctgcctgaggagctgagctacctgagcagcgctgctgccctggcccctggcagcggccccctgcccggggagagcagcccagatgccaccggcctgagccccaaggccagcctgctgcaccaggacagcgagagccggcggctgcccaggagcaacagcctgggcgctgggggcaagatcctgagccagaggcctccctggagcctcatccaccgggtgctgcctgaccacccctggggcaccctgaaccccagcgtgtcctggggcggcggcggccctggcaccggctggggcacccggcccatgccccaccctgagggcatctggggcatcaacaaccagcccccaggcacctcctggggcaacatcaaccgctacccaggcggctcctggggcaacatcaaccgctacccaggcggctcctggggcaacatcaaccgctacccaggcggctcctggggcaacatccacctgtacccaggcatcaacaaccccttccccccaggagtgctgcggcccccaggcagctcctggaacatcccagctggcttccccaacccccccagcccccggctgcagtggggctag

SEQ ID NO: 6925 - DNA, 2631 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagagatggcctgctgagctacacagcccctgtgggccagaccatgtacctgtctgaggccgtgtacctgaatgacagcacctatgatggccacacagtgggcggcctgcagtatggaggcctgggccagctggctgatggagtggtgggcctggatgacttcaggaagagccaggagctgcgggtgtggccaggctatgactatgtgggctggagcaaccacagcttcagcagcggctacgtggagatggagtttgaatttgaccggctgcgggccttccaggccatgcaggtgcactgcaacaacatgcacaccctgggcgcccggctgcccggcggcgtggagtgccgcttccggcggggccctgccatggcctgggagggggagcccatgaggcacaacctgggcggcaacctgggggacccccgggcccgggctgtgtctgtgcccctgggcggccgggtggcccgcttcctgcagtgccgcttcctgtttgctggcccctggctgctcttcagcgagatctccttcatcagtgatgtggtgaacaacagcagccctgccctgggcggcaccttccccccagccccctggtggcccccaggccccccacccaccaacttcagcagcctggagctggagccccggggccagcagcctgtggccaaggccgagggcagccccacagccatcctgattggctgcctggtggccatcatcctgctgctgctgctgatcatcgccctgatgctgtggaggctgcactggaggcggctgctgagcaaggccgagcggcgggtgctggaggaggagctgactgtgcacctgtctgtgcctggggacaccatcctgatcaacaaccggcccggcccccgggagcccccaccctaccaggagccccggccccggggcaaccccccccacagcgccccctgtgtgcccaacggcagcgcctacagcggggactacatggagcctgagaagccaggggcccccctgctgcccccaccaccccagaacagcgtgccccactatgcagaggccgacatcgtgaccctgcagggcgtgactggaggcaacacctatgctgtgcctgccctgcccccaggagctgtgggagatggccccccccgggtggacttccccaggagccggctgcgcttcaaggagaagctgggggagggccagtttggagaggtgcacctgtgtgaggtggacagcccccaggacctggtgtccctggacttccccctgaatgtgaggaagggccaccccctgctggtggccgtgaagatcctgcggccagatgccaccaagaatgccagaaatgacttcctgaaggaggtgaagatcatgagccggctgaaggaccccaacatcatccggctgctgggcgtgtgtgtgcaggatgaccccctgtgcatgatcacagactacatggagaatggagacctgaaccagttcctgagcgcccaccagctggaggacaaggctgctgagggcgcccctggagatggccaggccgcccagggccccaccatctcctaccccatgctgctgcacgtggccgcccagatcgccagcggcatgagatacctggccaccctgaactttgtgcaccgggacctggccaccaggaactgcctggtgggggagaacttcaccatcaagattgctgactttggcatgagcaggaacctgtatgctggggactactacagagtgcagggccgggctgtgctgcccatccgctggatggcctgggagtgcatcctgatgggcaagttcaccacagccagtgatgtgtgggccttcggcgtgaccctgtgggaggtgctgatgctgtgccgggcccagcccttcggccagctgacagatgagcaggtgattgaaaatgctggggagttcttccgggaccagggccggcaggtgtacctgagccggcccccagcctgcccccagggcctgtatgagctgatgctgcgctgctggagccgggagagcgagcagaggcctcccttcagccagctgcaccgcttcctggccgaggatgccctgaacacagtgtag

SEQ ID NO: 6926 - DNA, 672 bp, Artificial Sequence
  Description of Artificial Sequence: Synthetic coding sequence
atgaagtttgtgccctgcctgctgctggtgaccctgagctgcctgggcaccctgggccaggccccccggcagaagcagggcagcactggagaggagttccacttccagacaggaggccgggacagctgcaccatgaggcccagcagcctgggccagggcgctggggaggtgtggctgcgggtggactgcaggaacacagaccagacctactggtgtgagtaccggggccagcccagcatgtgccaggcctttgctgctgaccccaagccctactggaaccaggccctgcaggagctgcggcggctgcaccacgcctgccagggcgcccctgtgctgcggcccagcgtgtgccgggaggccggcccccaggcccacatgcagcaggtgaccagcagcctgaagggcagccctgagcccaaccagcagcctgaggccggcacccccagcctgcggcccaaggccaccgtgaagctgacagaggccacccagctgggcaaggacagcatggaggagctgggcaaggccaagcccaccacccggcccacagccaagcccacccagcccggccccaggcctggaggaaatgaggaggccaagaagaaggcctgggagcactgctggaagcccttccaggccctgtgtgccttcctgatctccttcttccggggctag

SEQ ID NO: 6927 - DNA, 585 bp, Artificial Sequence
  Description of Artificial Sequence: Synthetic coding sequence
atgaccatgaggcacaactggaccccagacctgagccccctgtgggtgctgctgctgtgtgcccacgtggtgaccctgctggtgcgggccacccctgtgtcccagaccaccacagctgccacagcctctgtgcgcagcaccaaggacccctgccccagccagccccctgtgtttcctgctgccaagcagtgcccagccctggaggtgacctggccagaggtggaggtgcccctgaatggcaccctgagcctgagctgtgtggcctgcagccgcttccccaacttcagcatcctgtactggctgggcaatggcagcttcatcgagcacctgcccggccgcctgtgggagggcagcaccagccgggagcggggcagcacaggcacccagctgtgcaaggccctggtgctggagcagctgaccccagccctgcacagcaccaacttcagctgtgtgctggtggaccctgagcaggtggtgcagagacatgtggtgctggcccagctgtgggccggcctgcgggccaccctgccccccacccaggaggccctgcccagcagccacagcagcccccagcagcagggctag

SEQ ID NO: 6928 - DNA, 777 bp, Artificial Sequence
  Description of Artificial Sequence: Synthetic coding sequence
atgattgccatctctgctgtgtcctctgccctgctcttcagcctgctgtgtgaggccagcacagtggtgctgctgaacagcacagacagcagcccccccaccaacaacttcacagacatcgaggccgccctgaaggcccagctggacagcgctgacatccccaaggcccggaggaagcgctacatcagccagaatgacatgattgccatcctggactaccacaaccaggtgcggggcaaggtgtttcctcctgctgccaacatggagtacatggtgtgggatgagaacctggccaagtctgctgaggcctgggccgccacctgcatctgggaccacggccccagctacctgctgcgcttcctgggccagaacctgtctgtgaggacaggccgctaccgcagcatcctgcagctggtgaagccctggtatgatgaggtgaaggactatgccttcccctacccccaggactgcaacccccgctgccccatgcgctgcttcggccccatgtgcacccactacacccagatggtgtgggccaccagcaaccgcatcggctgtgccatccacacctgccagaacatgaatgtgtggggctctgtgtggaggagagctgtgtacctggtgtgcaactatgcccccaagggcaactggattggagaggccccctacaaggtgggcgtgccctgcagcagctgccccccatcctatggaggcagctgcacagacaacctgtgcttccctggggtgaccagcaactacctgtactggttcaagtag

SEQ ID NO: 6929 - DNA, 906 bp, Artificial Sequence
  Description of Artificial Sequence: Synthetic coding sequence
atgctgcccctgaccatgacagtgctgatcctgctgctgctgcccaccggccaggccgcccccaaggatggagtgaccaggccagacagcgaggtgcagcaccagctgctgcccaaccccttccagcccggccaggagcagctgggcctgctgcagagctacctgaagggcctgggccgcacagaggtgcagctggagcacctgagccgggagcaggtgctgctgtacctgtttgccctgcatgactatgaccagagcggccagctggatggcctggagctgctgtccatgctgacagctgccctggcccctggggccgccaacagccccaccaccaaccctgtgatcctgattgtggacaaggtgctggagacccaggacctgaatggagatggcctgatgaccccagctgagctgatcaacttccctggggtggccctgcggcacgtggagcccggggagcccctggcccccagcccccaggagccccaggccgtgggccggcagagcctgctggccaagagccccctgcggcaggagacccaggaggcccctggcccccgggaggaggccaagggccaggtggaggcccggcgggagagcctggaccctgtgcaggagcccggcggccaggccgaggctgatggagatgtgcccggccccagaggagaggccgagggccaggccgaggccaagggagatgcccctggccccagaggagaggccggcggccaggccgaggccgagggagatgcccctggccccagaggagaggccggcggccaggccgaggccagagaaaatggagaggaggccaaggagctgcccggggagaccctggagagcaagaacacccagaatgactttgaggtgcacatcgtgcaggtggagaatgatgagatctag

SEQ ID NO: 6930 - DNA, 969 bp, Artificial Sequence
  Description of Artificial Sequence: Synthetic coding sequence
atgaagaccctggccggcctggtgctgggcctggtgatctttgatgctgctgtgacagcccccaccctggagagcatcaactatgacagcgagacctatgatgccaccctggaggacctggacaacctgtacaactatgagaacatccctgtggacaaggtggagattgagatcgccaccgtgatgcccagcggcaaccgggagctgctgaccccaccaccccagcctgagaaggcccaggaggaggaggaggaggaggagagcaccccccggctgattgatggcagcagcccccaggagcctgagttcaccggggtgctgggcccccacaccaatgaagacttccccacctgcctgctgtgcacctgcatcagcaccaccgtgtactgtgatgaccacgagctggatgccatcccccccctgcccaagaacacagcctacttctacagccgcttcaaccgcatcaagaagatcaacaagaatgactttgccagcctgagtgacctgaagagaattgacctgaccagcaacctgatcagcgagattgatgaagatgccttcaggaagctgccccagctgcgggagctggtgctgcgggacaacaagatccggcagctgcctgagctgcccaccaccctgaccttcatcgacatcagcaacaaccggctgggcaggaagggcatcaagcaggaggccttcaaggacatgtatgacctgcaccacctgtacctgacagacaacaacctggaccacatccccctgcccctgcctgagaacctgcgggccctgcacctgcagaacaacaacatcctggagatgcatgaggacaccttctgcaatgtgaagaacctgacctacatcaggaaggccctggaggacatccggctggatggcaaccccatcaacctgagcaagaccccccaggcctacatgtgcctgccccggctgcctgtgggcagcctggtgtag

SEQ ID NO: 6931 - DNA, 618 bp, Artificial Sequence
  Description of Artificial Sequence: Synthetic coding sequence
atggtgaacctggccgccatggtgtggaggcggctgctgaggaagcgctgggtgctggccctggtgtttggcctgagcctggtgtacttcctgagcagcaccttcaagcaggaggagagagctgtgcgggacaggaacctgctgcaggtgcatgaccacaaccagcccatcccctggaaggtgcagttcaacctgggcaacagcagccggcccagcaaccagtgcaggaacagcatccagggcaagcacctgatcacagatgagctgggctacgtgtgtgagaggaaggacctgctggtgaatggctgctgcaatgtgaatgtgcccagcaccaagcagtactgctgtgatggctgctggcccaacggctgctgcagcgcctatgagtactgtgtgtcctgctgcctgcagcccaacaagcagctgctgctggagcgcttcctgaacagagctgctgtggccttccagaacctcttcatggctgtggaggaccactttgagctgtgcctggccaagtgcaggaccagcagccagagcgtgcagcacgagaacacctacagagaccccatcgccaagtactgctatggagagagccccccagagctgtttcctgcctag

SEQ ID NO: 6932 - DNA, 3057 bp, Artificial Sequence
  Description of Artificial Sequence: Synthetic coding sequence
atggtgagccacttcatgggcagcctgtctgtgctgtgcttcctgctgctgctgggcttccagtttgtgtgcccccagcccagcacccagcacaggaaggtgccccagaggatggctgctgagggcgccccagaagatgatggcggcggcggggcccctggggtgtggggcgcctggggcccctggagcgcctgcagccgcagctgcagcggcggcgtgatggagcagacccggccctgcctgcccaggagctaccgcctgcggggcggccagaggcctggggccccagcccgggcctttgctgaccacgtggtgtctgctgtgaggacctctgtgcccctgcacaggagcagagatgagaccccagccctggccggcacagatgccagccggcagggccccaccgtgctgcggggcagccgccacccccagccccagggcctggaggtgactggagaccggcgcagcaggacccggggcaccatcggccctgggaagtatggctacggcaaggccccctacatcctgcccctgcagacagacacagcccacaccccccagaggctgcggcggcagaagctgagcagccgccacagccgcagccagggcgccagcagcgcccggcacggctacagcagccctgcccaccaggtgccccagcacggccccctgtaccagagcgacagcggccccaggagcggcctgcaggccgctgaggcccccatctaccagctgcccctgacccatgaccagggctacccagctgccagcagcctcttccacagccctgagaccagcaacaaccacggcgtgggcacccacggggccacccagagcttcagccagcctgcccggagcacagccatcagctgcatcggggcctaccggcagtacaagctgtgcaacaccaacgtgtgcccagagagcagccgcagcatccgggaggtgcagtgtgccagctacaacaacaagcccttcatgggccgcttctatgagtgggagccctttgctgaggtgaagggcaacagaaaatgtgagctgaactgccaggccatgggctaccgcttctacgtgcggcaggccgagaaggtgattgatggcaccccctgtgaccagaatggaacagccatctgtgtgtctggccagtgcaagagcatcggctgtgatgactacctgggcagtgacaaggtggtggacaagtgtggggtgtgtggcggggacaacacaggctgccaggtggtgtctggagtcttcaagcacgccctgaccagcctgggctaccaccgggtggtggagatccctgagggcgccaccaagatcaacatcacagagatgtacaagagcaacaactacctggccctgcggagccgcagcggccgcagcatcatcaatggaaactgggccatcgacaggcctgggaagtatgaaggaggcggcaccatgttcacctacaagaggcccaatgagatcagcagcacagctggggagagcttcctggccgagggccccaccaatgagatcctggatgtgtacatgatccaccagcagcccaaccctggggtgcactatgaatatgtgatcatgggcaccaatgccatcagcccccaggtgcccccccacagaagacctggagagcccttcaacggccagatggtgacagagggccgcagccaggaggagggggagcagaagggcagaaatgaggagaaggaggacctgcggggggaggcccctgagatgttcaccagcgagagcgcccagaccttccctgtgcgccacccagaccgcttcagcccccacaggccagacaacctggtgcccccagccccccagcccccccggcgcagccgggaccacaactggaagcagctgggcaccacagagtgcagcaccacctgtgggaagggcagccagtaccccatcttccgctgtgtgcacaggagcacccatgaggaggcccctgagagctactgtgacagctccatgaagcccaccccagaggaggagccctgcaacatcttcccctgcccagccttctgggacatcggggagtggagcgaatgttccaagacctgtggcctgggcatgcagcaccggcaggtgctgtgccggcaggtgtatgccaacagaagcctgactgtgcagccctaccgctgccagcacctggagaagccagagaccaccagcacctgccagctgaagatctgcagcgagtggcagatcagaacagactggaccagctgcagcgtgccctgtggggtgggccagaggaccagagatgtgaagtgtgtgagcaacattggagatgtggtggatgatgaggagtgcaacatgaagctgcggcccaatgacatcgagaactgtgacatgggcccctgtgccaagtcctggttcctgacagagtggagcgagcgctgcagcgcagaatgtggggccggcgtgaggaccaggtctgtggtgtgcatgaccaaccacgtgagcagcctgcccctggagggctgcggcaacaacagacctgctgaggccaccccctgtgacaatggcccctgcaccgggaaggtggagtggtttgctggctcctggagccagtgcagcattgaatgtggcagcggcacccagcagcgggaggtgatctgtgtgaggaagaatgctgacacctttgaggtgctggaccccagcgagtgcagcttcctggagaagccacccagccagcagagctgccacctgaagccctgtggggccaagtggttcagcacagagtggagcatgtgcagcaagagctgccagggcggcttccgggtgcgggaggtgcgctgcctgagtgatgacatgaccctgagcaacctgtgtgacccccagctgaagccagaggagcgggagagctgcaacccccaggactgtgtgcctgaggtggatgagaactgcaaggacaagtactacaactgcaatgtggtggtgcaggcccggctgtgtgtgtacaactactacaagacagcctgctgtgccagctgcaccagggtggccaaccggcagacaggcttcctgggcagcaggtag

SEQ ID NO: 6933 - DNA, 1503 bp, Artificial Sequence
  Description of Artificial Sequence: Synthetic coding sequence
atgaagtgcacagcccgggagtggctgcgggtgaccaccgtgctcttcatggcccgggccatcccagccatggtggtgcccaatgccaccctgctggagaagctgctggagaagtacatggatgaagatggagagtggtggatcgccaagcagaggggcaagagggccatcacagacaatgacatgcagagcatcctggacctgcacaacaagctgcggagccaggtgtaccccacagccagcaacatggagtacatgacctgggatgtggagctggagaggtctgctgagagctgggccgagagctgcctgtgggagcacggccctgccagcctgctgcccagcatcggccagaacctgggcgcccactggggccgctacagaccacccaccttccacgtgcagagctggtatgatgaggtgaaggacttctcctacccctatgaacatgagtgcaacccctactgccccttccgctgcagcggccctgtgtgcacccactacacccaggtggtgtgggccaccagcaacagaattggctgtgccatcaacctgtgccacaacatgaacatctggggccagatctggcccaaggctgtgtacctggtgtgcaactacagccccaagggcaactggtggggccacgccccctacaagcacggccggccctgcagcgcctgcccccccagctttggaggcggctgccgggagaacctgtgctacaaggagggcagtgaccgctactacccaccccgggaggaggagaccaatgaaattgagcggcagcagagccaggtgcatgacacccacgtgaggaccaggagtgatgacagcagcagaaatgaagtcatcagcgcccagcagatgagccagatcgtgtcctgtgaggtgcggctgcgggaccagtgcaagggcaccacctgcaacagatatgagtgcccagctggctgcctggacagcaaggccaaggtgattggctctgtgcactatgagatgcagagcagcatctgcagagctgccatccactacggcatcatcgacaatgatggcggctgggtggacatcacccggcagggcaggaagcactacttcatcaagagcaacagaaatggcatccagaccatcggcaagtaccagagcgccaacagcttcaccgtgtccaaggtgacagtgcaggccgtgacctgtgagaccaccgtggagcagctgtgccccttccacaagccagccagccactgcccccgggtgtactgccccaggaactgcatgcaggccaacccccactacgcccgggtgattggcaccagggtgtacagcgacctgagcagcatctgcagagctgctgtgcatgctggggtggtgagaaatcatggaggctacgtggatgtgatgcctgtggacaagaggaagacctacatcgccagcttccagaatggcatcttcagcgagagcctgcagaaccccccaggcggcaaggccttccgggtgtttgctgtggtgtag

SEQ ID NO: 6934 - DNA, 2070 bp, Artificial Sequence
  Description of Artificial Sequence: Synthetic coding sequence
atgaagtttggagctgtgaccagaattggaggcccccccctgggcaaccagagccccagcagctgcagcctgctgcacgagaaggacccccccaccaccagcggcccccagacagaccagcccaagaagcacctgaccaacttcaagagcgccaccaggagagtggcccggacccagtggctgacagctgaccggcagacctgggccagcatcagctctgtgccctgggcccagaccatcagcgagaagaagccaggcggcagcctgtgggagaccaggagcagcccccccaccacagctggaacagaggaggccatgaacaccaccagcctgctggccccagctgctgagatcatggccaccccaggcagccccagccaggccagccccaccctgggcgccttcacccacggcacccagacccccagccccaccaaggccacagccccccgctacccccagacaggagacctgtctgctgagtggcccttcaccgctggggaggagcctgtgctggtgccccggccccaccaggtgtcccgggtgcgcagcagctgctgcctgagccccatcctgtgcagccctgccatgattgccttcctgctgacctctgtgctgatgatcccccatgctgggggccaccccctggacaccccccacctgccccaggagctgcccccaggcctgcccaacaacatcaacatcaccttcttcagcggcatgttcaagaatgtggagagcgtggccgagatctttgactgcctgggcccccacttcacctggctgcaggccgtgttcaccaacttccctgtgctgatccagtttgtgaatggcatgaagtgtgtggccggcctgtgcccccgggactttgaagattatggctgcacctgccgctttgagatggagggcctgcctgtggatgaaagtgacagctgctgcttccagcaccggcgctgctatgaggaggccgctgagatggactgcctgcaggaccctgccaagctgagcacagaggtgaactgtgtgtccaagaagatcatctgtgagagcaaggacaactgtgagcacctgctgtgcacctgtgacaaggccgccattgaatgtctggcccggagcagcctgaacagcagcctgaacctgctggacaccagcttctgcctggcccagaccccagagaccaccatcaaggaggacctgaccaccctgctgccccgggtggtgcctgtggagcccacagacaccagcctgacagccctgagcggggaggtggccgctgagacagaagctgacaggctcatcaccctgagcaagaagaaggccggccatgaccaggagggcgtgggcgccgcccgggccaccagccccccaggcagcgctgagatcgtggccaccagggtgacagccaagatcgtgaccctggtgcctgctggcatcaagagcctgggcctggccgtgtcctctgtggagaatgaccctgaggagaccacagagaaggcctgtgaccgcttcaccttcctgcacctgggcagcggggacaacatgcaggtgatgccccagctgggggagatgctgttctgcctgaccagccgctgcccagaggagtttgagagctatggctgctactgcggccaggagggccgcggggagcccagagatgacctggaccgctgctgcctgagccaccactgctgcctggagcaggtgcggcggctgggctgcctgctggagcggctgccctggagccctgtggtgtgtgtggaccacacccccaagtgtggcggccagagcctgtgtgagaagctgctgtgtgcctgtgaccagacagctgctgagtgcatgaccagcgccagcttcaaccagagcctgaagagccccagccggctgggctgccccggccagcctgctgcctgtgaggacagcctgcaccctgtgcctgctgcccccaccctgggcagcagcagcgaggaggacagcgaggaggaccccccccaggaggacctgggccgggccaagcgcttcctgaggaagagcctgggccccctgggcatcggccccctgcatggaagatag

SEQ ID NO: 6935 - DNA, 1359 bp, Artificial Sequence
  Description of Artificial Sequence: Synthetic coding sequence
atggagctggccctgcggcgcagccctgtgccccgctggctgctgctgctgcccctgctgctgggcctgaatgctggagctgtgattgactggcccacagaggagggcaaggaggtgtgggactatgtgacagtgaggaaggatgcctacatgttctggtggctgtactatgccaccaacagctgcaagaacttcagcgagctgcccctggtgatgtggctgcagggcggccctgggggcagcagcactggatttggaaactttgaggagatcggccccctggacagcgacctgaagcccaggaagaccacctggctgcaggccgccagcctgctgtttgtggacaaccctgtgggcaccggcttctcctatgtgaatggcagcggggcctatgccaaggacctggccatggtggccagtgacatgatggtgctgctgaagaccttcttcagctgccacaaggagttccagacagtgcccttctacatcttcagcgagagctatggaggcaagatggccgccggcatcggcctggagctgtacaaggccatccagaggggcaccatcaagtgcaactttgctggggtggccctgggggacagctggatcagccctgtggacagcgtgctgtcctggggcccctacctgtacagcatgagcctgctggaggacaagggcctggccgaggtgtccaaggtggccgagcaggtgctgaatgctgtgaacaagggcctgtaccgggaggccacagagctgtggggcaaggccgagatgatcatcgagcagaacacagatggagtgaacttctacaacatcctgaccaagagcacccccaccagcaccatggagagcagcctggagttcacccagagccacctggtgtgcctgtgccagagacatgtgcgccacctgcagagagatgccctgagccagctgatgaatggccccatcaggaagaagctgaagatcatccctgaggaccagagctggggcggccaggccaccaacgtgtttgtgaacatggaggaggacttcatgaagcctgtgatcagcatcgtggatgagctgctggaggccggcatcaacgtgacagtgtacaacggccagctggacctgattgtggacaccatgggccaggaggcctgggtgaggaagctgaagtggccagagctgcccaagttcagccagctgaagtggaaggccctgtacagcgaccccaagagcctggagaccagcgcctttgtgaagagctacaagaacctggccttctactggatcctgaaggccggccacatggtgcccagcgaccagggcgacatggccctgaagatgatgaggctggtgacccagcaggagtag

SEQ ID NO: 6936 - DNA, 1395 bp, Artificial Sequence
  Description of Artificial Sequence: Synthetic coding sequence
atggtgcggctggccgctgagctgctgctgctgctgggcctgctgctgctgaccctgcacatcaccgtgctgcggggcagcggggctgctgatggcccagatgctgctgctggaaatgccagccaggcccagctgcagaacaacctgaatgtgggcagtgacaccaccagcgagaccagcttcagcctgagcaaggaggccccccgggagcacctggaccaccaggccgcccaccagcccttcccccggccccgcttccggcaggagaccggccaccccagcctgcagagggacttccccaggagcttcctgctggacctgcccaacttcccagacctgagcaaggctgacatcaatggccagaaccccaacatccaggtgaccatcgaggtggtggatggcccagattctgaggccgacaaggaccagcaccctgagaacaagcccagctggagcgtgcccagcccagactggagggcctggtggcagaggagcctgagcctggcccgggccaacagcggggaccaggactacaagtatgacagcaccagtgatgacagcaacttcctgaaccccccccggggctgggaccacacagcccctggccacaggacctttgagaccaaggaccagccagaatatgacagcacagatggagagggggactggagcctgtggagcgtgtgcagcgtgacctgtggaaatggaaaccagaagaggaccaggagctgtggctacgcctgcacagccacagagagcaggacctgtgaccggcccaactgccccggcatcgaggacaccttcagaacagctgccacagaggtgtccctgctggccggcagcgaggagttcaatgccaccaagctgtttgaggtggacacagacagctgtgagcgctggatgagctgcaagtctgagttcctgaagaagtacatgcacaaggtgatgaatgacctgcccagctgcccctgcagctaccccacagaggtggcctacagcacagctgacatctttgaccgcatcaagaggaaggacttccgctggaaggatgccagcggccccaaggagaagctggagatctacaagcccacagcccgctactgcatccgctccatgctgagcctggagagcaccaccctggccgcccagcactgctgctatggagacaacatgcagctgatcacccggggcaagggggccggcacccccaacctgatcagcacagagttctctgctgagctgcactacaaggtggatgtgctgccctggatcatctgcaagggggactggagccgctacaatgaggcccggccccccaacaacggccagaagtgcacagagagccccagtgatgaggactacatcaagcagttccaggaggcccgggagtactag

SEQ ID NO: 6937 - DNA, 1536 bp, Artificial Sequence
  Description of Artificial Sequence: Synthetic coding sequence
atgctggtggatggccccagcgagaggcctgccctgtgcttcctgctgctggccgtggccatgtccttcttcggcagcgccctgagcattgatgagacccgggcccacctgctgctgaaggagaagatgatgaggctgggcggccgcctggtgctgaacaccaaggaggagctggccaatgaaaggctgatgaccctgaagattgctgagatgaaggaggccatgaggaccctcatcttccccccatccatgcacttcttccaggccaagcacctgattgaaagaagccaggtgttcaacatcctgaggatgatgcccaagggagctgccctgcacctgcatgacatcggcatcgtgaccatggactggctggtgagaaatgtgacctaccggccccactgccacatctgcttcaccccccggggcatcatgcagttccgctttgcccaccccaccccccggcccagcgagaagtgcagcaagtggatcctgctggaggactacaggaagagggtgcagaatgtgacagaatttgatgacagcctgctgaggaacttcaccctggtgacccagcaccctgaggtgatctacaccaaccagaatgtggtgtggagcaagtttgagaccatcttcttcaccatcagcggcctcatccactacgcccctgtgttccgggactatgtgttccgctccatgcaggagttctatgaagataatgtgctgtacatggagatccgggcccggctgctgcctgtgtatgagctgagcggggagcaccatgatgaggagtggagcgtgaagacctaccaggaggtggcccagaagtttgtggagacccaccctgagttcatcggcatcaagatcatctacagcgaccacaggagcaaggatgtggccgtgattgctgagagcatccgcatggccatgggcctgcgcatcaagttccccaccgtggtggccggctttgacctggtgggccacgaggacaccggccacagcctgcatgactacaaggaggccctgatgatcccagccaaggatggagtgaagctgccctacttcttccacgccggggagacagactggcagggcaccagcattgacaggaacatcctggatgccctgatgctgaacaccacccgcatcggccacggctttgccctgagcaagcaccctgctgtgaggacctacagctggaagaaggacatccccatcgaggtgtgccccatcagcaaccaggtgctgaagctggtgtctgacctgaggaaccaccctgtggccaccctgatggccaccggccaccccatggtgatcagcagtgatgatcctgccatgtttggagccaagggcctgtcctatgacttctatgaggtgttcatgggcatcggcggcatgaaggctgacctgcggaccctgaagcagctggccatgaacagcatcaagtacagcaccctgctggagagcgagaagaacaccttcatggagatctggaagaagcgctgggacaagttcatcgcagatgtggccaccaagtag

SEQ ID NO: 6938 - DNA, 777 bp, Artificial Sequence
  Description of Artificial Sequence: Synthetic coding sequence
atgaagcagatcctgcacccagccctggagaccacagccatgaccctcttccctgtgctgctcttcctggtggccggcctgctgcccagcttccctgccaatgaagacaaggaccctgccttcaccgccctgctgaccacccagacccaggtgcagcgggagatcgtgaacaagcacaatgagctgcggcgggctgtgagccccccagccaggaacatgctgaagatggagtggaacaaggaggccgccgccaatgcccagaagtgggccaaccagtgcaactaccgccacagcaaccccaaggacaggatgaccagcctgaagtgtggagaaaatctctacatgagcagcgccagcagctcctggagccaggccatccagagctggtttgatgagtacaatgactttgattttggagtgggccccaagaccccaaatgctgtggtgggccactacacccaggtggtgtggtacagcagctacctggtgggctgtggaaatgcctactgccccaaccagaaggtgctgaagtactactacgtgtgccagtactgcccagctggcaactgggccaaccggctgtatgtgccctatgagcagggcgccccctgtgccagctgcccagacaactgtgatgatggcctgtgcaccaacggctgcaagtatgaagatctctacagcaactgcaagagcctgaagctgaccctgacctgcaagcaccagctggtgcgggacagctgcaaggccagctgcaactgcagcaacagcatctactag

SEQ ID NO: 6939 - DNA, 714 bp, Artificial Sequence
  Description of Artificial Sequence: Synthetic coding sequence
atggtgaccccacctcctcctcctgtgttcagcctgctgaagatcagccagagaattgtgtgcctggtgctggacaagagcggctccatgggcggcaaggaccggctgaacaggatgaaccaggccgccaagcacttcctgctgcagacagtggagaatggctcctgggtgggcatggtgcactttgacagcacagccaccatcgtgaacaagctgatccagatcaagagcagtgatgaaagaaacaccctgatggccggcctgcccacctaccccctgggcggcaccagcatctgcagcggcatcaagtatgccttccaggtgattggagagctgcacagccagctggatggcagcgaggtgctgctgctgacagatggagaggacaacacagccagcagctgcattgatgaggtgaagcagagcggggccatcgtgcacttcatcgccctgggccgggctgctgatgaggccgtcatcgagatgagcaagatcaccggcggcagccacttctacgtgtctgatgaggcccagaacaacggcctgattgatgccttcggggccctgaccagcggcaacacagacctgagccagaagagcctgcaggtgcgggtgctgatcccctgggtgttcatgttcacctttgccaccaggaagaaccacctggtggtgatcagctttgagttccacatcttcctgaaggtgaacttctag

SEQ ID NO: 6940 - DNA, 459 bp, Artificial Sequence
  Description of Artificial Sequence: Synthetic coding sequence
atggacaacgtgcagcccaagatcaagcaccggcccttctgcttctctgtgaagggccacgtgaagatgctgcggctggccctgactgtgacctccatgaccttcttcatcatcgcccaggcccctgagccctacatcgtcatcactggatttgaggtgaccgtcatcctcttcttcatcctgctgtatgtgctgcggctggaccggctgatgaagtggctgttctggcccctgctggacatcatcaacagcctggtgaccaccgtcttcatgctgattgtgtctgtgctggccctgatccctgagaccaccaccctgactgtgggcggcggcgtgtttgccctggtgacagctgtgtgctgcctggctgatggagccctgatctacaggaagctgctcttcaaccccagcggcccctaccagaagaagcctgtgcatgagaagaaggaggtgctgtag

SEQ ID NO: 6941 - DNA, 3744 bp, Artificial Sequence
  Description of Artificial Sequence: Synthetic coding sequence
atgctggccagcagcagccgcatccgggccgcctggacccgggccctgctgctgcccctgctgctggccggccctgtgggctgcctgagccggcaggagctgttcccctttggacctggccagggcgacctggagctggaggatggagatgactttgtgtccccagccctggagctgagcggggccctgcgcttctatgacagaagtgacattgatgctgtgtatgtgaccaccaacggcatcatcgccaccagcgagcccccagccaaggagagccaccctggcctcttcccccccacctttggagctgtggcccccttcctggccgacctggacaccacagatggcctgggcaaggtgtactaccgggaggacctgagccccagcatcacccagagagctgctgaatgtgtgcaccggggcttccctgagatctccttccagcccagcagcgctgtggtggtgacctgggagagcgtggccccctaccagggccccagccgggaccctgaccagaagggcaagaggaacaccttccaggccgtgctggccagcagtgacagcagcagctatgccatcttcctgtacccagaagatggcctgcagttccacaccaccttcagcaagaaggagaacaaccaggtgcctgctgtggtggccttcagccagggctctgtgggcttcctgtggaagagcaatggagcctacaacatctttgccaatgaccgggagagcgtggagaacctggccaagagcagcaacagcggccagcagggcgtgtgggtgtttgaaattggcagccctgccaccaccaacggggtggtgcctgcagatgtgatcctgggcacagaagatggagcagaatatgatgatgaagatgaggactatgacctggccaccacccggctgggcctggaggatgtgggcaccacccccttctcctacaaggccctgcggcggggcggcgctgacacctacagcgtgcccagcgtgctgagccccaggagagctgccacagagcggcccctgggccccccaacagagaggaccaggagcttccagctggccgtggagaccttccaccagcagcacccccaggtgattgatgtggatgaggtggaggagaccggggtggtgttctcctacaacacagacagccggcagacctgtgccaacaacagacaccagtgcagcgtgcatgctgagtgccgggactatgccaccggcttctgctgcagctgtgtggccggctacacaggaaatggccggcagtgtgtggccgagggcagcccccagagggtgaatggcaaggtgaagggccgcatctttgtgggcagcagccaggtgcccatcgtgtttgagaacacagacctgcacagctatgtggtgatgaaccacggccgcagctacacagccatcagcaccatccctgagaccgtgggctacagcctgctgcccctggcccctgtgggcggcatcatcggctggatgtttgctgtggagcaggacggcttcaagaatggcttcagcatcaccggcggggagttcacccggcaggccgaggtgacctttgtgggccaccctggcaacctggtgatcaagcagcgcttcagcggcattgatgaacatggccacctgaccatcgacacagagctggagggccgggtgccccagatccccttcggcagctctgtgcacatcgagccctacacagagctgtaccactacagcaccagcgtcatcaccagcagcagcacccgggagtacacagtgacagagcctgagagagatggagccagccccagccgcatctacacctaccagtggaggcagaccatcaccttccaggagtgtgtgcatgatgacagcaggcctgccctgcccagcacccagcagctgtctgtggacagcgtgtttgtgctgtacaaccaggaggagaagatcctgcgctatgccctgagcaacagcatcggccctgtgcgggagggcagcccagatgccctgcagaacccctgctacatcggcacccacggctgtgacaccaatgctgcctgcaggcctggccccaggacccagttcacctgtgagtgcagcatcggcttcagaggagatggccgcacctgctatgacattgatgaatgttctgagcagcccagcgtgtgtggcagccacaccatctgcaacaaccaccctggcaccttccgctgtgaatgtgtggagggctaccagttcagtgatgagggcacctgtgtggccgtggtggaccagaggcccatcaactactgtgagaccggcctgcacaactgtgacatcccccagagggcccagtgcatctacacaggaggcagcagctacacctgcagctgcctgcccggcttctctggagatggccaggcctgccaggatgtggatgagtgccagcccagccgctgccacccagatgccttctgctacaacaccccaggcagcttcacctgccagtgcaagccaggctaccagggagatggcttccgctgtgtgcctggagaggtggagaagacccgctgccagcacgagcgggagcacatcctgggcgccgccggggccacagacccccagaggcccatccccccaggcctgtttgtgcctgaatgtgatgcccacggccactacgcccccacccagtgccacggcagcacaggctactgctggtgtgtggacagagatggccgggaggtggagggcaccaggaccaggcctggcatgaccccaccctgcctgagcacagtggccccacccatccaccagggccctgctgtgcccacagctgtgatccccctgcccccaggcacccacctgctgtttgcccagacaggcaagattgaaaggctgcccctggagggcaacaccatgaggaagacagaggccaaggccttcctgcacgtgcctgccaaggtgatcatcggcctggcctttgactgtgtggacaagatggtgtactggacagacatcacagagcccagcatcggccgggccagcctgcacggcggggagcccaccaccatcatccggcaggacctgggcagccctgagggcattgctgtggaccacctgggcaggaacatcttctggacagacagcaacctggacagaattgaggtggccaagctggatggcacccagaggagagtgctgtttgaaacagacctggtgaacccccggggcatcgtgacagattctgtgcggggcaacctgtactggacagactggaacagagacaaccccaagattgagaccagctacatggatggcaccaacagacgcatcctggtgcaggatgacctgggcctgcccaacggcctgacctttgatgccttcagcagccagctgtgctgggtggatgctggcaccaacagagctgagtgcctgaaccccagccagcccagcaggaggaaggccctggagggcctgcagtacccctttgctgtgaccagctatggcaagaacctgtacttcacagactggaagatgaacagcgtggtggccctggacctggccatcagcaaggagacagatgccttccagccccacaagcagacccggctgtatggcatcaccacagccctgagccagtgcccccagggccacaactactgcagcgtgaacaacggcggctgcacccacctgtgcctggccaccccaggcagcaggacctgccgctgcccagacaacaccctgggcgtggactgcatcgagcagaagtag

SEQ ID NO: 6942 - DNA, 525 bp, Artificial Sequence
  Description of Artificial Sequence: Synthetic coding sequence
atgctgaggacagagagctgccggcccaggagccctgctggccaggtggccgccgccagccccctgctgctgctgctgctgctgctggcctggtgtgccggggcctgccgcggggcccccatcctgccccagggcctgcagcctgagcagcagctgcagctgtggaatgaaattgatgacacctgcagcagcttcctgagcattgacagccagccccaggccagcaatgccctggaggagctgtgcttcatgatcatgggcatgctgcccaagccccaggagcaggatgagaaggacaacaccaagcgcttcctgttccactacagcaagacccagaagctgggcaagagcaatgtggtgtcctctgtggtgcaccccctgctgcagctggtgccccacctgcatgaaagaaggatgaagcgcttccgggtggatgaggagttccagagcccctttgccagccagagccggggctacttcctgttccggcccagaaatggccgccgctctgctggcttcatctag

SEQ ID NO: 6943 - DNA, 1218 bp, Artificial Sequence
  Description of Artificial Sequence: Synthetic coding sequence
atggacaccatcttcctgtggagcctgctgctgctcttcttcggcagccaggccagccgctgcagcgcccagaagaacacagaatttgctgtggacctgtaccaggaggtgtccctgagccacaaggacaacatcatcttcagccccctgggcatcaccctggtgctggagatggtgcagctgggcgccaagggcaaggcccagcagcagatccggcagaccctgaagcagcaggagaccagcgctggggaggagttctttgtgctgaagagcttcttcagcgccatcagcgagaagaagcaggagttcaccttcaacctggccaatgccctgtacctgcaggagggcttcaccgtgaaggagcagtacctgcacggcaacaaggagttcttccagagcgccatcaagctggtggacttccaggatgccaaggcctgtgccgagatgatcagcacctgggtggagaggaagacagatggcaagatcaaggacatgttttctggagaggagtttggccccctgacccggctggtgctggtgaatgccatctacttcaagggggactggaagcagaagttcaggaaggaggacacccagctgatcaacttcaccaagaagaatggcagcacagtgaagatccccatgatgaaggccctgctgcggaccaagtatggctacttcagcgagagcagcctgaactaccaggtgctggagctgagctacaagggagatgagttcagcctcatcatcatcctgcctgctgagggcatggacatcgaggaggtggagaagctgatcacagcccagcagatcctgaagtggctgtctgagatgcaggaggaggaggtggagatcagcctgccccgcttcaaggtggagcagaaggtggacttcaaggatgtgctgtacagcctgaacatcacagagatcttcagcggcggctgtgacctgagcggcatcacagacagcagcgaggtgtatgtgtcccaggtgacccagaaggtgttctttgagatcaatgaagatggcagcgaggccgccaccagcacaggcatccacatccctgtgatcatgagcctggcccagagccagttcatcgccaaccaccccttcctgttcatcatgaagcacaaccccacagagagcatcctcttcatgggccgggtgaccaacccagacacccaggagatcaagggccgggacctggacagcctgtag

SEQ ID NO: 6944 - DNA, 3687 bp, Artificial Sequence
  Description of Artificial Sequence: Synthetic coding sequence
atgaagggggcccggctgtttgtgctgctgagcagcctgtggagcggcggcatcggcctgaacaacagcaagcacagctggaccatcccagaagatggcaacagccagaagaccatgcccagcgcctctgtgccccccaacaagatccagagcctgcagatcctgcccaccaccagggtgatgtctgctgagatcgccaccaccccagaggcccggaccagcgaggacagcctgctgaagagcaccctgccccccagcgagaccagcgccccagctgagggcgtgaggaaccagaccctgaccagcacagagaaggccgagggcgtggtgaagctgcagaacctgaccctgcccaccaatgccagcatcaagttcaaccctggagctgagagcgtggtgctgagcaacagcaccctgaagttcctgcagagctttgccaggaagagcaatgagcaggccaccagcctgaacacagtgggcggcaccggcggcattggaggagtgggcggcactggaggagtgggcaacagagccccccgggagacctacctgagcagaggagacagcagcagcagccagaggacagactaccagaagagcaactttgagaccacccggggcaagaactggtgtgcctacgtgcacacccggctgagccccaccgtcatcctggacaaccaggtgacctacgtgcctgggggcaagggcccctgtggctggacaggaggcagctgcccccagaggagccagaagatcagcaaccctgtgtacaggatgcagcacaagatcgtgaccagcctggactggcgctgctgccccggctacagcggccccaagtgccagctgcgggcccaggagcagcagagcctcatccacaccaaccaggccgagagccacacagctgtgggccggggcgtggccgagcagcagcagcagcagggctgtggggaccctgaggtgatgcagaagatgacagaccaggtgaactaccaggccatgaagctgaccctgctgcagaagaagattgacaacatcagcctgactgtgaatgatgtgaggaacacctacagcagcctggagggcaaggtgtctgaggacaagagccgggagttccagagcctgctgaagggcctgaagagcaagagcatcaacgtgctgatccgggacatcgtgcgggagcagttcaagatcttccagaatgacatgcaggagaccgtggcccagctgttcaagacagtgagcagcctgtctgaggacctggagagcacccggcagatcatccagaaggtgaatgaatctgtggtgtccattgctgcccagcagaagtttgtgctggtgcaggagaaccggcccaccctgacagacatcgtggagctgaggaaccacatcgtgaatgtgcggcaggagatgaccctgacctgtgagaagcccatcaaggagctggaggtgaagcagacccacctggagggcgccctggagcaggagcacagccgcagcatcctgtactatgagagcctgaacaagaccctgagcaagctgaaggaggtgcatgagcagctgctgagcacagagcaggtgtctgaccagaagaatgccccagctgctgagagcgtgagcaacaacgtgacagagtacatgagcaccctgcacgagaacatcaagaagcagagcctgatgatgctgcagatgtttgaggacctgcacatccaggagagcaagatcaacaacctgactgtgtccctggagatggagaaggagagcctgcggggagaatgtgaggacatgctgagcaagtgcagaaatgacttcaagttccagctgaaggacacagaggagaacctgcacgtgctgaaccagaccctggccgaggtgctcttccccatggacaacaagatggacaagatgtctgagcagctgaatgacctgacctatgacatggagatcctgcagcccctgctggagcagggcgccagcctgcggcagaccatgacctatgagcagcccaaggaggccatcgtcatcaggaagaagattgagaacctgaccagcgctgtgaacagcctgaacttcatcatcaaggagctgaccaagaggcacaacctgctgagaaatgaggtgcagggcagagatgatgccctggagcggcgcatcaatgaatatgccctggagatggaggatggcctgaacaagaccatgaccatcatcaacaatgccatcgacttcatccaggacaactatgccctgaaggagaccctgagcaccatcaaggacaacagcgagatccaccacaagtgcaccagtgacatggagaccatcctgaccttcatcccccagttccaccggctgaatgacagcatccagaccctggtgaatgacaaccagcgctacaactttgtgctgcaggtggccaagaccctggccggcatccccagagatgagaagctgaaccagagcaacttccagaagatgtaccagatgtttaatgagaccaccagccaggtgaggaagtaccagcagaacatgagccacctggaggagaagctgctgctgaccaccaagatcagcaagaactttgagacccggctgcaggacatcgagagcaaggtgacccagaccctcatcccctactacatctctgtgaagaagggctctgtggtgaccaatgaaagagaccaggccctgcagctgcaggtgctgaacagccgcttcaaggccctggaggccaagagcatccacctgagcatcaacttcttcagcctgaacaagaccctgcacgaggtgctgaccatgtgccacaatgccagcacctctgtgtctgagctgaatgccaccatccccaagtggatcaagcacagcctgcctgacatccagctgctgcagaagggcctgacagaatttgtggagcccatcatccagatcaagacccaggccgccctgagcaacctgacctgctgcatcgacaggagcctgcccggcagcctggccaacgtggtgaagagccagaagcaggtgaagagcctgcccaagaagatcaatgccctgaagaagcccaccgtgaacctgaccaccgtgctgattggccgcacccagaggaacacagacaacatcatctacccagaggagtacagcagctgcagccgccacccctgccagaatggaggcacctgcatcaatggccgcaccagcttcacctgtgcctgccgccaccccttcaccggggacaactgcaccatcaagctggtggaggagaatgccctggccccagacttcagcaagggcagctaccgctatgcccccatggtggccttctttgccagccacacctacggcatgaccatccctggccccatcctcttcaacaacctggatgtgaactacggggccagctacacccccaggacaggcaagttccgcatcccctacctgggcgtgtatgtgttcaagtacaccatcgagagcttcagcgcccacatcagcggcttcctggtggtggatggcatcgacaagctggcctttgaaagtgagaacatcaacagcgagatccactgtgacagagtgctgactggagatgccctgctggagctgaactacggccaggaggtgtggctgcggctggccaagggcaccatcccagccaagtttcctcctgtgaccaccttcagcggctacctgctgtaccgcacctag

SEQ ID NO: 6945 - DNA, 1365 bp, Artificial Sequence
  Description of Artificial Sequence: Synthetic coding sequence
atgtggcccctgactgtgcccccacccctgctgctgctgctgtgcagcggcctggccggccagaccctcttccagaaccctgaggagggctggcagctgtacaccagcgcccaggccccagatggcaagtgcatctgcacagctgtgatcccagcccagagcacctgcagcagagatggccgcagccgggagctgcggcagctgatggagaaggtgcagaatgtgtcccagagcatggaggtgctggagctgcggacctacagagacctgcagtatgtgcggggcatggagaccctgatgaggagcctggatgcccggctgcgggcagcagatggcagcctgagcgccaagagcttccaggagctgaaggacaggatgacagagctgctgcccctgagctctgtgctggagcagtacaaggctgacaccaggaccatcgtgcggctgcgggaggaggtgaggaacctgagcggcagcctggccgccatccaggaggagatgggcgcctacggctatgaggacctgcagcagagggtgatggccctggaggcccggctgcacgcctgtgcccagaagctgggctgcggcaagctgactggagtgagcaaccccatcaccgtgcgggccatgggcagccgcttcggctcctggatgacagacaccatggcccccagcgctgacagccgggtgtggtacatggatggctactacaagggccggcgggtgctggagttccgcaccctgggggacttcatcaagggccagaacttcatccagcacctgctgccccagccctgggccggcactggacatgtggtgtacaacggcagcctcttctacaacaagtaccagagcaatgtggtggtgaagtaccacttccgcagccgctctgtgctggtgcagaggagcctgcctggagctggctacaacaacaccttcccctacagctggggcggcttcagtgacatggacttcatggtggatgagagcggcctgtgggccgtgtacaccaccaaccagaatgccggcaacatcgtggtgtcccggctggacccccacaccctggaggtgatgaggtcctgggacaccggctaccccaagaggtctgctggggaggccttcatgatctgtggggtgctgtatgtgaccaacagccacctggccggggccaaggtgtactttgcctacttcaccaacaccagcagctatgagtacacagatgtgcccttccacaaccagtacagccacatctccatgctggactacaacccccgggagcgggccctgtacacctggaacaacggccaccaggtgctgtacaacgtgaccctcttccacgtgatcagcaccagcggggacccctag

SEQ ID NO: 6946 - DNA, 909 bp, Artificial Sequence
  Description of Artificial Sequence: Synthetic coding sequence
atgtgtgccgagcggctgggccagttcatgaccctggccctggtgctggccacctttgatcctgcccggggcacagatgccaccaaccccccagagggcccccaggacaggagcagccagcagaagggccgcctgagcctgcagaacacagctgagatccagcactgcctggtgaatgctggagatgtgggctgtggggtgtttgaatgttttgagaacaacagctgtgagatccggggcctgcacggcatctgcatgaccttcctgcacaatgctgggaagtttgatgcccagggcaagagcttcatcaaggatgccctgaagtgcaaggcccacgccctgcggcaccgcttcggctgcatcagcaggaagtgcccagccatccgggagatggtgtcccagctgcagcgggagtgctacctgaagcatgacctgtgtgccgccgcccaggagaacaccagggtcatcgtggagatgatccacttcaaggacctgctgctgcacgagccctacgtggacctggtgaacctgctgctgacctgtggggaggaggtgaaggaggccatcacccacagcgtgcaggtgcagtgtgagcagaactggggcagcctgtgcagcatcctgtccttctgcaccagcgccatccagaagccacccacagcccctcctgagcggcagccccaggtggacaggaccaagctgagccgggcccaccacggggaggccggccaccacctgcctgagcccagcagccgggagaccggccgcggggccaagggggagcggggcagcaagagccaccccaatgcccacgcccggggccgggtgggcggcctgggcgcccagggccccagcggcagcagcgagtgggaggatgagcagagcgagtacagcgacatcagaagatag

SEQ ID NO: 6947 - DNA, 2529 bp, Artificial Sequence
  Description of Artificial Sequence: Synthetic coding sequence
atgaagccaggcggcttctggctgcacctgaccctgctgggcgccagcctgcctgctgccctgggctggatggaccccggcaccagccggggcccagatgtgggcgtgggggagagccaggccgaggagcccaggagctttgaggtgacccggcgggagggcctgagcagccacaatgagctgctggccagctgtgggaagaagttctgcagccggggcagccgctgtgtgctgagcaggaagacaggagagcctgagtgccagtgcctggaggcctgccggcccagctatgtgcctgtgtgtggcagtgatggccgcttctatgagaaccactgcaagctgcacagagctgcctgcctgctgggcaagaggatcaccgtcatccacagcaaggactgcttcctgaagggggacacctgcaccatggccggctacgcccggctgaagaatgtgctgctggccctgcagacccggctgcagcccctgcaggagggggacagccggcaggaccctgccagccagaagaggctgctggtggagagcctcttccgggacctggatgctgatggaaatggccacctgagcagcagcgagctggcccagcacgtgctgaagaagcaggacctggatgaggacctgctgggctgcagccctggggacctgctgcgctttgatgactacaacagcgacagcagcctgaccctgcgggagttctacatggccttccaggtggtgcagctgagcctggcccctgaggacagagtgtctgtgaccaccgtgacagtgggcctgagcacagtgctgacctgtgctgtgcatggagacctgcggccccccatcatctggaagagaaatggcctgaccctgaacttcctggacctggaggacatcaatgactttggagaagatgacagcctgtacatcaccaaggtgaccaccatccacatgggcaactacacctgccacgccagcggccacgagcagctgttccagacccacgtgctgcaggtgaatgtgccccctgtgatccgggtgtacccagagagccaggcccaggagcccggggtggccgccagcctgcgctgccacgccgagggcatccccatgccccgcatcacctggctgaagaatggagtggatgtgtccacccagatgagcaagcagctgagcctgctggccaacggcagcgagctgcacatcagctctgtgcgctatgaggacaccggggcctacacctgcatcgccaagaatgaggtgggcgtggatgaggacatcagcagcctcttcattgaagattctgccaggaagaccctggccaacatcctgtggagggaggagggcctgtctgtgggcaacatgttttatgtgttcagtgatgatggcatcatcgtcatccaccctgtggactgtgagatccagaggcacctgaagcccacagagaagatcttcatgtcctatgaggagatctgcccccagcgggagaagaatgccacccagccctgccagtgggtgtctgctgtgaatgtgaggaaccgctacatctacgtggcccagcctgccctgagccgggtgctggtggtggacatccaggcccagaaggtgctgcagagcattggagtggaccccctgcctgccaagctgtcctatgacaagagccatgaccaggtgtgggtgctgtcctggggagatgtgcacaagagccggcccagcctgcaggtgatcacagaggccagcacaggccagagccagcacctgatccgcaccccatttgctggggtggatgacttcttcatcccccccaccaacctgatcatcaaccacatccgcttcggcttcatcttcaacaagagtgaccctgctgtgcacaaggtggacctggagaccatgatgcccctgaagaccatcggcctgcaccaccacggctgtgtgccccaggccatggcccacacccacctgggcggctacttcttcatccagtgccggcaggacagccctgccagcgctgcccggcagctgctggtggacagcgtgacagacagcgtgctgggccccaatggagatgtgacaggcaccccccacaccagcccagatggccgcttcatcgtgtctgctgctgctgacagcccctggctgcacgtgcaggagatcaccgtgcggggggagatccagaccctgtatgacctgcagatcaacagcggcatcagtgacctggccttccagaggagcttcacagagagcaaccagtacaacatctatgctgccctgcacacagagccagacctgctcttcctggagctgagcacaggcaaggtgggcatgctgaagaacctgaaggagcccccagctggccctgcccagccctggggcggcacccaccgcatcatgagggacagcggcctgtttggccagtacctgctgaccccagcccgggagagcctcttcctgatcaatggccggcagaacaccctgcgctgtgaggtgtctggcatcaagggcggcaccaccgtggtgtgggtgggggaggtgtag

SEQ ID NO: 6948 - DNA, 2256 bp, Artificial Sequence
  Description of Artificial Sequence: Synthetic coding sequence
atggccttccgcaccatctgtgtgctggtgggcgtcttcatctgcagcatctgtgtgaagggcagcagccagccccaggcccgggtgtacctgacctttgatgagctgcgggagaccaagaccagcgagtacttcagcctgagccaccaccccctggactaccgcatcctgctgatggatgaggaccaggaccgcatctacgtgggcagcaaggaccacatcctgagcctgaacatcaacaacatcagccaggaggccctgagcgtcttctggccagccagcaccatcaaggtggaggagtgcaagatggccggcaaggaccccacccacggctgcggcaactttgtgcgggtcatccagaccttcaacagaacccacctgtatgtgtgtggcagcggggccttcagccctgtgtgcacctacctgaacagaggccgccgctctgaggaccaggtgttcatgattgacagcaaatgtgagagcggcaagggccgctgcagcttcaaccccaacgtgaacacagtgtctgtgatgatcaatgaggagctgttcagcggcatgtacatcgacttcatgggcacagatgctgccatcttccgcagcctgaccaagagaaatgctgtgaggacagaccagcacaacagcaagtggctgtctgagcccatgtttgtggatgcccacgtgatcccagatggaacagaccccaatgatgccaaggtgtacttcttcttcaaggagaagctgacagacaacaacagaagcaccaagcagatccacagcatgattgcccgcatctgccccaatgacaccggcggcctgcggagcctggtgaacaagtggaccaccttcctgaaggcccggctggtgtgcagcgtgacagatgaagatggccctgagacccactttgatgagctggaggatgtgttcctgctggagacagacaaccccaggaccaccctggtgtatggcatcttcaccaccagcagcagcgtcttcaagggcagcgctgtgtgtgtgtaccacctgagtgacatccagacagtgttcaacggcccctttgcccacaaggagggccccaaccaccagctgatctcctaccagggccgcatcccctaccccaggcctggcacctgccctggaggagccttcacccccaacatgaggaccaccaaggagttcccagatgatgtggtgaccttcatccggaaccaccccctgatgtacaacagcatctaccccatccacaagaggcccctcatcgtgagaattggaacagactacaagtacaccaagattgctgtggacagagtgaatgctgctgatggccgctaccacgtgctcttcctgggcacagaccggggcaccgtgcagaaggtggtggtgctgcccaccaacaacagcgtgtctggagagctgatcctggaggagctggaggtgttcaagaaccacgcccccatcaccaccatgaagatcagcagcaagaagcagcagctgtatgtgagcagcaatgaaggagtgtcccaggtgtccctgcaccgctgccacatctatggaacagcctgtgccgactgctgcctggcccgggacccctactgtgcctgggatggccacagctgcagccgcttctaccccaccgggaagaggaggagccggcggcaggatgtgagacatggcaaccccctgacccagtgccggggcttcaacctgaaggcctacagaaatgctgctgagatcgtgcagtatggagtgaagaacaacaccaccttcctggagtgtgcccccaagagcccccaggccagcatcaagtggctgctgcagaaggacaaggacaggaggaaggaggtgaagctgaatgaaagaatcatcgccaccagccagggcctgctgatccgctctgtgcagggcagtgaccagggcctgtaccactgcatcgccacagaaaattccttcaagcagaccatcgccaagatcaacttcaaggtgctggacagcgagatggtggccgtggtgacagacaagtggagcccctggacctgggccagctctgtgcgggccctgcccttccaccccaaggacatcatgggcgccttcagccacagcgagatgcagatgatcaaccagtactgcaaggacacccggcagcagcaccagcagggagatgagagccagaagatgagaggagactatggcaagctgaaggccctgatcaacagcaggaagagcaggaacagaagaaaccagctgcctgagagctag

SEQ ID NO: 6949 - DNA, 2316 bp, Artificial Sequence
  Description of Artificial Sequence: Synthetic coding sequence
atgggctggctgaccagaattgtgtgcctcttctggggcgtgctgctgacagcccgggccaactaccagaatggcaagaacaacgtgccccggctgaagctgagctacaaggagatgctggagagcaacaacgtcatcaccttcaacggcctggccaacagcagcagctaccacaccttcctgctggatgaggagaggagccggctgtatgtgggcgccaaggaccacatcttctcctttgacctggtgaacatcaaggacttccagaagatcgtgtggcctgtgtcctacaccaggagagatgagtgcaagtgggccggcaaggacatcctgaaggaatgtgccaacttcatcaaggtgctgaaggcctacaaccagacccacctgtatgcctgtggcaccggggccttccaccccatctgcacctacatcgagatcggccaccaccctgaggacaacatcttcaagctggagaacagccactttgaaaatggccggggcaagagcccctatgaccccaagctgctgacagccagcctgctgattgatggagagctgtacagcggcacagctgctgacttcatgggccgggactttgccatcttccgcaccctgggccaccaccaccccatcagaacagagcagcacgacagccgctggctgaatgaccccaagttcatcagcgcccacctgatcagcgagagtgacaacccagaagatgacaaggtgtacttcttcttcagagaaaatgccattgatggagagcacagcggcaaggccacccacgccagaattggccagatctgcaagaatgactttggaggccacaggagcctggtgaacaagtggaccaccttcctgaaggcccggctcatctgcagcgtgcccggccccaatggaattgacacccactttgatgagctgcaggatgtgttcctgatgaacttcaaggaccccaagaaccctgtggtgtatggagtcttcaccaccagcagcaacatcttcaagggcagcgctgtgtgcatgtacagcatgtctgatgtgagaagagtcttcctgggcccctatgcccacagagatggccccaactaccagtgggtgccctaccagggccgggtgccctacccccggcccggcacctgccccagcaagaccttcggcggctttgacagcaccaaggacctgcctgatgatgtgatcacctttgcccggagccacccagccatgtacaaccctgtgttccccatgaacaaccggcccatcgtcatcaagacagatgtgaactaccagttcacccagatcgtggtggacagagtggatgctgaagatggccagtatgatgtgatgtttattggaacagatgtgggcaccgtgctgaaggtggtgtccatccccaaggagacctggtatgacctggaggaggtgctgctggaggagatgacagtgttccgggagcccacagccatcagcgccatggagctgagcaccaagcagcagcagctgtacatcggcagcacagctggggtggcccagctgcccctgcaccgctgtgacatctacggcaaggcctgtgccgagtgctgcctggcccgggacccctactgtgcctgggatggcagcgcctgcagccgctacttccccacagccaagaggaggacccggcggcaggacatcagaaatggagaccccctgacccactgcagcgacctgcaccacgacaaccaccacggccacagccctgaggagcgcatcatctacggcgtggagaacagcagcaccttcctggagtgcagccccaagagccagagggccctggtgtactggcagttccagaggagaaatgaggagaggaaggaggagatccgggtggatgaccacatcatcagaacagaccagggcctgctgctgcggagcctgcagcagaaggacagcggcaactacctgtgccacgctgtggagcacggcttcatccagaccctgctgaaggtgaccctggaggtgattgacacagagcacctggaggagctgctgcacaaggatgatgatggagatggcagcaagaccaaggagatgagcaacagcatgacccccagccagaaggtgtggtacagagacttcatgcagctgatcaaccaccccaacctgaacaccatggatgagttctgtgagcaggtgtggaagagggacaggaagcagaggcggcagaggcctggccacaccccaggcaacagcaacaagtggaagcacctgcaggagaacaagaagggcaggaacagaaggacccatgaatttgagcgggcccccaggtctgtgtag

SEQ ID NO: 6950 - DNA, 4605 bp, Artificial Sequence
  Description of Artificial Sequence: Synthetic coding sequence
atggccctgaccccaggctggggcagcagcgctggccctgtgcggcctgagctgtggctgctgctgtgggccgccgcctggaggctgggcgccagcgcctgcccagccctgtgcacctgcaccggcaccaccgtggactgccacggcaccggcctgcaggccatccccaagaacatccccaggaacacagagcggctggagctgaatggaaacaacatcacccgcatccacaagaatgactttgctggcctgaagcagctgcgggtgctgcagctgatggagaaccagattggagctgtggagcggggggcctttgatgacatgaaggagctggagcggctgcggctgaacagaaaccagctgcacatgctgcctgagctgctcttccagaacaaccaggccctgagccggctggacctgtctgaaaatgccatccaggccatccccaggaaggccttccggggggccacagacctgaagaacctgcagctggacaagaaccagatcagctgcatcgaggagggcgccttccgggccctgcggggcctggaggtgctgaccctgaacaacaacaacatcaccaccatccctgtgagcagcttcaaccacatgcccaagctgcggaccttccggctgcacagcaaccacctgttctgtgactgccacctggcctggctgagccagtggctgcggcagaggcccaccatcggcctcttcacccagtgcagcggccctgccagcctgcggggcctgaatgtggccgaggtgcagaagtctgagttcagctgcagcggccagggcgaggccggccgggtgcccacctgcaccctgagcagcggcagctgcccagccatgtgcacctgcagcaatggcatcgtggactgccggggcaagggcctgacagccatcccagccaacctgcctgagaccatgacagagatccggctggagctgaatggcatcaagagcatccccccaggggccttcagcccctacaggaagctgcggagaattgacctgagcaacaaccagattgctgagatcgccccagatgccttccagggcctgcggagcctgaacagcctggtgctgtatggcaacaagatcacagacctgccccggggcgtgtttggaggcctgtacaccctgcagctgctgctgctgaatgccaacaagatcaactgcatccggccagatgccttccaggacctgcagaacctgagcctgctgagcctgtatgacaacaagatccagagcctggccaagggcaccttcaccagcctgcgggccatccagaccctgcacctggcccagaaccccttcatctgtgactgcaacctgaagtggctggccgacttcctgcggaccaaccccatcgagaccagcggggcccgctgtgccagcccccggcggctggccaacaagagaattggccagatcaagagcaagaagttccgctgcagcgccaaggagcagtacttcatccctggaacagaggactaccagctgaacagcgagtgcaacagtgatgtggtgtgcccccacaagtgccgctgtgaggccaacgtggtggagtgcagcagcctgaagctgaccaagatccctgagcgcatcccccagagcacagctgagctgcggctgaacaacaatgagatcagcatcctggaggccaccggcatgttcaagaagctgacccacctgaagaagatcaacctgagcaacaacaaggtgtctgaaattgaagatggagcctttgaaggagctgcctctgtgtctgagctgcacctgacagccaaccagctggagagcatccgcagcggcatgttccggggcctggatggcctgcggaccctgatgctgaggaacaaccgcatcagctgcatccacaatgacagcttcaccggcctgagaaatgtgcggctgctgagcctgtatgacaaccagatcaccaccgtgtcccctggggcctttgacaccctgcagagcctgagcaccctgaacctgctggccaaccccttcaactgcaactgccagctggcctggctgggcggctggctgaggaagaggaagatcgtgactggaaacccccgctgccagaacccagacttcctgcggcagatccccctgcaggatgtggccttcccagacttccgctgtgaggagggccaggaggagggcggctgcctgccccggccccagtgcccccaggagtgtgcctgcctggacacagtggtgcgctgcagcaacaagcacctgcgggccctgcccaagggcatccccaagaatgtgacagagctgtacctggatggcaaccagttcaccctggtgcccggccagctgagcaccttcaagtacctgcagctggtggacctgagcaacaacaagatcagcagcctgagcaacagcagcttcaccaacatgagccagctgaccaccctcatcctgagctacaatgccctgcagtgcatcccccccctggccttccagggcctgcggagcctgcggctgctgagcctgcacggcaatgacatcagcaccctgcaggagggcatctttgctgatgtgaccagcctgagccacctggccatcggggccaaccccctgtactgtgactgccacctgcgctggctgagctcctgggtgaagacaggctacaaggagcccggcatcgcccgctgtgccggcccccaggacatggagggcaagctgctgctgaccaccccagccaagaagtttgagtgccagggcccccccaccctggccgtgcaggccaagtgtgacctgtgcctgagcagcccctgccagaaccagggcacctgccacaatgaccccctggaggtgtaccgctgtgcctgccccagcggctacaagggccgggactgtgaggtgtccctggacagctgcagcagcggcccctgtgaaaatggaggcacctgccacgcccaggagggagaagatgcccccttcacctgcagctgccccactggatttgagggccccacctgtggggtgaacacagatgactgtgtggaccacgcctgtgccaacggcggcgtgtgtgtggatggagtgggcaactacacctgccagtgccccctgcagtatgagggcaaggcctgtgagcagctggtggacctgtgcagcccagacctgaacccctgccagcacgaggcccagtgtgtgggcaccccagatggcccccgctgtgagtgcatgcctggctacgccggggacaactgcagcgagaaccaggatgactgccgggaccaccgctgccagaatggagcccagtgcatggatgaggtgaacagctacagctgcctgtgtgccgagggctacagcggccagctgtgtgagatccccccccacctgcctgcccccaagagcccctgtgagggcacagagtgccagaatggagccaactgtgtggaccagggcaacagacctgtgtgccagtgcctgcccggctttggaggcccagaatgtgagaagctgctgtctgtgaactttgtggaccgggacacctacctgcagttcacagacctgcagaactggccccgggccaacatcaccctgcaggtgtccacagctgaggacaatggcatcctgctgtacaacggggacaatgaccacatcgctgtggagctgtaccagggccacgtgcgggtgtcctatgaccccggcagctaccccagcagcgccatctacagcgctgagaccatcaatgatggccagttccacacagtggagctggtggcctttgaccagatggtgaacctgagcattgatggcggcagccccatgaccatggacaactttgggaagcactacaccctgaacagcgaggcccccctgtatgtgggcggcatgcctgtggatgtgaacagcgctgccttccggctgtggcagatcctgaatggcaccggcttccacggctgcatccggaacctgtacatcaacaatgagctgcaggacttcaccaagacccagatgaagccaggagtggtgcccggctgtgagccctgcaggaagctgtactgcctgcacggcatctgccagcccaatgccaccccaggccccatgtgccactgtgaggccggctgggtgggcctgcactgtgaccagcctgcagatggcccctgccacggccacaagtgtgtgcacggccagtgtgtgcccctggatgccctgagctacagctgccagtgccaggacggctacagcggggccctgtgcaaccaggccggggccctggccgagccctgccggggcctgcagtgcctgcacggccactgccaggccagcggcaccaagggggcccactgtgtgtgtgaccccggcttctctggagagctgtgtgagcaggagagcgagtgccgcggggaccctgtgcgggacttccaccaggtgcagaggggctacgccatctgccagaccacccggcccctgtcctgggtggagtgccggggcagctgccccggccagggctgctgccagggcctgcggctgaagaggaggaagttcacctttgaatgttctgatggcaccagctttgctgaggaggtggagaagcccaccaagtgtggctgtgccctgtgtgcctag

SEQ ID NO: 6951 - DNA, 342 bp, Artificial Sequence
  Description of Artificial Sequence: Synthetic coding sequence
atggacagccggcaggccgccgccctgctggtgctgctgctgctgattgatggcggctgtgccgagggccctgggggccagcaggaggaccagctgtctgctgaggaggacagcgagcccctgcccccccaggatgcccagaccagcggcagcctgctgcactacctgctgcaggccatggagaggcctggccgcagccaggccttcctgttccagccccagcgcttcggcaggaacacccagggctcctggagaaatgagtggctgagccccagggctggggagggcctgaacagccagttctggagcctggccgccccccagagatttgggaagaagtag

SEQ ID NO: 6952 - DNA, 2568 bp, Artificial Sequence
  Description of Artificial Sequence: Synthetic coding sequence
atggcccggcacctgctgctgcccctggtgatgctggtgatcagccccatccctggggccttccaggacagcgccctgagccccacccaggaggagcctgaggacctggactgtggccggcctgagcccagcgccagaattgtgggcggcagcaatgcccagcccggcacctggccctggcaggtgtccctgcaccacggcggcggccacatctgtggcggcagcctgattgcccccagctgggtgctgtctgctgcccactgcttcatgaccaacggcaccctggagcctgctgctgagtggagcgtgctgctgggcgtgcacagccaggacggccccctggatggagcccacaccagggctgtggccgccatcgtggtgcctgccaactacagccaggtggagctgggcgctgacctggccctgctgcggctggccagccctgccagcctgggccctgctgtgtggcctgtgtgcctgccccgggccagccacagatttgtgcatggaacagcctgctgggccaccggctggggagatgtgcaggaggccgaccccctgcccctgccctgggtgctgcaggaggtggagctgcggctgctgggggaggccacctgccagtgcctgtacagccagcccggccccttcaacctgaccctgcagatcctgcccggcatgctgtgtgccggctacccagagggcagaagagacacctgccagggcgacagcggcggccccctggtgtgtgaggagggcggccgctggttccaggccggcatcaccagctttggatttggctgcggcagaagaaacagacctggggtcttcaccgctgtggccacctatgaggcctggatccgggagcaggtgatgggcagcgagcccggccctgccttccccacccagccccagaagacccagagcgacccccaggagccccgggaggagaactgcaccatcgccctgcctgaatgtgggaaggcccccaggcctggggcctggccctgggaggcccaggtgatggtgcccggcagccggccctgccacggggccctggtgtctgagagctgggtgctggccccagccagctgcttcctggaccccaacagcagtgacagccccccccgggacctggatgcctggagggtgctgctgcccagccggcccagggctgagcgggtggcccggctggtgcagcatgaaaatgcctcctgggacaatgccagtgacctggccctgctgcagctgcggacccctgtgaacctgtctgctgccagcaggcctgtgtgcctgccccaccctgagcactacttcctgcccggcagccgctgccgcctggcccgctggggccgcggggagcccgccctgggccctggggccctgctggaggccgagctgctgggcggctggtggtgccactgcctgtatggccggcagggcgctgctgtgcccctgcccggggacccccctcatgccctgtgcccagcctaccaggagaaggaggaggtgggcagctgctggaatgacagccgctggagcctgctgtgccaggaggagggcacctggttcctggccggcatccgggacttccccagcggctgcctgcggccccgggccttcttccccctgcagacccacggcccctggatcagccacgtgaccaggggggcctacctggaggaccagctggcctgggactggggcccagatggagaggagacagagacccagacctgccccccccacacagaacatggagcctgtggcctgcggctggaggccgcccctgtgggcgtgctgtggccctggctggccgaggtgcacgtggccggggacagagtgtgcaccggcatcctgctggcccctggctgggtgctggccgccacccactgtgtgctgcggcccggcagcaccaccgtgccctacatcgaggtgtacctgggccgggccggggccagcagcctgccccagggccaccaggtgtcccggctggtgatcagcatccggctgccccagcacctgggcctgcggccccccctggccctgctggagctgagcagccgggtggagcccagccccagcgccctgcccatctgcctgcaccctgctggcatccccccaggggccagctgctgggtgctgggctggaaggagccccaggacagagtgcctgtggccgctgctgtgtccatcctgacccagaggatctgtgactgcctgtaccagggcatcctgcccccaggcaccctgtgtgtgctgtatgcagagggccaggagaacagatgtgagatgaccagcgccccacccctgctgtgccagatgacagagggctcctggatcctggtgggcatggctgtgcagggcagccgggagctgtttgctgccatcggccctgaggaggcctggatcagccagacagtgggggaggccaacttcctgccccccagcggcagcccccactggcccactggaggcagcaacctgtgccccccagagctggccaaggccagcggcagcccccatgctgtgtacttcctgctgctgctgaccctgctgatccagagctag

SEQ ID NO: 6953 - DNA, 912 bp, Artificial Sequence
  Description of Artificial Sequence: Synthetic coding sequence
atgctgcaccctgagaccagccctggccggggccacctgctggccgtgctgctggccctgctgggcaccacctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctggactggagcgacagcctggcccagctggcccaggcccgggccgccctgtgtggcatccccacccccagcctggccagcggcctgtggaggaccctgcaggtgggctggaacatgcagctgctgcctgctggcctggccagctttgtggaggtggtgtccctgtggtttgctgagggccagcgctacagccatgctgctggggagtgtgccagaaatgccacctgcacccactacacccagctggtgtgggccaccagcagccagctgggctgcggccgccacctgtgcagcgctggccagacagccatcgaggcctttgtgtgtgcctacagcccccggggcaactgggaggtgaatggcaagaccatcatcccctacaagaagggggcctggtgcagcctgtgcacagcctctgtgtctggctgcttcaaggcctgggaccatgctgggggcctgtgtgaggtgcccaggaacccctgcaggatgagctgccagaaccacggccgcctgaacatcagcacctgccactgccactgccccccaggctacacaggccgctactgccaggtgcgctgcagcctgcagtgtgtgcacggccgcttccgggaggaggagtgcagctgtgtgtgtgacatcggctacggggagcccagcgtgcccccacgctgcatcttccccagcacccctgtgacctag

SEQ ID NO: 6954 - DNA, 1158 bp, Artificial Sequence
  Description of Artificial Sequence: Synthetic coding sequence
atgaagatgctgcccggggtgggcgtgtttggcaccggcagcagcgcccgggtgctggtgcccctgctgcgggcagagggcttcaccgtggaggccctgtggggcaagacagaggaggaggccaagcagctggccgaggagatgaacatcgccttctacaccagcaggacagatgacatcctgctgcaccaggatgtggacctggtgtgcatcagcatccccccacccctgacccggcagatctctgtgaaggccctgggcatcggcaagaatgtggtgtgtgagaaggccgccacctctgtggatgccttcaggatggtgacagccagccgctactacccccagctgatgagcctggtgggcaatgtgctgcgcttcctgcctgcctttgtgaggatgaagcagctgatcagcgagcactacgtgggcgctgtgatgatctgtgatgcccgcatctacagcggcagcctgctgagccccagctatggctggatctgtgatgagctgatgggcggcggcggcctgcacaccatgggcacctacatcgtggacctgctgacccacctgaccggccggcgggcagagaaggtgcacggcctgctgaagacctttgtgcggcagaatgctgccatccggggcatccgccacgtgaccagtgatgacttctgcttcttccagatgctgatgggcggcggcgtgtgcagcacagtgaccctgaacttcaacatgcctggggcctttgtgcatgaggtgatggtggtgggcagcgctggccgcctggtggcccggggagctgacctgtatggccagaagaacagcgccacccaggaggagctgctgctgcgggacagcctggccgtgggcgccggcctgcctgagcagggcccccaggatgtgcccctgctgtacctgaagggcatggtgtacatggtgcaggccctgcggcagagcttccagggccagggcgacaggaggacctgggacaggacccctgtgtccatggccgccagctttgaagatggcctgtacatgcagagcgtggtggatgccatcaagaggagcagccgctctggagagtgggaggccgtggaggtgctgacagaggagccagacaccaaccagaacctgtgtgaggccctgcagaggaacaacctgtag

SEQ ID NO: 6955 - DNA, 1470 bp, Artificial Sequence
  Description of Artificial Sequence: Synthetic coding sequence
atgcctgtgacctttgccctgctgctgctgctgggccaggccacagctgacccctgctatgacccccagggccggccccagttctgcctgccccctgtgacccagctggccgctgtggccgccagctgcccccaggcctgtgccctgagccctggcaaccacctgggcgcccgggagacctgcaatggcagcctgaccctggccctgggcggccccttcctgctgacctctgtgtccctgcgcttctgcaccccaggccccccagccctgatcctgtctgctgcctgggccagcggcggcccctggaggctgctgtggcacaggcctgcctggccaggggccctgggcggccctgagcgggtgaccttccacagcaccccaggccccaaggccaccgtggccgccagccacctgcgggtggagtttggaggccaggccggcctggccgctgctggcctgcggggccgctgccagtgccacggccatgctgcccgctgtgccgcccgggcccggcccccacgctgccactgccgccaccacaccaccggccctggctgtgagagctgccggcccagccaccgggactggccctggaggcctgccacccccaggcacccccacccctgcctgccctgcagctgcaaccagcacgcccggcgctgccgcttcaacagcgagctgttccggctgagcggcggccgctctggaggagtgtgtgagcgctgccgccaccacacagctggccgccactgccactactgccagcccggcttctggagggaccccagccagcccatcttcagcagaagagcctgccgggcctgccagtgccaccccatcggggccactggaggcacctgcaaccagaccagcggccagtgcacctgcaagctgggcgtgacaggcctgacctgcaacagatgtggccctggctaccagcagagccgcagccccaggatgccctgccagagaattcctgaggccaccaccaccctggccaccacccctggggcctacagcagtgacccccagtgccagaactactgcaacatgtctgacaccagggtgcacatgagcctgcggcgctactgccagcaggaccacgtgctgcgggcccaggtgctggccagcgaggccgccggccctgcctggcagaggctggccgtgcgggtgctggccgtgtacaagcagagggcccagcctgtgagaagaggagaccaggatgcctgggtgcccagggctgacctgacctgtggctgcctgcggctgcagcctggaacagactacctgctgctgggcagcgctgtgggggaccctgaccccaccaggctcatcctggacagacatggcctggccctgccctggaggccccgctgggcccggcccctgaagaggctgcagcaggaggagcgggccggcggctgccggggcgtgcgggcccccacccccagccccaggcctgagcactag

SEQ ID NO: 6956 - DNA, 8430 bp, Artificial Sequence
  Description of Artificial Sequence: Synthetic coding sequence
atgaccctggagggcctgtacctggcccggggccccctggcccggctgctgctggcctggagcgccctgctgtgcatggccggcggccagggccgctgggatggagccctggaggccgccggccctggccgggtgagaagaagaggcagccctggcatcctgcagggccccaacgtgtgtggcagccgcttccacgcctactgctgccccggctggaggaccttccctggccgcagccagtgtgtggtgcccatctgcagaagagcctgtggggagggcttctgcagccagcccaacctgtgcacctgtgctgatggcaccctggcccccagctgtggggtgtcccggggcagcggctgcagcgtgtcctgcatgaatggaggcacctgccgcggggccagctgcctgtgccagaagggctacacaggcaccgtgtgtggccagcccatctgtgaccggggctgccacaatggaggccgctgcatcggccccaacagatgtgcctgtgtgtatggcttcatgggcccccagtgtgagcgggactacagaacaggcccctgcttcggccaggtgggccctgagggctgccagcaccagctgaccggcctggtgtgcaccaaggccctgtgctgtgccaccgtgggccgggcctggggcctgccctgtgagctgtgcccagcccagccccacccctgcagaagaggcttcatccccaacatccacactggagcctgccaggatgtggatgagtgccaggccgtgcccggcctgtgccagggcggcagctgtgtgaacatggtgggcagcttccactgccgctgccctgtgggccaccggctgagtgacagcagcgctgcctgtgaggactaccgggccggggcctgcttctctgtgctgtttggaggccgctgtgccggggacctggccggccactacacccggcggcagtgctgctgtgaccggggccgctgctgggccgccggccctgtgcctgagctgtgccccccccggggcagcaatgagttccagcagctgtgtgcccagaggctgcccctgctgcccggccaccctggcctcttccctggcctgctgggcttcggcagcaatggcatgggcccccccctgggccctgcccggctgaacccccacggcagtgatgcccggggcatccccagcctgggccctggcaacagcaacatcggcacagccaccctgaaccagaccatcgacatctgccgccacttcaccaacctgtgcctgaatggccgctgcctgcccacccccagcagctaccgctgtgagtgcaatgtgggctacacccaggatgtgcggggggagtgcattgatgtggatgagtgcaccagcagcccctgccaccacggggactgtgtgaacatccctggcacctaccactgccgctgctacccaggcttccaggccacccccacccggcaggcctgtgtggatgtggatgagtgcatcgtgtctgggggcctgtgccacctgggccgctgtgtgaacacagagggcagcttccagtgtgtgtgcaatgccggctttgagctgagcccagatggcaagaactgtgtggaccacaatgaatgtgccaccagcaccatgtgtgtgaatggagtgtgcctgaatgaagatggcagcttcagctgcctgtgcaagccaggcttcctgctggcccctgggggccactactgcatggacattgatgagtgccagaccccaggcatctgtgtgaatggccactgcaccaacacagagggcagcttccgctgccagtgcctgggcggcctggccgtgggcacagatggccgggtgtgtgtggacacccacgtgcgcagcacctgctatggagccatcgagaagggcagctgtgcccggcccttccctggcaccgtgaccaagtctgagtgctgctgtgccaacccagaccacggctttggagagccctgccagctgtgcccagccaaggacagcgctgagttccaggccctgtgcagcagcggcctgggcatcaccacagatggccgggacatcaatgaatgtgccctggaccctgaggtgtgtgccaatggagtgtgtgagaacctgcggggcagctaccgctgtgtgtgcaacctgggctatgaagctggggccagcggcaaggactgcacagatgtggatgaatgtgccctgaacagcctgctgtgtgacaatggctggtgccagaacagccctggcagctacagctgcagctgccccccaggcttccacttctggcaggacacagagatctgcaaggatgtggatgaatgtctgagcagcccctgtgtgtctggagtgtgcaggaacctggccggcagctacacctgcaagtgtggccctggcagccggctggaccccagcggcaccttctgcctggacagcaccaagggcacctgctggctgaagatccaggagagccgctgtgaggtgaacctgcagggcgccagcctgcggtctgagtgctgtgccaccctgggcgccgcctggggcagcccctgtgagcgctgtgaaattgatcctgcctgtgcccggggctttgccaggatgactggagtgacctgtgatgatgtgaatgaatgtgagagcttccctggggtgtgccccaacggccgctgtgtgaacacagctggcagcttccgctgtgaatgtcctgagggcctgatgctggatgccagcggccgcctgtgtgtggatgtgcggctggagccctgcttcctgcgctgggatgaagatgaatgtggggtgaccctgcccgggaagtacaggatggatgtgtgctgctgcagcattggagctgtgtggggcgtggagtgtgaggcctgcccagaccctgagagcctggagtttgccagcctgtgcccccggggcctgggctttgccagccgggacttcctgagcggccggcccttctacaaggatgtgaatgaatgcaaggtgtttcctggcctgtgcacccacggcacctgcaggaacacagtgggcagcttccactgtgcctgtgccggcggctttgccctggatgcccaggagaggaactgcacagacattgatgaatgtcgcatcagcccagacctgtgtggccagggcacctgtgtgaacaccccaggcagctttgaatgtgagtgcttccctggctatgaaagtggcttcatgctgatgaagaactgcatggatgtggatgaatgtgcccgggaccccctgctgtgccggggcggcacctgcaccaacacagatggcagctacaagtgccagtgccccccaggccacgagctgacagccaagggcacagcctgtgaggacattgatgagtgcagcctgagtgatggcctgtgcccccacggccagtgtgtgaatgtgattggagccttccagtgcagctgccacgccggcttccagagcaccccagaccggcagggctgtgtggacatcaatgaatgtcgggtgcagaatggaggctgtgatgtgcactgcatcaacacagagggcagctaccgctgcagctgtggccagggctacagcctgatgccagatggccgggcctgtgctgatgtggatgaatgtgaggagaacccccgggtgtgtgaccagggccactgcaccaacatgcctgggggccaccgctgcctgtgctatgatggcttcatggccaccccagacatgaggacctgtgtggatgtggatgaatgtgacctgaacccccacatctgcctgcatggagactgtgagaacaccaagggcagctttgtgtgccactgccagctgggctacatggtgaggaaaggagccaccggctgcagtgatgtggatgaatgtgaggtgggcggccacaactgtgacagccacgccagctgcctgaacatccctggcagcttcagctgccgctgcctgcccggctgggtgggagatggctttgagtgccacgacctggatgaatgtgtgtcccaggagcaccgctgcagccccaggggggactgcctgaatgtgcccggcagctaccgctgcacctgccggcagggctttgctggagatggcttcttctgtgaagatagagatgaatgtgccgagaatgtggacctgtgtgacaatggccagtgcctgaatgcccctgggggctaccgctgtgaatgtgagatgggctttgaccccacagaggaccaccgggcctgccaggatgtggatgaatgtgcccagggcaacctgtgtgccttcggcagctgtgagaacctgcccggcatgttccgctgcatctgcaatggaggctatgagctggacagaggaggcggcaactgcacagacatcaatgaatgtgccgaccctgtgaactgcatcaatggagtgtgcatcaacaccccaggcagctacctgtgcagctgcccccaggactttgagctgaaccccagcggcgtgggctgtgtggacaccagggctggcaactgcttcctggagacccatgacagaggagacagcggcatcagctgcagcgctgagattggagtgggcgtgacccgggccagctgctgctgcagcctgggccgggcctggggcaacccctgtgagctgtgccccatggccaacaccacagagtaccgcaccctgtgccctggaggagagggcttccagcccaaccgcatcaccgtcatcctggaggacattgatgagtgccaggagctgcccggcctgtgccagggcggggactgtgtgaacaccttcggcagcttccagtgtgaatgtcctcctggctaccacctgtctgagcacacccgcatctgtgaggacattgatgagtgcagcacccacagcggcatctgtggccctggcacctgctacaacaccctgggcaactacacctgtgtgtgcccagctgagtacctgcaggtgaatggaggcaacaactgcatggacatgaggaagtctgtgtgcttccgccactacaacggcacctgccagaatgagctggccttcaacgtgaccaggaagatgtgctgctgcagctacaacatcggccaggcctggaaccggccctgtgaggcctgccccacccccatcagcccagactaccagatcctgtgtggcaaccaggcccctggcttcctgacagacatccacacaggcaagcccctggacattgatgaatgtggggagatcccagccatctgtgccaacggcatctgcatcaaccagatcggcagcttccgctgtgaatgtcctgctggcttcaactacaacagcatcctgctggcctgtgaagatgtggatgaatgtggcagccgggagagcccctgccagcagaatgctgactgcatcaacatccctggcagctaccgctgcaagtgcacccggggctacaagctgagccctggaggagcctgtgtgggcagaaatgaatgtcgggagatccccaacgtgtgcagccacggggactgcatggacacagagggcagctacatgtgcctgtgccaccggggcttccaggccagcgctgaccagaccctgtgcatggacattgatgaatgtgaccggcagccctgtggaaatggcacctgcaagaacatcatcggcagctacaactgcctgtgcttccctggctttgtggtgacccacaatggagactgtgtggactttgatgaatgtaccaccctggtgggccaggtgtgccgcttcggccactgcctgaacacagctggcagcttccactgcctgtgccaggacggctttgagctgacagcagatggcaagaactgtgtggacaccaatgaatgtctgagcctggccggcacctgcctgcccggcacctgccagaacctggagggcagcttccgctgcatctgccccccaggcttccaggtgcagagcgaccactgcatcgacattgatgagtgcagcgaggagcccaacctgtgcctgtttggcacctgcaccaacagccctggcagcttccagtgcctgtgccccccaggctttgtgctgagtgacaatggccaccgctgctttgacacccggcagagcttctgcttcaccaggtttgaagctggaaaatgttctgtgcccaaggccttcaacaccaccaagacccgctgctgctgcagcaagaggcctggagagggctggggagacccctgtgagctgtgcccccaggagggcagcgctgccttccaggagctgtgccccttcggccacggggctgtgcccggcccagatgacagcagagaagatgtgaatgaatgtgccgagaaccctggggtgtgcaccaatggagtgtgtgtgaacacagatggcagcttccgctgtgagtgccccttcggctacagcctggacttcaccggcatcaactgtgtggacacagatgaatgttctgtgggccacccctgtggccagggcacctgcaccaacgtgattggaggctttgaatgtgcctgtgctgatggctttgagcccggcctgatgatgacctgtgaagatattgatgaatgttccctgaaccccctgctgtgtgccttccgctgccacaacacagagggcagctacctgtgcacctgcccagctggctacaccctgcgggaggatggagccatgtgcagagatgtggatgaatgtgctgatggccagcaggactgccacgcccggggcatggagtgcaagaacctgattggcacctttgcctgtgtgtgccccccaggcatgaggcccctgcccggcagcggggagggctgcacagatgacaatgaatgtcatgcccagcctgacctgtgtgtgaatggccgctgtgtgaacacagctggcagcttccgctgtgactgtgatgagggcttccagcccagccccaccctgacagaatgtcatgacatccggcagggcccctgctttgctgaggtgctgcagaccatgtgccgcagcctgagcagcagcagcgaggccgtgaccagggctgagtgctgctgcggcggcggccggggctggggcccccgctgtgagctgtgccccctgcccggcaccagcgcctacaggaagctgtgcccccacggcagcggctacacagctgagggcagagatgtggatgagtgcaggatgctggcccacctgtgtgcccacggggagtgcatcaacagcctgggcagcttccgctgccactgccaggccggctacaccccagatgccacagccaccacctgcctggacatggatgagtgcagccaggtgcccaagccctgcaccttcctgtgcaagaacaccaagggcagcttcctgtgcagctgcccccggggctacctgctggaggaggatggccgcacctgcaaggacctggatgaatgtaccagccggcagcacaactgccagttcctgtgtgtgaacacagtgggcgccttcacctgccgctgccccccaggcttcacccagcaccaccaggcctgctttgacaatgatgagtgcagcgcccagcccggcccctgtggggcccacggccactgccacaacaccccaggcagcttccgctgtgagtgccaccagggcttcaccctggtgagcagcggccacggctgtgaagatgtgaatgaatgtgatggcccccaccgctgccagcacggctgccagaaccagctgggcggctaccgctgcagctgcccccagggcttcacccagcacagccagtgggcccagtgtgtggatgaaaatgaatgtgccctgagcccccccacctgtggcagcgccagctgcaggaacaccctgggcggcttccgctgtgtgtgccccagcggctttgattttgaccaggccctgggcggctgccaggaggtggatgaatgtgccggcagaagaggcccctgcagctacagctgtgccaacaccccaggcggcttcctgtgtggctgcccccagggctacttccgggccggccagggccactgtgtgtctggcctgggcttcagccctggcccccaggacaccccagacaaggaggagctgctgagcagcgaggcctgctatgagtgcaagatcaatggcctgagcccccgggaccggccccggcgcagcgcccaccgggaccaccaggtgaacctggccaccctggacagcgaggccctgctgaccctgggcctgaacctgagccacctgggccgggcagagcgcatcctggagctgcggcctgccctggagggcctggagggccgcatccgctacgtgattgtgagaggaaatgagcagggcttcttcaggatgcaccacctgcggggcgtgagcagcctgcagctgggcagaagaagacctggccctggcacctaccgcctggaggtggtgagccacatggccggcccctggggcgtgcagcctgagggccagcccggcccctggggccaggccctgcggctgaaggtgcagctgcagctgctgtag

SEQ ID NO: 6957 - DNA, 303 bp, Artificial Sequence
  Description of Artificial Sequence: Synthetic coding sequence
atggagacccggcaggtgagccgcagcccccgggtgcggctgctgctgctgctgctgctgctgctggtggtgccctggggcgtgaggacagccagcggcgtggccctgccccctgtgggcgtgctgagcctgcggcccccaggccgggcctgggccgaccctgccaccccccggccccggcgcagcctggccctggctgatgatgctgccttccgggagcgggcccggctgctggccgccctggagaggaggcactggctgaacagctacatgcacaagctgctggtgctggatgccccctag

SEQ ID NO: 6958 - DNA, 1404 bp, Artificial Sequence
  Description of Artificial Sequence: Synthetic coding sequence
atgtggcgctgccccctgggcctgctgctgctgctgcccctggccggccacctggccctgggcgcccagcagggccggggccggcgggagctggcccctggcctgcacctgcggggcatcagagatgctgggggccgctactgccaggagcaggacctgtgctgccggggccgggcagatgactgtgccctgccctacctgggcgccatctgctactgtgacctcttctgcaacagaacagtgtctgactgctgcccagacttctgggacttctgcctgggcgtgcccccacccttcccccccatccagggctgcatgcatggaggccgcatctaccctgtgctgggcacctactgggacaactgcaaccgctgcacctgccaggagaaccggcagtggcagtgtgaccaggagccctgcctggtggaccctgacatgatcaaggccatcaaccagggcaactacggctggcaggccggcaaccacagcgccttctggggcatgaccctggatgagggcatccgctaccgcctgggcaccatccggcccagcagctctgtgatgaacatgcatgagatctacacagtgctgaaccctggagaggtgctgcccacagcctttgaggccagcgagaagtggcccaacctgatccacgagcccctggaccagggcaactgtgccggctcctgggccttcagcacagctgctgtggccagtgacagagtgtccatccacagcctgggccacatgacccctgtgctgagcccccagaacctgctgagctgtgacacccaccagcagcagggctgccggggcggccgcctggatggagcctggtggttcctgcggcggcggggcgtggtgtctgaccactgctaccccttcagcggccgggagagagatgaagctggccctgccccaccctgcatgatgcacagccgggccatgggccggggcaagaggcaggccacagcccactgccccaacagctatgtgaacaacaatgacatctaccaggtgacccctgtgtaccgcctgggcagcaatgacaaggagatcatgaaggagctgatggagaatggacctgtgcaggccctgatggaggtgcatgaggacttcttcctgtacaagggcggcatctacagccacacccctgtgtccctgggccggcctgagcgctacagaagacatggcacccacagcgtgaagatcaccggctggggcgaggagaccctgcctgatggccgcaccctgaagtactggacagctgccaacagctggggccctgcctggggcgagcggggccacttcagaattgtgcggggcgtgaatgaatgtgacatcgagagctttgtgctgggcgtgtggggccgggtgggcatggaggacatgggccaccactag

SEQ ID NO: 6959 - DNA, 2205 bp, Artificial Sequence
  Description of Artificial Sequence: Synthetic coding sequence
atgttttatgtgtgcagcagctgtgtgttcctgtgtggcagcaacttccccaacttccccttccaggtggccagcgccaagagcgcccctgagatccccaccatcgaccaggcctacagcaagctgagcaacagcatcaccgtggagtgggccaccgtgcctggggccaccagctacctgctgacagcagaagatggagacaccgtcatcgagaccaccgtggccaacagccctggcaccgtgacaggcctgaaggccgccacctggtatgagatcaccatccgcagcatctctgctgctggccgcagccaggccagcccccccaagcaggccaagacagtgctggccgcccccatcctggaggtgagcagccccagcagtgacagcatcctggtgcagtgggaggccgtgtacatggccatcgccttctctgtgtccatcatgagggccaacggcctgggcagcatctggaaggagaacaccaccaacaccagcctgaccttcaccagcctggaggccggcaccctgtacaccatcaaggcctatgcctggaatgccaaccgcatccctggagatgacagcacctgcaaccagaggaccagcccccgggccccagccaacatccaggtgtcctttgacagcggggccctgaaggccagcttctcctgggcccgggcagagggcgccttcaactacacagtgatggccctgagtgacagcagcgagctgacctgcagcaccaccttcagcagctgcaccatcagcagcctgcagtgtggcacagagtacctgatctctgtgctggccagcaatgatgctggcagcagcaagagcagcagcgccatgaccctgaagacagtggcctgtgcccctggccgggtgaccatccaggaggaccccccaggccacctgtctgtggcctggagctctgtggacctgggggactactacgtggtgtttgtgaagagtgatgatggcctggaggtgcactgcaacaccagcctgacccagtgcaacttcctgtctgaatgtggcttcacctacttcatctctgtgtttgtgtacaacaaggccggccagagccccctgggggacatcttcaactacaccacagccccctgctgccccagcgacatcaaccctgtgctggtgtccagtgacagagtggagatcgtgtggagccctgtgagaggagctgagctgtatgagaccaaggctgtggatggctacaacatggtggagtgcaatgacaccaccccagcctgcaccctgagcgccctggagtgtgacaccaagtacaacatcaccgtgtacagcttcaatgaggtgcggggcagcaacatgagctgcaccccccagttcatcaccacagccccctgcagccctgagatcaagaatgtgtccagagatgccttctccatgatcaacgtgcactggaggagcaccaatgatgatgccacctacacagtgacagcccagggcgagaagggcctgtaccagtgcagcagcactggagagagctgcaccatgaggggcctgccctgtggctctgtgttttctgtgacagctgtggccgagacccaggccggccgcagcctgcccagctacagcgtgcccctggagaccgtgccctgctgccccaccggcctgactgtgacccagatcacccagagcgtcatcaacgtgtcctggaccatcggccgggtggcccagacccacgtggccgtgctggagagccacacaggccagagcaagtgccacacccaccagaaccactgcctgctgggctgcatcacctgtggcatcaactacacagtgaccctgaaggccatcagcgccaccggcctgacagctgactgcagctaccagagctacttcagcggggcctgctgccccctgggcgtgaagctgtaccgcctgggccccaacggcatccgcatctactggcaggccagccggggcagcgccaactacagcacagacctgtatggcagcaagggcatcttcacctgcacccccagcgctggcctgtccttctgtgatgtgacagagatcccctgtggagatgtgtacacagtgatggtgtcccctgtggccaagacaggcctgaagctgaccttctgccccaagaagatctacagcgtgacctgcagcggcagcaccctgggcatggtgatctaccggggcaagagaaatgaggagtag

SEQ ID NO: 6960 - DNA, 1098 bp, Artificial Sequence
  Description of Artificial Sequence: Synthetic coding sequence
atgctggatggcagccccctggcccgctggctggccgccgccttcggcctgaccctgctgctggccgccctgcggcccagcgctgcctacttcggcctgaccggcagcgagcccctgaccatcctgcccctgaccctggagcctgaggccgccgcccaggcccactacaaggcctgtgaccggctgaagctggagaggaagcagaggaggatgtgcagaagagaccccggggtggccgagaccctggtggaggccgtgtccatgtctgccctggagtgccagttccagttccgctttgagcgctggaactgcaccctggagggccgctaccgggccagcctgctgaagaggggcttcaaggagacagccttcctgtatgccatcagcagcgctggcctgacccacgccctggccaaggcctgcagcgctggccgcatggagcgctgcacctgtgatgaggccccagacctggagaaccgggaggcctggcagtggggcggctgtggggacaacctgaagtacagcagcaagtttgtgaaggagttcctgggcagaagaagcagcaaggacctgcgggcccgggtggacttccacaacaacctggtgggcgtgaaggtgatcaaggccggcgtggagaccacctgcaagtgccacggcgtgtctggcagctgcaccgtgaggacctgctggaggcagctggcccccttccacgaggtgggcaagcacctgaagcacaagtatgaaacagccctgaaggtgggcagcaccaccaatgaggccgccggggaggccggggccatcagccccccccggggccgggccagcggggccggcggcagtgaccccctgcccaggaccccagagctggtgcacctggatgacagccccagcttctgcctggccggccgcttcagccctggaacagctggaagacgctgccaccgggagaagaactgtgagagcatctgctgcggccggggccacaacacccagagccgggtggtgacccggccctgccagtgccaggtgcgctggtgctgctacgtggagtgccggcagtgcacccagcgggaggaggtgtacacctgcaagggctag

SEQ ID NO: 6961 - DNA, 795 bp, Artificial Sequence
  Description of Artificial Sequence: Synthetic coding sequence
atgaggctgcggcccctgcccctggtggtggtgcccggcctgctgcagctgctcttctgtgacagcaaggaggtggtgcacgccacagagggcctggactgggaggacaaggatgcccctggcaccctggtgggcaatgtggtgcacagccgcatcatcagccccctgcggctgtttgtgaagcagagccctgtgcccaagccaggccccatggcctatgctgacagcatggagaacttctgggactggctggccaacatcacagagatccaggagcccctggcccggaccaagagaagacccatcgtgaagacaggcaagttcaagaagatgtttggctggggagacttccacagcaacatcaagacagtgaagctgaacctgctgatcaccgggaagatcgtggaccatggaaatggcaccttctctgtgtacttccgccacaacagcacaggcctgggcaatgtgtctgtgtccctggtgccccccagcaaggtggtggagtttgaggtgagcccccagagcaccctggagaccaaggagagcaagagcttcaactgcagaattgaatatgagaagacagaccgggccaagaagacagccctgtgcaactttgaccccagcaagatctgctaccaggagcagacccagagccacgtgtcctggctgtgcagcaagcccttcaaggtgatctgcatctacatcgccttctacagcgtggactacaagctggtgcagaaggtgtgcccagactacaactaccacagcgagaccccctacctgagcagtggatag

SEQ ID NO: 6962 - DNA, 1125 bp, Artificial Sequence
  Description of Artificial Sequence: Synthetic coding sequence
atgaagcccctgctggagaccctgtacctgctgggcatgctggtgcctgggggcctgggctatgacaggagcctggcccagcaccggcaggagatcgtggacaagtctgtgagcccctggagcctggagacctacagctacaacatctaccaccccatgggagagatctatgagtggatgagggagatcagcgagaagtacaaggaggtggtgacccagcacttcctgggcgtgacctatgagacccaccccatgtactacctgaagatcagccagcccagcggcaaccccaagaagatcatctggatggactgtggcatccacgcccgggagtggatcgccccagccttctgccagtggtttgtgaaggagatcctgcagaaccacaaggacaacagcagcatcaggaagctgctgaggaacctggacttctacgtgctgcctgtgctgaacattgatggctacatctacacctggaccacagaccggctgtggaggaagagccgcagcccccacaacaacggcacctgcttcggcacagacctgaacagaaacttcaatgcctcctggtgcagcattggagccagcaggaactgccaggaccagaccttctgtggcactggacctgtgtctgagcctgagaccaaggctgtggccagcttcatcgagagcaagaaggatgacatcctgtgcttcctgaccatgcacagctatggccagctgatcctgaccccctacggctacaccaagaacaagagcagcaaccaccctgagatgatccaggtgggccagaaggccgccaatgccctgaaggccaagtatggcaccaactacagagtgggcagcagcgctgacatcctgtatgccagcagcggcagcagccgggactgggcccgggacatcggcatccccttctcctacacctttgagctgcgggacagcggcacctacggctttgtgctgcctgaggcccagatccagcccacctgtgaggagaccatggaggccgtgctgtctgtgctggatgatgtgtatgccaagcactggcacagcgacagcgctggccgggtgaccagcgccaccatgctgctgggcctgctggtgtcctgcatgagcctgctgtag

SEQ ID NO: 6963 - DNA, 1728 bp, Artificial Sequence
  Description of Artificial Sequence: Synthetic coding sequence
atggcctcctggctgcggaggaagctgcggggcaagagaagacctgtgattgccttctgcctgctgatgatcctgagcgccatggctgtgacccgcttccccccccagaggccttctgctggccctgaccccggccccatggagccccagggcgtgactggagccccagccacccacatccggcaggccctgagcagcagccggcggcagagggccaggaacatgggcttctggaggagccgggccctgcccagaaattccatcctggtgtgtgccgaggagcagggccaccgggcccgggtggacaggagccgggagagccctggaggagacctgcggcaccctggccgggtgagaagagacatcaccctgagcggccacccccggctgagcacccagcacgtggtgctgctgcgggaggatgaggtgggggaccccggcaccaaggacctgggccacccccagcacggcagccccatccaggagacccagagcgaggtggtgaccctggtgagccccctgcccggcagtgacatggccgccctgcctgcctggagggccaccagcggcctgaccctgtggccccacacagctgagggccgggacctgctgggcgcagaaaatagagccctgaccggcggccagcaggccgaggaccccaccctggccagcggggcccaccagtggccaggctctgtggagaagctgcagggctctgtgtggtgtgatgctgagaccctgctgagcagcagcaggactggaggccaggccccaccctggctgacagaccatgatgtgcagatgctgcggctgctggcccagggcgaggtggtggacaaggcccgggtgcctgcccacggccaggtgctgcaggtgggcttcagcacagaggccgccctgcaggacctgagcagcccccggctgagccagctgtgcagccagggcctgtgtggcctcatcaagaggcctggggacctgcctgaggtgctgtccttccacgtggacagagtgctgggcctgcggcgcagcctgcctgctgtggcccggcgcttccacagccccctgctgccctaccgctacacagatggaggagcccggcctgtgatctggtgggccccagatgtgcagcacctgagtgaccctgatgaggaccagaacagcctggccctgggctggctgcagtaccaggccctgctggcccacagctgcaactggccaggccaggccccctgccccggcatccaccacacagagtgggcccggctggccctgtttgacttcctgctgcaggtgcatgaccggctggaccgctactgctgcggctttgagcctgagcccagcgacccctgtgtggaggagcggctgcgggagaagtgccagaacccagctgagctgcggctggtgcacatcctggtgcgcagcagtgaccccagccacctggtgtacatcgacaatgccggcaacctgcagcaccctgaggacaagctgaacttccggctgctggagggcattgatggcttccctgagagcgctgtgaaggtgctggccagcggctgcctgcagaacatgctgctgaagagcctgcagatggaccccgtcttctgggagagccagggcggggcccagggcctgaagcaggtgctgcagaccctggagcagaggggccaggtgctgctgggccacatccagaagcacaacctgaccctcttcagagatgaggacccctag

SEQ ID NO: 6964 - DNA, 1680 bp, Artificial Sequence
  Description of Artificial Sequence: Synthetic coding sequence
atgtggaccaacttcttcaagctgcggctcttctgctgcctgctggccgtgctgatggtggtggtgctggtgatcaacgtgacccaggtggagtacctggaccatgaaacagtgtctgccaccttcatcgacagcagcggccagtttgtgagcagccaggtgacaggcatcagcaggaacccctactgcggctatgaccagcagaccctgagcagccaggagaggatggaggaggacagcctgctggccgccctgcaccggcaggtgcctgatgtgggccctgtgccctttgtgaagagcacagaccccagcagcagctacttcgtcatcctgaacagcgctgccttcttcaaggtgggcagccagctggaggtgctggtgcacgtgcaggacttccagaggaagcccaagaagtatggaggagactacctgcaggcccgcatccacagcctgaagctgcaggccggggctgtgggccgggtggtggactaccagaatggcttctacaaggtgttcttcaccctgctgtggccaggcaaggtgaaggtgtctgtgtccctggtgcaccccagcgagggcatccgggtgctgcagaggctgcaggaggacaagccagacagagtgtacttcaagagcctcttccgcagcggccgcatcagcgagaccacagagtgcaatgtgtgcctgcccggcaacctgcccctgtgcaacttcacagacctgtacacaggagagccctggttctgcttcaagcccaagaagctgccctgcagcagccgcatcacccacttcaagggcggctacctgaagggcctgctgacagctgctgagagcgccttcttccagagcggcgtgaacatcaagatgcctgtgaacagcagcggccctgactgggtgaccgtcatcccccggcgcatcaaggagaccaacagcctggagctgagccagggcagcggcaccttccccagcggctactactacaaggaccagtggaggcccaggaagttcaagatgaggcagttcaatgaccctgacaacatcacagaatgtctgcagaggaaggtggtgcacctgtttggagacagcaccatccggcagtggtttgagtacctgaccacctttgtgcctgacctggtggagttcaacctgggcagccccaagaatgtgggccccttcctggccgtggaccagaagcacaacatcctgctgaagtaccgctgccacggcccccccatccgcttcaccaccgtcttcagcaatgagctgcactacgtggccaatgagctgaatggcatcgtgggcggcaagaacacagtggtggccatcgctgtgtggagccacttcagcaccttccccctggaggtgtacatccggcggctgaggaacatccggcgggctgtggtgcggctgctggacaggagccccaagacagtggtggtgatcagaacagccaatgcccaggagctgggccctgaggtgtccctcttcaacagcgactggtacaacttccagctggacaccatcctgcggaggatgttcagcggcgtgggcgtgtacctggtggatgcctgggagatgaccctggcccactacctgccccacaagctgcacccagatgaagtcatcgtgaagaaccagctggacatgttcctgagctttgtgtgccccctggagacctag

SEQ ID NO: 6965 - DNA, 3624 bp, Artificial Sequence
  Description of Artificial Sequence: Synthetic coding sequence
atgaggctgacccacatctgctgctgctgcctgctgtaccagctgggcttcctgagcaatggcatcgtgtctgagctgcagtttgccccagaccgggaggagtgggaggtggtgtttcctgccctgtggaggcgggagcctgtggaccctgctgggggcagcggcggcagcgctgaccccggctgggtgcggggcgtgggcggcggcggcagcgcccgggcccaggccgccggcagcagccgggaggtgcgctctgtggcccctgtgcccctggaggagcctgtggagggccgctctgagagccggctgcggcccccacctccttctgagggggaggaggatgaggagctggagagccaggagctgccccggggcagcagtggagctgctgccctgagccctggggccccagcctcctggcagcccccacctccaccccagcccccacccagccccccaccagcccagcacgccgagccagatggagatgaggtgctgctgcgcatcccagccttcagccgggacctgtacctgctgctgcggagagatggccgcttcctggcccccaggtttgctgtggagcagaggcccaaccctggccctggccccaccggggccgccagcgccccccagcccccagcccccccagatgctggctgcttctacacaggagctgtgctgcggcaccctggcagcctggccagcttcagcacctgtggcggcggcctgatgggcttcatccagctgaatgaagacttcatcttcatcgagcccctgaatgacaccatggccatcaccggccacccccaccgggtgtaccggcagaagaggtccatggaggagaaggtgacagagaagagcgccctgcacagccactactgcggcatcatcagtgacaagggccggcccaggagcaggaagattgctgagagcggccggggcaagcgctacagctacaagctgccccaggagtacaacattgaaacagtggtggtggccgaccctgccatggtgtcctaccatggagcagatgctgcccggcgcttcatcctgaccatcctgaacatggtgttcaacctcttccagcacaagagcctgtctgtgcaggtgaacctgcgggtcatcaagctgatcctgctgcacgagaccccacctgagctgtacatcggccaccacggggagaagatgctggagagcttctgcaagtggcagcacgaggagtttgggaagaagaatgacatccacctggagatgagcaccaactggggcgaggacatgacctctgtggatgctgccatcctgatcaccaggaaggacttctgtgtgcacaaggatgagccctgtgacacagtgggcatcgcctacctgagcggcatgtgcagcgagaagaggaagtgcatcatcgccgaggacaatggcctgaacctggccttcaccatcgcccacgagatgggccacaacatgggcatcaaccacgacaatgaccaccccagctgtgctgatggcctgcacatcatgtctggagagtggatcaagggccagaacctgggagatgtgtcctggagccgctgcagcaaagaagacctggagcgcttcctgcggagcaaggccagcaactgcctgctgcagaccaacccccagagcgtgaacagcgtgatggtgcccagcaagctgcccggcatgacctacacagcagatgagcagtgccagatcctgtttggccccctggccagcttctgccaggagatgcagcacgtgatctgcaccggcctgtggtgcaaggtggagggggagaaggagtgcaggaccaagctggacccccccatggatggaacagactgtgacctgggcaagtggtgcaaggccggggagtgcaccagcaggaccagcgcccctgagcacctggccggggagtggagcctgtggagcccctgcagcaggacctgcagcgctggcatcagcagccgggagaggaaatgtcctggcctggacagcgaggcccgggactgcaatggccccaggaagcagtaccgcatctgtgaaaatccaccctgcccagctggcctgcccggcttccgggactggcagtgccaggcctacagcgtgaggaccagcagccccaagcacatcctgcagtggcaggccgtgctggatgaggagaagccctgtgccctcttctgcagccctgtgggcaaggagcagcccatcctgctgtctgagaaggtgatggatggcaccagctgtggctaccagggcctggacatctgtgccaacggccgctgccagaaggtgggctgtgatggcctgctgggcagcctggcccgggaggaccactgcggcgtgtgcaatggaaatggcaagagctgcaagatcatcaagggggacttcaaccacaccaggggggccggctacgtggaggtgctggtgatcccagctggggcccggcgcatcaaggtggtggaggagaagccagcccacagctacctggccctgagagatgctgggaagcagagcatcaacagcgactggaagattgagcacagcggggccttcaacctggccggcaccaccgtgcactacgtgcggcggggcctgtgggagaagatcagcgccaagggccccaccacagcccccctgcacctgctggtgctgctcttccaggaccagaactacggcctgcactatgagtacaccatccccagcgaccccctgcctgagaaccagagcagcaaggcccctgagcccctcttcatgtggacccacacctcctgggaggactgtgatgccacctgtggcggcggggagaggaagaccaccgtgtcctgcaccaagatcatgagcaagaacatcagcatcgtggacaatgagaagtgcaagtacctgaccaagccagagccccagatcaggaagtgcaatgagcagccctgccagacccgctggatgatgacagagtggaccccctgcagcaggacctgtgggaagggcatgcagagccggcaggtggcctgcacccagcagctgagcaatggcaccctcatccgggcccgggagcgggactgcatcggccccaagccagccagcgcccagagatgtgagggccaggactgcatgacagtgtgggaggccggcgtgtggagcgaatgttctgtgaagtgtgggaagggcatccgccacaggacagtgcgctgcaccaaccccaggaagaagtgtgtgctgagcacccggccccgggaggccgaggactgtgaggactacagcaaatgttatgtgtggaggatgggagactggagcaagtgcagcatcacctgtgggaagggcatgcagagcagggtcatccagtgcatgcacaagatcaccggccgccacggcaatgaatgcttcagcagcgagaagccagctgcctaccggccctgccacctgcagccctgcaatgagaagatcaacgtgaacaccatcaccagcccccggctggccgccctgaccttcaagtgcctgggggaccagtggcctgtgtactgcagggtcatccgggagaagaacctgtgccaggacatgcgctggtaccagcgctgctgtgagacctgccgggacttctacgcccagaagctgcagcagaagagctag

SEQ ID NO: 6966 - DNA, 258 bp, Artificial Sequence
  Description of Artificial Sequence: Synthetic coding sequence
atgaagatcaccggcggcctgctgctgctgtgcaccgtggtgtacttctgcagcagcagcgaggccgccagcctgagccccaagaaggtggactgcagcatctacaagaagtaccctgtggtggccatcccctgccccatcacctacctgcctgtgtgtggcagtgactacatcacctatggaaatgaatgccacctgtgcacagagagcctgaagagcaatggccgggtgcagttcctgcatgatggcagctgctag

SEQ ID NO: 6967 - DNA, 2982 bp, Artificial Sequence
  Description of Artificial Sequence: Synthetic coding sequence
atgggcagcggccgggtgcccggcctgtgcctgctggtgctgctggtgcacgcccgggccgcccagtacagcaaggccgcccaggatgtggatgaatgtgtggagggcacagacaactgccacattgatgccatctgccagaacacccccaggagctacaagtgcatctgcaagagcggctacacaggagatggcaagcactgcaaggatgtggatgaatgtgaaagagaagataatgccggctgtgtgcatgactgtgtgaacatccctggcaactaccgctgcacctgctatgatggcttccacctggcccatgatggccacaactgcctggatgtggatgaatgtgccgagggcaatggaggctgccagcagagctgtgtgaacatgatgggcagctatgagtgccactgccgggagggcttcttcctgagtgacaaccagcacacctgcatccagaggcctgaggagggcatgaactgcatgaacaagaaccacggctgtgcccacatctgccgggagacccccaagggcggcatcgcctgtgaatgtcggcccggctttgagctgaccaagaaccagagggactgcaagctgacctgcaactatggaaatggaggctgccagcacacctgtgatgacacagagcagggcccccgctgtggctgccacatcaagtttgtgctgcacacagatggcaagacctgcatcgagacctgtgctgtgaacaacggcggctgtgacagcaagtgccatgatgctgccaccggggtgcactgcacctgccctgtgggcttcatgctgcagcctgacaggaagacctgcaaggacattgatgagtgccgcctgaacaatggaggctgtgaccacatctgcaggaacacagtgggcagctttgagtgcagctgcaagaagggctacaagctgctgatcaatgaaagaaactgccaggacattgatgaatgttcctttgacaggacctgtgaccacatctgtgtgaacaccccaggcagcttccagtgcctgtgccaccggggctacctgctgtatggcatcacccactgtggagatgtggatgagtgcagcatcaacagaggaggctgccgcttcggctgcatcaacaccccaggcagctaccagtgcacctgcccagctggccagggccgcctgcactggaatggcaaggactgcacagagcccctgaagtgccagggcagccctggggccagcaaggccatgctgagctgcaacagaagtggcaagaaggacacctgtgccctgacctgccccagccgggcccgcttcctgcctgagagtgaaaatggcttcaccgtgtcctgtggcacccccagcccccgggccgccccagcccgggccggccacaacggcaacagcaccaacagcaaccactgccacgaggccgctgtgctgagcatcaagcagagggccagcttcaagatcaaggatgccaagtgccgcctgcacctgagaaataaaggcaagacagaggaggccggccgcatcactggacctggaggagccccctgcagcgagtgccaggtgaccttcatccacctgaagtgtgacagcagcaggaaaggaaaaggaagaagagcccggaccccacctgggaaggaggtgacccggctgaccctggagctggaggccgaggtgcgggcagaggagaccacagccagctgtggcctgccctgcctgcggcagaggatggagcggcggctgaagggcagcctgaagatgctgaggaagagcatcaaccaggaccgcttcctgctgcggctggccggcctggactatgagctggcccacaagccaggcctggtggccggggagagagctgagcccatggagagctgcaggcctggccagcaccgggccggcaccaagtgtgtgtcctgcccccagggcacctactaccacggccagacagagcagtgtgtgccctgcccagctggcaccttccaggagcgggagggccagctgagctgtgacctgtgccccggcagtgatgcccacggccccctgggcgccaccaacgtgaccacctgtgccggccagtgccccccaggccagcacagcgtggatggcttcaagccctgccagccctgcccccggggcacctaccagcctgaggccggccgcaccctgtgcttcccctgtggcggcggcctgaccaccaagcatgagggcgccatctccttccaggactgtgacaccaaggtgcagtgcagccctggccactactacaacaccagcatccaccgctgcatccgctgtgccatgggcagctaccagcctgacttccggcagaacttctgcagccgctgccccggcaacaccagcacagactttgatggcagcacctctgtggcccagtgcaagaaccggcagtgtggcggggagctgggggagttcaccggctacatcgagagccccaactacccaggcaactacccagctggggtggagtgcatctggaacatcaaccccccacccaagaggaagatcctgattgtggtgcctgagatcttcctgcccagtgaagatgaatgtggagatgtgctggtgatgaggaagaacagcagccccagcagcatcaccacctatgagacctgccagacctatgagcggcccatcgccttcaccgcccggagcaggaagctgtggatcaacttcaagaccagcgaggccaacagcgcccggggcttccagatcccctacgtgacctatgatgaggactatgagcagctggtggaggacatcgtgagagatggccgcctgtatgccagcgagaaccaccaggagatcctgaaggacaagaagctgatcaaggccttctttgaggtgctggcccacccccagaactacttcaagtacacagagaagcacaaggagatgctgcccaagagcttcatcaagctgctgcggagcaaggtgtcctccttcctgcggccctacaagtag

SEQ ID NO: 6968 - DNA, 4773 bp, Artificial Sequence
  Description of Artificial Sequence: Synthetic coding sequence
atgcctgggggcgcctgtgtgctggtgattgccctgatgttcctggcctggggcgaggcccaggagtgcagccctgggggccaccagttcctgcggagcccctacagatctgtgcgctttgacagctggcacctgcagcagagcgctgtgcaggacctgatctgtgaccacagcctgagccctggctggtaccgcttcctgatcctggacaggcctgctgagatgcccaccaagtgtgtggagatgaaccactgcggcacccaggcccccatctggctgagcctgcgggacagcgagaccctgcccagccctggagagatcaagcagctgacagcctgtgccacctggcagttcctgttcagcaccaccaaggactgctgcctcttccagatccctgtgtctgtgaggaactgtggcaacttctctgtgtacctgctgcagcccacccagggctgcatgggctactgtgccgaggccatcagtgatgcccggctgcacccctgtggcagtgatgaaacagaaacaggaggagactgtgtgcggcagctggccgccagcctgcccccacctcctgctggccggcctgaggtgctggtggagctgattgagagccgcctcttctgccgctgcagctttgatgtgcctgccaccaagaacagcgtgggcttccacatcgcctggagccggctgagcagccaggaggtgaaggaggagctgacccaggagaccaccgtgcaggccttcagcctgctggagctggatggcatcaacctgcggctgggggaccgcatcttctgcagcgcctctgtgttcttcctggagaacccccacgtgcagagcgtggccatcgagagccaggagttctttgctggcttcaagctgcagcctgagctgagcaccatcagtgaagatggcaaggagtactacctgcgcatcgagagcacagtgcccatcatctgcagcgagttcagcgagctggaccaggagtgcaagatcagcctgaagctgaagaccatcggccagggccgggagcacctgggcctgaacctggccctgagcagctgccacgtggacctgctgcagaccagcagctgtgccaacggcacctgcagccacacctttgtgtactacacagctgtgacagacttcagcagagatggagacagagtgagcaacatcgtggtgcagcccatcgtgaatgaagacttcctgtggaacaactacatcccagacagcatccagatcaaggtgaaggatgtgcccacagcctactgctacaccttcacagacccccacatcatcacctttgatggccgggtgtatgacaacttcaagacaggcacctttgtgctgtacaagtccatgagccgggactttgaggtgcacgtgcggcagtgggactgccgcagcctgcactaccctgtgtcctgcaactgtggctttgtggcccaggagggcggggacatcgtgacctttgacatgtgcaatggccagctgcgggagagccagccctacctgttcatcaagagccaggatgtgaccaggaacatcaagatcagcgagagctacctgggcaggaaggtgaccatctggttcagcagcggggccttcatccgggctgacctgggggagtggggcatgagcctgaccatccgggcccccagcgtggactacagaaacaccctgggcctgtgtggcacctttgatgagaacccagaaaatgacttccatgacaagaatggcatgcagattgaccagaacttcaacaactacgtggccttcatcaatgagtggaggatcctgcccgggaagtccatgtctgacaccctgcctgtgtccatgaccagccctgggaagcccagctactgcagctgcagcctggacacagctgcctaccccagcagcgaggacctggacagcgtgagccgctctgagatcgccctgggctgcaaggacctgaaccacgtgtccctgagcagcctcatccctgagctggatgtgaccagcgagtacatcaacagcgacaccctggtgcgggagatcaacaagcacaccagccctgaggagtacaacctgaacctcttcctgcaggagaagaagcacatcaacctgaccaagctgggcctgaatgtgcagaagcaccctggaaatgagaaggaggacagcctgcagtacctggccaacaagaagtacacccagggccggggcagccacagccaggagatgagatacaaccggcagaaccgctggaagaggcagaacttccacgagttcccccccctgtttgccttccccagcctgagccagacagacctggaggagctgacctacttcttcccagaagatcatgctgaagatgtgcagcaggagttcttccccagctggcccaccccatctggcctgacagagtacagcaccctgaccctgtgccaggagaccctggccaacagcagcatcggccgcctgtgcctggccttcctgggcaagaggctggacagcgtgattgagatgtgtgtgaaggatgtgctgctgaaggatgacctgtcctgggccgaggccggcgtggccctgctggagaatgaatgtgagaagagaattgtggaggagggcaagtacaacacagaggagtatggcaccagcattgaggacatcctgtctgtgctgaagtgccccaacctgtgcagcggaaatggccagtgcatggagtggggctgtgcctgcagccccagcttcagcagctatgactgcagcgacagctatgacaaggcccctgagatcacagagctgggcaatgccggcttctgtgatgtgcagaagtacaactgcatgatggtgcgggtgtttgggaagggcttcaaggagctgcccagcatcaagtgtgaggtgaccaagctgcagtacaacagcagcgagtggatgcctggagagcccatctacacccagaccgtcttccacaacagcagagctgtggactgccagctgcccacagatgtgcagcagtttgacaccatggacctggtgggcggcaagcccaccgggaagtggcagctgaaggtgtccaatgatggctacaagttcagcaaccccaagatcaccgtcatctatgatggagcctgccaggtgtgtggcctgtacaagaatgacagctgcaccatcaaggaaaatgtgtgcatcattgatggcctgtgctacgtggagggggacaagaaccccaccagcccctgcctgatctgccggcccaagatcagccgcttcacctggagcttcctggagaacaaccagccccctgtgatccaggccctgcaggacaagctgcagaccttctatggagaaaattttgagtaccagtttgtggcctttgatcctgagggcagtgacatccacttcaccctggacagcggccctgagggcgcctctgtgagcagcgctggcctcttcatgtggaagacagacctgctgaccacccagcagatcaccgtgcggctgaatgatgactgtgatgctgagaccagggtgaccatcgaggtgacagtgaagagctgtgactgcctgaatggaggcagctgtgtgtctgacaggaacttcagccctggcagcggcgtgtacctgtgtgtgtgcctgcccggcttccacggcagcctgtgtgaggtggacatcagcggctgccagagcaacccctgtggcctgggcagctacatcagcggcttccacagctacagctgtgactgccccccagagctgaaggtggagacccagtttgtgaaccagttcaccacccagacagtggtgctgaccaggagtgacaagtctgtgaacaaggaggaggatgacaagaatgcccagggcaggaagagacatgtgaagcccaccagcggaaatgccttcaccatctgcaagtacccctgtgggaagagcagagaatgtgtggcccccaacatctgcaagtgcaagccaggctacatcggcagcaactgccagacagccctgtgtgaccctgactgcaagaaccacggcaagtgcatcaagcccaacatctgccagtgcctgcccggccacggcggggccacctgtgatgaggagcactgcaaccccccctgccagcacggcggcacctgcctggccggcaacctgtgcacctgcccctacggctttgtgggcccccgctgtgagaccatggtgtgcaacagacactgtgaaaatggaggccagtgcctgaccccagacatctgccagtgcaagccaggctggtacggccccacctgcagcacagccctgtgtgaccctgtgtgcctgaatggaggcagctgcaacaagcccaacacctgcctgtgccccaacggcttctttggagagcactgccagaatgccttctgccaccccccctgcaagaatggaggccactgcatgaggaacaacgtgtgtgtgtgccgggagggctacacaggaagacgcttccagaagagcatctgtgaccccacctgcatgaatggaggaaaatgtgtgggccccagcacctgcagctgccccagcggctggagcggcaagcgctgcaacacccccatctgcctgcagaagtgcaagaatggaggagaatgtattgcccccagcatctgccactgccccagctcctgggagggcgtgcgctgccagatccccatctgcaaccccaagtgcctgtatggaggccgctgcatcttccccaacgtgtgcagctgcaggacagagtacagcggcgtgaagtgtgagaagaagatccagatccgccgccactag

SEQ ID NO: 6969 - DNA, 624 bp, Artificial Sequence
  Description of Artificial Sequence: Synthetic coding sequence
atgagcaccaagccagacatgatccagaagtgcctgtggctggagatcctgatgggcatcttcatcgccggcaccctgagcctggactgcaacctgctgaatgtgcacctgcggcgggtgacctggcagaacctgcggcacctgagctccatgagcaacagcttccctgtggagtgcctgcgggagaacatcgcctttgagctgccccaggagttcctgcagtacacccagcccatgaagagggacatcaagaaggccttctatgagatgagcctgcaggccttcaacatcttcagccagcacaccttcaagtactggaaggagcggcacctgaagcagatccagatcggcctggaccagcaggccgagtacctgaaccagtgcctggaggaggacaagaatgaaaatgaagacatgaaggagatgaaggaaaatgagatgaagcccagcgaggcccgggtgccccagctgagcagcctggagctgcggcgctacttccacagaattgacaacttcctgaaggagaagaagtacagcgactgtgcctgggagatcgtgcgggtggagatccgccgctgcctgtactacttctacaagttcaccgccctcttccggaggaagtag

SEQ ID NO: 6970 - DNA, 939 bp, Artificial Sequence
  Description of Artificial Sequence: Synthetic coding sequence
atggagagcgccctgcctgctgctggcttcctgtactgggtgggcgccggcaccgtggcctacctggccctgcgcatctcctacagcctcttcaccgccctgcgggtgtggggcgtgggcaatgaagctggggtgggccctggcctgggggagtgggccgtggtgacaggcagcacagatggcatcggcaagagctatgcagaggagctggccaagcacggcatgaaggtggtgctgatcagccgcagcaaggacaagctggaccaggtgagcagcgagatcaaggagaagttcaaggtggagaccaggaccatcgctgtggactttgccagcgaggacatctatgacaagatcaagacaggcctggccggcctggagatcggcatcctggtgaacaacgtgggcatgtcctatgagtacccagagtacttcctggatgtgcctgacctggacaacgtcatcaagaagatgatcaacatcaacatcctgtctgtgtgcaagatgacccagctggtgctgcccggcatggtggagaggagcaaaggagccatcctgaacatcagcagcggcagcggcatgctgcctgtgcccctgctgaccatctacagcgccaccaagacctttgtggacttcttcagccagtgcctgcacgaggagtaccgcagcaaaggagtgtttgtgcagagcgtgctgccctactttgtggccaccaagctggccaagatcaggaagcccaccctggacaagcccagccctgagacctttgtgaagagcgccatcaagacagtgggcctgcagagcaggaccaacggctacctgattcatgccctgatgggcagcatcatcagcaacctgcccagctggatctacctgaagatcgtgatgaacatgaacaagagcacccgggcccactacctgaagaagaccaagaagaactag

SEQ ID NO: 6971 - DNA, 2214 bp, Artificial Sequence
  Description of Artificial Sequence: Synthetic coding sequence
atggagctgggctgctggacccagctgggcctgaccttcctgcagctgctgctgatcagcagcctgccccgggagtacaccgtcatcaatgaggcctgccctggagctgagtggaacatcatgtgccgggagtgctgtgaatatgaccagattgaatgtgtgtgccctgggaagcgggaggtggtgggctacaccatcccctgctgcagaaatgaagaaaatgaatgtgacagctgcctgatccaccctggctgcaccatctttgagaactgcaagagctgcagaaatggctcctggggcggcaccctggatgacttctacgtgaagggcttctactgtgctgaatgtcgggccggctggtatggaggagactgcatgagatgtggccaggtgctgcgggcccccaagggccagatcctgctggagagctaccccctgaatgcccactgtgagtggaccatccacgccaagccaggcttcgtcatccagctgcgctttgtgatgctgagcctggagtttgactacatgtgccagtatgactatgtggaggtgagagatggagacaacagagatggccagatcatcaagagggtgtgtggaaatgaaagacctgcccccatccagagcatcggcagcagcctgcacgtgctcttccacagtgatggcagcaagaactttgatggcttccacgccatctatgaggagatcacagcctgcagcagcagcccctgcttccatgatggcacctgtgtgctggacaaggccggcagctacaagtgtgcctgcctggccggctacacaggccagagatgtgagaacctgctggaggccggcaagagcaagatcaaggccagcgaggacagcctgtctgtgctggaggagaggaactgcagcgaccccggcggccctgtgaatggctaccagaagatcactggaggccctggcctcatcaatggaagacatgccaagattggcaccgtggtgtccttcttctgcaacaacagctatgtgctgtctggaaatgagaagaggacctgccagcagaatggagagtggagcggcaagcagcccatctgcatcaaggcctgccgggagcccaagatcagtgacctggtgagaagaagagtgctgcccatgcaggtgcagagccgggagacccccctgcaccagctgtacagcgctgccttcagcaagcagaagctgcagagcgcccccaccaagaagccagccctgccctttggagacctgcccatgggctaccagcacctgcacacccagctgcagtatgagtgcatcagccccttctacagaaggctgggcagcagcaggaggacctgcctgaggacaggcaagtggagcggccgggcccccagctgcatccccatctgtgggaagattgagaacatcacagcccccaagacccagggcctgcgctggccctggcaggccgccatctacagaaggaccagcggcgtgcatgatggcagcctgcacaagggggcctggttcctggtgtgcagcggggccctggtgaatgaaagaacagtggtggtggccgcccactgtgtgacagacctgggcaaggtgaccatgatcaagacagctgacctgaaggtggtgctgggcaagttctacagagatgatgacagagatgagaagaccatccagagcctgcagatcagcgccatcatcctgcaccccaactatgaccccatcctgctggatgctgacatcgccatcctgaagctgctggacaaggcccgcatcagcaccagggtgcagcccatctgcctggccgccagccgggacctgagcaccagcttccaggagagccacatcaccgtggccggctggaatgtgctggctgatgtgcgcagccctggcttcaagaatgacaccctgcggtctggagtggtgtctgtggtggacagcctgctgtgtgaggagcagcacgaggaccacggcatccctgtgtctgtgacagacaacatgttctgtgcctcctgggagcccacagcccccagcgacatctgcacagctgagaccggcggcattgctgctgtgtccttccctggccgggccagccctgagccccgctggcacctgatgggcctggtgtcctggagctatgacaagacctgcagccaccggctgagcacagccttcaccaaggtgctgcccttcaaggactggattgaaagaaacatgaagtag

SEQ ID NO: 6972 - DNA, 1503 bp, Artificial Sequence
  Description of Artificial Sequence: Synthetic coding sequence
atgggcacagcccgctggctggccctgggcagcctgtttgccctggccggcctgctggagggccgcctggtgggggaggaggaggccggctttggagaatgtgacaagttcttctacgccggcaccccacctgctggcctggccgctgacagccacgtgaagatctgccagagagctgagggcgctgagagatttgccaccctgtacagcacccgggaccgcatccctgtgtacagcgccttccgggcccccaggcctgcccctgggggcgctgagcagcgctggctggtggagccccagattgatgaccccaacagcaacctggaggaggccatcaatgaagctgaggccatcacctctgtgaacagcctgggcagcaagcaggccctgaacacagactacctggacagcgactaccagaggggccagctgtaccccttcagcctgagcagtgatgtgcaggtggccaccttcaccctgaccaacagcgcccccatgacccagagcttccaggagcgctggtacgtgaacctgcacagcctgatggaccgggccctgaccccccagtgtggcagcggggaggacctgtacatcctgaccggcaccgtgcccagcgactacagagtgaaggacaaggtggccgtgcctgagtttgtgtggctggccgcctgctgtgctgtgcctgggggcggctgggccatgggctttgtgaagcacacccgggacagcgacatcattgaagatgtgatggtgaaggacctgcagaagctgctgcccttcaacccccagctgttccagaacaactgtggggagacagagcaggacacagagaagatgaagaagatcctggaggtggtgaaccagatccaggatgaggagaggatggtgcagagccagaagagcagcagccccctgagcagcaccaggagcaagaggagcaccctgctgcccccagaggccagcgagggcagcagcagcttcctgggcaagctgatgggcttcatcgccacccccttcatcaagctgttccagctgatctactacctggtggtggccatcctgaagaacatcgtgtacttcctgtggtgtgtgaccaagcaggtgatcaatggcatcgagagctgcctgtaccgcctgggcagcgccaccatctcctacttcatggccatcggggaggagctggtgtccatcccctggaaggtgctgaaggtggtggccaaggtgatccgggccctgctgcgcatcctgtgctgcctgctgaaggccatctgccgggtgctgagcatccctgtgcgggtgctggtggatgtggccaccttccctgtgtacaccatgggcgccatccccatcgtgtgcaaggacatcgccctgggcctgggcggcaccgtgtccctgctgtttgacacagccttcggcaccctgggcggcctcttccaggtggtgttttctgtgtgcaagagaattggctacaaggtgacctttgacaacagcggggagctgtag

SEQ ID NO: 6973 - DNA, 300 bp, Artificial Sequence
  Description of Artificial Sequence: Synthetic coding sequence
atgaagagcgccaagctgggcttcctgctgcgcttcttcatcttctgcagcctgaacaccctgctgctgggcggcgtgaacaagattgctgagaagatctgtggggacctgaaggacccctgcaagctggacatgaactttggcagctgctatgaggtgcacttccgctacttctacaacagaaccagcaagagatgtgagacctttgtgttcagcggctgcaatggaaacctgaacaacttcaagctgaagattgagcgggaggtggcctgtgtggccaagtacaagcccccaagatag

SEQ ID NO: 6974 - DNA, 390 bp, Artificial Sequence
  Description of Artificial Sequence: Synthetic coding sequence
atgcccatggccagcccccagaccctggtgctgtacctgctggtgctggccgtgacagaggcctggggccaggaggccgtcatccctggctgccacctgcaccccttcaacgtgacagtgcggagtgaccggcagggcacctgccagggcagccacgtggcccaggcctgtgtgggccactgtgagagcagcgccttccccagccgctacagcgtgctggtggccagcggctaccgccacaacatcacctctgtgtcccagtgctgcaccatcagcggcctgaagaaggtgaaggtgcagctgcagtgtgtgggcagcagaagagaggagctggagatcttcaccgcccgggcctgccagtgtgacatgtgccgcctgagccgctactag

SEQ ID NO: 6975 - DNA, 1965 bp, Artificial Sequence
  Description of Artificial Sequence: Synthetic coding sequence
atggccaagtttggagtgcaccgcatcctgctgctggccatcagcctgaccaagtgcctggagagcaccaagctgctggccgacctgaagaagtgtggggacctggagtgtgaggccctgatcaacagagtgtctgccatgagggactaccggggccctgactgccgctacctgaacttcaccaagggggaggagatctctgtgtatgtgaagctggccggggagcgggaggacctgtgggccggcagcaagggcaaggagtttggctacttccccagagatgctgtgcagatcgaggaggtgttcatcagcgaggagatccagatgagcaccaaggagagtgacttcctgtgcctgctgggcgtgtcctacacctttgacaatgaagattctgagctgaatggagactatggagagaacatctacccctatgaggaggacaaggatgagaagagcagcatctatgaaagtgacttccagatcgagcccggcttctacgccacctatgagagcaccctgtttgaggaccaggtgcctgccctggaggccccagaagatattggcagcaccagcgagagcaaggactgggaggaggtggtggtggagagcatggagcaggaccgcatccctgaggtgcacgtgccccccagcagcgctgtgtctggagtgaaggagtggtttggcctgggcggggagcaggccgaggagaaggcctttgaatctgtgattgagcctgtgcaggagagcagcttccgcagcaggaagattgctgtggaggatgaaaatgacctggaggagctgaacaatggagagccccagacagagcaccagcaggagagcgagagcgagattgacagcgtgcccaagacccagagcgagctggccagcgagagcgagcacatccccaagccccagagcacaggctggtttggaggcggcttcaccagctacctgggctttggagatgaggacaccggcctggagctgattgctgaggagagcaacccccccctgcaggacttccccaacagcatcagcagtgacaaggaggccaccgtgccctgcacagagatcctgacagagaagaaggacaccatcaccaatgacagcctgagcctgaagcccagctggtttgattttggatttgccatcctgggctttgcctatgccaaggaggacaagatcatgctggatgacaggaagaatgaggaggatggaggagcagatgaacatgagcaccccctgaccagcgagctggaccctgagaaggagcaggagattgagaccatcaagatcattgaaacagaggaccagattgacaagaagcctgtgtctgagaagacagatgaaagtgacaccatcccctacctgaagaagttcctgtacaactttgacaacccctggaacttccagaacatccccaaggagacagagctgcccttccccaagcagatcctggaccagaacaacgtgattgaaaatgaggagactggagagttcagcattgacaactaccccacagacaacaccaaggtgatgatcttcaagagcagctacagcctgagtgacatggtgagcaacatcgagctgcccacccgcatccacgaggaggtgtactttgagcccagcagcagcaaggacagtgatgagaacagcaagcccagcgtggacacagagggccctgccctggtggagattgacagatctgtggagaacaccctgctgaacagccagatggtgtccacagacaacagcctgagcagccagaactacatcagccagaaggaggatgccagcgagttccagatcctgaagtacctgttccagattgatgtgtatgacttcatgaacagcgccttcagccccatcgtcatcctgacagagcgggtgtccctgcccttcaagccctttgccatcatcctgcccatcctgctgaacatccgggtggccaccaagtatgtgtag

SEQ ID NO: 6976 - DNA, 1152 bp, Artificial Sequence
  Description of Artificial Sequence: Synthetic coding sequence
atggccggcatccctggcctgctcttcctgctcttcttcctgctgtgtgctgtgggccaggtgagcccctacagcgccccctggaagcccacctggccagcctaccgcctgcctgtggtgctgccccagagcaccctgaacctggccaagccagactttggagctgaggccaagctggaggtgagcagcagctgtggcccccagtgccacaagggcacccccctgcccacctatgaggaggccaagcagtacctgtcctatgagaccctgtatgccaacggcagcaggacagagacccaggtgggcatctacatcctgagcagcagtggagatggagcccagcaccgggacagcggcagcagcggcaagagcaggaggaagaggcagatctacggctatgacagccgcttcagcatctttgggaaggacttcctgctgaactaccccttcagcacctctgtgaagctgagcacaggctgcaccggcaccctggtggccgagaagcacgtgctgacagctgcccactgcatccatgatggcaagacctacgtgaagggcacccagaagctgcgggtgggcttcctgaagcccaagttcaaggatggcggccgcggggccaatgacagcaccagcgccatgcctgagcagatgaagttccagtggatccgggtgaagaggacccacgtgcccaagggctggatcaagggaaatgccaatgacatcggcatggactatgactatgccctgctggagctgaagaagccccacaagaggaagttcatgaagattggagtgtccccaccagccaagcagctgcccggcggccgcatccacttcagcggctatgacaatgacaggcctggcaacctggtgtaccgcttctgtgatgtgaaggatgagacctatgacctgctgtaccagcagtgtgatgcccagcccggggccagcggcagcggcgtgtatgtgaggatgtggaagaggcagcagcagaagtgggagaggaagatcatcggcatcttcagcggccaccagtgggtggacatgaatggcagcccccaggacttcaacgtggccgtgcgcatcacccccctgaagtatgcccagatctgctactggatcaagggcaactacctggactgccgggagggctag

SEQ ID NO: 6977 - DNA, 1662 bp, Artificial Sequence
  Description of Artificial Sequence: Synthetic coding sequence
atgaagtggtgctggggccctgtgctgctgattgctggggccaccgtgctgatggagggcctgcaggccgcccagagggcctgtggccagaggggccctggcccccccaagccccaggagggcaacacagtgcctggagagtggccctggcaggcctctgtgcggcggcagggcgcccacatctgcagcggcagcctggtggccgacacctgggtgctgacagctgcccactgctttgagaaggctgctgccacagagctgaacagctggagcgtggtgctgggcagcctgcagcgggagggcctgagccctggagctgaggaggtgggcgtggccgccctgcagctgccccgggcctacaaccactacagccagggcagtgacctggccctgctgcagctggcccaccccaccacccacacccccctgtgcctgccccagcctgcccaccgcttcccctttggagccagctgctgggccaccggctgggaccaggacaccagtgatgcccctggcaccctgaggaacctgcggctgcggctcatcagccggcccacctgcaactgcatctacaaccagctgcaccagaggcacctgagcaacccagcccggcccggcatgctgtgtggcggcccccagcccggggtgcagggcccctgccagggcgacagcggcggccctgtgctgtgcctggagccagatggccactgggtgcaggccggcatcatcagctttgccagcagctgtgcccaggaggatgcccctgtgctgctgaccaacacagctgcccacagctcctggctgcaggcccgggtgcagggcgccgccttcctggcccagagccctgagaccccagagatgtctgatgaggacagctgtgtggcctgtggcagcctgaggacagctggcccccaggccggggcccccagcccctggccctgggaggcccggctgatgcaccagggccagctggcctgtggcggggccctggtgtctgaggaggccgtgctgacagctgcccactgcttcatcggccggcaggcccctgaggagtggagcgtgggcctgggcaccaggcctgaggagtggggcctgaagcagctgatcctgcatggagcctacacccaccctgagggcggctatgacatggccctgctgctgctggcccagcctgtgaccctgggcgccagcctgcggcccctgtgcctgccctacccagaccaccacctgcctgatggagagcggggctgggtgctgggccgggcccggcctggggccggcatcagcagcctgcagacagtgcctgtgaccctgctgggcccccgggcctgcagccggctgcatgctgcccctggaggagatggcagccccatcctgcccggcatggtgtgcaccagcgctgtgggggagctgcccagctgtgagggcctgagcggggcccccctggtgcatgaggtgcggggcacctggttcctggccggcctgcacagctttggagatgcctgccagggccctgcccggcctgctgtgttcaccgccctgcctgcctatgaggactgggtgagcagcctggactggcaggtgtactttgctgaggagcctgagcctgaggccgagcccggcagctgcctggccaacatcagccagcccaccagctgctag

SEQ ID NO: 6978 - DNA, 936 bp, Artificial Sequence
  Description of Artificial Sequence: Synthetic coding sequence
atgggcatcatccagagcatcctggccaccagccgggactgctacagcttcaagaagaagcccatccccaagaagcccaccatgctggccctggccaagatcctgctgatcagcaccctcttctacagcctgctgagcggcagccacggcaaggagaaccaggacatcaacaccacccagaacattgctgaggtgttcaagaccatggagaacaagcccatcagcctggagagcgaggccaacctgaacagcgacaaggagaacatcaccaccagcaacctgaaggccagccacagcccccccctgaacctgcccaacaacagccacggcatcacagacttcagcagcaacagcagcgctgagcacagcctgggcagcctgaagcccaccagcaccatcagcaccagccccccactcatccacagctttgtgtccaaggtgccctggaatgcccccatcgcagatgaggacctgctgcccatcagcgcccaccccaatgccaccccagccctgagcagcgagaacttcacctggagcctggtgaatgacacagtgaagaccccagacaacagcagcatcaccgtgtccatcctgagcagcgagcccaccagccccagcgtgacccccctgattgtggagcccagcggctggctgaccaccaacagcgacagcttcaccggcttcaccccctaccaggagaagaccaccctgcagcccaccctgaagttcaccaacaacagcaagctgttccccaacaccagtgacccccagaaggtgctgcggctggacaatgcccctgagccctatgatgtgtcctttggaaacagcagctactacaaccccaccctgaatgacagcgccatgcctgagagtgaagaaaatgccagagatggcatccccatggatgacatcccccccctgcggacctctgtgtag

SEQ ID NO: 6979 - DNA, 3120 bp, Artificial Sequence
  Description of Artificial Sequence: Synthetic coding sequence
atgcagagccggctgctgctgctgggcgcccctgggggccacggcggccctgccagcaggaggatgaggctgctgctgcggcaggtggtgcagaggaggcctggaggagaccggcagaggcctgaggtgcggctgctgcacgccggcagcggggctgacaccggggacacagtgaacattggagatgtgtcctacaagctgaagatccccaagaaccctgagctggtgccccagaactacatcagtgacagcctggcccagagcgtggtgcagcacctgcgctggatcatgcagaaggacctgctgggccaggatgtgttcctgattggccccccaggccccctgcggcgcagcatcgccatgcagtacctggagctgaccaagcgggaggtggagtacatcgccctgagccgggacaccacagaaacagacctgaagcagaggcgggagatccgggccggcacagccttctacatcgaccagtgtgctgtgcgggccgccacagagggccgcaccctcatcctggagggcctggagaaggccgagagaaatgtgctgcctgtgctgaacaacctgctggagaaccgggagatgcagctggaggatggccgcttcctgatgtctgctgagagatatgacaagctgctgcgggaccacaccaagaaggagctggacagctggaagatcgtgcgggtgtctgagaacttccgggtgattgccctgggcctgcctgtgccccgctacagcggcaaccccctggacccccccctgcggagccgcttccaggcccgggacatctactacctgcccttcaaggaccagctgaagctgctgtacagcattggagccaacgtgtctgctgagaaggtgtcccagctgctgagctttgccaccaccctgtgcagccaggagagcagcaccctgggcctgcctgacttccccctggacagcctggccgctgctgtgcagatcctggacagcttccccatgatgcccatcaagcacgccatccagtggctgtacccctacagcatcctgctgggccacgagggcaagatggctgtggagggcgtgctgaagagatttgagctgcaggacagcggcagcagcctgctgcccaaggagatcgtgaaggtggagaagatgatggagaaccacgtgtcccaggcctctgtgaccatcagaattgctgacaaggaggtgaccatcaaggtgcctgctggcacccggctgctgagccagccctgtgccagtgaccgcttcatccagaccctgagccacaagcagctgcaggccgagatgatgcagagccacatggtgaaggacatctgcctgattggaggcaagggctgcggcaagacagtcatcgccaagaactttgctgacaccctgggctacaacatcgagcccatcatgctgtaccaggacatgacagcccgggacctgctgcagcagcgctacaccctgcccaatggagacacagcctggaggagcagccccctggtgaatgctgccctggagggcaagctggtgctgctggatggcatccaccgggtgaatgccggcaccctggccgtgctgcagaggctcatccatgaccgggagctgagcctgtatgatggcagccggctgctgagagaagatcgctacatgaggctgaaggaggagctgcagctgagtgatgagcagctgcagaagaggagcatcttccccatccaccccagcttccgcatcatcgccctggccgagccccctgtgattggcagcacagcccaccagtggctgggccctgagttcctgaccatgttcttcttccactacatgaagcccctggtgaagtctgaggagatccaggtgatcaaggagaaggtgcccaacgtgccccaggaggccctggacaagctgctgtccttcacccacaagctgcgggagacccaggaccccacagcccagagcctggccgccagcctgagcacccggcagctgctgcgcatcagccggcggctgagccagtacccaaatgaaaacctgcacagcgctgtgaccaaggcctgcctgagccgcttcctgcccagcctggcccggagcgccctggagaagaacctggctgatgccaccatcgagatcaacacagatgacaacctggagcctgagctgaaggactacaagtgtgaggtgaccagcggcaccctgagaattggagctgtgtctgcccccatctacaatgcccacgagaagatgaaggtgcctgatgtgctcttctatgacaacatccagcacgtgattgtgatggaggacatgctgaaggacttcctgctgggggagcacctgctgctggtgggcaaccagggcgtgggcaagaacaagatcgtggaccgcttcctgcacctgctgaaccggccccgggagtacatccagctgcaccgggacaccaccgtgcagaccctgaccctgcagcccagcgtgaaggatggcctgattgtgtatgaggacagccccctggtgaaggctgtgaagctgggccacatcctggtggtggatgaagctgacaaggcccccaccaacgtgacctgcatcctgaagaccctggtggagaatggagagatgatcctggctgatggaagaagaattgtggccaacagcgccaacgtgaatggccgggagaatgtggtggtgatccacccagacttcaggatgattgtgctggccaaccggcccggcttccccttcctgggcaatgacttcttcggcaccctgggggacatcttcagctgccacgctgtggacaaccccaagccccacagcgagctggagatgctgcggcagtatggccccaacgtgcctgagcccatcctgcagaagctggtggccgcctttggagagctgcggagcctggccgaccagggcatcatcaactacccctacagcacccgggaggtggtgaacatcgtgaagcacctgcagaagttccccacagagggcctgagctctgtggtgagaaatgtgtttgattttgacagctacaacaatgacatgagggagatcctgatcaacaccctgcacaagtatggcatccccatcggggccaagcccacctctgtgcagctggccaaggagtag

SEQ ID NO: 6980 - DNA, 801 bp, Artificial Sequence
  Description of Artificial Sequence: Synthetic coding sequence
atgaggctgctcttcctggccgtgctgcggccccacactggaaatgctgtgacagcccagagggtgcgggcccacctggaggccgccggccacgtgtgtgtgctgaaggatgcctttgattttgagagccgctcagaaattgccaacctgatcctggccgagaactgtgaggccgccctggccctgcacctgtacagaggaggccgcctgctgcagggccaccgcatcccctttggagtcatctttggaggaacagatgtgaatgaagatgccaaccaggccgagaagaacacagtgatgggccgggtgctggaggaggccaggtttgctgtggccttcacagagagcatgaaggagatggcccaggcccagtgggtggaccccgtcttcacccgggaggtgaaggccaaggtgaagagagctgctggggtgcggctgattggagagatgccccaggaggacctgcatgctgtggtgaagaactgctttgctgtggtgaacagctctgtgtctgagggcatgtctgctgccatcctggaggccatggacctggaggtgcctgtgctggccaggaacatccctggaaatgctgctgtggtgaagcatgaggtgacaggcctgctcttcagcaacccccaggagtttgtgcacctggccaagaggctggtgtctgaccctgccctggagaaggagatcgtggtgaatggccgggagtatgtgaggatgtaccacagctggcaggtggagcgggacacctaccagcagctgatcaggaagctggagggcagcacagaagattag

SEQ ID NO: 6981 - DNA, 2478 bp, Artificial Sequence
  Description of Artificial Sequence: Synthetic coding sequence
atgttttctggcttcaacgtgttccgggtgggcatcagctttgtgatcatgtgcatcttctacatgcccaccgtgaacagcctgcctgagctgagcccccagaagtacttcagcaccctgcagcccgggaaggccagcctggcctacttctgccaggccgacagccccaggacctctgtgttcctggaggagctgaatgaggccgtgcggcccctgcaggactatggcatctctgtggccaaggtgaactgtgtgaaggaggagatcagccgctactgcggcaaggagaaggacctgatgaaggcctacctgttcaagggcaacatcctgctgcgggagttccccacagacaccctgtttgatgtgaatgccatcgtggcccacgtgctgtttgccctgctcttcagcgaggtgaagtacatcaccaacctggaggacctgcagaacattgaaaatgccctgaagggcaaggccaacatcatcttctcctatgtgcgggccatcggcatccctgagcacagagctgtgatggaggccgcctttgtgtatggcaccacctaccagtttgtgctgaccacagaaattgccctgctggagagcatcggctctgaagatgtggagtatgcccacctgtacttcttccactgcaagctggtgctggacctgacccagcagtgcaggaggaccctgatggagcagcccctgaccaccctgaacatccacctgttcatcaagaccatgaaggcccccctgctgacagaggtggccgaggacccccagcaggtgtccacagtgcacctgcagctgggcctgcccctggtgttcatcgtgtcccagcaggccacctatgaagctgacagaagaacagctgagtgggtggcctggaggctgctgggcaaggccggcgtgctgctgctgctgcgggacagcctggaggtgaacatcccccaggatgccaacgtggtgttcaagagagctgaggagggcgtgcctgtggagttcctggtgctgcatgatgtggacctgatcatcagccacgtggagaacaacatgcacatcgaggagatccaggaggatgaggacaatgacatggagggccctgacattgatgtgcaggatgatgaggtggccgagaccgtcttccgggacaggaagaggaagctgcccctggagctgactgtggagctgacagaggagaccttcaatgccaccgtgatggccagtgacagcatcgtgctcttctacgccggctggcaggccgtgtccatggccttcctgcagagctacattgatgtggccgtgaagctgaagggcaccagcaccatgctgctgacccgcatcaactgtgccgactggagcgatgtgtgcaccaagcagaatgtgacagagttccccatcatcaagatgtacaagaagggggagaaccctgtgtcctatgccggcatgctgggcacagaggacctgctgaagttcatccagctgaaccgcatctcctaccctgtgaacatcaccagcatccaggaggccgaggagtacctgagcggggagctgtacaaggacctgatcctgtacagctctgtgtctgtgctgggcctcttcagccccaccatgaagacagccaaggaggacttcagcgaggccggcaactacctgaagggctacgtgatcaccggcatctacagtgaagaagatgtgctgctgctgagcaccaagtatgctgccagcctgcctgccctgctgctggcccggcacacagagggcaagattgagagcatccccctggccagcacccacgcccaggacatcgtgcagatcatcacagatgccctgctggagatgtttcctgagatcaccgtggagaacctgcccagctacttccggctgcagaagcccctgctgatcctcttcagtgatggcaccgtgaacccccagtacaagaaggccatcctgaccctggtgaagcagaagtacctggacagcttcaccccctgctggctgaacctgaagaacacccctgtgggccggggcatcctgcgggcctactttgaccccctgccccccctgcccctgctggtgctggtgaacctgcacagcggcggccaggtgtttgccttccccagcgaccaggccatcatcgaggagaacctggtgctgtggctgaagaagctggaggccggcctggagaaccacatcaccatcctgcctgcccaggagtggaagccacccctgcctgcctatgacttcctgtccatgattgatgctgccaccagccagaggggcaccaggaaggtgcccaagtgcatgaaggagacagatgtgcaggagaatgacaaggagcagcacgaggacaagtctgctgtgaggaaggagcccatcgagaccctgcgcatcaagcactggaacagaagcaactggttcaaggaggccgagaagagcttccggcgggacaaggagctgggctgcagcaaggtgaactag

SEQ ID NO: 6982 - DNA, 672 bp, Artificial Sequence
  Description of Artificial Sequence: Synthetic coding sequence
atgacctggaggcaccacgtgcggctgctcttcaccgtgtccctggccctgcagatcatcaacctgggcaacagctaccagcgggagaagcacaacggcggccgggaggaggtgaccaaggtggccacccagaagcaccggcagagccccctgaactggaccagcagccactttggagaggtgacaggcagcgctgagggctggggccctgaggagcccctgccctacagctgggccttcggggagggcgccagcgcccggccccgctgctgcagaaatggaggcacctgtgtgctgggcagcttctgtgtgtgcccagcccacttcaccggccgctactgtgaacatgaccagaggagaagtgaatgtggggccctggagcacggggcctggaccctgcgggcctgccacctgtgccgctgcatctttggagccctgcactgcctgcccctgcagaccccagacagatgtgaccccaaggacttcctggccagccacgcccacggccccagcgctgggggcgcccccagcctgctgctgctgctgccctgtgccctgctgcaccggctgctgcggccagatgccccagcccaccccaggagcctggtgcccagcgtgctgcagcgggagcggcggccctgtggccggcccggcctgggccaccggctgtag

SEQ ID NO: 6983 - DNA, 1320 bp, Artificial Sequence
  Description of Artificial Sequence: Synthetic coding sequence
atgcctgccatcgctgtgctggccgctgctgctgctgcctggtgcttcctgcaggtggagagccgccacctggatgccctggccggcggggccggccccaaccacggcaacttcctggacaatgaccagtggctgagcacagtgtcccagtatgaccgggacaagtactggaaccgcttcagagatgatgactacttcaggaactggaaccccaacaagccctttgaccaggccctggaccccagcaaggacccctgcctgaaggtgaagtgcagcccccacaaggtgtgtgtgacccaggactaccagacagccctgtgtgtgtccaggaagcacctgctgccccggcagaagaagggaaatgtggcccagaagcactgggtgggccccagcaacctggtgaagtgcaagccctgccctgtggcccagagcgccatggtgtgtggcagtgatggccacagctacaccagcaagtgcaagctggagttccacgcctgcagcacaggcaagagcctggccaccctgtgtgatggcccctgcccctgcctgcctgagcctgagccccccaagcacaaggccgagaggtctgcctgcacagacaaggagctgaggaacctggccagccggctgaaggactggtttggagccctgcatgaagatgccaacagagtcatcaagcccaccagcagcaacacagcccagggccgctttgacaccagcatcctgcccatctgcaaggacagcctgggctggatgttcaacaagctggacatgaactatgacctgctgctggaccccagcgagatcaatgccatctacctggacaagtatgagccctgcatcaagcccctcttcaacagctgtgacagcttcaaggatggcaagctgagcaacaatgagtggtgctactgcttccagaagccaggcggcctgccctgccagaatgagatgaaccgcatccagaagctgagcaagggcaagagcctgctgggcgccttcatcccccgctgcaatgaggagggctactacaaggccacccagtgccacggcagcacaggccagtgctggtgtgtggacaagtatggaaatgagctggccggcagcaggaagcagggcgctgtgtcctgtgaggaggagcaggagaccagcggggactttggcagcggcggctctgtggtgctgctggatgacctggagtatgaaagagagctgggccccaaggacaaggagggcaagctgcgggtgcacaccagggctgtgacagaagatgatgaagatgaagatgatgacaaggaggatgaggtgggctacatctggtag

SEQ ID NO: 6984 - DNA, 7872 bp, Artificial Sequence
  Description of Artificial Sequence: Synthetic coding sequence
atgaaggtgaagggccggggcatcacctgcctgctggtgtcctttgctgtgatctgcctggtggccacccctgggggcaaggcctgcccccggcgctgtgcctgctacatgcccacagaggtgcactgcaccttccgctacctgaccagcatcccagacagcatcccccccaacgtggagcgcatcaacctgggctacaacagcctggtgcggctgatggagacagacttcagcggcctgaccaagctggagctgctgatgctgcacagcaatggcatccacaccatcccagacaagaccttcagtgacctgcaggccctgcaggtgctgaagatgagctacaacaaggtgaggaagctgcagaaggacaccttctacggcctgcggagcctgacccggctgcacatggaccacaacaacatcgagttcatcaaccctgaggtgttctacggcctgaacttcctgcggctggtgcacctggagggcaaccagctgaccaagctgcacccagacacctttgtgtccctgagctacctgcagatcttcaagatctccttcatcaagttcctgtacctgagtgacaacttcctgaccagcctgccccaggagatggtgtcctacatgccagacctggacagcctgtacctgcacggcaacccctggacctgtgactgccacctgaagtggctgagtgactggatccaggagaagccagatgtgatcaagtgcaagaaggacaggagccccagcagcgcccagcagtgccccctgtgcatgaaccccaggaccagcaagggcaagcccctggccatggtgtctgctgctgccttccagtgtgccaagcccaccatcgacagcagcctgaagagcaagagcctgaccatcctggaggacagcagcagcgccttcatcagcccccagggcttcatggcccccttcggcagcctgaccctgaacatgacagaccagagcggaaatgaggccaacatggtgtgcagcatccagaagcccagcaggaccagccccatcgccttcacagaggagaatgactacatcgtgctgaacaccagcttcagcaccttcctggtgtgcaacatcgactatggccacatccagcctgtgtggcagatcctggccctgtacagcgacagccccctcatcctggagaggagccacctgctgtctgagaccccccagctgtactacaagtacaagcaggtggcccccaagccagaggacatcttcaccaacatcgaggccgacctgcgggctgaccccagctggctgatgcaggaccagatcagcctgcagctgaacagaacagccaccaccttcagcaccctgcagatccagtacagcagtgatgcccagatcaccctgcccagggctgagatgaggcctgtgaagcacaagtggaccatgatcagccgggacaacaacaccaagctggagcacacagtgctggtgggcggcaccgtgggcctgaactgccccggccagggcgaccccaccccccacgtggactggctgctggctgatggcagcaaggtgcgggccccctacgtgtctgaagatggccgcatcctgattgacaagagcggcaagctggagctgcagatggctgacagctttgacaccggggtgtaccactgcatcagcagcaactatgatgatgctgacatcctgacctaccgcatcaccgtggtggagcccctggtggaggcctaccaggagaatggcatccaccacacagtgttcatcggggagaccctggacctgccctgccacagcacaggcatcccagatgccagcatctcctgggtgattcctggcaacaacgtgctgtaccagagcagccgggacaagaaggtgctgaacaacggcaccctgcgcatcctgcaggtgacccccaaggaccagggctactaccgctgtgtggccgccaaccccagcggcgtggacttcctgatcttccaggtgtctgtgaagatgaagggccagaggcccctggagcatgatggagaaacagagggcagcggcctggatgagagcaaccccatcgcccacctgaaggagcccccaggggcccagctgcggaccagcgccctgatggaggccgaggtgggcaagcacaccagcagcaccagcaagaggcacaactaccgggagctgaccctgcagaggagaggagacagcacccaccggcgcttcagagaaaatagaagacacttccccccatctgccaggagaattgacccccagcactgggccgccctgctggagaaggccaagaagaatgccatgccagacaagcgggagaacaccaccgtgtccccacctcctgtggtgacccagctgcccaacatccctggagaagaagatgacagcagcggcatgctggccctgcacgaggagttcatggtgcctgccaccaaggccctgaacctgcctgccaggacagtgacagctgacagcaggaccatcagtgacagccccatgaccaacatcaactacggcacagagttcagccctgtggtgaacagccagatcctgcccccagaggagcccacagacttcaagctgagcacagccatcaagaccacagccatgagcaagaacatcaaccccaccatgagcagccagatccagggcaccaccaaccagcacagcagcaccgtcttccccctgctgctgggcgccacagagttccaggacagcgaccagatgggccggggccgggagcacttccagagccggccccccatcaccgtgaggaccatgatcaaggatgtgaatgtgaagatgctgagcagcaccaccaacaagctgctgctggagagcgtgaacaccaccaacagccaccagacctctgtgcgggaggtgtctgagcccaggcacaaccacttctacagccacaccacccagatcctgagcaccagcaccttccccagcgacccccacacagctgcccacagccagttccccatccccaggaacagcacagtgaacatccccctcttccgccgcttcggccggcagaggaagattggaggccggggccgcatcatcagcccctaccgcacccctgtgctgcggcggcaccgctacagcatcttccgcagcaccacccggggcagcagcgagaagagcaccacagccttcagcgccaccgtgctgaatgtgacctgcctgagctgcctgccccgggagcggctgaccacagccacagctgccctgtccttccccagcgctgcccccatcaccttccccaaggctgacatcgcccgggtgcccagcgaggagagcaccaccctggtgcagaaccccctgctgctgctggagaacaagcccagcgtggagaagaccacccccaccatcaagtacttcagaacagagatcagccaggtgacccccactggagctgtgatgacctacgcccccaccagcatccccatggagaagacccacaaggtgaatgccagctacccccgggtgagcagcaccaatgaggccaagagggacagcgtcatcaccagcagcctgagcggggccatcaccaagccacccatgaccatcatcgccatcacccgcttcagcaggaggaagatcccctggcagcagaactttgtgaacaaccacaaccccaagggccgcctgaggaaccagcacaaggtgtccctgcagaagagcacagctgtgatgctgcccaagaccagccctgccctgccccgggacaaggtgagccccttccacttcaccaccctgagcacctctgtgatgcagatccccagcaacaccctgaccacagcccaccacaccaccaccaagacccacaaccctggcagcctgcccaccaagaaggagctgcccttcccccccctgaaccccatgctgcccagcatcatcagcaaggacagcagcaccaagagcatcatcagcacccagacagccatcccagccaccacccccaccttccctgccagcgtcatcacctatgagacccagacagagaggagccgggcccagaccatccagcgggagcaggagccccagaagaagaacagaacagaccccaacatcagcccagaccagagcagcggcttcaccacccccacagccatgaccccacctgtgctgaccacagctgagacctctgtgaagcccagcgtgtctgccttcacccacagccccccagagaacaccaccggcatcagcagcaccatctccttccacagcaggaccctgaacctgacagatgtgattgaggagctggcccaggccagcacccagaccctgaagagcaccatcgccagcgagaccaccctgagcagcaagagccaccagagcaccaccaccaggaaggccatcatccgccacagcaccatcccccccttcctgagcagcagcgccaccctgatgcctgtgcccatcagcccccccttcacccagagagctgtgacagacaacgtggccacccccatcagcggcctgatgaccaacacagtggtgaagctgcacgagagcagccgccacaatgccaagccccagcagctggtggccgaggtggccaccagccccaaggtgcaccccaatgccaagttcaccatcggcaccacccacttcatctacagcaacctgctgcacagcacccccatgcctgccctgaccaccgtgaagagccagaacagcaagctgacccccagcccctgggccgagaaccagttctggcacaagccctacagcgagattgctgagaagggcaagaagccagaggtgtccatgctggccaccaccggcctgtctgaggccaccaccctggtgtctgactgggatggccagaagaacaccaagaagagtgactttgacaagaagcctgtgcaggaggccaccaccagcaagctgctgccctttgacagcctgagccgctacatctttgagaagccccgcatcgtgggcggcaaggccgccagcttcaccatcccagccaacagtgatgccttcctgccctgtgaggccgtgggcaaccccctgcccaccatccactggaccagggtgcccagcggcctggacctgagcaagaggaagcagaacagccgggtgcaggtgctgcccaacggcaccctgagcatccagagggtggagatccaggaccggggccagtacctgtgcagcgccagcaacctgtttggaacagaccacctgcacgtgaccctgtctgtggtgtcctacccaccccgcatcctggagaggaggaccaaggagatcaccgtgcacagcggcagcacagtggagctgaagtgcagagctgagggccggcccagccccaccgtgacctggatcctggccaaccagacagtggtgtctgagagcagccagggcagccggcaggccgtggtgacagtggatggcaccctggtgctgcacaacctgagcatctatgaccggggcttctacaagtgtgtggccagcaaccctgggggccaggacagcctgctggtgaagatccaggtgattgctgcccctcctgtgatcctggagcagaggcggcaggtgattgtgggcacctggggcgagagcctgaagctgccctgcacagccaagggcaccccccagcccagcgtgtactgggtgctgagtgatggaacagaggtgaagcccctgcagttcaccaacagcaagctgttcctgttcagcaatggcaccctgtacatccggaacctggccagcagtgaccggggcacctatgagtgcatcgccaccagcagcactggaagtgaaagaagagtggtgatgctgaccatggaggagcgggtgaccagccccagaattgaagctgccagccagaagaggacagaggtgaactttggagacaagctgctgctgaactgcagcgccaccggggagcccaagccccagatcatgtggaggctgcccagcaaggctgtggtggaccagcagcaccgggtgggctcctggatccacgtgtaccccaacggcagcctcttcatcggctctgtgacagagaaggacagcggcgtgtacctgtgtgtggccaggaacaagatgggagatgacctgatcctgatgcacgtgtccctgcggctgaagccagccaagattgaccacaagcagtacttcaggaagcaggtgctgcacggcaaggacttccaggtggactgcaaggccagcggcagccctgtgcctgagatctcctggagcctgcctgatggcaccatgatcaacaatgccatgcaggctgatgattctggccacaggacccggcgctacaccctcttcaacaacggcaccctgtacttcaacaaggtgggcgtggccgaggagggggactacacctgctacgcccagaacaccctgggcaaggatgagatgaaggtgcacctgaccgtcatcacagctgccccccgcatccggcagagcaacaagaccaacaagaggatcaaggccggggacacagctgtgctggactgtgaggtgactggagaccccaagcccaagatcttctggctgctgcccagcaatgacatgatctccttcagcattgaccgctacaccttccacgccaacggcagcctgaccatcaacaaggtgaagctgctggacagcggggagtatgtgtgtgtggccaggaaccccagcggagatgacaccaagatgtacaagctggatgtggtgtccaagccacccctcatcaatggcctgtacaccaacagaactgtcatcaaggccacagctgtgcgccacagcaagaagcactttgactgcagagctgagggcacccccagccctgaggtgatgtggatcatgccagacaacatcttcctgacagccccctactacggcagccgcatcaccgtgcacaagaatggcaccctggagatcagaaatgtgcggctgagtgacagcgctgacttcatctgtgtggccagaaatgaaggaggagagagcgtgctggtggtgcagctggaggtgctggagatgctgcggcggcccaccttcaggaaccccttcaatgagaagatcgtggcccagctgggcaagagcacagccctgaactgcagcgtggatggcaaccccccacctgagatcatctggatcctgcccaacggcacccgcttcagcaatggcccccagagctaccagtacctgattgccagcaatggcagcttcatcatcagcaagaccacccgggaggatgctgggaagtaccgctgtgccgccaggaacaaggtgggctacatcgagaagctggtgatcctggagatcggccagaagcctgtgatcctgacctacgcccctggcaccgtgaagggcatcagcggggagagcctgagcctgcactgtgtgtctgatggcatccccaagcccaacatcaagtggaccatgcccagcggctacgtggtggaccggccccagatcaacgggaagtacatcctgcatgacaatggcaccctggtgatcaaggaggccacagcctatgaccggggcaactacatctgcaaggcccagaacagcgtgggccacaccctcatcaccgtgcctgtgatgattgtggcctacccaccccgcatcaccaaccggccccccaggagcatcgtgaccaggactggagctgccttccagctgcactgtgtggccctgggcgtgcccaagccagagatcacctgggagatgccagaccacagcctgctgagcacagccagcaaggagaggacccacggcagcgagcagctgcacctgcagggcaccctggtgatccagaacccccagaccagtgacagcggcatctacaagtgcacagccaagaaccccctgggcagtgactatgctgccacctacatccaggtgatctag

SEQ ID NO: 6985 - DNA, 1995 bp, Artificial Sequence
  Description of Artificial Sequence: Synthetic coding sequence
atgaagacaggcctcttcttcctgtgcctgctgggcacagctgctgccatccccaccaatgcccggctgctgagtgaccacagcaagcccacagctgagaccgtggccccagacaacacagccatccccagcctgcgggcagaggccgaggagaatgagaaggagacagctgtgtccacagaagatgacagccaccacaaggccgagaagagctctgtgctgaagagcaaggaggagagccatgagcagagcgctgagcagggcaagagcagcagccaggagctgggcctgaaggaccaggaggacagtgatggccacctgtctgtgaacctggagtatgcccccacagagggcaccctggacatcaaggaggacatgtctgagccccaggagaagaagctgtctgagaacacagacttcctggcccctggggtgtcctccttcacagacagcaaccagcaggagagcatcaccaagcgggaggagaaccaggagcagcccaggaactacagccaccaccagctgaacagaagcagcaagcacagccagggcctgcgggaccagggcaaccaggagcaggaccccaacatcagcaatggagaggaggaggaggagaaggagcccggggaggtgggcacccacaatgacaaccaggagaggaagacagagctgccccgggagcacgccaacagcaagcaggaggaggacaacacccagagtgatgacatcctggaggagagtgaccagcccacccaggtgtccaagatgcaggaggatgaatttgaccagggcaaccaggagcaggaggacaacagcaatgctgagatggaggaggagaatgccagcaatgtgaacaagcacatccaggagacagagtggcagagccaggagggcaagacaggcctggaggccatcagcaaccacaaggagacagaggagaagacagtgtctgaggccctgctgatggagcccacagatgatggcaacaccaccccaagaaatcatggagtggatgatgatggagatgatgatggagatgatggcggcacagatggccccaggcacagcgccagtgatgactacttcatccccagccaggccttcctggaggccgagcgggcccagagcatcgcctaccacctgaagattgaggagcagcgggagaaggtgcatgaaaatgaaaacatcggcaccacagagcctggagagcaccaggaggccaagaaggccgagaacagcagcaatgaggaggagaccagcagcgagggcaacatgagggtgcatgctgtggacagctgcatgtccttccagtgcaagaggggccacatctgcaaggctgaccagcagggcaagccccactgtgtgtgccaggaccctgtgacctgcccccccaccaagcccctggaccaggtgtgtggcacagacaaccagacctacgccagcagctgccacctgtttgccaccaagtgccgcctggagggcaccaagaagggccaccagctgcagctggactactttggagcctgcaagagcatccccacctgcacagactttgaggtgatccagttccccctgaggatgagggactggctgaagaacatcctgatgcagctgtatgaggccaacagcgagcacgccggctacctgaatgagaagcagaggaacaaggtgaagaagatctacctggatgagaagaggctgctggccggggaccaccccatcgacctgctgctgcgggacttcaagaagaactaccacatgtatgtgtaccctgtgcactggcagttcagcgagctggaccagcaccccatggacagagtgctgacccacagcgagctggcccccctgcgggccagcctggtgcccatggagcactgcatcacccgcttctttgaagaatgtgaccccaacaaggacaagcacatcaccctgaaggagtggggccactgcttcggcatcaaggaggaggacattgatgagaacctgctcttctag

SEQ ID NO: 6986 - DNA, 1254 bp, Artificial Sequence
  Description of Artificial Sequence: Synthetic coding sequence
atgctggccctgctggtgctggtgacagtggccctggccagcgcccaccacggcggggagcactttgaaggagagaaggtgttccgggtgaatgtggaggatgagaaccacatcaacatcatccgggagctggccagcaccacccagattgacttctggaagccagattctgtgacccagatcaagccccacagcacagtggacttccgggtgaaggccgaggacacagtgacagtggagaatgtgctgaagcagaatgagctgcagtacaaggtgctgatcagcaacctgagaaatgtggtggaggcccagtttgacagccgggtgcgggccaccggccacagctatgagaagtacaacaagtgggagaccatcgaggcctggacccagcaggtggccacagaaaatcctgccctgatcagccgctctgtgattggcaccacctttgagggccgggccatctacctgctgaaggtgggcaaggccggccagaacaagccagccatcttcatggactgtggcttccacgcccgggagtggatcagccctgccttctgccagtggtttgtgcgggaggccgtgaggacctacggccgggagatccaggtgacagagctgctggacaagctggacttctacgtgctgcctgtgctgaacattgatggctacatctacacctggaccaagagccgcttctggaggaagaccaggagcacccacacaggcagcagctgcatcggcacagaccccaacagaaactttgatgctggctggtgtgaaattggagccagcaggaacccctgtgatgagacctactgcggccctgctgctgagagcgagaaggagaccaaggccctggccgacttcatccggaacaagctgagcagcatcaaggcctacctgaccatccacagctacagccagatgatgatctacccctacagctatgcctacaagctgggggagaacaatgctgagctgaatgccctggccaaggccaccgtgaaggagctggccagcctgcacggcaccaagtacacctacggccctggggccaccaccatctacccagctgctgggggcagtgatgactgggcctatgaccagggcatccgctacagcttcacctttgagctgcgggacaccggccgctatggcttcctgctgcctgagagccagatccgggccacctgtgaggagaccttcctggccatcaagtatgtggccagctatgtgctggagcacctgtactag

SEQ ID NO: 6987 - DNA, 588 bp, Artificial Sequence
  Description of Artificial Sequence: Synthetic coding sequence
atggctgtgtcccagggagatggcaccctgtgctttgtgctgctgctgtgctgctggcaggagacagagctgcggcccaggacagtcatccctggcagccccacagagatccccttcagcagcaagcaggaggacatgtctgagctgctggatgagatcctggtgcaggagatcctggacctgaacaagaccaccccatctgagatgcccagcacagccagcaccctgagcacccccctgcacgccggcattgatgagaactaccaggccggcggcagcgagaactaccacgagctgctggagaacctgcagttcagccctggcatcgaggtgaagatcagcaatgatgaggccaatgccaatgccaacctgcatggagaccccagcgagaactaccggggcccccaggtgtccccaggcagcgagaagtctgtgagcagcaaggagaagaacagcaagaacacccagtatgagaacctgagcatcctggaccagatcctgcagaacatcggccgcagcagcggcaacatcttccacaaggagcagcagaggaccagcgcccagaggaggagccagggcagccagtag

SEQ ID NO: 6988 - DNA, 2334 bp, Artificial Sequence
  Description of Artificial Sequence: Synthetic coding sequence
atgaatgccaacaaggatgagcggctgaaggcccggagccaggacttccacctgtttcctgccctgatgatgctgtccatgaccatgctgttcctgcctgtgacaggcaccctgaagcagaacatcccccggctgaagctgacctacaaggacctgctgctgagcaacagctgcatccccttcctgggcagcagcgagggcctggacttccagaccctgctgctggatgaggagcggggccgcctgctgctgggcgccaaggaccacatcttcctgctgagcctggtggacctgaacaagaacttcaagaagatctactggccagctgccaaggagcgggtggagctgtgcaagctggccggcaaggatgccaacacagaatgtgccaacttcatccgggtgctgcagccctacaacaagacccacatctacgtgtgtggcaccggggccttccaccccatctgtggctacatcgacctgggcgtgtacaaggaggacatcatcttcaagctggacacccacaacctggagagcggccgcctgaagtgcccctttgacccccagcagccctttgcctctgtgatgacagatgagtacctgtacagcggcacagccagtgacttcctgggcaaggacacagccttcaccaggagcctgggccccacccatgaccaccactacatcagaacagacatcagcgagcactactggctgaatggagccaagttcatcggcaccttcttcatcccagacacctacaacccagatgatgacaagatctacttcttcttccgggagagcagccaggagggcagcaccagtgacaagaccatcctgagccgggtgggccgggtgtgcaagaatgatgtgggcggccagaggagcctcatcaacaagtggaccaccttcctgaaggcccggctcatctgcagcatccctggcagtgatggagctgacacctactttgatgagctgcaggacatctacctgctgcccaccagagatgaaagaaatcctgtggtgtatggagtcttcaccaccaccagcagcatcttcaagggcagcgctgtgtgtgtgtacagcatggctgacatccgggctgtgttcaacggcccctatgcccacaaggagagcgctgaccaccgctgggtgcagtatgatggccgcatcccctaccccaggcctggcacctgccccagcaagacctatgaccccctcatcaagagcacccgggacttcccagatgatgtgatctccttcatcaagaggcacagcgtgatgtacaagtctgtgtaccctgtggccggcggccccaccttcaagaggatcaacgtggactaccgcctgacccagatcgtggtggaccacgtgattgctgaagatggccagtatgatgtgatgttcctgggcacagacattggaacagtgctgaaggtggtgtccatcagcaaggagaagtggaacatggaggaggtggtgctggaggagctgcagatcttcaagcacagcagcatcatcctgaacatggagctgagcctgaagcagcagcagctgtacatcggcagcagagatggcctggtgcagctgagcctgcaccgctgtgacacctacggcaaggcctgtgccgactgctgcctggcccgggacccctactgtgcctgggatggaaatgcctgcagccgctatgcccccaccagcaagaggcgggcccggcggcaggatgtgaagtatggagaccccatcacccagtgctgggacatcgaggacagcatcagccatgaaacagcagatgagaaggtgatcttcggcatcgagttcaacagcaccttcctggagtgcatccccaagagccagcaggccaccatcaagtggtacatccagaggtctggagatgagcaccgggaggagctgaagccagatgagcgcatcatcaagacagaatatggcctgctgatccgcagcctgcagaagaaggacagcggcatgtactactgcaaggcccaggagcacaccttcatccacaccatcgtgaagctgaccctgaatgtgattgaaaatgagcagatggagaacacccagagagctgagcacgaggagggcaaggtgaaggacctgctggccgagagccggctgcgctacaaggactacatccagatcctgagcagccccaacttcagcctggaccagtactgtgagcagatgtggcaccgggagaagaggcggcagagaaataaaggaggccccaagtggaagcacatgcaggagatgaagaagaagaggaacagaagacaccaccgggacctggatgagctgcccagggctgtggccacctag

SEQ ID NO: 6989 - DNA, 1332 bp, Artificial Sequence
  Description of Artificial Sequence: Synthetic coding sequence
atgcagcccagcgagatggtgatgaaccccaagcaggtgttcctgtctgtgctgatcttcggcgtggccggcctgctgctcttcatgtacctgcaggtgtggattgaggagcagcacacaggccgggtggagaagaggcgggagcagaaggtgaccagcggctggggccctgtgaagtacctgcggcctgtgccccgcatcatgagcacagagaagatccaggagcacatcaccaaccagaaccccaagttccacatgccagaagatgtgcgggagaagaaggagaacctgctgctgaacagcgagaggagcacccggctgctgaccaagaccagccacagccagggcggggaccaggccctgagcaagagcacaggcagccccacagagaagctgattgagaagaggcagggcgccaagacagtgttcaacaagttcagcaacatgaactggcctgtggacatccaccccctgaacaagagcctggtgaaggacaacaagtggaagaagacagaggagacccaggagaagaggaggagcttcctgcaggagttctgcaagaagtatggaggagtgagccaccaccagagccacctgttccacacagtgagccgcatctacgtggaggacaagcacaagatcctgtactgtgaggtgcccaaggccggctgcagcaactggaagaggatcctgatggtgctgaatggcctggccagcagcgcctacaacatcagccacaatgctgtgcactacggcaagcacctgaagaagctggacagctttgacctgaagggcatctacacccggctgaacacctacaccaaggctgtgtttgtgcgggaccccatggagcggctggtgtctgccttccgggacaagtttgagcaccccaacagctactaccaccctgtgtttgggaaggccatcatcaagaagtaccggcccaatgcctgtgaggaggccctgatcaatggcagcggcgtgaagttcaaggagttcatccactacctgctggacagccacaggcctgtgggcatggacatccactgggagaaggtgtccaagctgtgctacccctgcctgatcaactatgactttgtgggcaagtttgagaccctggaggaggatgccaactacttcctgcagatgattggagcccccaaggagctgaagttccccaacttcaaggacagacacagcagtgatgagaggaccaatgcccaggtggtgcggcagtacctgaaggacctgaccaggacagagcggcagctgatctatgacttctactacctggactacctgatgttcaactacaccacccccttcctgtag

SEQ ID NO: 6990 - DNA, 3228 bp, Artificial Sequence
  Description of Artificial Sequence: Synthetic coding sequence
atgagaggaggcaagtgcaacatgctgagcagcctgggctgcctgctgctgtgtggcagcatcaccctggccctgggcaatgcccagaagctgcccaagggcaagaggcccaacctgaaggtgcacatcaacaccaccagtgacagcatcctgctgaagttcctgcggcccagccccaacgtgaagctggagggcctgctgctgggctacggcagcaatgtgagccccaaccagtacttccccctgcctgctgagggcaagttcacagaggccatcgtggatgctgagcccaagtacctgattgtggtgcggcctgcccccccacccagccagaagaagagctgcagcggcaagaccaggagcaggaagcccctgcagctggtggtgggcaccctgacccccagcagcgtcttcctgtcctggggcttcctgatcaacccccaccacgactggaccctgcccagccactgccccaatgaccgcttctacaccatccgctaccgggagaaggacaaggagaagaagtggatcttccagatctgcccagccacagagaccatcgtggagaacctgaagcccaacacagtgtatgaatttggagtgaaggacaacgtggagggcggcatctggagcaagatcttcaaccacaagacagtggtgggcagcaagaaggtgaatggcaagatccagagcacctatgaccaggaccacacagtgcctgcctacgtgcccaggaagctgatccccatcaccatcatcaagcaggtgatccagaatgtgacccacaaggacagcgccaagagccctgagaaggcccccctgggcggcgtcatcctggtgcacctgatcatccctggcctgaatgagaccaccgtgaagctgcctgccagcctgatgtttgagatcagtgatgccctgaagacccagctggccaagaatgagaccctggccctgcctgctgagagcaagaccccagaggtggagaagatcagcgcccggcccaccaccgtgaccccagagaccgtgcccaggagcaccaagcccaccaccagcagcgccctggatgtgtctgagaccaccctggccagcagcgagaagccctggatcgtgcccacagccaagatcagcgaggacagcaaggtgctgcagccccagacagccacctatgatgtgttcagcagccccaccaccagtgatgagcctgagatcagtgacagctacacagccaccagtgaccgcatcctggacagcatcccccccaagaccagcaggaccctggagcagccccgggccaccctggcccccagcgagaccccatttgtgccccagaagctggagatcttcaccagccctgagatgcagcccaccaccccagccccccagcagaccaccagcatccccagcacccccaagaggcggccccggcccaagccacccaggaccaagccagagaggaccaccagcgctggcaccatcacccccaagatcagcaagagccctgagcccacctggaccaccccagcccctgggaagacccagttcatcagcctgaagcccaagatccccctgagccctgaggtgacccacaccaagccagcccccaagcagaccccccgggccccacccaagcccaagaccagcccccggccccgcatcccccagacccagcctgtgcccaaggtgccccagagggtgacagccaagcccaagaccagccccagccctgaggtgtcctacaccaccccagcccccaaggatgtgctgctgccccacaagccctacccagaggtgtcccagagcgagcccgcccccctggagacccggggcatccccttcatccccatgatcagccccagccccagccaggaggagctgcagaccaccctggaggagacagaccagagcacccaggagcccttcaccaccaagatccccaggaccacagagctggccaagaccacccaggccccccaccgcttctacaccaccgtgcggcccaggaccagtgacaagccccacatccggcctggggtgaagcaggccccccggcccagcggggctgacagaaatgtgtctgtggacagcacccaccccaccaagaagccaggcaccaggaggcctcccctgcccccccggcccacccaccccaggaggaagcccctgccccccaacaacgtgacaggcaagccaggcagcgctggcatcatcagcagcggccccatcaccaccccacccctgcggagcaccccccggcccaccggcacccccctggagcgcatcgagacagacatcaagcagcccaccgtgcctgccagcggggaggagctggagaacatcacagacttcagcagcagccccacccgggagacagaccccctgggcaagccccgcttcaagggcccccacgtgcgctacatccagaagccagacaacagcccctgcagcatcacagattctgtgaagcgcttccccaaggaggaggccacagagggcaatgccaccagccccccccagaacccccccaccaacctgactgtggtgacagtggagggctgccccagctttgtgatcctggactgggagaagcccctgaatgacacagtgacagaatatgaagtcatcagcagagaaaatggcagcttcagcggcaagaacaagagcatccagatgaccaaccagaccttcagcacagtggagaacctgaagcccaacaccagctatgagttccaggtgaagcccaagaaccccctgggggagggccctgtgagcaacacagtggccttcagcacagagagcgctgacccccgggtgtctgagcctgtgtctgctggaagagatgccatctggacagagcggcccttcaacagcgacagctacagtgaatgtaaaggcaagcagtatgtgaagaggacctggtacaagaagtttgtgggcgtgcagctgtgcaacagcctgcgctacaagatctacctgagtgacagcctgaccgggaagttctacaacatcggggaccagaggggccacggggaggaccactgccagtttgtggacagcttcctggatggccgcacaggccagcagctgaccagtgaccagctgcccatcaaggagggctacttccgggctgtgcggcaggagcctgtgcagtttggagaaattggaggccacacccagatcaactacgtgcagtggtatgaatgtggcaccaccatccctgggaagtggtag

SEQ ID NO: 6991 - DNA, 483 bp, Artificial Sequence
  Description of Artificial Sequence: Synthetic coding sequence
atgctgcccttcctgttcttcagcaccctcttcagcagcatcttcacagaggcccagaagcagtactgggtgtgcaacagcagtgatgccagcatctcctacacctactgtgacaagatgcagtaccccatcagcatcaacgtgaacccctgcatcgagctgaagaggagcaagggcctgctgcacatcttctacatcccccggcgggacctgaagcagctgtacttcaacctgtacatcaccgtgaacaccatgaacctgcccaagaggaaggaggtgatctgccggggcagtgatgatgactacagcttctgccgggccctgaagggggagaccgtgaacaccaccatctccttctccttcaagggcatcaagttcagcaagggcaagtacaagtgtgtggtggaggccatcagcggcagccctgaggagatgctgttctgcctggagtttgtgatcctgcaccagcccaacagcaactag

SEQ ID NO: 6992 - DNA, 780 bp, Artificial Sequence
  Description of Artificial Sequence: Synthetic coding sequence
atggccgccctgatgaggagcaaggacagcagctgctgcctgctgctgctggccgctgtgctgatggtggagagcagccagatcggcagcagccgggccaagctgaacagcatcaagagcagcctgggcggggagaccccaggccaggccgccaacagatctgctggcatgtaccagggcctggcctttggaggcagcaagaagggcaagaacctgggccaggcctacccctgcagcagtgacaaggaatgtgaggtgggccgctactgccacagcccccaccagggcagcagcgcctgcatggtgtgcaggaggaagaagaagcgctgccacagagatggcatgtgctgccccagcacccgctgcaacaacggcatctgcatccctgtgacagagagcatcctgaccccccacatcccagccctggatggcaccaggcaccgggacaggaaccacggccactacagcaaccacgacctgggctggcagaacctgggccggccccacaccaagatgagccacatcaagggccacgagggggacccctgcctgcggagcagtgactgcatcgagggcttctgctgtgcccggcacttctggaccaagatctgcaagcctgtgctgcaccagggcgaggtgtgcaccaagcagaggaagaagggcagccacggcctggagatcttccagagatgtgactgtgccaagggcctgagctgcaaggtgtggaaggatgccacctacagcagcaaggcccggctgcacgtgtgccagaagatctag

SEQ ID NO: 6993 - DNA, 3030 bp, Artificial Sequence
  Description of Artificial Sequence: Synthetic coding sequence
atgggccagctgtgctggctgcccctgctggcccccctgctgctgctgcggcccccaggagtgcagagcgctggccccatccgggcctttgtggtgccccacagccacatggatgtgggctgggtgtacacagtgcaggagagcatgagggcctatgctgccaacgtgtacacctctgtggtggaggagctggcccggggccagcagaggcgcttcatcgctgtggagcaggagttcttccggctgtggtgggatggagtggccagtgaccagcagaagtaccaggtgcggcagctgctggaggagggccgcctggagtttgtgattggaggccaggtgatgcatgatgaggccgtgacccacctggatgaccagatcctgcagctgacagagggccacggcttcctgtatgagaccttcggcatccggccccagttctcctggcacgtggacccctttggagccagcgccaccacccccaccctgtttgccctggccggcttcaatgcccacctgggcagcagaattgattatgacctgaaggccgccatgcaggaggcccggggcctgcagtttgtgtggaggggcagccccagcctgtctgagcggcaggagatcttcacccacatcatggaccagtacagctactgcacccccagccacatccccttcagcaacagaagtggcttctactggaatggagtggccgtgttccccaagccaccccaggatggagtgtaccccaacatgtctgagcctgtgaccccagccaacatcaacctgtatgcagaggccctggtggccaacgtgaagcagagagctgcctggttccgcacccctcatgtgctgtggccctggggctgtgacaagcagttcttcaatgcctctgtgcagtttgccaacatggaccccctgctggaccacatcaacagccatgctgctgagctgggcgtgtctgtgcagtatgccaccctgggggactacttccgggccctgcacgccctgaatgtgacctggagggtgcgggaccaccacgacttcctgccctacagcacagagcccttccaggcctggacaggcttctacaccagccgcagcagcctgaagggcctggcccggcgggccagcgccctgctgtatgctggggagagcatgttcacccgctacctgtggccagccccccggggccacctggaccccacctgggccctgcagcagctgcagcagctgcgctgggccgtgtctgaggtgcagcaccatgatgccatcaccggcacagagagccccaaggtgcgggacatgtatgccacccacctggccagcggcatgctgggcatgaggaagctgatggccagcatcgtgctggatgagctgcagccccaggcccccatggccgccagcagtgatgctggccctgctggccactttgcctctgtgtacaaccccctggcctggacagtgaccaccatcgtgaccctgactgtgggcttccctggggtgcgggtgacagatgaggccggccaccctgtgcccagccagatccagaacagcacagagacccccagcgcctatgacctgctgatcctgaccaccatccctggcctgagctaccgccactacaacatccggcccacagctggggcccaggagggcacccaggagcctgctgccaccgtggccagcaccctgcagtttggaagaaggctgcggcggaggaccagccacgccggccgctacctggtgcctgtggccaatgactgctacatcgtgctgctggaccaggacaccaacctgatgcacagcatctgggagcggcagagcaacagaacagtgcgggtgacccaggagttcctggagtaccacgtgaatggagatgtgaagcagggccccatcagtgacaactacctgttcaccccaggcaaggctgctgtgcctgcctgggaggccgtggagatggagatcgtggccggccagctggtgacagagatccggcagtacttctacagaaacatgacagcccagaactacacctacgccatccgcagccggctgacccacgtgccccagggccatgatggagagctgctgtgccaccgcatcgagcaggagtaccaggccggccccctggagctgaaccgggaggccgtgctgcggaccagcaccaacctgaacagccagcaggtgatctacagcgacaacaacggctaccagatgcagaggcggccctacgtgtcctatgtgaacaacagcatcgccaggaactactaccccatggtgcagagcgccttcatggaggatggcaagagccggctggtgctgctgtctgagcgggcccacggcatcagcagccagggcaatggccaggtggaggtgatgctgcaccggcggctgtggaacaactttgactgggacctgggctacaacctgaccctgaatgacacctctgtggtgcaccctgtgctgtggctgctgctgggctcctggagcctgaccacagccctgcggcagaggtctgccctggccctgcagcacaggcctgtggtgctgtttggagacctggccggcacagcccccaagctgcccggcccccagcagcaggaggccgtgaccctgccccccaacctgcacctgcagatcctgagcatccctggctggagatacagcagcaaccacacagagcacagccagaacctgaggaagggccacagaggagaggcccaggccgacctgcggcgggtgctgctgcggctgtaccacctgtatgaggtgggagaagatcctgtgctgagccagcctgtgacagtgaacctggaggccgtgctgcaggccctgggctctgtggtggccgtggaggagaggagcctgaccggcacctgggacctgtccatgctgcaccgctggagctggaggactggacctggccgccacagaggagacaccaccagccccagccggcccccaggcggccccatcatcaccgtgcaccccaaggagatccgcaccttcttcatccacttccagcagcagtag

SEQ ID NO: 6994 - DNA, 1443 bp, Artificial Sequence
  Description of Artificial Sequence: Synthetic coding sequence
atgctgttcaggaaccgcttcctgctgctgctggccctggccgccctgctggcctttgtgtccctgagcctgcagttcttccacctgatccctgtgtccacccccaagaatggcatgagcagcaagagcaggaagaggatcatgccagaccctgtgacagagccccctgtgacagatcctgtgtatgaggccctgctgtactgcaacatccccagcgtggccgagaggtccatggagggccacgccccccaccacttcaagctggtgtctgtgcacgtgttcatcagacatggagaccgctaccccctgtatgtgatccccaagaccaagaggcctgagattgactgcaccctggtggccaacaggaagccctaccaccccaagctggaggccttcatcagccacatgagcaagggcagcggggccagctttgagagccccctgaacagcctgcccctgtaccccaaccaccccctgtgtgagatgggagagctgacccagacaggagtggtgcagcacctgcagaatggccagctgctgcgggacatctacctgaagaagcacaagctgctgcccaatgactggagcgctgaccagctgtacctggagaccaccgggaagagcaggaccctgcagagcggcctggccctgctgtatggcttcctgcctgactttgactggaagaagatctacttccgccaccagcccagcgccctcttctgcagcggcagctgctactgccctgtgaggaaccagtacctggagaaggagcagaggcggcagtacctgctgcggctgaagaacagccagctggagaagacctatggagagatggccaagatcgtggatgtgcccaccaagcagctgcgggccgccaaccccatcgacagcatgctgtgccacttctgccacaacgtgtccttcccctgcaccagaaatggctgtgtggacatggagcacttcaaggtgatcaagacccaccagattgaagatgagcgggagcggcgggagaagaagctgtacttcggctacagcctgctgggcgcccaccccatcctgaaccagaccatcggccgcatgcagagggccacagagggcaggaaggaggagctgtttgccctgtacagcgcccatgatgtgaccctgagccctgtgctgagcgccctgggcctgtctgaggcccgcttccccaggtttgctgcccggctcatctttgagctgtggcaggaccgggagaagcccagcgagcacagcgtgcgcatcctgtacaacggggtggatgtgaccttccacaccagcttctgccaggaccaccacaagaggagccccaagcccatgtgccccctggagaacctggtgcgctttgtgaagagggacatgtttgtggccctgggcggcagcggcaccaactactatgatgcctgccaccgggagggcttctag

SEQ ID NO: 6995 - DNA, 1341 bp, Artificial Sequence
  Description of Artificial Sequence: Synthetic coding sequence
atgctgcaccctgagaccagccctggccggggccacctgctggccgtgctgctggccctgctgggcacagcctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctggactggagcgacagcctggcccagctggcccaggcccgggccgccctgtgtggcacccccacccccagcctggccagcggcctgtggaggaccctgcaggtgggctggaacatgcagctgctgcctgctggcctggtgtcctttgtggaggtggtgtccctgtggtttgctgagggccagcgctacagccatgctgctggggagtgtgccagaaatgccacctgcacccactacacccagctggtgtgggccaccagcagccagctgggctgcggccgccacctgtgcagcgctggccaggccgccatcgaggcctttgtgtgtgcctacagcccccggggcaactgggaggtgaatggcaagaccatcgtgccctacaagaagggggcctggtgcagcctgtgcacagcctctgtgtctggctgcttcaaggcctgggaccatgctgggggcctgtgtgaggtgcccaggaacccctgcaggatgagctgccagaaccacggccgcctgaacatcagcacctgccactgccactgccccccaggctacacaggccgctactgccaggtgcgctgcagcctgcagtgtgtgcacggccgcttccgggaggaggagtgcagctgtgtgtgtgacatcggctacggcggggcccagtgtgccaccaaggtgcacttccccttccacacctgtgacctgagaattgatggagactgcttcatggtgtcctctgaggccgacacctactaccgggccaggatgaagtgccagaggaagggcggcgtgctggcccagatcaagagccagaaggtgcaggacatcctggccttctacctgggccgcctggagaccaccaatgaagtcatcgacagcgactttgagaccaggaacttctggattggcctgacctacaagacagccaaggacagcttccgctgggccaccggggagcaccaggccttcaccagctttgccttcggccagcctgacaaccacggctttggaaactgtgtggagctgcaggccagcgctgccttcaactggaatgaccagcgctgcaagaccaggaaccgctacatctgccagtttgcccaggagcacatcagccgctggggccctggcagctag

SEQ ID NO: 6996 - DNA, 2313 bp, Artificial Sequence
  Description of Artificial Sequence: Synthetic coding sequence
atggtggagagcgctggccgggccggccagaagaggcctggcttcctggagggcggcctgctgctgctgctgctgctggtgacagctgccctggtggccctgggcgtgctgtatgctgacagaagaggcaagcagctgccccggctggccagccggctgtgcttcctgcaggaggagaggacctttgtgaagaggaagccccggggcatccctgaggcccaggaggtgtctgaggtgtgcaccaccccaggctgtgtgattgctgctgcccgcatcctgcagaacatggaccccaccacagagccctgtgatgacttctaccagtttgcctgtggcggctggctgcggcggcacgtgattcctgagaccaacagccgctacagcatctttgatgtgctgagagatgagctggaggtgatcctgaaggctgtgctggagaacagcacagccaaggacaggcctgctgtggagaaggcccggaccctgtaccgcagctgcatgaaccagagcgtcatcgagaagaggggcagccagcccctgctggacatcctggaggtggtgggcggctggcctgtggccatggaccgctggaatgagaccgtgggcctggagtgggagctggagcggcagctggccctgatgaacagccagttcaacagaagagtgctgattgacctcttcatctggaatgatgaccagaacagcagccgccacatcatctacatcgaccagcccaccctgggcatgcccagccgggagtactacttcaatggaggcagcaacaggaaggtgcgggaggcctacctgcagttcatggtgtctgtggccaccctgctgagagaagatgccaacctgccccgggacagctgcctggtgcaggaggacatggtgcaggtgctggagctggagacccagctggccaaggccaccgtgccccaggaggagagacatgatgtgattgccctgtaccacaggatgggcctggaggagctgcagagccagtttggcctgaagggcttcaactggaccctcttcatccagacagtgctgagctctgtgaagatcaagctgctgcctgatgaggaggtggtggtgtatggcatcccctacctgcagaacctggagaacatcatcgacacctacagcgcccggaccatccagaactacctggtgtggaggctggtgctggacagaattggcagcctgagccagcgcttcaaggacaccagggtgaactacaggaaggccctgtttggcaccatggtggaggaggtgcgctggagagaatgtgtgggctacgtgaacagcaacatggagaatgctgtgggcagcctgtatgtgcgggaggccttccctggggacagcaagtccatggtgcgggagctgattgacaaggtgaggacagtgtttgtggagaccctggatgagctgggctggatggatgaggagagcaagaagaaggcccaggagaaggccatgagcatccgggagcagatcggccacccagactacatcctggaggagatgaacagaaggctggatgaggagtacagcaacctgaacttcagcgaggacctgtactttgagaacagcctgcagaacctgaaggtgggcgcccagaggagcctgaggaagctgcgggagaaggtggaccccaacctgtggatcattggagctgctgtggtgaatgccttctacagccccaacagaaaccagatcgtgtttcctgctggcatcctgcagccccccttcttcagcaaggagcagccccaggccctgaactttggaggcatcggcatggtgattggccacgagatcacccacggctttgatgacaatggaagaaactttgacaagaatggaaacatgatggactggtggagcaacttcagcacccagcacttccgggagcagagcgagtgcatgatctaccagtatggcaactacagctgggacctggctgatgagcagaatgtgaatggcttcaacaccctgggagaaaatattgctgacaatggaggagtgcggcaggcctacaaggcctacctgaagtggatggccgagggcggcaaggaccagcagctgcccggcctggacctgacccatgagcagctgttcttcatcaactatgcccaggtgtggtgtggcagctacagacctgagtttgccatccagagcatcaagacagatgtgcacagccccctgaagtacagagtgctgggcagcctgcagaacctggccgcctttgctgacaccttccactgtgcccggggcacccccatgcaccccaaggagcgctgccgggtgtggtag

SEQ ID NO: 6997 - DNA, 1317 bp, Artificial Sequence
  Description of Artificial Sequence: Synthetic coding sequence
atgagcaagagggacaaggccggcaaggacacagcccggggcaagggcaaggacatcagcaaatatggctctgtgcagaagagctttgctgaccggggcctgcccaagccacccaaggagaagctgctgcaggtggagaagctgaggaaggagagcggcaagggcagcttcctgcagcccacagccaagccccgggccctggcccagcagcaggccgtcatccggggcttcacctactacaaggccggcaagcaggaggtgacagaggccgtggccgacaacaccctgcagggcacctcctggctggagcagctgccccccaaggtggagggccgcagcaacagcgctgagcccaacagcgctgagcaggatgaggccgagcccaggagcagcgagcgggtggacctggccagcggcacccccaccagcatcccagccaccaccaccacagccaccaccacccccacccccaccaccagcctgctgcccacagagccccccagcggccctgaggtgagcagccagggccgggaggccagctgtgagggcaccctgcgggctgtggacccccctgtgcgccaccacagctatggaagacatgagggcgcctggatgaaggaccctgctgccagagatgaccgcatctacgtgaccaactactactacggcaacagcctggtggagttcaggaacctggagaacttcaagcagggccgctggagcaacatgtacaagctgccctacaactggattggaactggacatgtggtgtaccagggcgccttctactacaacagagccttcaccaagaacatcatcaagtatgacctgcggcagagatttgtggcctcctgggccctgctgcctgatgtggtgtatgaggacaccaccccctggaagtggaggggccacagcgacatcgactttgctgtggatgagagcggcctgtgggtgatctacccagctgtggatgacagagatgaggcccagcctgaggtgattgtgctgagccggctggaccccggggacctgtctgtgcaccgggagaccacctggaagacccggctgcggaggaacagctatggcaactgcttcctggtgtgtggcatcctgtatgctgtggacacctacaaccagcaggagggccaggtggcctatgcctttgacacccacactggaacagatgcccggccccagctgcccttcctgaatgagcacgcctacaccacccagattgactacaaccccaaggagcgggtgctgtatgcctgggacaatggccaccagctgacctacaccctgcactttgtggtgtag

SEQ ID NO: 6998 - DNA, 3570 bp, Artificial Sequence
  Description of Artificial Sequence: Synthetic coding sequence
atgcctggcctgctgaactggatcactggagctgccctgcccctgacagccagtgatgtgaccagctgtgtgtctggctacgccctgggcctgacagccagcctgacctacggcaacctggaggcccagcccttccagggcctgtttgtgtaccccctggatgaatgtaccaccgtcatcggctttgaggccgtgattgctgacagagtggtgacagtgcagatcaaggacaaggccaagctggagagcggccactttgatgccagccacgtgcgcagccccaccgtgactggaaacatcctgcaggatggagtgtccatcgccccccacagctgcacccctgggaaggtgaccctggatgaggacctggagcgcatcctgtttgtggccaacctgggcaccatcgcccccatggagaatgtgaccatcttcatcagcaccagcagcgagctgcccaccctgcccagcggggctgtgcgggtgctgctgcctgctgtgtgtgcccccaccgtgccccagttctgcaccaagagcacaggcaccagcaaccagcaggcccagggcaaggacagacactgcttcggggcctgggcccctggctcctggaacaagctgtgcctggccaccctgctgaacacagaggtgagcaaccccatggagtatgagttcaacttccagctggagatccggggcccctgcctgctggccggcgtggagagccccacccatgagatccgggcagatgctgcccccagcgcccggagcgccaagagcatcatcatcaccctggccaacaagcacacctttgacaggcctgtggagatcctgatccaccccagcgagccccacatgccccacgtgctgattgaaaaaggagacatgaccctgggggagtttgaccagcacctgaagggccgcacagacttcatcaagggcatgaagaagaagagcagagctgagaggaagacagagatcatcaggaagaggctgcacaaggacatcccccaccacagcgtcatcatgctgaacttctgcccagacctgcagagcgtgcagccctgcctgaggaaggcccatggagagttcatcttcctgattgacaggagcagctccatgagcggcatctccatgcaccgggtgaaggatgccatgctggtggccctgaagagcctgatgcctgcctgcctcttcaacatcatcggcttcggcagcaccttcaagagcctcttccccagcagccagacctacagcgaggacagcctggccatggcctgtgatgacatccagaggatgaaggctgacatgggcggcaccaacatcctgagccccctgaagtgggtgatccggcagcctgtgcaccggggccacccccggctgctgtttgtgatcacagatggagctgtgaacaacacaggcaaggtgctggagctggtgagaaatcatgccttcagcacccgctgctacagctttggcatcggccccaacgtgtgccaccggctggtgaagggcctggcctctgtgtctgagggcagcgctgagctgctgatggagggggagcggctgcagcccaagatggtgaagagcctgaagaaggccatggcccctgtgctgagtgatgtgacagtggagtggatcttccctgagaccacagaggtgctggtgtcccctgtgtctgccagcagcctcttccctggagagcggctggtgggctatggaattgtgtgtgatgccagcctgcacatcagcaaccccaggagtgacaagagaagacgctacagcatgctgcacagccaggagagcggcagctctgtgttctaccacagccaggatgatggccctggcctggagggcggggactgtgccaagaacagcggggcccccttcatcctgggccaggccaagaatgcccggctggccagcggggacagcaccaccaagcatgacctgaacctgagccagaggagaagagcctacagcaccaaccagatcaccaaccacaagcccctgccccgggccaccatggccagtgaccccatgcctgctgccaagcgctaccccctgaggaaggcccggctgcaggacctgaccaaccagaccagcctggatgtgcagcgctggcagattgacctgcagcccctgctgaacagcggccaggacctgaaccagggccccaagctgcggggccctggggcccggcggcccagcctgctgccccagggctgccagcccttcctgccctggggccaggagacccaggcctggagccctgtgcgggagaggaccagtgacagccgcagccctggggacctggagcccagccaccaccccagcgcctttgaaacagagaccagcagtgactgggaccccccagctgagagccaggagcgggccagccccagcaggcctgccaccccagcccctgtgctgggcaaggccctggtgaagggcctgcatgacagccagaggctgcagtgggaggtgtcctttgagctgggcaccccaggccctgagcggggcggggcccaggatgctgacctgtggagcgagaccttccaccacctggccgcccgggccatcatccgggactttgagcagctggccgagcgggagggggagattgagcagggcagcaacagacgctaccaggtgtctgccctgcacaccagcaaggcctgcaacatcatcagcaagtacacagcctttgtgcctgtggatgtgtccaagagccgctacctgcccaccgtggtggagtaccccaacagcgctgccctgaggatgctgggcagccgggccctggcccagcagtggaggggcaccagcagcggcttcggccggccccagaccatgctgggggaggacagcgcccctggaaatggcccccagaggagcctggccaccaacaccctgagctccatgaaggccagcgagaacctgtttggctcctggctgaacctgaacaagagccggctgctgacccgggccgccaagggcttcctgagcaagcccctcatcaaggctgtggagagcaccagcggcaaccagagctttgactacatccccctggtgtccctgcagctggccagcggggccttcctgctgaatgaggccttctgtgaggccacccacatccccatggagaagctgaagtggaccagccccttcacctgccaccgggtgtccctgaccacccggcccagcgagagcaagacccccagcccccagctgtgcaccagcagcccccccaggcaccccagctgtgacagcttcagcctggagcccctggccaagggcaagctgggcctggagcccagggctgtggtggagcacacaggcaagctgtgggccaccgtggtgggcctggcctggctggagcacagcagcgccagctacttcacagagtgggagctggtggccgccaaggccaacagctggctggagcagcaggaggtgcctgagggccgcacccagggcaccctgaaggccgccgcccggcagctgtttgtgctgctgcggcactgggatgagaacctggagttcaacatgctgtgctacaaccccaactacgtgtag

SEQ ID NO: 6999 - DNA, 1344 bp, Artificial Sequence
  Description of Artificial Sequence: Synthetic coding sequence
atgcctcatgtgctgattgagaagggggacatgaccctgggggagtttgaccagcacctgaagggccgcacagacttcatcaagggcatgaagaagaagagcagagctgagaggaagacagagatcatcaggaagaggctgcacaaggacatcccccaccacagcgtcatcatgctgaacttctgcccagacctgcagagcgtgcagccctgcctgaggaaggcccacggggagttcatcttcctgattgacaggagcagctccatgagcggcatctccatgcaccgggtgaaggatgccatgctggtggccctgaagagcctgatgcctgcctgcctcttcaacatcattggatttggcagcaccttcaagagcctcttccccagcagccagacctacagcgaggacagcctggccatggcctgtgatgacatccagaggatgaaggctgacatgggcggcaccaacatcctgagccccctgaagtgggtgatccggcagcctgtgcaccggggccacccccggctgctcttcgtcatcacagatggagctgtgaacaacacaggcaaggtgctggagctggtgaggaaccacgccttcagcacccgctgctacagctttggaattggccccaacgtgtgccaccggctggtgaagggcctggcctctgtgtctgagggcagcgctgagctgctgatggagggggagcggctgcagcccaagatggtgaagagcctgaagaaggccatggcccctgtgctgagtgatgtgacagtggagtggatcttccctgagaccacagaggtgctggtgtcccctgtgtctgccagcagcctcttccctggagagcggctggtgggctacggcatcgtgtgtgatgccagcctgcacatcagcaaccccaggagtgacaagagaagacgctacagcatgctgcacagccaggagagcggcagcagcgtcttctaccacagccaggatgatggccctggcctggagggcggggactgtgccaagaacagcggggcccccttcatcctgggccaggccaagaatgcccggctggccagcggggacagcaccaccaagcatgacctgaacctgagccagaggcggcgggcctacagcaccaaccagatcaccaaccacaagcccctgccccgggccaccatggccagtgaccccatgcctgctgccaagcgctaccccctgaggaaggcccggctgcaggacctgaccaaccagaccagcctggatgtgcagcgctggcagattgacctgcaggccttcatctgcctgaccagcgaggacaccttccagatccgcacccccaccggccagtag

SEQ ID NO: 7000 - DNA, 726 bp, Artificial Sequence
  Description of Artificial Sequence: Synthetic coding sequence
atgtggacagtgaggacagagggcggccacttccccctgcacagccccaccttctcctggagaaatgtggccttcctgctgctgctgagcctggccctggagtggaccagcgccatgctgaccaagaagatcaagcacaagccaggcctgtgccccaaggagcggctgacctgcaccacagagctgcctgacagctgcaacacagactttgactgcaaggagtaccagaagtgctgcttctttgcctgccagaagaagtgcatggaccccttccaggagccctgcatgctgcctgtgagacatggcaactgcaaccacgaggcccagcgctggcactttgacttcaagaactaccgctgcacccccttcaagtaccggggctgtgagggcaatgccaacaacttcctgaatgaagatgcctgcaggacagcctgcatgctgattgtgaaggatggccagtgccccctcttccccttcacagagaggaaggagtgcccccccagctgccacagcgacatcgactgcccccagacagacaagtgctgtgagagccgctgtggctttgtgtgtgcccgggcctggacagtgaagaagggcttctgccccaggaagcccctgctgtgcaccaagattgacaagcccaagtgcctgcaggatgaagaatgtcccctggtggagaagtgctgcagccactgcggcctgaagtgcatggaccccaggaggtag

SEQ ID NO: 7001 - DNA, 1074 bp, Artificial Sequence
  Description of Artificial Sequence: Synthetic coding sequence
atgaggcctcctccagccctggccctggccggcctgtgcctgctggccctgcctgctgctgctgccagctacttcggcctgaccggccgggaggtgctgacccccttccctggcctgggcacagctgctgccccagcccagggcggggcccacctgaagcagtgtgacctgctgaagctgagccggcggcagaagcagctgtgcagaagagagcccggcctggccgagaccctgagagatgctgcccacctgggcctgctggagtgccagttccagttcagacatgagcgctggaactgcagcctggagggccgcatgggcctgctgaagaggggcttcaaggagacagccttcctgtatgctgtgagcagcgctgccctgacccacaccctggcccgggcctgcagcgctggccgcatggagcgctgcacctgtgatgacagccctggcctggagagccggcaggcctggcagtggggcgtgtgtggggacaacctgaagtacagcaccaagttcctgagcaacttcctgggcagcaagaggggcaacaaggacctgcgggcccgggcagatgcccacaacacccacgtgggcatcaaggctgtgaagagcggcctgcggaccacctgcaagtgccacggcgtgtctggcagctgtgctgtgaggacctgctggaagcagctgagccccttccgggagaccggccaggtgctgaagctgcgctatgacagcgctgtgaaggtgagcagcgccaccaatgaggccctgggccgcctggagctgtgggccccagcccggcagggcagcctgaccaagggcctggcccccaggtctggggacctggtgtacatggaggacagccccagcttctgccggcccagcaagtacagccctggaacagctggccgggtgtgcagccgggaggccagctgcagcagcctgtgctgcggccggggctatgacacccagagccggctggtggccttcagctgccactgccaggtgcagtggtgctgctacgtggagtgccagcagtgtgtgcaggaggagctggtgtacacctgcaagcactag

SEQ ID NO: 7002 - DNA, 810 bp, Artificial Sequence
  Description of Artificial Sequence: Synthetic coding sequence
atggtgcgctgcctgggccctgccctgctgctgctgctgctgctgggcagcgccagctctgtgggcggcaacagatgtgtggatgctgctgaggcctgcacagcagatgcccgctgccagaggctgcggagtgaatatgtggcccagtgcctgggccgggccgcccagggcggctgcccccgggcccgctgcagaagagccctgcggcgcttctttgcccggggccccccagccctgacccacgccctgctcttctgcccctgtgccggccctgcctgtgccgagcggcggcggcagacctttgtgcccagctgtgccttcagcggccctggccctgccccacccagctgcctggagcccctgaacttctgtgagaggagccgggtgtgccggccccggctgctggccttccaggtgtcctgcaccccagcccccagcgccccagatggctgcctgctggaccagggcgcccgctgcctgcgggcctatgccggcctggtgggcacagctgtgacccccaactacgtggacaacgtgtctgcccgggtggccccctggtgtgactgtggggccagcggcaacagaagagaggactgtgaggccttccggggcctcttcaccaggaaccgctgcctggatggagccatccaggcctttgccagcggctggccccctgtgctgctggaccagctgaacccccagggcgaccctgagcacagcctgctgcaggtgagcagcacaggccgggccctggagaggaggagcctgctgagcatcctgcctgtgctggccctgcctgccctgctgtag

SEQ ID NO: 7003 - DNA, 1728 bp, Artificial Sequence
  Description of Artificial Sequence: Synthetic coding sequence
atgagcggcaactgggtgcaccctggccagatcctgatctgggccatctgggtgctggccgcccccaccaagggccccagcgctgagggcccccagaggaacacccggctgggctggatccagggcaagcaggtgacagtgctgggcagccctgtgcctgtgaatgtgttcctgggcgtgccctttgctgccccacccctgggcagcctgcgcttcaccaacccccagcctgccagcccctgggacaacctgcgggaggccaccagctaccccaacctgtgcctgcagaacagcgagtggctgctgctggaccagcacatgctgaaggtgcactaccccaagtttggagtgtctgaggactgcctgtacctgaacatctatgccccagcccacgccgacaccggcagcaagctgcctgtgctggtgtggttccctggaggagccttcaagacaggcagcgccagcatctttgatggcagcgccctggccgcctatgaagatgtgctggtggtggtggtgcagtaccgcctgggcatcttcggcttcttcaccacctgggaccagcacgcccctggcaactgggccttcaaggaccaggtggccgccctgtcctgggtgcagaagaacatcgagttctttggaggagaccccagctctgtgaccatctttggagagagcgctggggccatctctgtgagcagcctcatcctgagccccatggccaagggcctcttccacaaggccatcatggagagcggcgtggccatcatcccctacctggaggcccatgactatgagaagtctgaggacctgcaggtggtggcccacttctgtggcaacaatgccagtgacagcgaggccctgctgcgctgcctgcggaccaagcccagcaaggagctgctgaccctgagccagaagaccaagagcttcaccagggtggtggatggagccttcttccccaatgagcccctggacctgctgagccagaaggccttcaaggccatccccagcatcattggagtgaacaaccatgaatgtggcttcctgctgcccatgaaggaggcccctgagatcctgagcggcagcaacaagagcctggccctgcacctgatccagaacatcctgcacatccccccccagtacctgcacctggtggccaatgagtacttccatgacaagcacagcctgacagagatccgggacagcctgctggacctgctgggagatgtgttctttgtggtgcctgccctgatcacagcccgctaccacagagatgctggggcccctgtgtacttctatgagttccgccaccggccccagtgctttgaggacaccaagccagcctttgtgaaggctgaccatgctgatgaggtgcgctttgtgtttggaggagccttcctgaagggggacatcgtgatgtttgagggcgccacagaggaggagaagctgctgagcaggaagatgatgaagtactgggccacctttgccaggacaggcaaccccaatggaaatgacctgagcctgtggccagcctacaacctgacagagcagtacctgcagctggacctgaacatgagcctgggccagaggctgaaggagccccgggtggacttctggaccagcaccatccccctcatcctgagcgccagtgacatgctgcacagccccctgagcagcctgaccttcctgagcctgctgcagcccttcttcttcttctgtgccccctag

SEQ ID NO: 7004 - DNA, 1026 bp, Artificial Sequence
  Description of Artificial Sequence: Synthetic coding sequence
atgggcaccctgccctggctgctggccttcttcatcctgggcctgcaggcctgggacacccccaccatcgtgtccaggaaggagtggggcgcccggcccctggcctgccgggccctgctgaccctgcctgtggcctacatcatcacagaccagctgcccggcatgcagtgccagcagcagagcgtgtgcagccagatgctgcggggcctgcagagccacagcgtgtacaccatcggctggtgtgatgtggcctacaacttcctggtgggagatgatggccgggtgtatgagggcgtgggctggaacatccagggcctgcacacccagggctacaacaacatcagcctgggcatcgccttctttggaaacaagattggcagcagccccagccctgctgccctgtctgctgctgagggcctcatctcctatgccatccagaagggccacctgagcccccgctacatccagcccctgctgctgaaggaggagacctgcctggacccccagcaccctgtgatgcccaggaaggtgtgccccaacatcatcaagaggtctgcctgggaggcccgggagacccactgccccaagatgaacctgcctgccaagtatgtgatcatcatccacacagctggcaccagctgcaccgtgtccacagactgccagacagtggtgaggaacatccagagcttccacatggacaccaggaacttctgtgacatcggctaccacttcctggtgggccaggatggaggagtgtatgaaggagtgggctggcacatccagggcagccacacctacggcttcaatgacatcgccctgggcatcgccttcatcggctactttgtggagaagcccccaaatgctgctgccctggaggccgcccaggacctgatccagtgtgctgtggtggagggctacctgacccccaactacctgctgatgggccacagtgatgtggtgaacatcctgagccctggccaggccctgtacaacatcatcagcacctggccccacttcaagcactag

SEQ ID NO: 7005 - DNA, 897 bp, Artificial Sequence
  Description of Artificial Sequence: Synthetic coding sequence
atgggcatcgtgtgtgcccagtgcagcttcatcctgctgctgagcatcatccgggcccggcccccacccttcctgttctgccccctgagcagccagaggacagagagcccctacaagcctgtgcacctgggcctgggccccacagacaaggtggccgccatcgccatggcccgcatcatcgacctggtgccctgggatgatggcagcacccacgtgtatgccagccctgccatcctgctgcccatggagcggcagaggaaccagctggccggcgtgaagcagcagctgtaccacccagccctgcccaccctgcggcacatggaccgggacacagtgaaggcctgcctgcctgatgagcactgccagagcaccacctactgcaggaaggatgaatttgacaatgcccacttcaccctgctgggcgtgcccaacaagcccctgcagtgcctggacatcacagccaccggccagaagctgaggaaccgctaccacgagggcaagctggcccccatcgcccctggcatcaacagagtggactggccctgcttcacccgggccatcgaggactggagccactttgtgagcagcgctggggagttcaagctgccctgcctgaggaagagagctgagggcctgagcggctatgctgtgcgctacctgaagccagatgtgacccagacctggaggcaggaggccctgtgtggggcctgggccggccggccctgcagcccagacagcccccggccctacccctgctgccccccccagtactgcctgagccagaaccccagcctggacagatatggccagaagcccctgccctttgacagcctgaacaccttccgcagctttggcagcagctacagccgggtgaactacctgaccccctggcactag

SEQ ID NO: 7006 - DNA, 5799 bp, Artificial Sequence
  Description of Artificial Sequence: Synthetic coding sequence
atggcccctggggccctgcggggcggctgtgagcagagggcccctgggggcggggccaggacagctgccctgggcccctggccctggcccagccctggccctgcccccagccctggggccgccccacccaggagcaggaagatgtctggggccctgctgtggcccctgctgcccctgctgctgctgctgctgagcgccagagatggagtgcgggccgcccagccccaggcccctggctacctgattgctgcccccagcgtcttccgggccggcgtggaggaggtgatctctgtgaccatcttcaacagcccccgggaggtgacagtgcaggcccagctggtggcccagggcgagcctgtggtgcagagccagggcgccatcctggacaagggcaccatcaagctgaaggtgcccaccggcctgcggggccaggccctgctgaaggtgtggggccggggctggcaggccgaggagggccccctcttccacaaccagacctctgtgacagtggatggccgcggggccagcgtcttcatccagacagacaagcctgtgtaccggccccagcaccgggtgctgatcagcatcttcaccgtgagccccaacctgcggcctgtgaatgagaagctggaggcctacatcctggacccccggggcagcaggatgattgagtggaggcacctgaagcccttctgctgcggcatcaccaacatgtccttccccctgagtgaccagcctgtgctgggggagtggttcatctttgtggagatgcagggccacgcctacaacaagagctttgaggtgcagaagtatgtgctgcccaagtttgagctgctgattgaccccccacgctacatccaggacctggatgcctgtgagaccggcaccgtgcgggcccgctacaccttcggcaagcctgtggccggggccctgatgatcaacatgacagtgaatggagtgggctactacagccatgaggtgggccggcctgtgctgcggaccaccaagatcctgggcagccgggactttgacatctgtgtgcgggacatgatcccagcagatgtgcctgagcacttccggggccgggtgtccatctgggccatggtgacctctgtggatggcagccagcaggtggcctttgatgacagcacccctgtgcagaggcagctggtggacatccgctacagcaaggacaccaggaagcagttcaagccaggcctggcctacgtgggcaaggtggagctgagctacccagatggcagccctgctgagggcgtgacagtgcagatcaaggccgagctgacccccaaggacaacatctacaccagcgaggtggtgtcccagaggggcctggtgggctttgagatccccagcatccccaccagcgcccagcacgtgtggctggagaccaaggtgatggccctgaatggcaagcctgtgggcgcccagtacctgcccagctacctgagcctgggctcctggtacagccccagccagtgctacctgcagctgcagccccccagccaccccctgcaggtgggggaggaggcctacttctctgtgaagagcacctgcccctgcaacttcaccctgtactatgaggtggccgcccggggcaacatcgtgctgagcggccagcagcctgcccacaccacccagcagaggagcaagagagctgccccagccctggagaagcccatccggctgacccacctgtctgaaacagagcccccaccagcccctgaggccgaggtggatgtgtgtgtgaccagcctgcacctggccgtgacccccagcatggtgcccctgggccgcctgctggtgttctacgtgagagaaaatggagaaggagtggccgacagcctgcagtttgctgtggagaccttctttgagaaccaggtgtctgtgacctacagcgccaatgagacccagcctggagaggtggtggacctgcgcatccgggccgcccggggcagctgtgtgtgtgtggccgctgtggacaagtctgtgtacctgctgcggagcggcttccggctgaccccagcccaggtgttccaggagctggaggactatgatgtgtctgacagctttggagtgtcccgggaggatggccccttctggtgggccggcctgacagcccagaggagaagaagaagcagcgtcttcccctggccctggggcatcaccaaggacagcggctttgccttcacagaaacaggcctggtggtgatgacagacagagtgtccctgaaccaccggcaggacggcggcctgtacacagatgaagctgtgcctgccttccagccccacacaggcagcctggtggccgtggcccccagccgccacccccccaggacagagaagaggaagaggaccttcttccctgagacctggatctggcactgcctgaacatcagtgaccccagcggggagggcaccctgtctgtgaaggtgcctgacagcatcacctcctgggtgggggaggccgtggccctgagcaccagccagggcctgggcattgctgagcccagcctgctgaagaccttcaagcccttctttgtggacttcatgctgcctgccctgatcatccggggggagcaggtgaagatccccctgtctgtgtacaactacatgggcacctgtgccgaggtgtacatgaagctgtctgtgcccaagggcatccagtttgtgggccaccctgggaagagacatgtgaccaagaagatgtgtgtggcccctggagaggccgagcccatctgggtggtgctgtccttcagtgacctgggcctgaacaacatcacagccaaggccctggcctacggggacaccaactgctgcagagatggccgcagcagcaagcacccagaagaaaatcatgctgaccggcgggtgcccatcggcgtggaccacgtgcggcgctctgtgatggtggaggccgagggcgtgccccgggcctacacctacagcgccttcttctgccccagcgagcgggtgcacatcagcacccccaacaagtatgagttccagtatgtgcagaggcccctgcggctgaccaggtttgatgtggccgtgcgggcccacaatgatgcccgggtggccctgagcagcggcccccaggacacagctggcatgattgaaattgtgctgggcggccaccagaacaccaggtcctggatcagcaccagcaagatgggagagcctgtggccagcgcccacacagccaagatcctgtcctgggatgagttccgcaccttctggatctcctggaggggcggcctcatccaggtgggccacggccctgagcccagcaatgaatctgtcatcgtggcctggaccctgccccggcccccagaggtgcagttcatcggcttcagcacaggctggggctccatgggagagttccgcatctggaggaagatggaggtggatgagagctacagcgaggccttcaccctgggcgtgccccacggggccatccctggcagcgagcgggccacagccagcatcattggagatgtgatgggccccaccctgaaccacctgaacaacctgctgcggctgcccttcggctgtggggagcagaacatgatccactttgcccccaacgtgtttgtgctgaagtacctgcagaagacccagcagctgagccctgaggtggagcgggagaccacagactacctggtgcagggctaccagaggcagctgacctacaagaggcaggacggcagctacagcgcctttggagagagagatgccagcggctccatgtggctgacagcctttgtgctgaagagctttgcccaggcccgctccttcatctttgtggacccccgggagctggccgccgccaagtcctggatcatccagcagcagcaggctgatggcagcttcctggccgtgggccgggtgctgaacaaggacatccagggcggcatccatggaacagtgcccctgacagcctacgtggtggtggccctgctggagactggaacagccagcgaggaggagcggggcagcacagacaaggcccggcacttcctggagagcgctgcccccctggccatggacccctacagctgtgccctgaccacctacgccctgaccctgctgcggagccctgctgcccctgaggccctgaggaagctgcggagcctggccatcatgagagatggagtgacccactggagcctgagcaacagctgggatgtggacaagggcaccttcctgtccttcagtgacagagtgtcccagagcgtggtgtctgctgaggtggagatgacagcctatgccctgctgacctacaccctgctgggagatgtggccgccgccctgcctgtggtgaagtggctgagccagcagagaaatgccctgggcggcttcagcagcacccaggacacctgtgtggccctgcaggccctggccgagtatgccatcctgtcctatgctgggggcatcaacctgactgtgtccctggccagcaccaacctggactaccaggagacctttgagctgcacaggaccaaccagaaggtgctgcagacagctgccatccccagcctgcccaccggcctgtttgtgtctgccaagggagatggctgctgcctgatgcagattgatgtgacctacaacgtgcctgaccctgtggccaagccagccttccagctgctggtgtccctgcaggagcctgaggcccagggccggcccccacccatgcctgccagcgctgctgagggcagcagaggagactggcccccagcagatgatgatgatcctgctgctgaccagcaccaccaggagtacaaggtgatgctggaggtgtgcacccgctggctgcatgctggcagcagcaacatggctgtgctggaggtgcccctgctgagcggcttccgggctgacatcgagagcctggagcagctgctgctggacaagcacatgggcatgaagagatatgaggtggccggcagaagagtgctcttctactttgatgagatccccagccgctgcctgacctgtgtgcgcttccgggccctgagagaatgtgtggtgggccgcaccagcgccctgcctgtgtctgtgtatgactactatgagcccgcctttgaggccacccgcttctacaacgtgtccacccacagccccctggcccgggagctgtgtgccggccctgcctgcaatgaggtggagcgggccccagcccggggccctggctggttccctggagagagcggccctgctgtggcccctgaggagggcgccgccatcgcccgctgtggctgtgaccatgactgtggggcccagggcaaccctgtgtgtggcagtgatggagtggtgtatgccagcgcctgccgcctgcgggaggccgcctgccggcaggccgcccccctggagcccgccccacccagctgctgtgccctggagcagaggctgcctgccagcagcagcagcacctatggagatgacctggcctctgtggcccctggccccctgcagcaggatgtgaagctgaatggagctggcctggaggtggaggacagcgaccctgagcctgagggggaggccgaggacagagtgacagctggccccaggcctcctgtgagcagcggcaacctggagagcagcacccagagcgccagccccttccaccgctggggccagaccccagccccccagaggcacagcggccgggtggtgggcgcccaccggcccggcctgctgagccctgtgtttgtgtacagccctgccttccagagcggcggggaggagggcctgtggatgagcaacacctgcaccctgaggtag

SEQ ID NO: 7007 - DNA, 1209 bp, Artificial Sequence
  Description of Artificial Sequence: Synthetic coding sequence
atggtgtgtgcccgggccgccctgggccctggggccctgtgggccgccgcctggggcgtgctgctgctgacagccccagctggggcccagaggggcaggaagaaggtggtgcacgtgctggagggggagagcggctctgtggtggtgcagacagcccctggccaggtggtgagccacagaggaggcaccatcgtgctgccctgccgctaccactatgaggccgccgcccacggccatgatggagtgcggctgaagtggaccaaggtggtggaccccctggccttcacagatgtgtttgtggccctgggcccccagcaccgggccttcggcagctaccggggccgggcagagctgcagggagatggccctggagatgccagcctggtgctgagaaatgtgaccctgcaggactatggccgctatgaatgtgaggtgaccaatgagctggaggatgatgctggcatggtgaagctggacctggagggcgtggtgttcccctaccacccccggggcggccgctacaagctgacctttgctgaggcccagagggcctgtgccgagcaggacggcatcctggccagcgctgagcagctgcacgccgcctggagagatggcctggactggtgcaatgccggctggctgagagatggctctgtgcagtaccctgtgaaccggccccgggagccctgtggcggcctgggcggcaccggcagcgctgggggcggcggagatgccaacggcggcctgaggaactacggctaccgccacaatgctgaggagagatatgatgccttctgcttcaccagcaacctgcccggccgggtcttcttcctgaagcccctgcggcctgtgcccttctctggagctgcccgggcctgtgccgcccggggagctgctgtggccaaggtgggccagctgtttgctgcctggaagctgcagctgctggaccgctgcacagctggctggctggctgatggcagcgcccgctaccccatcgtgaacccccgggcccgctgtggcggccggcggcctggggtgcgcagcctgggcttcccagatgccacccggcggctgtttggagtgtactgctaccgggcccctggggccccagaccctgcccctgggggctggggctggggctgggccggcggcggcggctgggccggcggggcccgggaccctgctgcctggacccccctgcacgtgtag

SEQ ID NO: 7008 - DNA, 1740 bp, Artificial Sequence
  Description of Artificial Sequence: Synthetic coding sequence
atgtctgccctgcggcccctgctgctgctgctgctgcccctgtgccccggccctggccctggccctggcagcgaggccaaggtgaccaggagctgtgccgagacccggcaggtgctgggcgcccggggctacagcctgaacctgatccccccagccctgatctctggagagcacctgcgggtgtgcccccaggagtacacctgctgcagcagcgagacagagcagaggctcatccgggagacagaggccaccttccggggcctggtggaggacagcggcagcttcctggtgcacaccctggccgcccggcacaggaagtttgatgagttcttcctggagatgctgtctgtggcccagcacagcctgacccagctgttcagccacagctatggccgcctgtatgcccagcacgccctgatcttcaacggcctcttcagccggctgcgggacttctacggggagagcggggagggcctggatgacaccctggccgacttctgggcccagctgctggagagggtcttccccctgctgcacccccagtacagcttccccccagactacctgctgtgcctgagccggctggccagcagcacagatggcagcctgcagccctttggagacagcccccggcggctgcggctgcagatcaccaggaccctggtggccgcccgggcctttgtgcagggcctggagactggaagaaatgtggtgtctgaggccctgaaggtgcctgtgtctgagggctgcagccaggccctgatgaggctcatcggctgccccctgtgccggggcgtgcccagcctgatgccctgccagggcttctgcctgaatgtggtgcggggctgcctgagcagccggggcctggagccagactggggcaactacctggatggcctgctgatcctggccgacaagctgcagggccccttctcctttgagctgacagctgagagcattggagtgaagatcagcgagggcctgatgtacctgcaggagaacagcgccaaggtgtctgcccaggtgttccaggagtgtggccccccagaccctgtgcctgccaggaacagaagagcccccccaccccgggaggaggccggccgcctgtggagcatggtgacagaggaggagcggcccaccacagctgctggcaccaacctgcaccggctggtgtgggagctgcgggagcggctggccaggatgaggggcttctgggcccggctgagcctgactgtgtgtggggacagcaggatggccgcagatgccagcctggaggccgccccctgctggacaggagctggccggggccgctacctgccccctgtggtgggcggcagccctgctgagcaggtgaacaaccctgagctgaaggtggatgccagcggcccagatgtgcccaccaggagaagaaggctgcagctgcgggccgccacagccaggatgaagacagctgccctgggccatgacctggatggccaggatgctgatgaagatgccagcggcagcggcggcggccagcagtatgcagatgactggatggccggggctgtggcccccccagcccggcccccccggcccccctaccccccaagaagagatggcagcggcggcaagggcggcggcggcagcgcccgctacaaccagggccgcagccgctctggaggagccagcatcggcttccacacccagaccatcctgatcctgagcctgagcgccctggccctgctgggccccaggtag

SEQ ID NO: 7009 - DNA, 498 bp, Artificial Sequence
  Description of Artificial Sequence: Synthetic coding sequence
atggccctgctggccctgctgctggtggtggccctgccccgggtgtggacagatgccaacctgacagcccggcagagggaccctgaggacagccagaggacagatgaaggagacaacagagtgtggtgccacgtgtgtgaaagagagaacacctttgagtgccagaacccccggcgctgcaagtggacagagccctactgtgtgattgctgctgtgaagatcttcccccgcttcttcatggtggccaagcagtgcagcgctggctgtgccgccatggagcggcccaagccagaggagaagcgcttcctgctggaggagcccatgcccttcttctacctgaagtgctgcaagatccgctactgcaacctggagggcccccccatcaacagctctgtgttcaaggagtatgccggctccatgggagagagctgtggcggcctgtggctggccatcctgctgctgctggccagcattgctgctggcctgagcctgtcctag

SEQ ID NO: 7010 - DNA, 933 bp, Artificial Sequence
  Description of Artificial Sequence: Synthetic coding sequence
atgaatggcctgagcctgtctgagctgtgctgcctcttctgctgccccccctgccccggcagaattgctgccaagctggccttcctgcccccagaggccacctacagcctggtgcctgagcctgagcccggccctggaggagctggggccgcccccctgggcaccctgcgggccagcagcggggcccctggccgctggaagctgcacctgacagaaagagctgacttccagtacagccagcgggagctggacaccatcgaggtgttccccaccaagagcgcccggggcaacagagtgtcctgcatgtatgtgcgctgtgtgcctggggcccgctacacagtgctcttcagccacggcaatgctgtggacctgggccagatgagcagcttctacatcggcctgggcagccggctgcactgcaacatcttctcctatgactacagcggctacggggccagcagcggccggcccagcgagaggaacctgtatgctgacattgatgctgcctggcaggccctgcggaccaggtatggcatcagcccagacagcatcatcctgtatggccagagcattggaacagtgcccaccgtggacctggccagccgctatgaatgtgccgctgtggtgctgcacagccccctgaccagcggcatgagggtggccttcccagacaccaagaagacctactgctttgatgccttccccaacatcgagaaggtgtccaagatcaccagccctgtgctgatcatccatggaacagaagatgaagtcatcgacttcagccacggcctggccctgtatgagcgctgccccaaggctgtggagcccctgtgggtggagggcgccggccacaatgacatcgagctgtacagccagtacctggagcggctgcggcgcttcatcagccaggagctgcccagccagagggcctag

SEQ ID NO: 7011 - DNA, 1905 bp, Artificial Sequence
  Description of Artificial Sequence: Synthetic coding sequence
atggcccagggcgtgctgtggatcctgctgggcctgctgctgtggagcgaccccggcacagccagcctgcccctgctgatggattctgtcatccaggccctggccgagctggagcagaaggtgcctgctgccaagaccaggcacacagccagcgcctggctgatgtctgcccccaacagcggcccccacaaccggctgtaccacttcctgctgggcgcctggagcctgaatgccacagagctggacccctgccccctgagccctgagctgctgggcctgaccaaggaggtggcccggcatgatgtgcgggagggcaaggagtatggagtggtgctggccccagatggcagcacagtggccgtggagcccctgctggccggcctggaggccggcctgcagggcagaagagtcatcaacctgcccctggacagcatggccgccccctgggagactggagacaccttcccagatgtggtggccatcgccccagatgtgcgggccaccagcagccctggcctgagagatggcagcccagatgtgaccacagctgacattggagccaacaccccagatgccaccaagggctgcccagatgtgcaggccagcctgcctgatgccaaggccaagagcccccccaccatggtggacagcctgctggccgtgaccctggccggcaacctgggcctgaccttcctgcggggcagccagacccagagccacccagacctgggcacagagggctgctgggaccagctgagcgcccccaggaccttcaccctgctggaccccaaggccagcctgctgaccatggccttcctgaatggagccctggatggagtcatcctgggggactacctgagcaggaccccagagccccggcccagcctgagccacctgctgagccagtactacggggccggcgtggcccgggaccccggcttccgcagcaacttccggcggcagaatggagctgccctgaccagcgccagcatcctggcccagcaggtgtggggcaccctggtgctgctgcagaggctggagcctgtgcacctgcagctgcagtgcatgagccaggagcagctggcccaggtggccgccaatgccaccaaggagttcacagaggccttcctgggctgcccagccatccacccccgctgccgctggggcgccgccccctaccggggccggcccaagctgctgcagctgcccctgggcttcctgtatgtgcaccacacctacgtgcctgccccaccctgcacagacttcacccgctgtgccgccaacatgaggtccatgcagcgctaccaccaggacacccagggctggggagacatcggctacagctttgtggtgggcagtgatggctacgtgtatgagggccggggctggcactgggtgggcgcccacaccctgggccacaacagccggggcttcggcgtggccatcgtgggcaactacacagctgccctgcccacagaggccgccctgaggacagtgcgggacaccctgcccagctgtgctgtgcgggccggcctgctgcggccagactatgccctgctgggccaccggcagctggtgaggacagactgccctggagatgccctgtttgacctgctgcggacctggccccacttcaccgctgtgtccctgcggagcctgcactacacagcccggcggcccagcgtgtacaccagcagcacccggcccctgcccccagcctgcaacagctgtgccaggacagccagcgcccggccccccaccagcagaagacatgtgtacagcggcaacctgggccctgcctttgctggccacagcgctggcaacatcccagaccctgtgaccagcgcctatgctgccagcgcccagccccagacccagcctgcctgccccttccccagcagctag

SEQ ID NO: 7012 - DNA, 777 bp, Artificial Sequence
  Description of Artificial Sequence: Synthetic coding sequence
atgctggtgctgtatggccacagcacccaggacctgcctgagaccaatgcccgggtggtgggcggcacagaagctggaagaaattcctggcccagccagatcagcctgcagtaccgcagcggcggcagccgctaccacacctgtggcggcaccctcatccggcagaactgggtgatgacagctgcccactgtgtggactaccagaagaccttccgggtggtggccggggaccacaacctgagccagaatgatggaacagagcagtatgtgtctgtgcagaagatcgtggtgcacccctactggaacagcgacaacgtggccgccggctatgacatcgccctgctgcggctggcccagagcgtgaccctgaacagctatgtgcagctgggcgtgctgccccaggagggcgccatcctggccaacaacagcccctgctacatcaccggctggggcaagaccaagaccaacggccagctggcccagaccctgcagcaggcctacctgcccagcgtggactatgccatctgcagcagcagcagctactggggcagcacagtgaagaacaccatggtgtgtgctggaggagatggagtgcgcagcggctgccagggcgacagcggcggccccctgcactgcctggtgaatggcaagtacagcgtgcatggagtgaccagctttgtgagcagccggggctgcaatgtgtccaggaagcccaccgtcttcacccaggtgtctgcctacatctcctggatcaacaacgtgattgccagcaactag

SEQ ID NO: 7013 - DNA, 993 bp, Artificial Sequence
  Description of Artificial Sequence: Synthetic coding sequence
atggccgcccggcgcagccagaggagaagaggccggcggggggagcccggcacagccctgctggtgcccctggccctgggcctgggcctggccctggcctgcctgggcctgctgctggccgtggtgtccctgggcagccgggccagcctgagcgcccaggagcccgcccaggaggagctggtggccgaggaggaccaggaccccagcgagctgaacccccagacagaggagagccaggaccctgcccccttcctgaaccggctggtgcggccccggcgcagcgcccccaagggcaggaagacccgggcccggcgggccatcgccgcccactatgaggtgcaccccaggcctggccaggatggagcccaggccggcgtggatggcaccgtgtctggctgggaggaggcccgcatcaacagcagcagccccctgcgctacaaccggcagatcggggagttcatcgtgacccgggccggcctgtactacctgtactgccagagcagtgatgccctggaggcctgggagaatggagagaggagcaggaagagaagagctgtgctgacccagaagcagaagaagcagcacagcgtgctgcacctggtgcccatcaatgccaccagcaaggatgacagtgatgtgacagaggtgatgtggcagcctgccctgcggcggggccggggcctgcaggcccagggctatggagtgcgcatccaggatgctggggtgtacctgctgtacagccaggtgctcttccaggatgtgaccttcaccatgggccaggtggtgtcccgggagggccagggccggcaggagaccctcttccgctgcatccgctccatgcccagccacccagaccgggcctacaacagctgctacagcgctggggtcttccacctgcaccagggcgacatcctgagcgtcatcatcccccgggcccgggccaagctgaacctgagcccccacggcaccttcctgggctttgtgaagctgtag

SEQ ID NO: 7014 - DNA, 2253 bp, Artificial Sequence
  Description of Artificial Sequence: Synthetic coding sequence
atggccaagccccggctgctggtgctgtactttgccctgattgtggtgcctgcctgggtgagcagcatcgtgctgaccggcaccagcgagcccccagatgcccagacagtggccccagcagaagatgagaccctgcagaatgaagctgacaaccaggagaatgtgctgagccagctgctgggggactatgacaaggtgaaggccatgtctgagggcagtgactgccagtgcaagtgtgtggtgcggcccctgggcagagatgcctgccagaggatcaatgctggggccagcaggaaggaggacttctacacagtggagaccatcaccagcggcagcagctgcaagtgtgcctgtgtggcccctccttctgccctgaacccctgtgagggggacttccggctgcagaagctgcgggaggccgacagccaggacctgaagctgagcaccatcatcgacatgctggagggcgccttctacggcctggacctgctgaagctgcacagcgtgaccaccaagctggtgggccgggtggacaagctggaggaggaggtgtccaagaacctgaccaaggaaaatgagcagatcaaggaggacatggaggagatcagaacagagatgaacaagaggggcaaggagaactgcagcgagaacatcctggacagcatgccagacatccgcagcgccctgcagagagatgctgctgctgcctatgcccacccagaatatgaggagcgcttcctgcaggaggagaccgtgtcccagcagatcaacagcattgagctgctgcagacccggcccctggccctgcctgaggtggtgaagagccagaggcccctgcagaggcaggtgcacctgcggggccgcccagccagccagcccaccgtcatccggggcatcacctactacaaggccaaggtgtctgaggaggagaatgacatcgaggagcagcaggatgagttcttcagcggggacaatggagtggacctgctgattgaggaccagctgctgcggcacaacggcctgatgacctctgtgaccaggaggcctgctgccacccggcagggccacagcacagctgtgaccagtgacctgaatgccaggacagccccctggagcagcgccctgccccagcccagcaccagtgaccccagcatcgccaaccacgcctctgtgggccccaccctgcagaccacctctgtgtccccagaccccacccgggagagcgtgctgcagcccagcccccaggtgcctgccaccaccgtggcccacacagccacccagcagcctgctgccccagcccccccagctgtgagcccccgggaggccctgatggaggccatgcacacagtgcctgtgccccccaccaccgtgaggacagacagcctgggcaaggatgccccagctggctggggcaccaccccagccagccccaccctgagccctgaggaggaggatgacatcagaaatgtgattggccgctgcaaggacaccctgagcaccatcaccggccccaccacccagaacacctacggcagaaatgaaggagcctggatgaaggaccccctggccaaggatgagcgcatctacgtgaccaactactactacggcaacaccctggtggagttcaggaacctggagaacttcaagcagggccgctggagcaacagctacaagctgccctacagctggattggcaccggccacgtggtgtacaacggggccttctactacaacagagccttcaccaggaacatcatcaagtatgacctgaagcagcgctacgtggccgcctgggccatgctgcatgatgtggcctatgaggaggccaccccctggcgctggcagggccacagtgatgtggactttgctgtggatgaaaatggcctgtggctgatctacccagccctggatgatgagggcttcagccaggaggtgattgtgctgagcaagctgaatgctgctgacctgagcacccagaaggagaccacctggaggacaggcctgcggaggaacttctacggcaactgctttgtgatctgtggggtgctgtatgctgtggacagctacaaccagagaaatgccaacatctcctatgcctttgacacccacaccaacacccagatcgtgccccggctgctgtttgaaaatgagtacagctacaccacccagattgactacaaccccaaggaccggctgctgtatgcctgggacaatggccaccaggtgacctaccacgtgatctttgcctactag

SEQ ID NO: 7015 - DNA, 678 bp, Artificial Sequence
  Description of Artificial Sequence: Synthetic coding sequence
atgaagctgggctgtgtgctgatggcctgggccctgtacctgagcctgggcgtgctgtgggtggcccagatgctgctggccgccggctgccacgccgagctgtttcctgcccccatcctgcgggctgtgcccagcgctgagccccaggccggcagccccatgaccctgagctgccagaccaagctgcccctgcagaggtctgctgcccggctgctcttctccttctacaaggatggaagaattgtgcagagccggggcctgagcagcgagttccagatccccacagccagcgaggaccacagcggcagctactggtgtgaggccgccacagaggacaaccaggtgtggaagcagagcccccagctggagatccgggtgcagggcgccagcagcagcgctgccccacccaccctgaacccagccccccagaagtctgctgcccctggaacagcccctgaggaggcccctggccccctgcccccaccacccacccccagcagcgaggaccccggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 7016 - DNA, 891 bp, Artificial Sequence
  Description of Artificial Sequence: Synthetic coding sequence
atgagccggcaggagcccaagatgtttgtgctgctgtatgtgaccagctttgccatctgtgccagcggccagccccggggcaaccagctgaagggggagaactacagcccccgctacatctgcagcatccctggcctgcccggccccccaggccccccaggggccaacggcagccctggcccccacggcagaattggcctgcccggcagagatggaagagatggcaggaaaggagagaagggggagaagggcacagctggcctgcggggcaagacaggccccctgggcctggccggggagaagggggaccagggcgagaccgggaagaagggccccatcggccctgagggggagaagggggaggtgggccccatcggccccccaggccccaagggggacagaggagagcagggcgaccccggcctgcccggggtgtgccgctgtggcagcatcgtgctgaagagcgccttctctgtgggcatcaccaccagctacccagaggagcggctgcccatcatcttcaacaaggtgctcttcaatgaaggagagcactacaacccagccaccgggaagttcatctgtgccttccctggcatctactacttctcctatgacatcaccctggccaacaagcacctggccatcggcctggtgcacaacggccagtaccgcatcaagacctttgatgccaacacaggcaaccatgatgtggccagcggcagcaccgtcatctacctgcagccagaagatgaggtgtggctggagatcttcttcacagaccagaatggcctcttcagtgaccccggctgggccgacagcctcttcagcggcttcctgctgtatgtggacacagactacctggacagcatcagtgaagatgatgagctgtag

SEQ ID NO: 7017 - DNA, 1275 bp, Artificial Sequence
  Description of Artificial Sequence: Synthetic coding sequence
atgggcagcctggtgctgaccctgtgtgccctcttctgcctggccgcctacctggtgtctggcagccccatcatgaacctggagcagagccccctggaggaggacatgagcctgtttggagatgtgttcagcgagcaggatggagtggacttcaacaccctgctgcagagcatgaaggatgagttcctgaagaccctgaacctgagtgacatccccacccaggacagcgccaaggtggaccccccagagtacatgctggagctgtacaacaagtttgccacagacaggacctccatgcccagcgccaacatcatccgctccttcaagaatgaagatctcttcagccagcctgtgtccttcaacggcctgaggaagtaccccctgctcttcaacgtgtccatcccccaccacgaggaggtgatcatggccgagctgcggctgtacaccctggtgcagagggacaggatgatctatgatggagtggacaggaagatcaccatctttgaggtgctggagagcaagggggacaatgaaggagagaggaacatgctggtgctggtgtctggagagatctacggcaccaacagcgagtgggagacctttgatgtgacagatgccatccgccgctggcagaagagcggcagcagcacccaccagctggaggtgcacatcgagagcaagcatgatgaagcagaagatgccagcagcggccgcctggagattgacaccagcgcccagaacaagcacaaccccctgctgattgtgttcagtgatgaccagagcagtgacaaggagaggaaggaggagctgaatgagatgatcagccatgagcagctgcctgagctggacaacctgggcctggacagcttcagcagcggccctggagaggaggccctgctgcagatgaggagcaacatcatctatgacagcacagcccgcatcagaagaaatgccaagggcaactactgcaagaggacccccctgtacatcgacttcaaggagatcggctgggacagctggatcatcgcccctcctggctatgaggcctatgaatgtcggggcgtgtgcaactaccccctggccgagcacctgacccccaccaagcacgccatcatccaggccctggtgcacctgaagaacagccagaaggccagcaaggcctgctgcgtgcccaccaagctggagcccatcagcatcctgtacctggacaagggcgtggtgacctacaagttcaagtatgagggcatggctgtgtctgaatgtggctgcaggtag

SEQ ID NO: 7018 - DNA, 381 bp, Artificial Sequence
  Description of Artificial Sequence: Synthetic coding sequence
atgcacctgagccagctgctggcctgtgccctgctgctgaccctgctgagcctgcggcccagcgaggccaagccaggggccccacccaaggtgcccaggaccccacctgctgaggagctggccgagccccaggccgccggcggcggccagaagaagggggacaaggcccctgggggcggcggggccaacctgaagggggacaggagccggctgctgcgggacctgcgggtggacaccaagagcagagctgcctgggcccggctgctgcaggagcaccccaatgccaggaagtacaagggggccaacaagaagggcctgagcaagggctgcttcggcctgaagctggaccgcatcggctccatgagcggcctgggctgctag

SEQ ID NO: 7019 - DNA, 423 bp, Artificial Sequence
  Description of Artificial Sequence: Synthetic coding sequence
atgaggagccccaggatgagggtgtgtgccaagtctgtgctgctgagccactggctgttcctggcctacgtgctgatggtgtgctgcaagctgatgtctgccagcagccagcacctgcggggccatgctggccaccaccagatcaagcagggcacctgtgaggtggtggccgtgcaccgctgctgcaacaagaacagaattgaggagaggagccagacagtgaagtgcagctgcttccctggccaggtggccggcaccacccgggcccagcccagctgtgtggaggccagcatcgtcatccagaagtggtggtgccacatgaacccctgcctggagggggaggactgcaaggtgctgcctgactacagcggctggagctgcagcagcggcaacaaggtgaagaccaccaaggtgaccaggtag

SEQ ID NO: 7020 - DNA, 1332 bp, Artificial Sequence
  Description of Artificial Sequence: Synthetic coding sequence
atgctgatgctgtttgtgtttggagtgctgctgcacgaggtgtccctgagcggccagaatgaggccccacccaacacccacagcatccctggagagcccctgtacaactatgccagcatccggctgcctgaggagcacatccccttcttcctgcacaacaacagacacatcgccaccgtgtgcaggaaggacagcctgtgcccctacaagaagcacctggagaagctgaagtactgctggggctatgagaagagctgcaagccagagttccgcttcggctaccctgtgtgcagctatgtggacatgggctggacagacaccctggagagcgctgaggacatcttctggaagcaggccgactttggctacgcccgggagcggctggaggagatgcacgtgctgtgccagcccaaggagaccagtgacagcagcctggtgtgcagccgctacctgcagtactgccgggccaccaacctgtacctggacctgaggaacatcaagaggaaccacgaccgcttcaaggaggacttcttccagagcggggagattggaggccactgcaagctggacatccgcaccctgaccagcgagggccagaggaagagccccctgcagagctggtttgctgagctgcagagctacacccagctgaacttccggcccattgaagatgccaagtgtgacatcgtgattgagaagcccacctacttcatgaagctggatgctggggtgaacatgtaccaccacttctgtgacttcatcaacctgtacatcacccagcacgtgaacaacagcttcagcacagatgtgtacatcgtgatgtgggacacagatggcaagatccgggtgaccatcctggcccggagcacagagtacaggaagatcctgaaccagaatgagctggtgaatgccctgaagacagtgtccacctttgaggtgcagatcgtggactacaagtaccgggagctgggcttcctggaccagctgcgcatcacccacaacacagacatcttcatcggcatgcacggggccggcctgacccacctgctcttcctgcctgactgggccgctgtgtttgagctgtacaactgtgaagatgagcgctgctacctggacctggcccggctgcggggcgtgcactacatcacctggaggcggcagaacaaggtgttcccccaggacaagggccaccaccccaccctgggggagcaccccaagttcaccaactacagctttgatgtggaggagttcatgtacctggtgctgcaggccgctgaccacgtgctgcagcaccccaagtggcccttcaagaagaagcatgatgagctgtag

SEQ ID NO: 7021 - DNA, 336 bp, Artificial Sequence
  Description of Artificial Sequence: Synthetic coding sequence
atgggccccagcagctgcctgctgctgatcctgatccccctgctgcagctgatcaaccctggcagcacccagtgcagcctggacagcgtgatggacaagaagatcaaggatgtgctgaacagcctggagtacagccccagccccatcagcaagaagctgagctgtgcctctgtgaagagccagggccggcccagcagctgcccagctggcatggctgtgacaggctgtgcctgtggctacggctgcggctcctgggatgtgcagctggagaccacctgccactgccagtgcagcgtggtggactggaccacagcccgctgctgccacctgacctag

SEQ ID NO: 7022 - DNA, 1965 bp, Artificial Sequence
  Description of Artificial Sequence: Synthetic coding sequence
atggcccccaagaagctgagctgcctgcggagcctgctgctgcccctgagcctgaccctgctgctgccccaggccgacaccaggagctttgtggtggaccggggccatgaccgcttcctgctggatggagcccccttccgctacgtgtctggcagcctgcactacttccgggtgccccgggtgctgtgggccgaccggctgctgaagatgcgctggagcggcctgaatgccatccagttctacgtgccctggaactaccacgagccccagcccggggtgtacaacttcaacggcagccgggacctgattgccttcctgaatgaagctgccctggccaacctgctggtgatcctgcggcccggcccctacatctgtgccgagtgggagatgggcggcctgcccagctggctgctgaggaagccagagatccacctgcggaccagtgaccctgacttcctggccgctgtggacagctggttcaaggtgctgctgcccaagatctacccctggctgtaccacaacggcggcaacatcatcagcatccaggtggagaatgaatatggcagctaccgggcctgtgacttctcctacatgaggcacctggccggcctcttccgggccctgctgggggagaagatcctgctcttcaccacagatggccctgagggcctgaagtgtggcagcctgcggggcctgtacaccaccgtggactttggacctgctgacaacatgaccaagatcttcaccctgctgaggaaatatgagccccacggccccctggtgaacagcgagtactacacaggctggctggactactggggccagaaccacagcaccaggtctgtgtctgctgtgaccaagggcctggagaacatgctgaagctgggcgcctctgtgaacatgtacatgtttcatggaggcaccaactttggctactggaatggagctgacaagaagggccgcttcctgcccatcaccaccagctatgactatgatgcccccatcagcgaggccggggaccccacccccaagctgtttgccctgagagatgtgatcagcaagttccaggaggtgcccctgggccccctgcccccacccagccccaagatgatgctgggccctgtgaccctgcacctggtgggccacctgctggccttcctggacctgctgtgcccccggggccccatccacagcatcctgcccatgacctttgaggccgtgaagcaggaccacggcttcatgctgtaccgcacctacatgacccacaccatctttgagcccacccccttctgggtgcccaacaatggagtgcatgaccgggcctacgtgatggtggatggagtcttccagggcgtggtggagaggaacatgagggacaagctgttcctgaccgggaagctgggcagcaagctggacatcctggtggagaacatgggccgcctgagctttggcagcaacagcagtgacttcaagggcctgctgaagccacccatcctgggccagaccatcctgacccagtggatgatgttccccctgaagattgacaacctggtgaagtggtggttccccctgcagctgcccaagtggccctacccccaggcccccagcggccccaccttctacagcaagaccttccccatcctgggctctgtgggggacaccttcctgtacctgcccggctggaccaagggccaggtgtggatcaatggcttcaacctgggccgctactggaccaagcagggcccccagcagaccctgtatgtgccccgcttcctgctcttccccaggggggccctgaacaagatcaccctgctggagctggaggatgtgcccctgcagccccaggtgcagttcctggacaagcccatcctgaacagcaccagcaccctgcacaggacccacatcaacagcctgtctgctgacaccctgagcgccagcgagcccatggagctgagcggccactag

SEQ ID NO: 7023 - DNA, 2502 bp, Artificial Sequence
  Description of Artificial Sequence: Synthetic coding sequence
atgaacatggagatcggccacccccatgagggcaaggatgacctgggggacaagagggtcatcatgggcaccaagttccccatggagctgggcatccgggtgggcctgggcaaggaggacagccgctgtggggagagccctgtggtgagcaacaagtgtgagggccgcatggcccctcctgagaccaagttccccctgagcaagggcctggagatgggcctggagcggcagaacatcagcaggacagtgatgcagaggggcagcctgggcgtggacagcgtgtctgccagccagggcaccaagcccagcctgctgcccggccgcatgggcctggagaatgaaagcctgctggccggctacacccatgagcgcatcatccagccccccctgggccgggtgtgtggcagcagccaggccgccggcagcagaagagcccccctggccagcggccctgagggcgtggaggagctggtgggcaagccagcctttgtgatggagccccggcaggagatggagaaggagagcacctgtgtgctgatgaagcccaacacagagatcaagctgcctgtggaggtggacatcggcctgacccaggccgagggcccagatgagaccaagaacacagagccccagatgggcctggtgattgagcccccccagtgccagtttgcccagcagcacgagcagaggaaggaggccggcaacatcgagagcggcgtggagcccccagaccgcatccggcccatctacagcggcaagttctttgacaggaccccctgctggcccagcgctgggaaggtgattcctgtgggctacagagtggccacctgcctgacagagaagctgcccaggctcatcaccccacctgaggccaagaagtacttcaacttccgctaccccccagctggggtggagagggtcttctacggccgggccaatgacccccagatcgccccctacctgacccacggcatccgcagcaagatctctgtgctggccaacaccctcatcaacccccagcccatcaccaccttccagcagaagatcaaggacaagaaggagagcatctacctgagcaacagaagagcccccctgggcaagagccatgaccaggcccctggcctgcccaagggcatggacaccaccaacaccaccttcggcacagctgtgatcaaggagtacagcgccaaggatgtggtgaacccccccaagagctatgaggaggtgttcaaggagggcaatgaaggacatgacctgtatgtggtgagccacaatgactactatgctggggaggccaagaacaggaagtacaaccccagcagcttccaccgctgcagcgtgtatggagtgcccaccccccacttcaatgatggccgggccatggccaagagcctgtactggctgcacgagctgcagatgaagagaggagccaagtttgtgtccaagagagcagatgacttcaaggagaagttccagcacaagctgggccgggtgctggaccccatcgccgagaccatgaatgtgcccccagactgcaccttcggggcctgcctgcggcctgaggagtatggagtgggggacctgatccacaaccggctgcctgatgagtacctgcggggcaaggaccggcagagggccctgattgctgctgtgcgccaccacctgaagaaggtgaactaccagaagtttgacaccctgctggccgccttccgccactatgacaagaagggagatggcatgattgacaaggatgagctgcaggaggcctgtgaccaggccaacctgagcctggatgacaagctgctggaccagctgtttgactactgtgatgtggacaatgatggcttcatcaactacctggagtttgccaacttcctgaactggaaggacaagatgctgctgaaggagtatgaggagagggtcatcatcaagggcaggaagccagactgtgtgaaccccacagaggccaacgtggaggagcctgagcagaccctgctgatcaagccagaggacatcgtgctgaaggaggccggcagcacagagaagaccctgcggaccctgctgcggcccagcgacaaggtgagcaactactacaagaccaccagcagcgagatcaatgccatcgtgggcgccatccccagcacctgctaccccatctgtggggtgcccaccatccgcagtgacatcccagccccccgcatccgccgcatcagtgacaggaccaactatggagaggagggcagcgcctacagcctgctgtaccccaccatctttgccaggaaaggagtgtttgagcgggacttcttcaagaccaggagcaaggaggagattgctgagatcctgtgcaacatcggcgtgaagctgagtgatgaggagtttgaaaatgtgtggaacctggccagcaagaagcaccacagaggagaggtgtgtgtggagaacatcagaaatgtgctggatgagctgcggcatgctgaccgcatcaagtgcaagaccctgatgtag

SEQ ID NO: 7024 - DNA, 2004 bp, Artificial Sequence
  Description of Artificial Sequence: Synthetic coding sequence
atgggcagcagccggctggccgccctgctgctgcccctgctgctgattgtcatcgacctgagtgacagcgctggcatcggcttccgccacctgccccactggaacacccgctgccccctggccagccacacagatgacagcttcaccggcagcagcgcctacatcccctgcaggacctggtgggccctcttcagcaccaagccctggtgtgtgcgggtgtggcactgcagccgctgcctgtgccagcacctgctgagcggcggcagcggcctgcagaggggcctcttccacctgctggtgcagaagagcaagaagagcagcaccttcaagttctacagaagacacaagatgcctgccccagcccagaggaagctgctgccccggcggcacctgtctgagaagagccaccacatcagcatccccagcccagacatcagccacaagggcctgcggagcaagaggacccagcccagcgaccctgagacctgggagagcctgccccggctggacagccagagacatggaggccctgagttctcctttgacctgctgcctgaggcccgggccatccgggtgaccatcagcagcggccctgaggtgtctgtgcggctgtgccaccagtgggccctggagtgtgaggagctgagcagcccctatgatgtgcagaagatcgtgtctgggggccacacagtggagctgccctatgagttcctgctgccctgcctgtgcatcgaggccagctacctgcaggaggacacagtgcggaggaagaagtgccccttccagagctggccagaggcctacggcagtgacttctggaagtctgtgcacttcacagactacagccagcacacccagatggtgatggccctgaccctgcgctgccccctgaagctggaggccgccctgtgccagagacatgactggcacaccctgtgcaaggacctgcccaatgccacagcccgggagagtgatggctggtacgtgctggagaaggtggacctgcacccccagctgtgcttcaagttctcctttggaaacagcagccacgtggagtgcccccaccagacaggcagcctgacctcctggaatgtgtccatggacacccaggcccagcagctgatcctgcacttcagcagcaggatgcacgccaccttctctgctgcctggagcctgcccggcctgggccaggacaccctggtgccccctgtgtacacagtgtcccaggcccggggcagcagccctgtgtccctggacctgatcatccccttcctgcggcccggctgctgcgtgctggtgtggaggagtgatgtgcagtttgcctggaagcacctgctgtgcccagatgtgtcctaccgccacctgggcctgctgatcctggccctgctggccctgctgaccctgctgggcgtggtgctggccctgacctgccggcggccccagagcggccctggccctgcccggcctgtgctgctgctgcatgctgctgacagcgaggcccagaggcggctggtgggcgccctggccgagctgctgcgggccgccctgggcggcggcagagatgtgattgtggacctgtgggagggcagacatgtggcccgggtgggccccctgccctggctgtgggccgcccggaccagggtggcccgggagcagggcaccgtgctgctgctgtggagcggggctgacctgcggcctgtgtctggccctgacccccgggccgcccccctgctggccctgctgcatgctgccccccggcccctgctgctgctggcctacttcagccggctgtgtgccaagggggacatccccccacccctgcgggccctgccccgctaccgcctgctgcgggacctgccccggctgctgcgggccctggatgcccggccctttgctgaggccacctcctggggccgcctgggcgcccggcagaggcggcagagccggctggagctgtgcagccggctggagcgggaggccgcccggctggccgacctgggctag

SEQ ID NO: 7025 - DNA, 609 bp, Artificial Sequence
  Description of Artificial Sequence: Synthetic coding sequence
atggagctgtggggcgcctacctgctgctgtgcctcttcagcctgctgacccaggtgaccacagagccccccacccagaagcccaagaagatcgtgaatgccaagaaggatgtggtgaacaccaagatgtttgaggagctgaagagccggctggacaccctggcccaggaggtggccctgctgaaggagcagcaggccctgcagacagtgtgcctgaagggcaccaaggtgcacatgaagtgcttcctggccttcacccagaccaagaccttccacgaggccagcgaggactgcatcagccggggcggcaccctgggcaccccccagacaggctctgaaaatgatgccctgtatgagtacctgcggcagagcgtgggcaatgaagctgagatctggctgggcctgaatgacatggctgctgagggcacctgggtggacatgaccggggcccgcatcgcctacaagaactgggagacagagatcacagcccagccagatggcggcaagacagagaactgtgctgtgctgtctggagctgccaacgggaagtggtttgacaagcgctgccgggaccagctgccctacatctgccagtttggaattgtgtag

SEQ ID NO: 7026 - DNA, 1839 bp, Artificial Sequence
  Description of Artificial Sequence: Synthetic coding sequence
atgctggagggcctgggcagccctgccagccccagggctgctgccagcgcctctgtggccggcagcagcggccctgctgcctgcagcccccccagcagcagcgcccccaggagccctgagagccctgcccccaggagaggaggagtgcgggcctctgtgccccagaagctggccgagatgctgagcagccagtatggcctcatcgtgtttgtggccggcctgctgctgctgctggcctgggccgtgcacgccgccggcgtgtccaagagtgacctgctgtgcttcctgacagccctgatgctgctgcagctgctgtggatgctgtggtacgtgggccgcagcagcgcccaccggcggctcttccggctgaaggacacccacgccggggccggctggctgcggggcagcatcaccctgtttgctgtgatcaccgtcatcctgggctgcctgaagattggctacttcatcggcttcagcgagtgcctgagcgccacagaaggagtcttccctgtgacccacagcgtgcacaccctgctgcaggtgtacttcctgtggggccacgccaaggacatcatccagagcttcaagaccctggagagatttggagtcatccacagcgtcttcaccaacctgctgctgtgggccaacggggtgctgaatgaaagcaagcaccagctgaatgagcacaaggagcggctcatcaccctgggcttcggcaacatcaccaccgtgctggatgaccacaccccccagtgcaactgcaccccacccaccctgtgcacagccatcagccacggcatctactacctgtaccccttcaacatcgagtaccagatcctggccagcaccatgctgtatgtgctgtggaagaacatcggcaggaaggtggacagccaccagcaccagaagatgcagttcaagagtgatggagtgatggtgggcgctgtgctgggcctgactgtgctggccgccaccatcgctgtggtggtggtgtacctgatccacatcggccgcagcaagaccaagtctgagagcgccctgatcatgttctacctgtatgccatcaccctgctgatgctgatgggcgccgccggcctggccggcatccgcatctacagaattgatgagaagagcctggatgagagcaagaacccagccaggaagctggacagcgacctgctggtgggcacagccagcggctcctggctgatctcctggggcagcatcctggccatcctgtgtgccgagggccacccccgctacacctggtacaacctgccctacagcatcctggccatcgtggagaagtacatccagaacctcttcatctttgagagcatccaccgggagcctgagaagctgtctgaggacatccagaccctgcgggtggtgacagtgtgcaatggaaacaccatgcccctggccagcagctgccccaagtctggaggagtggccagagatgtggccccccagggcaaggacatgcccccagctgccaatggaaatgtgtgcatgagggagagccatgacaaggaggaggagaagcaggaggagagctcctggggcggcagccccagccctgtgcggctgccccgcttcctgcagggcaatgccaagaggaaggtgctgaggaacattgctgccttcctgttcctgtgcaacatcagcctgtggatccccccagccttcggctgcaggccagaatatgacaatggcctggaggagatcgtgtttggatttgagccctggatcatcgtggtgaacctggccatgcccttcagcatcttctacaggatgcatgctgctgccagcctgtttgaggtgtactgcaagatctag

SEQ ID NO: 7027 - DNA, 786 bp, Artificial Sequence
  Description of Artificial Sequence: Synthetic coding sequence
atggagctgctgcaggtgaccatcctcttcctgctgcccagcatctgcagcagcaacagcactggagtgctggaggccgccaacaacagcctggtggtgaccaccaccaagcccagcatcaccacccccaacacagagagcctgcagaagaatgtggtgacccccaccaccggcaccacccccaagggcaccatcaccaatgagctgctgaagatgagcctgatgagcacagccaccttcctgaccagcaaggatgagggcctgaaggccaccaccacagatgtgaggaagaatgacagcatcatcagcaatgtgacagtgacctctgtgaccctgcccaatgctgtgtccaccctgcagagcagcaagcccaagacagagacccagagcagcatcaagaccacagagatccctggctctgtgctgcagccagatgccagccccagcaagacaggcaccctgaccagcatccctgtgaccatccctgagaacaccagccagagccaggtgattggaacagaaggaggcaagaatgccagcaccagcgccaccagccgcagctacagcagcatcatcctgcctgtggtgattgccctgattgtcatcaccctgtctgtgtttgtgctggtgggcctgtacaggatgtgctggaaggctgaccccggcaccccagaaaatggaaatgaccagccccagagcgacaaggagagcgtgaagctgctgactgtgaagaccatcagccatgagagcggggagcacagcgcccagggcaagaccaagaactag

SEQ ID NO: 7028 - DNA, 6408 bp, Artificial Sequence
  Description of Artificial Sequence: Synthetic coding sequence
atgcctgccctgggccctgccctgctgcaggccctgtgggccggctgggtgctgaccctgcagcccctgcccccaacagccttcaccccaaatggcacctacctgcagcacctggcccgggaccccaccagcggcaccctgtacctgggcgccaccaacttcctgttccagctgagccctggcctgcagctggaggccaccgtgtccacaggccctgtgctggacagccgggactgcctgccccctgtgatgccagatgaatgtccccaggcccagcccaccaacaaccccaaccagctgctgctggtgtcccctggggccctggtggtgtgtggctctgtgcaccagggcgtgtgtgagcagaggcggctgggccagctggagcagctgctgctgcggcctgagaggcctggggacacccagtatgtggccgccaatgaccctgctgtgtccacagtgggcctggtggcccagggcctggccggggagcccctgctgtttgtgggccggggctacaccagccggggcgtgggcggcggcatcccccccatcaccacccgggccctgtggcccccagacccccaggccgccttctcctatgaggagacagccaagctggccgtgggccgcctgtctgagtacagccaccactttgtgtctgcctttgcccggggggccagcgcctacttcctgttcctgcggcgggacctgcaggcccagagccgggccttccgggcctacgtgtcccgggtgtgcctgcgggaccagcactactacagctatgtggagctgcccctggcctgtgagggcggccgctatggcctcatccaggccgctgctgtggccaccagccgggaggtggcccatggagaggtgctgtttgctgccttcagcagcgctgccccacccaccgtgggccggccccccagcgctgctgctggggccagcggggccagcgccctgtgtgccttccccctggatgaggtggaccggctggccaacagaacaagagatgcctgctacacccgggagggccgggcagaagatggaacagaggtggcctacatcgagtatgatgtgaacagcgactgtgcccagctgcctgtggacaccctggatgcctacccctgtggcagtgaccacacccccagccccatggccagccgggtgcccctggaggccacccccatcctggagtggccaggcatccagctgacagctgtggccgtgaccatggaggatggccacaccatcgccttcctgggggacagccagggccagctgcaccgggtgtacctgggccctggcagtgatggccacccctacagcacccagagcatccagcagggcagcgctgtgtcccgggacctgacctttgatggcacctttgagcacctgtatgtgatgacccagagcaccctgctgaaggtgcctgtggccagctgtgcccagcacctggactgtgccagctgcctggcccaccgggacccctactgcggctggtgtgtgctgctgggccgctgcagccgccgctcagaatgttcccggggccagggccctgagcagtggctgtggagcttccagcctgagctgggctgcctgcaggtggccgccatgagccctgccaacatcagccgggaggagacccgggaggtgttcctgtctgtgcctgacctgccccccctgtggccaggagagagctacagctgccactttggagagcaccagagccctgccctgctgaccggcagcggcgtgatgtgccccagcccagaccccagcgaggcccctgtgctgcccagaggagctgactatgtgtctgtgtctgtggagctgcgctttggagctgtggtgattgccaagaccagcctgtccttctatgactgtgtggccgtgacagagctgcggcccagcgcccagtgccaggcctgtgtgagcagccgctggggctgcaactggtgtgtgtggcagcacctgtgcacccacaaggccagctgtgatgctggccccatggtggccagccaccagagccccctggtgtccccagaccccccagcccggggcggccccagccccagccccccaacagcccccaaggccctggccaccccagccccagacaccctgcctgtggagcccggggcccccagcacagccacagccagtgacatcagccctggggccagccccagcctgctgagcccctggggcccctgggccggcagcggcagcatcagcagccctggcagcacaggcagccccctgcacgaggagcccagcccccccagcccccagaatggacctggaacagctgtgcctgcccccacagacttccggcccagcgccaccccagaggacctgctggccagccccctgagccccagcgaggtggccgctgtgcccccagctgaccccggccctgaggccctgcaccccaccgtgcccctggacctgcccccagccaccgtgcctgccaccaccttccctggggccatgggctctgtgaagccagccctggactggctgacccgggagggcggggagctgcctgaggctgatgagtggacaggaggagatgccccagccttcagcaccagcaccctgctgtctggagatggagacagcgctgagctggagggccccccagcccccctcatcctgcccagcagcctggactaccagtatgacaccccaggcctgtgggagctggaggaggccaccctgggcgccagcagctgcccctgtgtggagagcgtgcagggcagcaccctgatgcctgtgcacgtggagcgggagatccggctgctgggcaggaacctgcacctgttccaggacggccctggggacaatgaatgtgtgatggagctggagggcctggaggtggtggtggaggcccgggtggagtgtgagcccccaccagacacccagtgccacgtgacctgccagcagcaccagctgtcctatgaggccctgcagcctgagctgcgggtgggcctcttcctgcggcgggccggccgcctgcgggtggacagcgctgagggcctgcacgtggtgctgtatgactgcagcgtgggccacggggactgcagccgctgccagacagccatgccccagtatggctgtgtgtggtgtgagggggagcggccccgctgtgtgacccgggaggcctgtggggaggccgaggccgtggccacccagtgcccagcccccctcatccacagcgtggagcccctgactggacctgtggatggcggcaccagggtgaccatccggggcagcaacctgggccagcacgtgcaggatgtgctgggcatggtgacagtggccggcgtgccctgtgctgtggatgcccaggagtatgaggtgagcagcagcctggtgtgcatcaccggggccagcggggaggaggtggccggggccacagctgtggaggtgcccggccggggccggggcgtgtctgaacatgactttgcctaccaggaccccaaggtgcacagcatcttccctgcccggggccccagggctgggggcacccggctgaccctgaatggcagcaagctgctgaccggccgcctggaggacatccgggtggtggtgggggaccagccctgccacctgctgcctgagcagcagagcgagcagctgcgctgtgagaccagcccccggcccaccccagccaccctgcctgtggccgtgtggtttggagccacagaaagaaggctgcagaggggccagttcaagtacaccctggaccccaacatcaccagcgctggccccaccaagagcttcctgagcggcggccgggagatctgtgtgcggggccagaacctggatgtggtgcagaccccccgcatccgggtgacagtggtgtccaggatgctgcagcccagccagggcctgggcagaagaagaagagtggtgcctgagacagcctgcagcctgggccccagctgcagcagccagcagtttgaggagccctgccacgtgaacagcagccagctgatcacctgcaggaccccagccctgcccggcctgcctgaggacccctgggtgcgggtggagttcatcctggacaacctggtgtttgattttgccaccctgaaccccacccccttctcctatgaggccgaccccaccctgcagcccctgaaccctgaggaccccaccatgcccttccgccacaagccaggcagcgtcttctctgtggagggggagaacctggacctggccatgagcaaggaggaggtggtggccatgattggagatggcccctgtgtggtgaagaccctgaccaggcaccacctgtactgtgagccccctgtggagcagcccctgcccaggcaccacgccctgcgggaggccccagacagcctgcctgagttcaccgtgcagatgggcaacctgcgcttcagcctgggccacgtgcagtatgatggagagagccctggggccttccctgtggccgcccaggtgggcctgggcgtgggcaccagcctgctggccctgggcgtcatcatcatcgtgctgatgtacagaaggaagagcaagcaggccctgcgggactacaagaaggtgcagatccagctggagaacctggagagctctgtgcgggaccgctgcaagaaggagttcacagacctgatgacagagatgacagacctgaccagtgacctgctgggcagcggcatccccttcctggactacaaggtgtatgcagagcgcatcttcttccctggccaccgggagagccccctgcaccgggacctgggcgtgcctgagagcagaagacccaccgtggagcagggcctgggccagctgagcaacctgctgaacagcaagctgttcctgaccaagttcatccacaccctggagagccagaggaccttcagcgcccgggaccgggcctacgtggccagcctgctgactgtggccctgcacggcaagctggagtacttcacagacatcctgcggaccctgctgagtgacctggtggcccagtatgtggccaagaaccccaagctgatgctgcggaggacagaaacagtggtggagaagctgctgaccaactggatgagcatctgcctgtacacctttgtgcgggacagcgtgggggagcccctgtacatgctgttccggggcatcaagcaccaggtggacaagggccctgtggacagcgtgacaggcaaggccaagtacaccctgaatgacaaccggctgctgcgggaggatgtggagtaccggcccctgaccctgaatgccctgctggccgtgggccctggagctggggaggcccagggcgtgcctgtgaaggtgctggactgtgacaccatcagccaggccaaggagaagatgctggaccagctgtacaagggcgtgcccctgacccagaggccagaccccaggaccctggatgtggagtggaggtctggagtggccggccacctgatcctgagtgatgaagatgtgaccagcgaggtgcagggcctgtggaggcggctgaacaccctgcagcactacaaggtgcctgatggagccaccgtggccctggtgccctgcctgaccaagcacgtgctgcgggagaaccaggactatgtgcctggagagaggacccccatgctggaggatgtggatgaaggaggcatccggccctggcacctggtgaagcccagtgatgagcctgagcccccccggccccggcggggcagcctgcggggcggggagcgggagcgggccaaggccatccctgagatctacctgacccggctgctgtccatgaagggcaccctgcagaagtttgtggatgacctcttccaggtgatcctgagcaccagcaggcctgtgcccctggccgtgaagtacttctttgacctgctggatgagcaggcccagcagcacggcatcagtgaccaggacaccatccacatctggaagaccaacagcctgcccctgcgcttctggatcaacatcatcaagaacccccagtttgtgtttgatgtgcagaccagtgacaacatggatgctgtgctgctggtgattgcccagaccttcatggatgcctgcaccctggccgaccacaagctgggccgggacagccccatcaacaagctgctgtatgcccgggacatcccccgctacaagaggatggtggagcgctactatgctgacatccggcagacagtgcctgccagtgaccaggagatgaacagcgtgctggccgagctgtcctggaactacagcggggacctgggcgcccgggtggccctgcacgagctgtacaagtacatcaacaagtactatgaccagatcatcacagccctggaggaggatggaacagcccagaagatgcagctgggctaccgcctgcagcagattgctgctgctgtggagaacaaggtgacagacctgtag

SEQ ID NO: 7029 - DNA, 297 bp, Artificial Sequence
  Description of Artificial Sequence: Synthetic coding sequence
atgaagctgatggtgctggtgttcaccatcggcctgaccctgctgctgggcgtgcaggccatgcctgccaaccggctgagctgctacaggaagatcctgaaggaccacaactgccacaacctgcctgagggcgtggccgacctgacccagattgatgtgaatgtgcaggaccacttctgggatggcaagggctgtgagatgatctgctactgcaacttcagcgagctgctgtgctgccccaaggatgtgttcttcggccccaagatcagctttgtgatcccctgcaacaaccagtag

SEQ ID NO: 7030 - DNA, 1443 bp, Artificial Sequence
  Description of Artificial Sequence: Synthetic coding sequence
atgaagaggtctgtggccgtgtggctgctggtgggcctgagcctgggcgtgccccagtttgggaagggggacatctgtgaccccaacccctgtgaaaatggaggcatctgcctgcccggcctggctgatggcagcttcagctgtgaatgtccagatggcttcacagaccccaactgcagctctgtggtggaggtggccagtgatgaggaggagcccaccagcgctggcccctgcacccccaacccctgccacaatggaggcacctgtgagatcagcgaggcctacagaggagacaccttcatcggctacgtgtgcaagtgcccccggggcttcaacggcatccactgccagcacaacatcaatgaatgtgaggtggagccctgcaagaatggaggcatctgcacagacctggtggccaactacagctgtgagtgccctggagagttcatgggcaggaactgccagtacaagtgcagcggccccctgggcatcgagggcggcatcatcagcaaccagcagatcacagccagcagcacccaccgggccctgtttggcctgcagaagtggtacccctactatgcccggctgaacaagaagggcctcatcaatgcctggacagctgctgaaaatgaccgctggccctggatccagatcaacctgcagaggaagatgagggtgactggagtcatcacccagggcgccaagagaattggcagccctgagtacatcaagagctacaagatcgcctacagcaatgatggcaagacctgggccatgtacaaggtgaagggcaccaatgaagacatggtgttccggggcaacatcgacaacaacaccccctatgccaacagcttcaccccacccatcaaggcccagtatgtgcggctgtacccccaggtgtgccgccgccactgcaccctgaggatggagctgctgggctgtgagctgagcggctgcagcgagcccctgggcatgaagagcggccacatccaggactaccagatcacagccagcagcatcttccgcaccctgaacatggacatgttcacctgggagcccaggaaggcccggctggacaagcagggcaaggtgaatgcctggaccagcggccacaatgaccagagccagtggctgcaggtggacctgctggtgcccaccaaggtgacaggcatcatcacccagggcgccaaggactttggacatgtgcagtttgtgggcagctacaagctggcctacagcaatgatggagagcactggacagtgtaccaggatgagaagcagaggaaggacaaggtgttccagggcaactttgacaatgacacccacaggaagaatgtgattgatcctcccatctatgcccggcacatccgcatcctgccctggagctggtacggccgcatcaccctgcggtctgagctgctgggctgcacagaggaggagtag

SEQ ID NO: 7031 - DNA, 1323 bp, Artificial Sequence
  Description of Artificial Sequence: Synthetic coding sequence
atggctgtgaagctgggcaccctgctgctggccctggccctgggcctggcccagcctgccagcgcccggaggaagctgctggtgttcctgctggatggcttcagaagtgactacatcagtgatgaggccctggagagcctgcccggcttcaaggagatcgtgtccagaggagtgaaggtggactacctgaccccagacttccccagcctgagctaccccaactactacaccctgatgacaggccgccactgtgaggtgcaccagatgattggcaactacatgtgggaccccaccaccaacaagagctttgatattggagtgaacaaggacagcctgatgcccctgtggtggaatggcagcgagcccctgtgggtgaccctgaccaaggccaagaggaaggtgtacatgtactactggccaggctgtgaggtggagatcctgggcgtgcggcccacctactgcctggagtacaagaatgtgcccacagacatcaactttgccaatgctgtgtctgatgccctggacagcttcaagagcggccgggctgacctggccgccatctaccacgagagaattgatgtggagggccaccactacggccctgccagcccccagaggaaggatgccctgaaggctgtggacacagtgctgaagtacatgaccaagtggatccaggagcggggcctgcaggaccggctgaatgtcatcatcttcagtgaccacggcatgacagacatcttctggatggacaaggtgattgagctgaacaagtacatcagcctgaatgacctgcagcaggtgaaggaccggggccctgtggtgtccctgtggccagcccctgggaagcacagcgagatctacaacaagctgagcacagtggagcacatgacagtgtatgagaaggaggccatccccagccgcttctactacaagaagggcaagtttgtgagccccctgaccctggtggctgatgagggctggttcatcacagaaaatcgggagatgctgcccttctggatgaacagcactggaagaagagagggctggcagaggggctggcacggctatgacaatgagctgatggacatgaggggcatcttcctggccttcggccctgacttcaagagcaacttccgggccgcccccatccgctctgtggatgtgtacaacgtgatgtgcaatgtggtgggcatcacccccctgcccaacaacggctcctggagccgggtgatgtgcatgctgaagggccgggccagcacagcccctcctgtgtggcccagccactgtgccctggccctgatcctgctcttcctgctggcctag

SEQ ID NO: 7032 - DNA, 351 bp, Artificial Sequence
  Description of Artificial Sequence: Synthetic coding sequence
atggagagcagccgggtgcggctgctgcccctgctgggcgccgccctgctgctgatgctgcccctgctgggcacccgggcccaggaggatgctgagctgcagccccgggccctggacatctacagcgctgtggatgatgccagccatgagaaggagctgattgaggccctgcaggaggtgctgaagaagctgaagagcaagagggtgcccatctatgagaagaagtatggccaggtgcccatgtgtgatgctggggagcagtgtgctgtgaggaagggggcccgcatcggcaagctgtgtgactgcccccggggcaccagctgcaacagcttcctgctgaagtgcctgtag

SEQ ID NO: 7033 - DNA, 1365 bp, Artificial Sequence
  Description of Artificial Sequence: Synthetic coding sequence
atggcccggcccaacaagttcctgctgtggttctgctgctttgcctggctgtgcttccccatcagcctgggcagccaggccagcggcggggaggcccagattgctgccagcgctgagctggagagcggggccatgccctggagcctgctgcagcacattgatgagcgggacagagctggcctgctgcctgccctcttcaaggtgctgtctgtgggccggggcggcagcccccggctgcagcctgacagccgggccctgcactacatgaagaagctgtacaagacctacgccaccaaggagggcatccccaagagcaacagaagccacctgtacaacacagtgcggctcttcaccccctgcaccaggcacaagcaggcccctggggaccaggtgacaggcatcctgcccagcgtggagctgctcttcaacctggaccgcatcaccaccgtggagcacctgctgaagtctgtgctgctgtacaacatcaacaacagcgtgtccttcagcagcgctgtgaagtgtgtgtgcaacctgatgatcaaggagcccaagagcagcagcaggaccctgggccgggccccctacagcttcaccttcaacagccagtttgaatttgggaagaagcacaagtggatccagattgatgtgaccagcctgctgcagcccctggtggccagcaacaagaggagcatccacatgagcatcaacttcacctgcatgaaggaccagctggagcaccccagcgcccagaatggcctcttcaacatgaccctggtgagccccagcctcatcctgtacctgaatgacaccagcgcccaggcctaccacagctggtacagcctgcactacaagagaagacccagccagggccctgaccaggagaggagcctgagcgcctaccctgtgggggaggaggccgcagaagatggccgcagcagccaccaccgccaccggcggggccaggagaccgtgagcagcgagctgaagaagcccctgggccctgccagcttcaacctgtctgagtacttccggcagttcctgctgccccagaatgaatgtgagctgcatgacttccggctgtccttcagccagctgaagtgggacaactggatcgtggccccccaccgctacaacccccgctactgcaagggggactgccccagggctgtgggccacagatatggcagccctgtgcacaccatggtgcagaacatcatctatgagaagctggacagctctgtgccccggcccagctgtgtgcctgccaagtacagccccctgtctgtgctgaccatcgagccagatggcagcatcgcctacaaggagtatgaggacatgattgccaccaagtgcacctgcaggtag

SEQ ID NO: 7034 - DNA, 234 bp, Artificial Sequence
  Description of Artificial Sequence: Synthetic coding sequence
atgtggcacctgaagctgtgtgctgtgctgatgatcttcctgctgctgctgggccagattgatggcagccccatccctgaggtgagcagcgccaagagaagacccaggaggatgacccccttctggaggggcgtgtccctgcggcccatcggggccagctgcagagatgacagcgagtgcatcacccggctgtgcaggaagaggcgctgcagcctgtctgtggcccaggagtag

SEQ ID NO: 7035 - DNA, 912 bp, Artificial Sequence
  Description of Artificial Sequence: Synthetic coding sequence
atgtctgagccccagcctgacctggagcccccccagcacggcctgtacatgctgttcctgctggtgctggtgttcttcctgatgggcctggtgggcttcatgatctgccacgtgctgaagaagaagggctaccgctgcaggaccagccggggcagcgagccagatgatgcccagctgcagcccccagaagatgatgacatgaatgaagatactgtggagagaattgtgcgctgcatcatccagaatgaggccaatgctgaggccctgaaggagatgctgggggacagcgagggggagggcaccgtgcagctgagctctgtggatgccaccagcagcctgcaggatggagcccccagccaccaccacacagtgcacctgggcagcgctgccccctgcctgcactgcagccgcagcaagaggcctcccctggtgcggcagggccgcagcaaggagggcaagagccggcccaggactggagagaccaccgtcttctctgtgggccgcttccgggtgacccacatcgagaagagatatggcctgcacgagcacagagatggcagccccacagaccgctcctggggcagcggcggcggccaggaccccggcggcggccagggcagcggcggcggccagcccaaggccggcatgcctgccatggagcggctgcccccagagcggccccagccccaggtgctggccagcccccctgtgcagaatggaggcctgcgggacagcagcctgaccccccgggccctggagggcaacccccgggccagcgctgagcccaccctgcgggccggcggccggggccccagccctggcctgcccacccaggaggccaacggccagcccagcaagccagacaccagtgaccaccaggtgtccctgccccagggcgccggctccatgtag

SEQ ID NO: 7036 - DNA, 795 bp, Artificial Sequence
  Description of Artificial Sequence: Synthetic coding sequence
atgaggaccctgtggatggccctgtgtgccctgagccggctgtggccaggggcccaggccggctgtgccgaggccggccgctgctgccccggccgggaccctgcctgctttgcccggggctggaggctggacagagtgtatggcacctgcttctgtgaccaggcctgccgcttcaccggggactgctgctttgattatgaccgggcctgcccagcccggccctgctttgtgggggagtggagcccctggagcggctgtgccgaccagtgcaagcccaccaccagggtgagaagaagatctgtgcagcaggagccccagaatggaggagccccctgcccccccctggaggagagagctggctgcctggagtacagcaccccccagggccaggactgtggccacacctacgtgcctgccttcatcaccaccagcgccttcaacaaggagaggacccggcaggccaccagcccccactggagcacccacacagaagatgctggctactgcatggagttcaagacagagagcctgaccccccactgtgccctggagaactggcccctgacccgctggatgcagtacctgcgggagggctacacagtgtgtgtggactgccagcccccagccatgaacagcgtgtccctgcgctgcagcggagatggcctggacagtgatggcaaccagaccctgcactggcaggccatcggcaacccccgctgccagggcacctggaagaaggtgcggcgggtggaccagtgcagctgcccagctgtgcacagcttcatcttcatctag

SEQ ID NO: 7037 - DNA, 312 bp, Artificial Sequence
  Description of Artificial Sequence: Synthetic coding sequence
atgaggcagaggctgctgcccagcgtgaccagcctgctgctggtggccctgctcttccctggcagcagccaggcccggcacgtgaaccacagcgccacagaggccctgggggagctgcgggagcgggcccctggccagggcaccaacggcttccagctgctgcggcatgctgtgaagagggacctgctgccccccaggaccccaccctaccaggtgcacatcagccaccgggaggcccggggccccagcttccgcatctgtgtggacttcctgggcccccgctgggcccggggctgcagcactggaaattag

SEQ ID NO: 7038 - DNA, 3867 bp, Artificial Sequence
  Description of Artificial Sequence: Synthetic coding sequence
atggcctctgtggcctgggccgtgctgaaggtgctgctgctgctgcccacccagacctggagccctgtgggcgccggcaaccccccagactgtgatgcccccctggccagcgccctgcccaggagcagcttcagcagcagcagcgagctgagcagcagccacggccctggcttcagccggctgaacagaagagatggagctgggggctggacccccctggtgagcaacaagtaccagtggctgcagattgacctgggggagaggatggaggtgacagctgtggccacccagggcggctacggcagcagtgactgggtgaccagctacctgctgatgttcagtgatggcggcaggaactggaagcagtaccgccgggaggagagcatctggggcttccctggcaacaccaatgctgacagcgtggtgcactaccgcctgcagcccccatttgaggcccgcttcctgcgcttcctgcccctggcctggaacccccggggccgcatcggcatgagaattgaggtgtatggctgtgcctacaagtctgaggtggtgtactttgatggccagagcgccctgctgtaccgcctggacaagaagcccctgaagcccatcagagatgtgatcagcctgaagttcaaggccatgcagagcaatggcatcctgctgcaccgggagggccagcacggcaaccacatcaccctggagctgatcaagggcaagctggtgttcttcctgaacagcggaaatgccaagctgcccagcaccatcgcccctgtgaccctgaccctgggcagcctgctggatgaccagcactggcacagcgtgctgattgagctgctggacacccaggtgaacttcaccgtggacaagcacacccaccacttccaggccaagggggacagcagctacctggacctgaactttgagatcagctttggaggcatccccaccccaggccgcagccgggccttccggaggaagagcttccacggctgcctggagaacctgtactacaatggagtggatgtgacagagctggccaagaagcacaagccccagatcctgatgatgggaaatgtgtccttcagctgcccccagccccagacagtgcctgtgaccttcctgagcagccgcagctacctggccctgcccggcaacagcggggaggacaaggtgtctgtgaccttccagttccgcacctggaacagagctggccacctgctgtttggagagctgcggcggggcagcggcagctttgtgctcttcctgaaggatggcaagctgaagctgagcctcttccagcccggccagagccccagaaatgtgacagctggggccggcctgaatgatggccagtggcacagcgtgtccttcagcgccaagtggagccacatgaatgtggtggtggatgatgacacagctgtgcagcccctggtggccgtgctgattgattctggggacacctactactttggaggctgcctggacaacagcagcggcagcggctgcaagagccccctgggcggcttccagggctgcctgcggctcatcaccatcggggacaaggctgtggaccccatcctggtgcagcagggcgccctgggcagcttccgggacctgcagattgacagctgtggcatcacagaccgctgcctgcccagctactgtgagcacggcggagaatgttcccagagctgggacaccttcagctgtgactgcctgggcaccggctacacaggagagacctgccacagcagcctgtatgagcagagctgtgaggcccacaagcaccggggcaaccccagcggcctgtactacattgatgctgatggcagcggccccctgggccccttcctggtgtactgcaacatgacagcagatgctgcctggacagtggtgcagcacggcggcccagatgctgtgaccctgcggggggcccccagcggccaccccaggtctgctgtgtcctttgcctatgctgctggagctggccagctgcggtctgctgtgaacctggccgagcgctgtgagcagaggctggccctgcgctgtggcacagcccggcggccagacagcagagatggcacccccctgtcctggtgggtgggccgcaccaatgagacccacacctcctggggcggcagcctgcctgatgcccagaagtgcacctgtggcctggagggcaactgcatcgacagccagtactactgcaactgtgatgctggaagaaatgagtggaccagtgacaccatcgtgctgagccagaaggagcacctgcctgtgacccagatcgtgatgacagatgctggccggccccacagcgaggccgcctacaccctgggccccctgctgtgccgcggggaccagagcttctggaacagcgccagcttcaacacagagaccagctacctgcacttccctgccttccacggggagctgacagcagatgtgtgcttcttcttcaagaccaccgtgtcctctggagtcttcatggagaacctgggcatcacagacttcatccgcatcgagctgcgggcccccacagaggtgaccttctcctttgatgtgggcaatggcccctgtgaggtgacagtgcagagccccacccccttcaatgacaaccagtggcaccacgtgcgggcagagagaaatgtgaagggggccagcctgcaggtggaccagctgccccagaagatgcagcctgccccagcagatggccacgtgcggctgcagctgaacagccagctgttcatcggcggcacagccacccggcagaggggcttcctgggctgcatccgcagcctgcagctgaatggagtggccctggacctggaggagcgggccaccgtgaccccaggagtggagcccggctgtgccggccactgcagcacctacggccacctgtgcagaaatggaggccgctgccgggagaagagaagaggagtgacctgtgactgtgccttcagcgcctatgatggccccttctgcagcaatgagatcagcgcctactttgccaccggcagctccatgacctaccacttccaggagcactacaccctgtctgagaacagcagcagcctggtgagcagcctgcacagagatgtgaccctgacccgggagatgatcaccctgtccttccgcaccaccaggacccccagcctgctgctgtatgtgagcagcttctatgaggagtacctgagcgtcatcctggccaacaacggcagcctgcagatccgctacaagctggacagacaccagaacccagatgccttcacctttgacttcaagaacatggctgatggccagctgcaccaggtgaagatcaaccgggaggaggccgtggtgatggtggaggtgaaccagagcaccaagaagcaggtgatcctgagcagcggcacagagttcaatgctgtgaagagcctcatcctgggcaaggtgctggaggccgccggggctgaccctgacaccaggagagctgccaccagcggcttcaccggctgcctgtctgctgtgcgcttcggccgggccgcccccctgaaggccgccctgcggcccagcggccccagccgggtgacagtgcggggccacgtggcccccatggcccgctgtgccgccggggccgccagcggcagccctgcccgggagctggccccccggctggccggcggggccggccgcagcggccctgcagatgaaggagagcccctggtgaatgctgacagaagagacagcgctgtgattggaggagtgattgctgtggtgatcttcatcctgctgtgcatcacagccatcgccatccgcatctaccagcagaggaagctgaggaaagaaaatgaaagcaaggtgtccaagaaggaggagtgctag

SEQ ID NO: 7039 - DNA, 369 bp, Artificial Sequence
  Description of Artificial Sequence: Synthetic coding sequence
atggtgcccggccccccagagagcgtggtgcgcttcttcctgtggttctgcttcctgctgccccccaccaggaaggccagctgtgacccccgggacctgaagagctgcaaccggccctgtgtgtggagccggctgctgaagcccaacagcagcctgagcaacctggagacagcctacttcccccagatcctgcgcttcctgcggccctggtacttcagccgcagccacctgaactaccaccagaaggccccagcccgctgggagtggctgtacagcatctacaggaagggcaccaaggcccagaggagaaatgtgctgcggagcccctgtgccccaccccagcccagctggccctgcagcgtcatctag

SEQ ID NO: 7040 - DNA, 1887 bp, Artificial Sequence
  Description of Artificial Sequence: Synthetic coding sequence
atggcccccagcgctgaccccggcatgagcaggatgctgcccttcctgctgctgctgtggttcctgcccatcacagagggcagccagagagctgagcccatgttcaccgctgtgaccaacagcgtgctgcccccagactatgacagcaaccccacccagctgaactacggcgtggccgtgacagatgtggaccatgatggagactttgaaattgtggtggccggctacaacggccccaacctggtgctgaagtatgaccgggcccagaagaggctggtgaacattgctgtggatgagaggagcagcccctactatgccctgcgggaccggcagggcaatgccatcggcgtgacagcctgtgacattgatggagatggccgggaggagatctacttcctgaacaccaacaatgccttcagcggcgtggccacctacacagacaagctgttcaagttcaggaacaaccgctgggaggacatcctgagtgatgaggtgaatgtggcccggggcgtggccagcctgtttgctggccgctctgtggcctgtgtggacaggaagggcagcggccgctacagcatctacatcgccaactatgcctatggaaatgtgggcccagatgccctgattgagatggaccctgaggccagtgacctgagccggggcatcctggccctgagagatgtggccgctgaggccggcgtgtccaagtacacaggaggccggggcgtgtctgtgggccccatcctgagcagcagcgccagtgacatcttctgtgacaatgaaaatggccccaacttcctgttccacaacagaggagatggcacctttgtggatgctgctgccagcgctggggtggatgacccccaccagcacggccggggcgtggccctggccgacttcaacagagatggcaaggtggacatcgtgtatggcaactggaatggcccccaccggctgtacctgcagatgagcacccacggcaaggtgcgcttccgggacatcgccagccccaagttctccatgcccagccctgtgaggacagtcatcacagctgactttgacaatgaccaggagctggagatcttcttcaacaacatcgcctaccgcagcagcagcgccaacagactcttccgggtcatcagaagagagcacggggaccccctgattgaggagctgaaccctggagatgccctggagcctgagggccggggcactggaggagtggtgacagactttgatggagatggcatgctggacctgatcctgagccacggggagagcatggcccagcccctgtctgtgttccggggcaaccagggcttcaacaacaactggctgcgggtggtgcccaggaccaggtttggagcctttgcccggggggccaaggtggtgctgtacaccaagaagagcggggcccacctgcgcatcattgatggcggcagcggctacctgtgtgagatggagcctgtggcccacttcggcctgggcaaggatgaggccagctctgtggaggtgacctggccagatggcaagatggtgtccagaaatgtggccagcggggagatgaacagcgtgctggagatcctgtaccccagagatgaggacaccctgcaggaccctgcccccctggagacccccatgaatgccagcagcagccacagctgtgccctggagaccagcccctacgtgtccacccccatggaggccaccggggccggccccaccaggtctgctgtgggcgccaccagccccaccaggatggcccagcctgcctggggcctgagcgccagccaccgggccccagcccctcctcctccacccctgctgctgcccctgcccctgctgctgcccctgctggagctgcccctgctgcacaggagcagctag

SEQ ID NO: 7041 - DNA, 1008 bp, Artificial Sequence
  Description of Artificial Sequence: Synthetic coding sequence
atgcagggccagggcagaagaagaggcacctgcaaggacatcttctgcagcaagatggccagctacctgtatggagtgctgtttgctgtgggcctgtgtgcccccatctactgtgtgtccccagccaatgcccccagcgcctacccccggcccagcagcaccaagagcaccccagccagccaggtgtacagcctgaacacagactttgccttccggctgtacagaaggctggtgctggagacccccagccagaacatcttcttcagccctgcccgcatcaacagccacgtgaagaagaagacccagggcaaggtggtggacatcatccagggcctggacctgctgacagccatggtgctggtgaaccacatcttcttcaaggccaagtgggagaagcccttccaccctgagtacaccaggaagaacttccccttcctggtgggggagcaggtgacagtgcacgtgcccatgatgcaccagaaggagcagtttgccttcggcgtggacacagagctgaactgctttgtgctgcagatggactacaagggagatgctgtggccttctttgtgctgcccagcaagggcaagatgaggcagctggagcaggccctgagcgcccggaccctgaggaagtggagccacagcctgcagaagcgctggattgaggtgttcatcccccgcttcagcatcagcgccagctacaacctggagaccatcctgcccaagatgggcatccagaatgtgtttgacaagaatgctgacttcagcggcatcgccaagagggacagcctgcaggtgtccaaggccacccacaaggctgtgctggatgtgtctgaggagggcacagaggccacagctgccaccaccaccaagttcatcgtgcgcagcaaggatggccccagctacttcaccgtgtccttcaacagaaccttcctgatgatgatcaccaacaaggccacagatggcatcctcttcctgggcaaggtggagaaccccaccaagagctag

SEQ ID NO: 7042 - DNA, 768 bp, Artificial Sequence
  Description of Artificial Sequence: Synthetic coding sequence
atggtgctgctgctggtgatcctgatccctgtgctggtgtcctctgctggcaccagcgcccactatgagatgctgggcacctgcaggatggtgtgtgacccctatggaggcaccaaggcccccagcacagctgccaccccagaccggggcctgatgcagagcctgcccaccttcatccagggccccaagggggaggccggccggcctgggaaggccggcccccggggccccccaggagagcccggccccccaggccccatgggccccccaggagagaagggggagcccggccggcagggcctgcccggccccccaggggcccctggcctgaatgctgctggggccatctctgctgccacctacagcacagtgcccaagatcgccttctacgccggcctgaagaggcagcacgagggctatgaggtgctgaagtttgatgatgtggtgaccaacctgggcaaccactatgaccccaccaccgggaagttcacctgcagcatccctggcatctacttcttcacctaccacgtgctgatgagaggaggagatggcacctccatgtgggccgacctgtgcaagaacaaccaggtgcgggccagcgccatcgcccaggatgctgaccagaactatgactatgccagcaacagcgtggtgctgcacctggagcctggagatgaggtgtacatcaagctggatggcggcaaggcccatggaggcaacaacaacaagtacagcaccttcagcggcttcatcatctatgctgactag

SEQ ID NO: 7043 - DNA, 1617 bp, Artificial Sequence
  Description of Artificial Sequence: Synthetic coding sequence
atgtccttcagcgccaccatcctcttcagccccccatctggcagcgaggcccgctgctgctgctgtgcctgcaagtctgagaccaatggaggcaacacaggcagccagggcggcaaccccccacccagcacccccatcaccgtgactggacatggcctggccgtgcagagcagcgagcagctgctgcacgtgatctaccagagggtggacaaggctgtgggcctggccgaggccgccctgggcctggcccgggccaacaatgagctgctgaagaggctgcaggaggaggtgggggacctgcggcagggcaaggtgtccatcccagatgaagatggagagagccgggcccacagcagccccccagaggagcccggccccctgaaggagagccctggagaggccttcaaggccctgtctgctgtggaggaggagtgtgacagcgtgggcagcggcgtgcaggtggtgattgaggagctgcggcagctgggcgccgcctctgtgggccctggccccctgggcttccctgccacccagagggacatgaggctgcccggctgcaccctggccgccagcgaggccgcccccctgctgaaccccctggtggatgattatgtggccagcgagggcgctgtgcagagggtgctggtgcctgcctatgccaagcagctgagccctgccacccagctggccatccagagggccaccccagagaccggcccagaaaatggcaccaagctgcccccacccaggcctgaggacatgctgaatgctgctgctgccctggacagcgccctggaggagagcggccctggcagcactggagagctgcggcacagcctgggcctgactgtgagcccctgcaggacccggggcagcggccagaagaacagcaggaggaagagggacctggtgctgagcaagctggtgcacaacgtgcacaaccacatcaccaatgacaagcgcttcaatggaagtgagagcatcaagagctcctggaacatctctgtggtgaagttcctgctggagaagctgaagcaggagctggtgaccagcccccacaactacacagacaaggagctgaagggggcctgtgtggcctacttcctgaccaagaggcgggagtacagaaacagcctgaaccccttcaagggcctgaaggagaaggaggagaagaagctgcggagccgccgctaccgcctgtttgccaacagaagcagcatcatgaggcactttggacctgaggaccagaggctgtggaatgatgtgacagaggagctgatgtctgatgaggaggacagcctgaatgaacctggggtgtgggtggcccggcccccacgcttccgggcccagaggctgacagagctgtgctaccacctggatgccaacagcaagcacggcaccaaggccaacagagtgtatggccccccaagtgaccggctgcccagcgctgaggcccagctgctgcccccagagctgtacaaccccaacttccaggaggaggaggatgagggcggagatgaaaatgcccctggcagccccagctttgaccagccccacaagacctgctgcccagacctgaacagcttcatcgagatcaaggtggagaaggatgaatag

SEQ ID NO: 7044 - DNA, 2853 bp, Artificial Sequence
  Description of Artificial Sequence: Synthetic coding sequence
atgctgctgctgggcatcctgaccctggcctttgctggccgcacagctgggggcagcgagcctgagcgggaggtggtggtgcccatccggctggaccctgacatcaatggccgccgctactactggaggggccctgaggacagcggggaccagggcctcatcttccagatcacagccttccaggaggacttctacctgcacctgaccccagatgcccagttcctggccccagccttcagcacagagcacctgggcgtgcccctgcagggcctgaccggcggcagcagtgacctgcggcgctgcttctacagcggagatgtgaatgctgagccagacagctttgctgctgtgtccctgtgtggcggcctgcggggggccttcggctacagaggagcagaatatgtgatcagccccctgcccaatgccagcgccccagctgcccagaggaacagccagggcgcccacctgctgcagaggagaggagtgcctgggggccccagcggggaccccaccagccgctgtggggtggccagcggctggaacccagccatcctgcgggccctggacccctacaagccccggcgggccggctttggagagagccgcagcagaagaagaagtggccgggccaagagatttgtgtccatccccaggtatgtggagaccctggtggtggctgatgagagcatggtgaagttccacggggctgacctggagcactacctgctgaccctgctggccacagctgcccggctgtaccgccaccccagcatcctgaaccccatcaacatcgtggtggtgaaggtgctgctgctgcgggaccgggacagcggccccaaggtgactggaaatgctgccctgaccctgaggaacttctgtgcctggcagaagaagctgaacaaggtgtctgacaagcaccctgagtactgggacacagccatcctcttcacccggcaggacctgtgtggggccaccacctgtgacaccctgggcatggctgatgtgggcaccatgtgtgaccccaagaggagctgcagcgtgattgaagatgatggcctgcccagcgccttcaccacagcccacgagctgggccacgtgttcaacatgcctcatgacaacgtgaaggtgtgtgaggaggtgtttgggaagctgcgggccaaccacatgatgagccccaccctcatccagattgaccgggccaacccctggagcgcctgcagcgctgccatcatcacagacttcctggacagcggccatggagactgcctgctggaccagcccagcaagcccatcagcctgcctgaggacctgcccggggccagctacaccctgagccagcagtgtgagctggccttcggcgtgggcagcaagccctgcccctacatgcagtactgcaccaagctgtggtgcaccgggaaggccaagggccagatggtgtgccagaccaggcacttcccctgggcagatggcaccagctgtggggagggcaagctgtgcctgaagggggcctgtgtggagcggcacaacctgaacaagcaccgggtggatggctcctgggccaagtgggacccctacggcccctgcagcaggacctgtggcggcggcgtgcagctggcccggcggcagtgcaccaaccccaccccagccaacggcggcaagtactgtgaaggagtgcgggtgaagtaccgcagctgcaacctggagccctgccccagcagcgccagcggcaagagcttccgggaggagcagtgtgaggccttcaacggctacaaccacagcaccaaccggctgaccctggccgtggcctgggtgcccaagtacagcggcgtgagcccccgggacaagtgcaagctgatctgccgggccaatggaacaggctacttctacgtgctggcccccaaggtggtggatggcaccctgtgcagcccagacagcacctctgtgtgtgtgcagggcaagtgcatcaaggccggctgtgatggcaacctgggcagcaagaagagatttgataaatgtggggtgtgtggcggggacaacaagagctgcaagaaggtgacaggcctcttcaccaagcccatgcacggctacaactttgtggtggccatcccagctggggccagcagcattgacatccggcagaggggctacaagggcctgattggagatgacaactacctggccctgaagaacagccagggcaagtacctgctgaatggccactttgtggtgtctgctgtggagcgggacctggtggtgaagggcagcctgctgcgctacagcggcaccggcacagctgtggagagcctgcaggccagccggcccatcctggagcccctgactgtggaggtgctgtctgtgggcaagatgaccccaccccgggtgcgctacagcttctacctgcccaaggagccccgggaggacaagagcagccaccccaaggacccccggggccccagcgtgctgcacaacagcgtgctgagcctgagcaaccaggtggagcagccagatgaccggcccccagcccgctgggtggccggctcctggggcccctgcagcgccagctgtggcagcggcctgcagaagagagctgtggactgccggggcagcgctggccagaggacagtgcctgcctgtgatgctgcccacaggcctgtggagacccaggcctgtggggagccctgccccacctgggagctgagcgcctggagcccctgcagcaagagctgtggccggggcttccagaggaggagcctgaagtgtgtgggccatggaggccgcctgctggcccgggaccagtgcaacctgcacaggaagccccaggagctggacttctgtgtgctgcggccctgctag

SEQ ID NO: 7045 - DNA, 1521 bp, Artificial Sequence
  Description of Artificial Sequence: Synthetic coding sequence
atgaccagcaagccccacagcgactggatcccctacagcgtgctggatgatgagggcaggaacctgcggcagcagaagctggaccggcagagggccctgctggagcagaagcagaagaagaagaggcaggagcccctgatggtgcaggccaatgctgatggccggcccaggagcagaagagcccggcagagcgaggagcaggcccccctggtggagagctacctgagcagcagcggcagcaccagctaccaggtgcaggaggccgacagcctggcctctgtgcagctgggcgccacccggcccacagccccagccagcgccaagaggaccaaggctgctgccacagctgggggccagggcggggccgccaggaaggagaagaagggcaagcacaagggcaccagcggccctgctgccctggccgaggacaagtctgaggcccagggccctgtgcagatcctgactgtgggccagagcgaccacgcccaggatgctggggagacagctgctgggggcggggagcggcccagcggccaggacctgcgggccaccatgcagaggaagggcatcagcagctccatgagctttgatgaagatgaagaagatgaggaggagaacagcagcagcagcagccagctgaacagcaacacccggcccagcagcgccaccagcaggaagtctgtgcgggaggccgccagcgcccccagccccacagcccctgagcagcctgtggatgtggaggtgcaggacctggaggagtttgccctgcggcctgccccccagggcatcaccatcaagtgccgcatcacccgggacaagaagggcatggaccggggcatgtaccccacctacttcctgcacctggacagagaagatggcaagaaggtgttcctgctggccggcaggaagaggaagaagagcaagaccagcaactacctgatctctgtggaccccacagacctgagccggggcggggacagctacatcggcaagctgcggagcaacctgatgggcaccaagttcaccgtgtatgacaacggggtgaacccccagaaggccagcagcagcaccctggagagcggcaccctgcggcaggagctggccgctgtgtgctatgagaccaacgtgctgggcttcaagggccccaggaagatgtctgtcatcgtgcccggcatgaacatggtgcatgagcgggtgtccatccggcccagaaatgaacatgagaccctgctggcccgctggcagaacaagaacacagagagcatcatcgagctgcagaacaagacccctgtgtggaatgatgacacccagagctatgtgctgaacttccacggccgggtgacccaggcctctgtgaagaacttccagatcatccatggaaatgaccctgactacatcgtgatgcagtttggccgggtggctgaagatgtgttcaccatggactacaactaccccctgtgtgccctgcaggcctttgccatcgccctgagcagctttgacagcaagctggcctgtgagtag

SEQ ID NO: 7046 - DNA, 594 bp, Artificial Sequence
  Description of Artificial Sequence: Synthetic coding sequence
atggccaagaatggcctggtgatctgcatcctggtgatcaccctgctgctggaccagaccaccagccacaccagccggctgaaggccaggaagcacagcaagagaagagtgcgggacaaggatggagacctgaagacccagatcgagaagctgtggacagaggtgaatgccctgaaggagatccaggccctgcagacagtgtgcctgcggggcaccaaggtgcacaagaagtgctacctggccagcgagggcctgaagcacttccacgaggccaatgaagactgcatcagcaagggcggcatcctggtgatccccaggaacagtgatgagatcaatgccctgcaggactatggcaagaggagcctgcccggggtgaatgacttctggctgggcatcaatgacatggtgacagagggcaagtttgtggatgtgaatggaattgccatctccttcctgaactgggaccgggcccagcccaacggcggcaagcgggagaactgtgtgctcttcagccagagcgcccagggcaagtggagcgatgaggcctgccgcagcagcaagcgctacatctgtgagttcaccatcccccagtag

SEQ ID NO: 7047 - DNA, 2424 bp, Artificial Sequence
  Description of Artificial Sequence: Synthetic coding sequence
aagaagaagaggaagatcagcctgctgcccaagccacccaagcatgatgcccccctgaccatcgagttccccaacctggacaagaccagcgctgagtggctgaaggtgaatggcctgaaggccaagaagctgagcctgtaccaggtgctggccccaaatgccttcagccctgtggaggagtttgtgcccatcctgcagaagacagtgagcagcaccatccacgagaaggccatgatccagtttgagtggcatgatggcaccgtgaagaacatccacgtggacccccccttcctgtacaagtaccagcagcagctgagccgggccatgaggatgtatgaaagacgcatcgagtggctgagcctggccagccgccgcatctggggcaccgtgtgtgagaagagggtggtggtgctgctggacatcagcgccaccaacagcatgtacatcatccacatccagcacagcctgcggctgctgctggaggagcagctgagcaacaaggactgcttcaacctgattgccttcggcagcaccattgaatcctggaggcctgagatggtgcctgtgagccacaacaacctgcagagcgcctggcgctgggccctgaacctgcgctgccggggcagcagaaatgtgctgagcgccctgaggaaggctgtggaggtggacttcaaggacaaggacaagcaccagagccagggcatctacctgttcaccggcggcatcccagaccaggacatgcccaccctgagcgcctacatggccgaggcctgtggcggctgtgacctgcagctgaatgtgtgcctcttctacgtgggggagcccaagatggacaccaccccaccagcccgctatgccagccacacagacacagctgctgcctacaaggaggtgaccagggctgctgggggccgcttccactggtttggagacaccggcatctatgaaagtgatgacatcaacagcatcatgtctgagatggagaaggccctgaactacagccagaagtgtgccttcctgatggccagcctgaagaaccacagcggcaaggtgctgggcagcagcgccctgcccaaggagaagcccaagaccctgcagctgcggagccagcccaagaagctgtgccccccccggcccaccgtgcccctgggcgccaggatgagcatcaaggatgatcctgaccgggagaagagcccccccctgaagagcctgaagtggaggcccctgagcagccgggtgggcatcagccctgctgctgcccagcccaccaaggagggcatgatggagctgcggaggaagaccaagagccgggaggccgagaccagcctgctgctcttctacacagagaagggaaatgatgtgggctctgtgtacaagaagtacccccagggccggggcctgcggaggaccagcagcagcattgacctgcccaggaaggacacagtgtgcagcagccaggagtgggtggccaagtatggcctgaagaagctgaagctggagatcagccgctgcatgggccccaactgcacccaccagaagagcggccagaggtctgccagcgccaagcactgcagcatcttccccagcgtggagatccatggagtggtgcgccacatccagtggaccccccgggagatggaggtgtacatccgccacctggagaaggtgctgcggcgctacgtgcagaggctgcagtggctgctgagcggcagccggcggctgtttggaacagtgctggagagcaaggtgtgcatcctgctggacaccagcggctccatgggcccctacctgcagcaggtgaagacagagctggtgctgctgatctgggagcagctgaggaagtgctgtgacagcttcaacctgctgagctttgctgagagcttccagagctggcaggacaccctggtggagaccacagatgctgcctgccacgaggccatgcagtgggtgacccacctgcaggcccagggcagcaccagcatcctgcaggccctgctgaaggccttctccttccatgacctggagggcctgtacctgctgacagatggcaagccagacaccagctgcagcctggtgctgaatgaggtgcagaagctgcgggagaagagagatgtgaaggtgcacaccatcagcctgaactgcagcgacagagctgctgtggagttcctgaggaagctggccagcttcaccggcggccgctaccactgccctgtgggggaggacaccctgagcaagatccacagcctgctgaccaagggcttcatcaatgagaaggaccccaccctgcccccatttgaaggagatgacctgcgcatcctggcccaggagatcaccaaggcccggagcttcctgtggcaggcccagagcttccgcagccagctgcagaagaagaatgatgctgagcccaaggtgaccctgtcctag

SEQ ID NO: 7048 - DNA, 639 bp, Artificial Sequence
  Description of Artificial Sequence: Synthetic coding sequence
atggtgtccaggatggtgtccaccatgctgagcggcctgctcttctggctggccagcggctggaccccagcctttgcctacagccccaggaccccagacagagtgtctgaggccgacatccagaggctgctgcatggagtgatggagcagctgggcatcgcccggccccgggtggagtacccagcccaccaggccatgaacctggtgggcccccagagcattgagggcggggcccacgagggcctgcagcacctgggccccttcggcaacatccccaacatcgtggccgagctgactggagacaacatccccaaggacttcagcgaggaccagggctacccagacccccccaacccctgccctgtgggcaagacagcagatgatggctgcctggagaacaccccagacacagctgagttcagccgggagttccagctgcaccagcacctgtttgatcctgagcatgactacccaggcctgggcaagtggaacaagaagctgctgtatgagaagatgaagggcggggagaggaggaagagaagatctgtgaacccctacctgcagggccagaggctggacaacgtggtggccaagaagtctgtgccccacttcagtgatgaggacaaggaccctgagtag

SEQ ID NO: 7049 - DNA, 1524 bp, Artificial Sequence
  Description of Artificial Sequence: Synthetic coding sequence
atgtgcaccaagaccatccctgtgctgtggggctgcttcctgctgtggaacctgtatgtgagcagcagccagaccatctacccaggcatcaaggcccgcatcacccagagggccctggactatggagtgcaggccggcatgaagatgattgagcagatgctgaaggagaagaagctgcctgacctgagcggcagcgagagcctggagttcctgaaggtggactatgtgaactacaacttcagcaacatcaagatcagcgccttctccttccccaacaccagcctggcctttgtgcctggggtgggcatcaaggccctgaccaaccacggcacagccaacatcagcacagactggggctttgagagccccctcttccaggacaccggcggcgctgacctcttcctgagcggcgtgtacttcaccggcatcatcatcctgaccagaaatgactttggccaccccaccctgaagctgcaggactgctacgcccagctgagccacgcccacgtgtccttctctggagagctgtctgtgctgtacaacagctttgctgagcccatggagaagcccatcctgaagaacctgaatgagatgctgtgccccatcatcgccagcgaggtgaaggccctgaatgccaacctgagcaccctggaggtgctgaccaagattgacaactacaccctgctggactacagcctcatcagcagccctgagatcacagagaactacctggacctgaacctgaagggcgtcttctaccccctggagaacctgacagatcctcccttcagccctgtgccctttgtgctgcctgagaggagcaacagcatgctgtacatcggcattgctgagtacttcttcaagagcgccagctttgcccacttcaccgctggggtcttcaacgtgaccctgagcacagaggagatcagcaaccactttgtgcagaacagccagggcctgggcaatgtgctgagcagaattgctgagatctacatcctgagccagcccttcatggtgcgcatcatggccacagagccccccatcatcaacctgcagcccggcaacttcaccctggacatcccagccagcatcatgatgctgacccagcccaagaacagcacagtggagaccatcgtgtccatggactttgtggccagcacctctgtgggcctggtgatcctgggccagaggctggtgtgcagcctgagcctgaaccgcttccggctggccctgcctgagagcaacagaagcaacatcgaggtgctgcgctttgagaacatcctgagcagcatcctgcactttggagtgctgcccctggccaatgccaagctgcagcagggcttccccctgagcaacccccacaagttcctgtttgtgaacagcgacatcgaggtgctggagggcttcctgctgatcagcacagacctgaagtatgagaccagcagcaagcagcagcccagcttccacgtgtgggagggcctgaacctgatcagccggcagtggaggggcaagagcgccccctag

SEQ ID NO: 7050 - DNA, 474 bp, Artificial Sequence
  Description of Artificial Sequence: Synthetic coding sequence
atgcacccctggctgggcagcgccctgggcttccccaagtgccggggcatccacctgtgtgcctgtggaaatggctggaccccaggagagaccctgagccagaacaagacagagatcaccaagaacaaggtgacctgctggaggccccacggctgtgagcccaacacaggcctgggctaccagggcagccacaccagcaagtacaccctgctgccctggaacctgctgaagaccaagcccctgccccccagccacggcaaggagggcggcaaggaggccaaggtgcccagcggggacaacagcggccgcggggaggtgccccgggcccaggagggccaggccgcctgtggccgggccgccagcggggacagccaggagggcatgagaagaggctatgaggagcgggccacagcccagaggcctgctgtgcgctctgctgagaccacagcccacggcacctggatctacccctag

SEQ ID NO: 7051 - DNA, 213 bp, Artificial Sequence
  Description of Artificial Sequence: Synthetic coding sequence
atgagcaacaacatggccaagattgctgaggccaggaagacagtggagcagctgaagctggaggtgaacatcgacaggatgaaggtgtcccaggccgctgctgagctgctggccttctgtgagacccacgccaaggatgaccccctggtgacccctgtgcctgctgctgagaaccccttccgggacaagaggctcttctgtgtgctgctgtag

SEQ ID NO: 7052 - DNA, 645 bp, Artificial Sequence
  Description of Artificial Sequence: Synthetic coding sequence
atggccctgctgctgtgcctggtgtgcctgacagctgccctggcccacggctgcctgcactgccacagcaacttcagcaagaagttctccttctaccgccaccacgtgaacttcaagtcctggtgggtgggggacatccctgtgtctggggccctgctgacagactggagcgatgacaccatgaaggagctgcacctggccatcccagccaagatcacccgggagaagctggaccaggtggccacagctgtgtaccagatgatggaccagctgtaccagggcaagatgtacttccctggctacttccccaatgagctgaggaacatcttccgggagcaggtgcacctgatccagaatgccatcatcgagagcagaattgactgccagcaccgctgtggcatcttccagtatgagaccatcagctgcaacaactgcacagacagccacgtggcctgcttcggctacaactgtgagagcagcgcccagtggaagtctgctgtgcagggcctgctgaactacatcaacaactggcacaagcaggacacctccatgagcctggtgtccccagccctgcgctgcctggagcccccccacctggccaacctgaccctggaggatgctgctgaatgtctgaagcagcactag

SEQ ID NO: 7053 - DNA, 459 bp, Artificial Sequence
  Description of Artificial Sequence: Synthetic coding sequence
atgagcccccacctgacagccctgctgggcctggtgctgtgcctggcccagaccatccacacccaggagggcgccctgccccggcccagcatctctgctgagcccggcaccgtcatcagccctggcagccacgtgaccttcatgtgccggggccctgtgggcgtgcagaccttccggctggagagagaagatcgggccaagtacaaggacagctacaacgtgttccggctgggccccagcgagagcgaggcccgcttccacatcgacagcgtgtctgagggcaatgccggcctgtaccgctgcctgtactacaagcccccaggctggagcgagcacagcgacttcctggagctgctggtgaaggagagcagcggcggccctgacagcccagacacagagcccggcagcagcgctggcaccgtgcccggcacagaggccagcggctttgatgccccctag

SEQ ID NO: 7054 - DNA, 900 bp, Artificial Sequence
  Description of Artificial Sequence: Synthetic coding sequence
atggccccctggagccaccccagcgcccagctgcagcctgtgggcggagatgctgtgtccccagccctgatggtgctgctgtgcctgggcctgagcctgggccccaggacccacgtgcaggccggcaacctgagcaaggccaccctgtgggccgagcccggcagcgtcatcagccggggcaacagcgtgaccatccgctgccagggcaccctggaggcccaggagtaccgcctggtgaaggagggcagccctgagccctgggacacccagaaccccctggagcccaagaacaaggcccgcttcagcatccccagcatgacagagcaccacgccggccgctaccgctgctactactacagccctgctggctggagcgagcccagcgaccccctggagctggtggtgacaggcttctacaacaagcccaccctgagcgccctgcccagccctgtggtgaccagcggggagaatgtgaccctgcagtgtggcagccggctgcgctttgaccgcttcatcctgacagaggagggggaccacaagctgtcctggaccctggacagccagctgacccccagcggccagttccaggccctcttccctgtgggccctgtgacccccagccaccgctggatgctgcgctgctacggcagccgccgccacatcctgcaggtgtggagcgagcccagcgacctgctggagatccctgtgtctggagctgctgacaacctgagccccagccagaacaagagtgacagcggcacagccagccacctgcaggactatgctgtggagaacctgatccgcatgggcatggccggcctcatcctggtggtgctgggcatcctgatcttccaggactggcacagccagaggagcccccaggccgctgctggaagatag

SEQ ID NO: 7055 - DNA, 618 bp, Artificial Sequence
  Description of Artificial Sequence: Synthetic coding sequence
atgaaggtgctgctgctgaccggcctgggcgccctcttctttgcctactactgggatgacaactttgaccccggcggcctggactacctggtgctgaaccacatcggcggggccccagctggcacccgggcccggagcccccaggccacccgctggctgatgcaggtgaactttgtgtcctatgtgcagctgaccagccgggccctgcccagcctgacagacagcaagggcagcctggtggtggtgagcagcctgctgggccgggtgcccaccagcttcagcaccccctacagcgctgccaagtttgccctggatggcttcttcggcagcctgcggcgggagctggatgtgcaggatgtgaatgtggccatcaccatgtgtgtgctgggcctgcgggaccgggccagcgctgctgaggccgtgcggggcgtgaccagggtgaaggccgcccctggccccaaggccgccctggccgtcatccggggcggggccaccagggctgctggggtcttctacccctggaggttccggctgctgtgcctgctgcggcgctggctgccccggccccgggcctggttcatccggcaggagctgaatgtgacagctgctgctgcctag

SEQ ID NO: 7056 - DNA, 795 bp, Artificial Sequence
  Description of Artificial Sequence: Synthetic coding sequence
atgctgcgctgtggcggccggggcctgctgctgggcctggccgtggccgctgctgctgtgatggccgcccggctgatgggctggtggggccccagggctggcttccgcctcttcatccctgaggagctgagccgctaccggggcggccctggggaccccggcctgtacctggccctgctgggccgggtgtatgatgtgagcagcggccgccgccactatgagcccggcagccactacagcggctttgctggaagagatgccagccgggcctttgtgactggagactgcagcgaggccggcctggtggatgatgtgtctgacctgtctgctgctgagatgctgaccctgcacaactggctgtccttctatgagaagaactacgtgtgtgtgggccgggtgacaggccgcttctacggggaggatggcctgcccaccccagccctgacccaggtggaggccgccatcacccggggcctggaggccaacaagctgcagctgcaggagaagcagaccttccccccctgcaatgctgagtggagcagcgcccggggcagccggctgtggtgcagccagaagtctggaggagtgtcccgggactggattggagtgcccaggaagctgtacaagccaggggccaaggagccccgctgtgtgtgtgtgaggaccactggacctccttctggccagatgccagacaaccccccccacaggaacagaggagacctggaccaccccaacctggccgagtacacaggctgcccccccctggccatcacctgcagcttccccctgtag

SEQ ID NO: 7057 - DNA, 468 bp, Artificial Sequence
  Description of Artificial Sequence: Synthetic coding sequence
atgagcaagaggctgctgctgctgctgctgctgtccatgggcggcacctgggccagcaaggagcccctgcggccccgctgccggcccatcaatgccaccctggccgtggagaaggagggctgccctgtgtgcatcaccgtgaacaccaccatctgtgccggctactgccccaccatgaccagggtgctgcagggcgtgctgcctgccctgccccaggtggtgtgcaactacagagatgtgcgctttgagagcatccggctgcccggctgcccccggggcgtgaaccctgtggtgtcctatgctgtggccctgagctgccagtgtgccctgtgccgccgcagcaccacagactgtggcggccccaaggaccaccccctgacctgtgatgacccccgcttccaggacagcagcagcagcaaggcccccccacccagcctgcccagccccagccggctgcccggcccctag

SEQ ID NO: 7058 - DNA, 498 bp, Artificial Sequence
  Description of Artificial Sequence: Synthetic coding sequence
atggagatgttccagggcctgctgctgctgctgctgctgtccatgggcggcacctgggccagcaaggagcccctgcggccccgctgccggcccatcaatgccaccctggccgtggagaaggagggctgccctgtgtgcatcaccgtgaacaccaccatctgtgccggctactgccccaccatgaccagggtgctgcagggcgtgctgcctgccctgccccaggtggtgtgcaactacagagatgtgcgctttgagagcatccggctgcccggctgcccccggggcgtgaaccctgtggtgtcctatgctgtggccctgagctgccagtgtgccctgtgccgccgcagcaccacagactgtggcggccccaaggaccaccccctgacctgtgatgacccccgcttccaggacagcagcagcagcaaggcccccccacccagcctgcccagccccagccggctgcccggccccagcgacacccccatcctgccccagtag

SEQ ID NO: 7059 - DNA, 990 bp, Artificial Sequence
  Description of Artificial Sequence: Synthetic coding sequence
atgctgcccctgctgctgggcctgctgggccctgctgcctgctgggccctgggccccaccccaggccctggcagcagcgagctgcggagcgccttctctgctgcccggaccacccccctggagggcaccagcgagatggctgtgacctttgacaaggtgtatgtgaacattggaggagactttgatgtggccaccggccagttccgctgccgggtgcctggggcctacttcttctccttcaccgctgggaaggccccccacaagagcctgtctgtgatgctggtgaggaacagagatgaggtgcaggccctggcctttgatgagcagaggaggcctggggccaggagagctgccagccagagcgccatgctgcagctggactatggagacacagtgtggctgcggctgcatggagccccccagtatgccctgggcgcccctggggccaccttcagcggctacctggtgtatgcagatgctgatgctgatgccccagcccggggccccccagcccctcctgagcccaggtctgccttctctgctgcccggaccaggagcctggtgggcagtgatgctggccctggccccaggcaccagcccctggcctttgacacagaatttgtgaacatcggcggggactttgatgctgctgctggggtcttccgctgccgcctgcccggggcctacttcttctccttcaccctgggcaagctgcccaggaagaccctgtctgtgaagctgatgaagaacagagatgaggtgcaggccatgatctatgatgatggagccagcagaagaagagagatgcagagccagagcgtgatgctggccctgcggagaggagatgctgtgtggctgctgagccatgaccatgatggctacggggcctacagcaaccacggcaagtacatcaccttcagcggcttcctggtgtacccagacctggccccagctgcccctcctggcctgggcgccagcgagctgctgtag

SEQ ID NO: 7060 - DNA, 873 bp, Artificial Sequence
  Description of Artificial Sequence: Synthetic coding sequence
atgaggaggcctgctgctgtgcccctgctgctgctgctgtgcttcggcagccagagggccaaggccgccacagcctgtggccggcccaggatgctgaacaggatggtgggcggccaggacacccaggagggggagtggccctggcaggtgtccatccagagaaatggcagccacttctgtggcggcagcctgattgctgagcagtgggtgctgacagctgcccactgcttcaggaacaccagcgagaccagcctgtaccaggtgctgctgggcgcccggcagctggtgcagcccggcccccacgccatgtatgcccgggtgcggcaggtggagagcaaccccctgtaccagggcacagccagcagcgcagatgtggccctggtggagctggaggcccctgtgcccttcaccaactacatcctgcctgtgtgcctgcctgaccccagcgtcatctttgagaccggcatgaactgctgggtgacaggctggggcagccccagcgaggaggacctgctgcctgagccccgcatcctgcagaagctggccgtgcccatcatcgacacccccaagtgcaacctgctgtacagcaaggacacagaatttggctaccagcccaagaccatcaagaatgacatgctgtgtgccggctttgaggagggcaagaaggatgcctgcaagggggacagcggcggccccctggtgtgcctggtgggccagagctggctgcaggccggggtcatctcctggggcgagggctgtgcccggcagaacagacctggggtgtacatccgggtgacagcccaccacaactggatccaccgcatcatccccaagctgcagttccagcctgcccggctgggcggccagaagtag

SEQ ID NO: 7061 - DNA, 792 bp, Artificial Sequence
  Description of Artificial Sequence: Synthetic coding sequence
atggccttcctgtggctgctgagctgctgggccctgctgggcaccaccttcggctgcggcgtgcctgccatccaccctgtgctgagcggcctgagccgcatcgtgaatggagaagatgctgtgcccggctcctggccctggcaggtgtccctgcaggacaagacaggcttccacttctgtggcggcagcctcatcagcgaggactgggtggtgacagctgcccactgcggcgtgaggaccagtgatgtggtggtggccggggagtttgaccagggcagtgatgaggagaacatccaggtgctgaagatcgccaaggtgttcaagaaccccaagttcagcatcctgactgtgaacaatgacatcaccctgctgaagctggccaccccagcccgcttcagccagacagtgtctgctgtgtgcctgcccagcgcagatgatgacttccctgctggcaccctgtgtgccaccaccggctggggcaagaccaagtacaatgccaacaagaccccagacaagctgcagcaggccgccctgcccctgctgagcaatgctgagtgcaagaagtcctggggccgccgcatcacagatgtgatgatctgtgccggggccagcggcgtgagcagctgcatgggagacagcggcggccccctggtgtgccagaaggatggagcctggaccctggtgggcatcgtgtcctggggcagcaggacctgcagcaccaccaccccagctgtgtatgcccgggtggccaagctgatcccctgggtgcagaagatcctggccgccaactag

SEQ ID NO: 7062 - DNA, 228 bp, Artificial Sequence
  Description of Artificial Sequence: Synthetic coding sequence
atgggcgccgccatcagccagggcgccctgattgccatcgtgtgcaatggcctggtgggcttcctgctgctgctgctgtgggtgatcctgtgctgggcctgccacagccgctctgcagatgtggacagcctgtctgagagcaggacccaggagagcgcctgcctggagctggaccctgctgcccagagcctggccagcctggcccccatcggggcccagtggccctag

SEQ ID NO: 7063 - DNA, 762 bp, Artificial Sequence
  Description of Artificial Sequence: Synthetic coding sequence
atggcccggagcctgctgctgcccctgcagatcctgctgctgagcctggccctggagacagctggggaggaggcccagggcgacaagatcattgatggagccccctgtgcccggggcagccacccctggcaggtggccctgctgagcggcaaccagctgcactgcggcggcgtgctggtgaatgaacgctgggtgctgacagctgcccactgcaagatgaatgagtacacagtgcacctgggcagtgacaccctgggggaccggcgggcccagaggatcaaggccagcaagagcttccgccaccctggctacagcacccagacccacgtgaatgacctgatgctggtgaagctgaacagccaggcccggctgagctccatggtgaagaaggtgcggctgcccagccgctgtgagcccccaggcaccacctgcaccgtgtctggctggggcaccaccaccagcccagatgtgaccttccccagcgacctgatgtgtgtggatgtgaagctgatcagcccccaggactgcaccaaggtgtacaaggacctgctggagaacagcatgctgtgtgccggcatcccagacagcaagaagaatgcctgcaatggagacagcggcggccccctggtgtgccggggcaccctgcagggcctggtgtcctggggcaccttcccctgtggccagcccaatgaccccggggtgtacacccaggtgtgcaagttcaccaagtggatcaatgacaccatgaagaagcacaggtag

SEQ ID NO: 7064 - DNA, 480 bp, Artificial Sequence
  Description of Artificial Sequence: Synthetic coding sequence
atgaaggcctggggcaccgtggtggtgaccctggccaccctgatggtggtgacagtggatgccaagatctatgaaagatgtgagctggccgcccggctggagcgggccggcctgaatggctacaagggctacggcgtgggggactggctgtgcatggcccactatgaaagtggctttgacacagcctttgtggaccacaacccagatggcagcagtgaatatggcatcttccagctgaacagcgcctggtggtgtgacaatggcatcacccccaccaagaacctgtgccacatggactgccacgacctgctgaacagacacatcctggatgacatccgctgtgccaagcagatcgtgagcagccagaatggcctgagcgcctggacctcctggaggctgcactgcagcggccatgacctgtctgagtggctgaagggctgtgacatgcacgtgaagattgaccccaagatccacccctag

SEQ ID NO: 7065 - DNA, 501 bp, Artificial Sequence
  Description of Artificial Sequence: Synthetic coding sequence
atggcccagaccaacagcttcttcatgctgatcagcagcctgatgttcctgagcctgagccagggccaggagagccagacagagctgcccaacccccgcatcagctgcccagagggcaccaatgcctaccgcagctactgctactacttcaatgaagatcctgagacctgggtggatgctgacctgtactgccagaacatgaacagcggcaacctggtgtctgtgctgacccaggccgagggcgcctttgtggccagcctcatcaaggagagcagcacagatgacagcaatgtgtggattggcctgcatgaccccaagaagaacagacgctggcactggagcagcggcagcctggtgtcctacaagtcctgggacaccggcagccccagcagcgccaatgccggctactgtgccagcctgaccagctgcagcggcttcaagaagtggaaggatgagagctgtgagaagaagttctcctttgtgtgcaagttcaagaactag

SEQ ID NO: 7066 - DNA, 528 bp, Artificial Sequence
  Description of Artificial Sequence: Synthetic coding sequence
atgctgccccccatggccctgcccagcgtgtcctggatgctgctgagctgcctgatgctgctgagccaggtgcagggcgaggagccccagcgggagctgcccagcgcccgcatccgctgccccaagggcagcaaggcctacggcagccactgctacgccctcttcctgagccccaagtcctggacagatgctgacctggcctgccagaagaggccttctggcaacctggtgtctgtgctgtctggagctgagggcagctttgtgagcagcctggtgaagagcatcggcaacagctacagctatgtgtggattggcctgcatgaccccacccagggcacagagcccaacggggagggctgggagtggagcagcagtgatgtgatgaactactttgcctgggagaggaaccccagcaccatcagcagccctggccactgtgccagcctgagccgcagcacagccttcctgcgctggaaggactacaactgcaatgtgcggctgccctacgtgtgcaagttcacagactag

SEQ ID NO: 7067 - DNA, 1686 bp, Artificial Sequence
  Description of Artificial Sequence: Synthetic coding sequence
atgggcgcccggacccccctgcccagcttctgggtgtccttctttgctgagaccggcatcctcttccctgggggcaccccctggcccatgggcagccagcacagcaagcagcacaggaagccaggccccctgaagaggggccacagaagagacaggaggaccaccaggaggaagtactggaaggagggccgggagatcgcccgggtgctggatgatgagggcaggaacctgcggcagcagaagctggaccggcagagggccctgctggagcagaagcagaagaagaagaggcaggagcccctgatggtgcaggccaatgctgatggccggcccaggagccggcgggcccggcagagcgaggagcaggcccccctggtggagagctacctgagcagcagcggcagcaccagctaccaggtgcaggaggccgacagcctggcctctgtgcagctgggcgccacccggcccacagccccagccagcgccaagaggaccaaggccgccgccacagctgggggccagggcggggccgccaggaaggagaagaagggcaagcacaagggcaccagcggccctgctgccctggccgaggacaagtctgaggcccagggccctgtgcagatcctgactgtgggccagagcgaccacgcccaggatgctggggagacagctgctgggggcggggagcggcccagcggccaggacctgcgggccaccatgcagaggaagggcatcagcagctccatgagctttgatgaagatgaggaggatgaggaggagaacagcagcagcagcagccagctgaacagcaacacccggcccagcagcgccaccagcaggaagtctgtgcgggaggccgccagcgcccccagccccacagcccctgagcagcctgtggatgtggaggtgcaggacctggaggagtttgccctgcggcctgccccccagggcatcaccatcaagtgccgcatcacccgggacaagaagggcatggaccggggcatgtaccccacctacttcctgcacctggaccgggaggatggcaagaaggtgttcctgctggccggcaggaagaggaagaagagcaagaccagcaactacctgatctctgtggaccccacagacctgagcagaggaggagacagctacatcggcaagctgcggagcaacctgatgggcaccaagttcaccgtgtatgacaatggagtgaacccccagaaggccagcagcagcaccctggagagcggcaccctgcggcaggagctggccgctgtgtgctatgagaccaacgtgctgggcttcaagggccccaggaagatgtctgtgattgtgcccggcatgaacatggtgcatgagcgggtgtccatccggcccagaaatgagcacgagaccctgctggcccgctggcagaacaagaacacagagagcatcatcgagctgcagaacaagacccctgtgtggaatgatgacacccagagctatgtgctgaacttccacggccgggtgacccaggcctctgtgaagaacttccagatcatccacggcaatgaccctgactacatcgtgatgcagtttggccgggtggccgaggatgtgttcaccatggactacaactaccccctgtgtgccctgcaggcctttgccatcgccctgagcagctttgacagcaagctggcctgtgagtag

SEQ ID NO: 7068 - DNA, 1272 bp, Artificial Sequence
  Description of Artificial Sequence: Synthetic coding sequence
atgatgtacagaccagatgtggtgcgggccaggaagagggtgtgctgggagccctgggtgattggcctggtgatcttcatcagcctcatcgtgctggccgtgtgcatcggcctgactgtgcactacgtgcgctacaaccagaagaagacctacaactactacagcaccctgtccttcaccacagacaagctgtatgcagagtttggccgggaggccagcaacaacttcacagagatgagccagaggctggagagcatggtgaagaatgccttctacaagagccccctgcgggaggagtttgtgaagagccaggtgatcaagttcagccagcagaagcatggagtgctggcccacatgctgctgatctgccgcttccacagcacagaagatcctgagaccgtggacaagatcgtgcagctggtgctgcacgagaagctgcaggatgctgtgggcccccccaaggtggacccccacagcgtgaagatcaagaagatcaacaagacagaaacagacagctacctgaaccactgctgcggcaccaggaggagcaagaccctgggccagagcctgcgcatcgtgggcggcacagaggtggaggagggggagtggccctggcaggccagcctgcagtgggatggcagccaccgctgtggggccaccctcatcaatgccacctggctggtgtctgctgcccactgcttcaccacctacaagaacccagcccgctggacagccagctttggagtgaccatcaagcccagcaagatgaagaggggcctgcggcgcatcatcgtgcatgagaagtacaagcaccccagccatgactatgacatcagcctggccgagctgagcagccctgtgccctacaccaatgctgtgcaccgggtgtgcctgcctgatgccagctatgagttccagcctggagatgtgatgtttgtgacaggctttggagccctgaagaatgatggctacagccagaaccacctgcggcaggcccaggtgaccctgattgatgccaccacctgcaatgagccccaggcctacaatgatgccatcacccccaggatgctgtgtgccggcagcctggagggcaagacagatgcctgccagggcgacagcggcggccccctggtgtccagtgatgcccgggacatctggtacctggccggcatcgtgtcctggggagatgaatgtgccaagcccaacaagccaggagtgtacaccagggtgacagccctgcgggactggatcaccagcaagacaggcatctag

SEQ ID NO: 7069 - DNA, 282 bp, Artificial Sequence
  Description of Artificial Sequence: Synthetic coding sequence
atgaagcctgtgctgcccctgcagttcctggtggtgttctgcctggccctgcagctggtgcccggcagccccaagcagagggtgctgaagtacatcctggagcccccaccctgcatcagcgcccctgagaactgcacccacctgtgcaccatgcaggaggactgtgagaagggcttccagtgctgcagcagcttctgtggcatcgtgtgcagcagcgagaccttccagaagaggaaccgcatcaagcacaagggcagcgaggtgatcatgcctgccaactag

SEQ ID NO: 7070 - DNA, 1530 bp, Artificial Sequence
  Description of Artificial Sequence: Synthetic coding sequence
atggacttcctgctggccctggtgctggtgagcagcctgtacctgcaggccgctgctgagtttgatggccgctggccccggcagatcgtgagcagcatcggcctgtgccgctatggaggaagaattgactgctgctggggctgggcccggcagagctggggccagtgccagcctgtgtgccagccccgctgcaagcacggggagtgcatcggccccaacaagtgcaagtgccaccctggctacgccggcaagacctgcaaccaggacctgaatgaatgtggcctgaagccccggccctgcaagcaccgctgcatgaacacctacggcagctacaagtgctactgcctgaatggctacatgctgatgccagatggcagctgcagcagcgccctgacctgcagcatggccaactgccagtatggctgtgatgtggtgaagggccagatccgctgccagtgccccagccctggcctgcagctggccccagatggccgcacctgtgtggatgtggatgaatgtgccaccggccgggccagctgcccccgcttccggcagtgtgtgaacaccttcggcagctacatctgcaagtgccacaagggctttgacctgatgtacatcggcggcaagtaccagtgccacgacattgatgaatgttccctgggccagtaccagtgcagcagctttgcccgctgctacaacatccggggcagctacaagtgcaagtgcaaggagggctaccagggagatggcctgacctgtgtgtacatccccaaggtgatgattgagcccagcggccccatccacgtgcccaagggaaatggcaccatcctgaagggggacaccggcaacaacaactggatcccagatgtgggcagcacctggtggccacccaagaccccctacatcccccccatcatcaccaaccggcccaccagcaagcccaccacccggcccacccccaagcccacccccatccccaccccacctcctcctccacccctgcccacagagctgcggacccccctgccccccaccaccccagagcggcccaccaccggcctgaccaccatcgccccagctgccagcaccccacctgggggcatcaccgtggacaacagagtgcagacagacccccagaagcccagaggagatgtgttttctgtgctggtgcacagctgcaactttgaccacggcctgtgtggctggatccgggagaaggacaatgacctgcactgggagcccatccgggaccctgctgggggccagtacctgactgtgtctgctgccaaggcccctgggggcaaggccgcccggctggtgctgcccctgggccgcctgatgcacagcggggacctgtgcctgtccttccgccacaaggtgacaggcctgcacagcggcaccctgcaggtgtttgtgaggaagcatggagcccacggggccgccctgtggggcagaaatggaggccacggctggaggcagacccagatcaccctgcggggagctgacatcaagtctgagagccagaggtag

SEQ ID NO: 7071 - DNA, 381 bp, Artificial Sequence
  Description of Artificial Sequence: Synthetic coding sequence
atggacaagagcctgctgctggagctgcccatcctgctgtgctgcttccgggccctgagcggcagcctgtccatgagaaatgatgctgtgaatgaaattgtggccgtgaagaacaacttccctgtgattgaaattgtgcagtgcaggatgtgccacctgcagtttcctggagagaagtgcagccggggccggggcatctgcacagccaccacagaggaggcctgcatggtgggccgcatgttcaagagagatggcaacccctggctgaccttcatgggctgcctgaagaactgtgctgatgtgaagggcatccgctggagcgtgtacctggtgaacttccgctgctgccgcagccatgacctgtgcaatgaagacctgtag

SEQ ID NO: 7072 - DNA, 537 bp, Artificial Sequence
  Description of Artificial Sequence: Synthetic coding sequence
atggagctgctgcaggtgaccatcctcttcctgctgcccagcatctgcagcagcaacagcactggagtgctggaggccgccaacaacagcctggtggtgaccaccaccaagcccagcatcaccacccccaacacagagagcctgcagaagaatgtggtgacccccaccaccggcaccacccccaagggcaccatcaccaatgagctgctgaagatgagcctgatgagcacagccaccttcctgaccagcaaggatgagggcctgaaggccaccaccacagatgtgaggaagaatgacagcatcatcagcaatgtgacagtgacctctgtgaccctgcccaatgctgtgtccaccctgcagagcagcaagcccaagacagagacccagagcagcatcaagaccacagagatccctggcaccccagaaaatggaaatgaccagccccagagcgacaaggagagcgtgaagctgctgactgtgaagaccatcagccatgaaagtggagagcacagcgcccagggcaagaccaagaactag

SEQ ID NO: 7073 - DNA, 2544 bp, Artificial Sequence
  Description of Artificial Sequence: Synthetic coding sequence
atgttcaagtgctggagcgtggtgctggtgctgggcttcatcttcctggagagcgagggccggcccaccaaggagggcggctacggcctgaagagctaccagcccctgatgaggctgcggcacaagcaggagaagaaccaggagagcagccgggtgaagggcttcatgatccaggacggccccttcggcagctgtgagaacaagtactgcggcctgggccgccactgtgtgaccagccgggagaccggccaggccgagtgtgcctgcatggacctgtgcaagaggcactacaagcctgtgtgtggcagtgatggagagttctatgagaaccactgtgaggtgcacagagctgcctgcctgaagaagcagaagatcaccatcgtgcacaatgaagactgcttcttcaagggggacaagtgcaagaccacagagtacagcaagatgaagaacatgctgctggacctgcagaaccagaagtacatcatgcaggagaatgaaaaccccaatggagatgacatcagcaggaagaagctgctggtggaccagatgttcaagtactttgatgctgacagcaatggcctggtggacatcaatgagctgacccaggtgatcaagcaggaggagctgggcaaggacctgtttgactgcaccctgtatgtgctgctgaagtatgatgacttcaatgctgacaagcacctggccctggaggagttctaccgggccttccaggtgatccagctgagcctgcctgaggaccagaagctgagcatcacagctgccaccgtgggccagagcgctgtgctgagctgtgccatccagggcaccctgcggccccccatcatctggaagaggaacaacatcatcctgaacaacctggacctggaggacatcaatgactttggagatgatggcagcctgtacatcaccaaggtgaccaccacccacgtgggcaactacacctgctacgcagatggctatgagcaggtgtaccagacccacatcttccaggtgaatgtgccccctgtgatccgggtgtacccagagagccaggcccgggagcccggggtgacagccagcctgcgctgccacgccgagggcatccccaagccccagctgggctggctgaagaatggaattgacatcacccccaagctgagcaagcagctgaccctgcaggccaacggcagcgaggtgcacatcagcaatgtgcgctatgaggacaccggggcctacacctgcatcgccaagaatgaagctggggtggatgaggacatcagcagcctgtttgtggaggacagcgccaggaagaccctggccaacatcctgtggagggaggagggcctgggcatcggcaacatgttttatgtgttctatgaagatggcatcaaggtgatccagcccattgaatgtgagttccagaggcacatcaagcccagcgagaagctgctgggcttccaggatgaggtgtgccccaaggccgagggagatgaggtgcagagatgtgtgtgggccagcgctgtgaatgtgaaggacaagttcatctacgtggcccagcccaccctggacagagtgctgattgtggatgtgcagagccagaaggtggtgcaggccgtgtccacagatcctgtgcctgtgaagctgcactatgacaagagccatgaccaggtgtgggtgctgtcctggggcaccctggagaagaccagccccaccctgcaggtgatcaccctggccagcggaaatgtgccccaccacaccatccacacccagcctgtgggcaagcagtttgacagagtggatgacttcttcatccccaccaccaccctcatcatcacccacatgagatttggcttcatcctgcacaaggatgaggccgccctgcagaagattgacctggagaccatgagctacatcaagaccatcaacctgaaggactacaagtgtgtgccccagagcctggcctacacccacctgggcggctactacttcatcggctgcaagccagacagcactggagctgtgagcccccaggtgatggtggatggagtgacagattctgtgattggcttcaacagtgatgtgacaggcaccccctacgtgtccccagatggccactacctggtgtccatcaatgatgtgaagggcctggtgcgggtgcagtacatcaccatccggggggagatccaggaggcctttgacatctacaccaacctgcacatcagtgacctggccttccagcccagcttcacagaggcccaccagtacaacatctacggcagcagcagcacccagacagatgtgctgtttgtggagctgagcagcggcaaggtgaagatgatcaagagcctgaaggagcccctgaaggccgaggagtggccctggaacaggaagaaccggcagatccaggacagcggcctgtttggccagtacctgatgacccccagcaaggacagcctcttcatcctggatggccgcctgaacaagctgaactgtgagatcacagaggtggagaagggcaacacagtcatctgggtgggagatgcctag

SEQ ID NO: 7074 - DNA, 273 bp, Artificial Sequence
  Description of Artificial Sequence: Synthetic coding sequence
atgaggctgtctgtgtgcctgctgctgctgaccctggccctgtgctgctaccgggccaatgctgtggtgtgccaggccctgggcagcgagatcaccggcttcctgctggccggcaagcctgtgttcaagttccagctggccaagttcaaggcccccctggaggccgtggccgccaagatggaggtgaagaagtgtgtggacaccatggcctatgagaagagggtgctgatcaccaagaccctgggcaagattgctgagaagtgtgacagatag

SEQ ID NO: 7075 - DNA, 1044 bp, Artificial Sequence
  Description of Artificial Sequence: Synthetic coding sequence
atgagctcctggagccggcagaggcccaagagccctgggggcatccagccccacgtgtccaggaccctcttcctgctgctgctgctggccgccagcgcctggggcgtgaccctgagccccaaggactgccaggtgttcagaagtgaccacggcagcagcatcagctgccagcccccagctgagatccctggctacctgcctgctgacacagtgcacctggccgtggagttcttcaacctgacccacctgcctgccaacctgctgcagggcgccagcaagctgcaggagctgcacctgagcagcaatggcctggagagcctgagccctgagttcctgcggcctgtgccccagctgcgggtgctggacctgaccagaaatgccctgaccggcctgcccccaggcctcttccaggccagcgccaccctggacaccctggtgctgaaggagaaccagctggaggtgctggaggtgtcctggctgcacggcctgaaggccctgggccacctggacctgagcggcaaccggctgaggaagctgcccccaggcctgctggccaacttcaccctgctgcggaccctggacctgggggagaaccagctggagaccctgcccccagacctgctgcggggccccctgcagctggagcggctgcacctggagggcaacaagctgcaggtgctgggcaaggacctgctgctgccccagcctgacctgcgctacctgttcctgaatggaaacaagctggcccgggtggccgccggggccttccagggcctgcggcagctggacatgctggacctgagcaacaacagcctggcctctgtgcctgagggcctgtgggccagcctgggccagcccaactgggacatgagagatggctttgacatcagcggcaacccctggatctgtgaccagaacctgagtgacctgtaccgctggctgcaggcccagaaggacaagatgttcagccagaatgacacccgctgtgccggccctgaggccgtgaagggccagaccctgctggccgtggccaagagccagtag

SEQ ID NO: 7076 - DNA, 1407 bp, Artificial Sequence
  Description of Artificial Sequence: Synthetic coding sequence
atgccaccctggggcgccgccctggccctgatcctggccgtgctggccctgctgggcctgctgggcccccggctgcggggcccctggggccgggctgtgggggagaggaccctgcccggggcccaggacagagatgatggagaggaggctgatggcggcggccctgctgaccagttcagtgatggccgggagcccctgcccggcggctgcagcctggtgtgcaagcccagcgccctggcccagtgcctgctgcgggccctgcggcgctctgaggccctggaggccggccccaggtcctggttcagcggcccccacctgcagaccctgtgccactttgtgctgcctgtggcccctggccctgagctggcccgggagtacctgcagctggctgatgatggcctggtggccctggactgggtggtgggcccctgtgtgcggggccgccgcatcaccagcgctgggggcctgcctgctgtgctgctggtgatccccaatgcctggggccgcctgaccagaaatgtgctgggcctgtgcctgctggccctggagcggggctactaccctgtgatcttccacagaagaggccaccacggctgccccctggtgagcccccggctgcagccctttggagaccccagcgacctgaaggaggccgtgacctacatccgcttccgccaccctgctgcccccctgtttgctgtgtctgagggcagcggcagcgccctgctgctgagctacctgggagaatgtggcagcagcagctatgtgactggagctgcctgcatcagccctgtgctgcgctgccgggagtggtttgaggccggcctgccctggccctatgaaagaggcttcctgctgcaccagaagatcgccctgagccgctatgccacagccctggaggacacagtggacaccagccgcctcttccgcagccgcagcctgcgggagtttgaggaggccctcttctgccacaccaagagcttccccatctcctgggacacctactgggacagaaatgaccccctgagagatgtggatgaggccgctgtgcctgtgctgtgcatctgcagcgcagatgatcctgtgtgtggccccccagaccacaccctgaccacagagctgttccacagcaacccctacttcttcctgctgctgagccgccacggcggccactgcggcttcctgcggcaggagcccctgcctgcctggagccatgaagtcatcctggagagcttccgggccctgacagagttcttcagaacagaggagcgcatcaagggcctgagccgccaccgggccagcttcctgggcggcagaagaagaggaggagccctgcagaggcgggaggtgagcagcagcagcaacctggaggagatcttcaactggaagaggagctacaccaggtag

SEQ ID NO: 7077 - DNA, 423 bp, Artificial Sequence
  Description of Artificial Sequence: Synthetic coding sequence
atgttcttcaccatcagcaggaagaacatgagccagaagctgagcctgctgctgctggtgtttggcctcatctggggcctgatgctgctgcactacaccttccagcagcccaggcaccagagctctgtgaagctgcgggagcagatcctggacctgagcaagcgctacgtgaaggccctggccgaggagaacaagaacacagtggatgtggagaatggagcctccatggccggctacgccgacctgaagaggaccatcgctgtgctgctggatgacatcctgcagaggctggtgaagctggagaacaaggtggactacatcgtggtgaatggcagcgctgccaacaccaccaacggcaccagcggcaacctggtgcctgtgaccaccaacaagaggaccaacgtgtctggcagcatcagatag

SEQ ID NO: 7078 - DNA, 993 bp, Artificial Sequence
  Description of Artificial Sequence: Synthetic coding sequence
cggggggccctggtgggcgcccccaggtctgcccgggccagctgcctgcggggcagaagacctggaagacggcagccctgtggccgctgcccagaccccccaagaagtggccctggccaggccggccgggcccgctgtgccagagatgtggccgcccagacagccctggccccccgggccctggccctgggcgctggggccgccggccctggctggagaggagctgtgccccggcggcctgctgcccgggtgtccagagctgcccagaggcaggagcaggagctggtgcggctgcaccgggagcaggagtgtgagctgcagcctgagcccgccccaccccggcccagcggccctgccacagctgaggaccccggccggcggcctgtgctgccccagaggcctcctgaggagaggcctccccagcccccaggcagcactggagtgattgctgagaccggccaggccggccccccagctggagctggggtgtctggctaccccaagagcccccctgtggccagccctggggcccctgtgcccagcctggtgtccttctctgctggcctgacccagaagcccttccccagtgatggaggagtggtgctcttcaacaaggtgctggtgaatgatggagatgtgtacaaccccagcactggagtcttcaccgccccctatgatggccgctacctgatcacagccaccctgaccccagagagagatgcctacgtggaggccgtgctgtctgtgtccaatgcctctgtggcccagctgcacacagctggctacagaagagagttcctggagtaccaccggcccccaggggccctgcacacctgtggcggccctggggccttccacctgattgtgcacctgaaggctggagatgctgtgaatgtggtggtgactggaggcaagctggcccacacagactttgatgagatgtacagcaccttctctggagtcttcctgtaccccttcctgagccacctgtag

SEQ ID NO: 7079 - DNA, 585 bp, Artificial Sequence
  Description of Artificial Sequence: Synthetic coding sequence
atgtctgccctgtggctgctgctgggcctgctggccctgatggacctgtctgagagcagcaactggggctgctacggcaacatccagagcctggacacccctggggccagctgtggcatcggccgccgccacggcctgaactactgcggcgtgcgggccagcgagcggctggccgagattgacatgccctacctgctgaagtaccagcccatgatgcagaccatcggccagaagtactgcatggaccctgctgtgattgctggggtgctgagcaggaagagccctggggacaagatcctggtgaacatgggagacaggacctccatggtgcaggaccccggcagccaggcccccacctcctggatcagcgagagccaggtgtcccagaccacagaggtgctgaccacccgcatcaaggagatccagaggcgcttccccacctggaccccagaccagtacctgcggggcggcctgtgtgcctacagcggcggggccggctacgtgcgcagcagccaggacctgagctgtgacttctgcaatgatgtgctggcccgggccaagtacctgaagagacatggcttctag

SEQ ID NO: 7080 - DNA, 273 bp, Artificial Sequence
  Description of Artificial Sequence: Synthetic coding sequence
atgaagttcctggccgtgctggtgctgctgggcgtgtccatcttcctggtgtctgcccagaaccccaccacagctgccccagctgacacctacccagccaccggccctgcagatgatgaggccccagatgctgagaccacagctgctgccaccacagccaccacagctgcccccaccacagccaccacagctgccagcaccacagccaggaaggacatccctgtgctgcccaagtgggtgggggacctgcccaacggccgggtgtgcccctag

SEQ ID NO: 7081 - DNA, 1914 bp, Artificial Sequence
  Description of Artificial Sequence: Synthetic coding sequence
atgagcaggatgctgcccttcctgctgctgctgtggttcctgcccatcacagagggcagccagagagctgagcccatgttcaccgctgtgaccaacagcgtgctgcccccagactatgacagcaaccccacccagctgaactacggcgtggccgtgacagatgtggaccatgatggagactttgaaattgtggtggccggctacaacggccccaacctggtgctgaagtatgaccgggcccagaagaggctggtgaacattgctgtggatgagaggagcagcccctactatgccctgcgggaccggcagggcaatgccatcggcgtgacagcctgtgacattgatggagatggccgggaggagatctacttcctgaacaccaacaatgccttcagcggcgtggccacctacacagacaagctgttcaagttcaggaacaaccgctgggaggacatcctgagtgatgaggtgaatgtggcccggggcgtggccagcctgtttgctggccgctctgtggcctgtgtggacaggaagggcagcggccgctacagcatctacatcgccaactatgcctatggaaatgtgggcccagatgccctgattgagatggaccctgaggccagtgacctgagccggggcatcctggccctgagagatgtggccgctgaggccggcgtgtccaagtacacaggaggccggggcgtgtctgtgggccccatcctgagcagcagcgccagtgacatcttctgtgacaatgaaaatggccccaacttcctgttccacaacagaggagatggcacctttgtggatgctgctgccagcgctggggtggatgacccccaccagcacggccggggcgtggccctggccgacttcaacagagatggcaaggtggacatcgtgtatggcaactggaatggcccccaccggctgtacctgcagatgagcacccacggcaaggtgcgcttccgggacatcgccagccccaagttctccatgcccagccctgtgaggacagtcatcacagctgactttgacaatgaccaggagctggagatcttcttcaacaacatcgcctaccgcagcagcagcgccaacagactcttccgggtcatcagaagagagcacggggaccccctgattgaggagctgaaccctggagatgccctggagcctgagggccggggcactggaggagtggtgacagactttgatggagatggcatgctggacctgatcctgagccacggggagagcatggcccagcccctgtctgtgttccggggcaaccagggcttcaacaacaactggctgcgggtggtgcccaggaccaggtttggagcctttgcccggggggccaaggtggtgctgtacaccaagaagagcggggcccacctgcgcatcattgatggcggcagcggctacctgtgtgagatggagcctgtggcccacttcggcctgggcaaggatgaggccagctctgtggaggtgacctggccagatggcaagatggtgtccagaaatgtggccagcggggagatgaacagcgtgctggagatcctgtaccccagagatgaggacaccctgcaggaccctgcccccctggagtgtggccagggcttcagccagcaggagaatggccactgcatggacaccaatgaatgcatccagttcccctttgtgtgcccccgggacaagcctgtgtgtgtgaacacctacggcagctaccgctgcaggaccaacaagaagtgcagccggggctatgagcccaatgaagatggaacagcctgtgtggcccaggtggccttcctgggcggctacagcagcgctgccagccgcatcagcgagcccctgagccgggccagctacctgagcctgggcctgggcctgtgcctgcagctgtatgccctgtag

SEQ ID NO: 7082 - DNA, 600 bp, Artificial Sequence
  Description of Artificial Sequence: Synthetic coding sequence
atggccctgaatggagctgaggtggatgacttctcctgggagcccccaacagaagctgagaccaaggtgctgcaggcccggcgggagcggcaggaccgcatcagccggctgatgggagactacctgctgcggggctacaggatgctgggggagacctgtgccgactgtggcaccatcctgctgcaggacaagcagaggaagatctactgtgtggcctgccaggagctggacagtgatgtggacaaggacaacccagccctgaatgcccaggccgccctgagccaggcccgggagcaccagctggccagcgccagcgagctgcccctgggcagcaggcctgccccccagccccctgtgcccaggcctgagcactgtgagggcgctgctgctggcctgaaggccgcccagggccccccagccccagctgtgccccccaacacagatgtgatggcctgcacccagacagccctgctgcagaagctgacctgggccagcgctgagctgggcagcagcaccagcctggagaccagcatccagctgtgtggcctcatccgggcctgtgccgaggccctgcggagcctgcagcagctgcagcactag

SEQ ID NO: 7083 - DNA, 813 bp, Artificial Sequence
  Description of Artificial Sequence: Synthetic coding sequence
atgaagctgggctgtgtgctgatggcctgggccctgtacctgagcctgggcgtgctgtgggtggcccagatgctgctggccgccagctttgagaccctgcagtgtgagggccctgtgtgcacagaggagagcagctgccacacagaagatgacctgacagatgcccgggaggccggcttccaggtgaaggcctacaccttcagcgagcccttccacctgattgtgtcctatgagctgtttcctgcccccatcctgcgggctgtgcccagcgctgagccccaggccggcagccccatgaccctgagctgccagaccaagctgcccctgcagaggtctgctgcccggctgctcttctccttctacaaggatggccgcatcgtgcagagccggggcctgagcagcgagttccagatccccacagccagcgaggaccacagcggcagctactggtgtgaggccgccacagaggacaaccaggtgtggaagcagagcccccagctggagatccgggtgcagggcgccagcagcagcgctgccccacccaccctgaacccagccccccagaagtctgctgcccctggaacagcccctgaggaggcccctggccccctgcccccaccacccacccccagcagtgaagatcctggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 7084 - DNA, 2421 bp, Artificial Sequence
  Description of Artificial Sequence: Synthetic coding sequence
atgaggctgagccctgcccccctgaagctgagcaggaccccagccctgctggccctggccctgcccctggccgccgccctggccttcagtgatgagaccctggacaaggtgcccaagtctgagggctactgcagccgcatcctgcgggcccagggcacccggcgggagggctacacagagttcagcctgcgggtggagggggaccctgacttctacaagccaggcaccagctacagagtgaccctgtctgctgccccacccagctacttccggggcttcaccctcatcgccctgcgggagaaccgggagggggacaaggaggaggaccatgctggcaccttccagatcattgatgaggaggagacccagttcatgagcaactgccctgtggccgtgacagagagcacccccaggaggaggacccgcatccaggtgttctggatcgcccccccagctggcaccggctgcgtcatcctgaaggccagcatcgtgcagaagaggatcatctacttccaggatgagggcagcctgaccaagaagctgtgtgagcaggacagcacctttgatggagtgacagacaagcccatcctggactgctgctgcggcacagccaagtaccgcctgaccttctacggcaactggagcgagaagacccaccccaaggactacccccggcgggccaaccactggagcgccatcatcggcggcagccacagcaagaactacgtgctgtgggagtatggaggctacgccagcgagggcgtgaagcaggtggccgagctgggcagccctgtgaagatggaggaggagatccggcagcagagtgatgaggtgctgaccgtcatcaaggccaaggcccagtggccagcctggcagcccctgaatgtgcgggccgcccccagcgctgagttctctgtggacaggaccaggcacctgatgtccttcctgaccatgatgggccccagcccagactggaatgtgggcctgtctgctgaggacctgtgcaccaaggaatgtggctgggtgcagaaggtggtgcaggacctgatcccctgggatgctggaacagacagcggcgtgacctatgagagccccaacaagcccaccatcccccaggagaagatccggcccctgaccagcctggaccacccccagagccccttctatgaccctgagggcggcagcatcacccaggtggcccgggtggtgattgaaagaattgccaggaagggggagcagtgcaacatcgtgcctgacaacgtggatgacatcgtggccgacctggcccctgaggagaaggatgaagatgacaccccagagacctgcatctacagcaactggagcccctggagcgcctgcagcagcagcacctgtgacaagggcaagaggatgaggcagaggatgctgaaggcccagctggacctgtctgtgccctgcccagacacccaggacttccagccctgcatgggccctggctgcagtgatgaagatggcagcacctgcaccatgtctgagtggatcacctggagcccctgcagcatcagctgtggcatgggcatgaggagccgggagcgctacgtgaagcagtttcctgaagatggctctgtgtgcaccctgcccacagaggagacagagaagtgcaccgtgaatgaggagtgcagccccagcagctgcctgatgacagagtggggcgagtgggatgagtgcagcgccacctgtggcatgggcatgaagaagaggcacaggatgatcaagatgaacccagcagatggctccatgtgcaaggccgagaccagccaggccgagaagtgcatgatgcctgagtgccacaccatcccctgcctgctgagcccctggagcgagtggagcgactgcagcgtgacctgtgggaagggcatgaggacccggcagaggatgctgaagagcctggccgagctgggggactgcaatgaagacctggagcaggtggagaagtgcatgctgcctgaatgtcccatcgactgtgagctgacagagtggagccagtggagcgagtgcaacaagagctgtgggaaaggacatgtgatccgcaccaggatgatccagatggagccccagtttggaggagccccctgcccagagaccgtgcagaggaagaagtgccgcatcaggaagtgcctgaggaaccccagcatccagaagctgcgctggagggaggcccgggagagcagaagaagtgagcagctgaaggaggagagcgagggggagcagtttcctggctgcaggatgaggccctggacagcctggagcgagtgcaccaagctgtgtggcggcggcatccaggagcgctacatgacagtgaagaagcgcttcaagagcagccagttcaccagctgcaaggacaagaaggagatccgggcctgcaatgtgcacccctgctag

SEQ ID NO: 7085 - DNA, 4242 bp, Artificial Sequence
  Description of Artificial Sequence: Synthetic coding sequence
atgagacatggagtggcctgggccctgctggtggccgccgccctgggcctgggcgcccggggcgtgagaggagctgtggccctggccgacttctacccctttggagctgagagaggagatgctgtgacccccaagcaggatgatggcggcagcggcctgcggcccctgtctgtgcccttccccttctttggagctgagcacagcggcctgtatgtgaacaacaacggcatcatctccttcctgaaggaggtgtcccagttcacccctgtggccttccccatcgccaaggacagatgtgtggtggccgccttctgggcagatgtggacaacagaagagctggagatgtgtactaccgggaggccacagatcctgccatgctgcggcgggccacagaagatgtgcgccactacttccctgagctgctggacttcaatgccacctgggtgtttgtggccacctggtacagagtgaccttcttcggcggcagcagcagcagccctgtgaacaccttccagacagtgctgatcacagatggcaagctgtccttcaccatcttcaactatgagagcatcgtgtggaccaccggcacccacgccagcagcggcggcaatgccaccggcctgggcggcattgctgcccaggccggcttcaatgctggagatggccagcgctacttcagcatccctggcagcaggacagctgacatggccgaggtggagaccaccaccaacgtgggcgtgcccggccgctgggccttcagaattgatgatgcccaggtgcgggtgggcggctgcggccacaccacctctgtgtgcctggccctgcggccctgcctgaatggaggaaaatgtattgatgactgtgtgacaggcaaccccagctacacctgcagctgcctgagcggcttcaccggccgccgctgccacctggatgtgaatgaatgtgccagccagccctgccagaatggaggcacctgcacccacggcatcaacagcttccgctgccagtgcccagctggctttggaggccccacctgtgaaacagcccagagcccctgtgacaccaaggagtgccagcacggcggccagtgccaggtggagaatggcagcgctgtgtgtgtgtgccaggccggctacaccggggccgcctgtgagatggatgtggatgactgcagcccagacccctgcctgaatggaggcagctgtgtggacctggtgggcaactacacctgcctgtgtgccgagcccttcaagggcctgcgctgtgagaccggggaccaccctgtgcctgatgcctgcctgagcgccccctgccacaacggcggcacctgtgtggatgctgaccagggctacgtgtgtgagtgcccagagggcttcatgggcctggactgccgggagcgggtgcctgatgactgtgaatgtagaaatggaggccgctgcctgggcgccaacaccaccctgtgccagtgccccctgggcttcttcggcctgctgtgtgaatttgagatcacagccatgccctgcaacatgaacacccagtgcccagatggcggctactgcatggagcacggcggcagctacctgtgtgtgtgccacacagaccacaatgccagccacagcctgcccagcccctgtgacagcgacccctgcttcaacggcggcagctgtgatgcccatgatgacagctacacctgtgagtgcccccggggcttccacggcaagcactgtgagaaggcccggccccacctgtgcagcagcggcccctgcagaaatggaggcacctgcaaggaggccggcggggagtaccactgcagctgcccctaccgcttcaccggccgccactgtgaaattggcaagccagacagctgtgccagcggcccctgccacaacggcggcacctgcttccactacatcggcaagtacaagtgtgactgccccccaggcttcagcggccgccactgtgagatcgcccccagcccctgcttccgcagcccctgtgtgaatggaggcacctgtgaagatcgggacacagacttcttctgccactgccaggccggctacatgggccgccgctgccaggccgaggtggactgtggccccccagaggaggtgaagcacgccaccctgcgcttcaacggcacccggctgggcgctgtggccctgtatgcctgtgaccggggctacagcctgagcgcccccagccgcatccgggtgtgccagccccacggcgtgtggagcgagcccccccagtgcctggagattgatgagtgccgcagccagccctgcctgcacggcggcagctgccaggacagagtggccggctacctgtgcctgtgcagcacaggctatgaaggagcccactgtgagctggagagagatgagtgccgggcccacccctgcagaaatggaggcagctgcaggaacctgcccggggcctacgtgtgccgctgcccagctggctttgtgggcgtgcactgtgaaacagaggtggatgcctgtgacagcagcccctgccagcacggcggccgctgtgagagcggcggcggggcctacctgtgtgtgtgcccagagagcttcttcggctaccactgtgagaccgtgtctgacccctgcttcagcagcccctgtggcggccggggctactgcctggccagcaatggcagccacagctgcacctgcaaggtgggctacaccggggaggactgtgccaaggagctgttccccccaacagccctgaagatggagcgggtggaggagagcggcgtgtccatctcctggaacccccccaacggccctgctgcccggcagatgctggatggctatgctgtgacctacgtgtccagtgatggcagctacagaagaacagactttgtggacaggaccaggagcagccaccagctgcaggccctggccgccggccgggcctacaacatctctgtgttttctgtgaagaggaacagcaacaacaagaatgacatcagcaggcctgctgtgctgctggcccggacccggcccaggcctgtggagggctttgaggtgaccaacgtgacagccagcaccatctctgtgcagtgggccctgcaccgcatcagacatgccaccgtgtctggagtgcgggtgtccatccgccaccctgaggccctgcgggaccaggccacagatgtggacagatctgtggaccgcttcaccttccgggccctgctgcccgggaagcgctacaccatccagctgaccaccctgagcggcctgcggggggaggagcaccccacagagagcctggccacagcccccacccacgtgtggacccggcccctgcccccagccaacctgacagctgcccgggtgacagccaccagcgcccacgtggtgtgggatgcccccaccccaggcagcctgctggaggcctacgtgatcaacgtgaccaccagccagagcaccaagagccgctacgtgcccaacgggaagctggccagctacacagtgcgggacctgctgcccggccgccgctaccagctgtctgtgattgctgtgcagagcacagagctgggcccccagcacagcgagcccgcccacctgtacatcatcaccagccccagagatggagctgaccggcgctggcaccagggcggccaccacccccgggtgctgaagaaccggcccccaccagcccggctgcctgagctgcggctgctgaatgaccacagcgcccctgagacccccacccagcccccacgcttcagcgagctggtggatggccggggccgggtgtctgccaggtttggaggcagccccagcaaggccgccaccgtgcgcagccagcccacagccagcgcccagctggagaacatggaggaggcccccaagagggtgtccctggccctgcagctgcctgagcacggcagcaaggacattggaaatgtgcccggcaactgcagcgagaacccctgccagaatggaggcacctgtgtgcctggagcagatgcccacagctgtgactgtggccctggcttcaagggccgccgctgtgagctggcctgcatcaaggtgtcccggccctgcaccaggctcttcagcgagaccaaggccttccctgtgtgggagggcggcgtgtgccaccacgtgtacaagagggtgtacagagtgcaccaggacatctgcttcaaggagagctgtgagagcaccagcctgaagaagacccccaacaggaagcagagcaagagccagaccctggagaagagctag

SEQ ID NO: 7086 - DNA, 1008 bp, Artificial Sequence
  Description of Artificial Sequence: Synthetic coding sequence
atgttcctggccaccctgtccttcctgctgccctttgcccaccccttcggcaccgtgtcctgtgagtacatgctgggcagccccctgagcagcctggcccaggtgaacctgagccccttcagccaccccaaggtgcacatggaccccaactactgccaccccagcaccagcctgcacctgtgcagcctggcctggagcttcacccggctgctgcacccccccctgagccctggcatcagccaggtggtgaaggaccacgtgaccaagcccacagccatggcccagggccgggtggcccacctgattgagtggaagggctggagcaagcccagcgacagccctgctgccctggagagcgccttcagcagctacagcgacctgtctgagggggagcaggaggccaggtttgctgctggggtggccgagcagtttgccatcgccgaggccaagctgcgggcctggagctctgtggatggagaggacagcacagatgacagctatgatgaagattttgctgggggcatggacacagacatggccggccagctgcccctgggcccccacctgcaggacctcttcaccggccaccgcttcagcaggcctgtgcggcagggctctgtggagcctgagagtgactgcagccagacagtgtccccagacaccctgtgcagcagcctgtgcagcctggaggatggcctgctgggcagccctgcccggctggccagccagctgctgggagatgagctgctgctggccaagctgccccccagccgggagagcgccttccgcagcctgggccccctggaggcccaggacagcctgtacaacagccccctgacagagagctgcctgagccctgctgaggaggagcccgccccctgcaaggactgccagcccctgtgcccccccctgaccggctcctgggagcggcagaggcaggccagtgacctggccagcagcggcgtggtgtccctggatgaagatgaggccgagcctgaggagcagtag

SEQ ID NO: 7087 - DNA, 828 bp, Artificial Sequence
  Description of Artificial Sequence: Synthetic coding sequence
atgcagcccccaggcccccgggaccccctcatccggctgtgcttcttccgggaggagggcaccaacgtggtgcagaagatctgcttcagcacccagatcatccgccactttgagagcaagctgagtgacaccatcgaggtgtaccaggagcgcatccagtggctgacagagaacagcaagaaggccttcggcctcatcaagggggcccgggtgtccatcctgattgatgtgtctgccatcagcagcggcccccagaaggaggagttccagaaggacctgatgagcctgattgatgagcagctgagccacaaggagaagctgtttgtgctgagctttggcaccaatgccggcagcctgtggccagaccccatggaggtgtctgccagcaccctgcaggagctgaagctgtgggtgaagaccctgcagccagatggcggcagcaacctgctgcaggccctgaagaagatcttcaccctgaagggcctggacagcctggtggccatcatgaggagctgcccagaccagcccagcgagatcctgagtgactacatccagcagagcaccatgggccgggacctgatcatccacttcatcacctaccgctgtgatgaccagatgcctcctgctgtgctgaagaacctggccgaggccgtgcggggctactaccactgctacagccccaagatggagcactacaccagccgggacatggatgagctgctggccgagatccagaaggcccagagcctgctgagccacgtgcaggccctgcagcacagcagcccctgtgaggccctgacctgcaccatggaggagcccaggaactag

SEQ ID NO: 7088 - DNA, 438 bp, Artificial Sequence
  Description of Artificial Sequence: Synthetic coding sequence
atgctgacccggctggtgctgagcgcccacctgagcagcaccaccagccccccctggacccacgccgccatctcctgggagctggacaacgtgctgatgcccagcccccgcatctggccccaggtgacccccaccggccgcagcgcctctgtgcgctctgagggcaacaccagcagcctgtggaacttctctgctggccaggatgtgcacgccatcgtgaccaggacctgtgagagcgtgctgagcagcgctgtgtacacccacggctgcggctgtgtgcgcagcgccaccaacatcacctgccagagcagcggccagcagaggcaggccgcccggcaggaggaggagaacagcatctgcaaggcccatgacagccgggagggccgcctgggctaccccctgagcgcccaccagcccggcagcggcggccccaactag

SEQ ID NO: 7089 - DNA, 777 bp, Artificial Sequence
  Description of Artificial Sequence: Synthetic coding sequence
atgaccccacccaagctgcgggccagcctgagccccagcctgctgctgctgctgagcggctgcctgctggccgccgcccggcgggagaagggggccgccagcaatgtggccgagcctgtgcccggccccaccggcggcagcagcggccgcttcctgagccctgagcagcacgcctgctcctggcagctgctgctgcctgcccctgaggccgccgccggcagcgagctggccctgcgctgccagagcccagatggagcccggcaccagtgtgcctaccggggccaccctgagcgctgtgccgcctatgctgcccggcgggcccacttctggaagcaggtgctgggcggcctgaggaagaagagaagaccctgccacgaccctgcccccctgcaggcccggctgtgtgccggcaagaagggccatggagctgagctgcggctggtgccccgggccagccccccagcccggcccaccgtggccggctttgctggggagagcaagccccgggccaggaacagaggaagaacccgggagcgggccagcggccctgctgctggcaccccaccaccccagagcgccccacccaaggagaaccccagcgagaggaagaccaatgaaggcaagaggaaggccgccctggtgcccaatgaggagcggcccatgggcactggaccagaccctgatggcctggatggaaatgctgagctgacagagacctactgtgccgagaagtggcacagcctgtgcaacttctttgtgaacttctggaatggatag

SEQ ID NO: 7090 - DNA, 393 bp, Artificial Sequence
  Description of Artificial Sequence: Synthetic coding sequence
atggcccggcggcactgcttctcctactggctgctggtgtgctggctggtggtgacagtggccgagggccaggaggaggtgttcaccccacctggggacagccagaacaatgctgatgccacagactgccagatcttcaccctgaccccacctccagcccccaggagccctgtgacccgggcccagcccatcaccaagaccccccgctgccccttccacttcttcccccggcggccccgcatccacttccgcttccccaaccggccctttgtgcccagccgctgcaaccaccgcttccccttccagcccttctactggccccaccgctacctgacctaccgctacttcccccggcggcggctgcagaggggcagcagcagcgaggagagctag

SEQ ID NO: 7091 - DNA, 600 bp, Artificial Sequence
  Description of Artificial Sequence: Synthetic coding sequence
atgtacccagccacagctgtgccccagatcaacatcaccatcctgaagggggagaagggggacagaggagaccggggcctgcagggcaagtatggcaagacaggcagcgctggggcccggggccacacaggccccaagggccagaagggctccatgggcgcccctggagagcgctgcaagagccactacgccgccttctctgtgggcaggaagaagcccatgcacagcaaccactactaccagaccgtcatctttgacacagaatttgtgaacctgtatgaccacttcaacatgttcaccgggaagttctactgctacgtgcccggcctgtacttcttcagcctgaatgtgcacacctggaaccagaaggagacctacctgcacatcatgaagaatgaggaggaggtggtgatcctgtttgcccaggtgggggacaggagcatcatgcagagccagagcctgatgctggagctgcgggagcaggaccaggtgtgggtgcggctgtacaagggggagcgggagaatgccatcttcagcgaggagctggacacctacatcaccttcagcggctacctggtgaagcacgccacagagccctag

SEQ ID NO: 7092 - DNA, 702 bp, Artificial Sequence
  Description of Artificial Sequence: Synthetic coding sequence
atggccctgaagaacaagttcagctgcctgtggatcctgggcctgtgcctggtggccaccaccagcagcaagatccccagcatcacagacccccacttcatcgacaactgcatcgaggcccacaatgagtggaggggcaaggtgaaccccccagctgctgacatgaagtacatgatctgggacaagggcctggccaagatggccaaggcctgggccaaccagtgcaagtttgagcacaatgactgcctggacaagagctacaagtgctatgctgcctttgaatatgtgggggagaacatctggctgggcggcatcaagagcttcacccccaggcatgccatcacagcctggtacaatgagacccagttctatgactttgacagcctgagctgcagccgggtgtgtggccactacacccagctggtgtgggccaacagcttctacgtgggctgtgctgtggccatgtgccccaacctgggcggggccagcacagccatctttgtgtgcaactacggccctgctggcaactttgccaacatgccaccctacgtgcggggggagagctgcagcctgtgcagcaaggaggagaagtgtgtgaagaacctgtgcaagaaccccttcctgaagcccaccggccgggccccccagcagacagccttcaaccccttcagcctgggcttcctgctgctgcgcatcttctag

SEQ ID NO: 7093 - DNA, 669 bp, Artificial Sequence
  Description of Artificial Sequence: Synthetic coding sequence
atggccctgcacatccacgaggcctgcatcctgctgctggtgattcctggcctggtgaccagcgctgccatcagccatgaggactacccagcagatgaaggagaccagatcagcagcaatgacaacctgatctttgatgactaccggggcaagggctgtgtggatgattctggctttgtgtacaagctgggggagcgcttcttccctggccacagcaactgcccctgtgtgtgtgccctggatggccctgtgtgtgaccagccagaatgtcccaagatccaccccaagtgcaccaaggtggagcacaacggctgctgcccagagtgcaaggaggtgaagaacttctgtgagtaccacggcaagaactacaagatcctggaggagttcaagcccagcccctgtgagtggtgccgctgtgagcccagcaatgaggtgcactgtgtggtggccgactgtgctgtgcctgaatgtgtgaaccctgtgtatgagcctgagcagtgctgccctgtgtgcaagaatggccccaactgctttgctggcaccaccatcatcccagctggcatcgaggtgaaggtggatgagtgcaacatctgccactgccacaacggggactggtggaagccagcccagtgcagcaagcgggagtgccagggcaagcagacagtgtag

SEQ ID NO: 7094 - DNA, 957 bp, Artificial Sequence
  Description of Artificial Sequence: Synthetic coding sequence
atgctgcccctgaccatgacagtgctgatcctgctgctgctgcccaccggccaggccgcccccaaggatggagtgaccaggccagacagcgaggtgcagcaccagctgctgcccaaccccttccagcccggccaggagcagctgggcctgctgcagagctacctgaagggcctgggccgcacagaggtgcagctggagcacctgagccgggagcaggtgctgctgtacctgtttgccctgcatgactatgaccagagcggccagctggatggcctggagctgctgtccatgctgacagctgccctggcccctggggccgccaacagccccaccaccaaccctgtgatcctgattgtggacaaggtgctggagacccaggacctgaatggagatggcctgatgaccccagctgagctgatcaacttccctggggtggccctgcggcacgtggagcccggggagcccctggcccccagcccccaggagccccaggccgtgggccggcagagcctgctggccaagagccccctgcggcaggagacccaggaggcccctggcccccgggaggaggccaagggccaggtggaggcccggcgggagagcctggaccctgtgcaggagcccggcggccaggccgaggctgatggagatgtgcccggccccagaggagaggccgagggccaggccgaggccaagggagatgcccctggccccagaggagaggccggcggccaggccgaggccgagggagatgcccctggccccagaggagaggccggcggccaggccgaggccgagggagatgcccctggccccagaggagaggccggcggccaggccgaggcccgggagaatggagaggaggccaaggagctgcctggagagaccctggagagcaagaacacccagaatgactttgaggtgcacatcgtgcaggtggagaatgatgagatctag

SEQ ID NO: 7095 - DNA, 393 bp, Artificial Sequence
  Description of Artificial Sequence: Synthetic coding sequence
atgctggcccccctcttcctgtgctgcctgaggaacctcttcaggaagctgatctccttccagcccccccagctgggccgcaccaacatgcactacagcaagctgcccaggacagccatcgagacagagttcaagcagaatgtgggccccccacccaaggacctgacagctgaggtgtacttccccagcatcaagagccgcagccacctgcctgctgtgttctacaaccagtacttcaagcaccccaagtgtgtgggggagtatggccccaagaatggagctgagcggcagatcgaggagaggaaggtgctgcccaccaccatgatgttctccatgctggccgactgtgtgctgaagagcacccccatccccatcctgggcgtggccatgtag

SEQ ID NO: 7096 - DNA, 4362 bp, Artificial Sequence
  Description of Artificial Sequence: Synthetic coding sequence
atgatgctgccccagaacagctggcacatcgactttggccgctgctgctgccaccagaacctcttctctgctgtggtgacctgcatcctgctgctgaacagctgcttcctgatcagcagcttcaacggcacagacctggagctgcggctggtgaatggagatggcccctgcagcggcaccgtggaggtgaagttccagggccagtggggcaccgtgtgtgatgatggctggaacaccacagccagcacagtggtgtgcaagcagctgggctgccccttctcctttgccatgttccgcttcggccaggccgtgaccaggcatggcaagatctggctggatgatgtgtcctgctatggaaatgaaagtgccctgtgggagtgccagcaccgggagtggggcagccacaactgctaccatggagaagatgtgggcgtgaactgctacggggaggccaacctgggcctgcggctggtggatggcaacaacagctgcagcggccgggtggaggtgaagttccaggagcgctggggcaccatctgtgatgatggctggaacctgaacacagctgctgtggtgtgccggcagctgggctgccccagcagcttcatcagcagtggagtggtgaacagccctgctgtgctgcggcccatctggctggatgacatcctgtgccagggcaatgagctggccctgtggaactgccgccaccggggctggggcaaccacgactgcagccacaatgaagatgtgaccctgacctgctatgacagcagtgacctggagctgcggctggtgggcggcaccaaccgctgcatgggccgggtggagctgaagatccagggccgctggggcaccgtgtgccaccacaagtggaacaatgctgctgctgatgtggtgtgcaagcagctgggctgcggcacagccctgcactttgctggcctgccccacctgcagagcggcagtgatgtggtgtggctggatggagtgtcctgcagcggaaatgaaagcttcctgtgggactgccgccacagcggcaccgtgaactttgactgcctgcaccagaatgatgtgtctgtcatctgcagtgatggagctgacctggagctgcggctggctgatggcagcaacaactgcagcggccgggtggaggtgcgcatccacgagcagtggtggaccatctgtgaccagaactggaagaatgagcaggccctggtggtgtgcaagcagctgggctgccccttctctgtgtttggcagccggcgggccaagcccagcaatgaggcccgggacatctggatcaacagcatcagctgcacaggaaatgaaagtgccctgtgggactgcacctatgatggcaaggccaagaggacctgcttccgccgcagtgatgctggggtcatctgcagcgacaaggctgacctggacctgcggctggtgggcgcccacagcccctgctacggccgcctggaggtgaagtaccagggcgagtggggcaccgtgtgccacgaccgctggagcaccagaaatgctgctgtggtgtgcaagcagctgggctgcggcaagcccctgcacgtgtttggcatgacctacttcaaggaggccagcggccccatctggctggatgatgtgtcctgcattggaaatgaaagcaacatctgggactgtgagcacagcggctggggcaagcacaactgtgtgcacagagaagatgtgattgtgacctgcagcggagatgccacctggggcctgcggctggtgggcggcagcaaccgctgcagcggccgcctggaggtgtacttccagggccgctggggcaccgtgtgtgatgatggctggaacagcaaggctgctgctgtggtgtgcagccagctggactgccccagcagcatcatcggcatgggcctgggcaatgccagcacaggctacggcaagatctggctggatgatgtgtcctgtgatggagatgaaagtgacctgtggagctgcagaaattctggctggggcaacaatgactgcagccacagtgaagatgtgggcgtcatctgcagtgatgccagtgacatggagctgcggctggtgggcggcagcagccgctgtgccggcaaggtggaggtgaatgtgcagggcgctgtgggcatcctgtgtgccaacggctggggcatgaacattgctgaggtggtgtgccggcagctggagtgtggcagcgccatccgggtgtcccgggagccccacttcacagagaggaccctgcacatcctgatgagcaacagcggctgcaccggcggggaggccagcctgtgggactgcatccgctgggagtggaagcagacagcctgccacctgaacatggaggccagcctcatctgcagcgcccaccggcagccccggctggtgggcgctgacatgccctgcagcggccgggtggaggtgaagcatgctgacacctggaggtctgtgtgtgacagcgacttcagcctgcacgccgccaacgtgctgtgccgggagctgaactgtggagatgccatcagcctgtctgtgggggaccactttggaaaaggaaatggcctgacctgggccgagaagttccagtgtgagggcagcgagacccacctggccctgtgccccatcgtgcagcaccctgaggacacctgcatccacagccgggaggtgggcgtggtgtgcagccgctacacagatgtgcggctggtgaatggcaagagccagtgtgatggccaggtggagatcaacgtgctgggccactggggcagcctgtgtgacacccactgggaccctgaagatgcccgggtgctgtgccggcagctgagctgtggcacagccctgagcaccaccggcggcaagtacatcggggagaggtctgtgcgggtgtggggccaccgcttccactgcctgggcaatgaaagcctgctggacaactgccagatgacagtgctgggcgccccaccctgcatccacggcaacacagtgtctgtcatctgcaccggcagcctgacccagcccctcttcccctgcctggccaacgtgtctgacccctacctgtctgctgtgcctgagggcagcgccctgatctgcctggaggacaagaggctgcggctggtggatggagacagccgctgtgccggccgggtggagatctaccatgatggcttctggggcaccatctgtgatgatggctgggacctgagtgatgcccacgtggtgtgccagaagctgggctgcggcgtggccttcaatgccaccgtgtctgcccactttggagagggcagcggccccatctggctggatgacctgaactgcaccggcatggagagccacctgtggcagtgccccagccggggctggggccagcacgactgccgccacaaggaggatgctggggtcatctgcagcgagttcaccgccctgcggctgtacagcgagacagaaacagagagctgtgccggccgcctggaggtgttctacaacggcacctggggctctgtgggcagaagaaacatcaccacagccatcgccggcatcgtgtgccggcagctgggctgtggggagaatggagtggtgtccctggcccccctgagcaagacaggcagcggcttcatgtgggtggatgacatccagtgccccaagacccacatcagcatctggcagtgcctgagcgccccctgggagcggcgcatcagcagccctgctgaggagacctggatcacctgtgaagatcgcatccgggtgcggggcggggacacagagtgcagcggccgggtggagatctggcacgccggctcctggggcaccgtgtgtgatgacagctgggacctggccgaggccgaggtggtgtgccagcagctgggctgcggcagcgccctggccgccctgagagatgccagctttggccagggcaccggcaccatctggctggatgacatgcgctgcaagggaaatgaaagcttcctgtgggactgccacgccaagccctggggccagagcgactgtggccacaaggaggatgctggggtgcgctgcagcggccagagcctgaagagcctgaatgccagcagcggccacctggccctgatcctgagcagcatcttcggcctgctgctgctggtgctcttcatcctcttcctgacctggtgccgggtgcagaagcagaagcacctgcccctgcgggtgtccaccaggagaagaggcagcctggaggagaacctcttccacgagatggagacctgcctgaagcgggaggacccccacggcaccaggaccagtgatgacacccccaaccacggctgtgaagatgccagtgacaccagcctgctgggcgtgctgcctgccagcgaggccaccaagtag

SEQ ID NO: 7097 - DNA, 759 bp, Artificial Sequence
  Description of Artificial Sequence: Synthetic coding sequence
atgctgcccccacccaggcctgctgctgccctggccctgcctgtgctgctgctgctgctggtggtgctgaccccaccacccaccggggcccggcccagccctggccctgactacctgcggcggggctggatgaggctgctggccgagggggagggctgtgccccctgcaggcctgaggagtgtgccgccccccggggctgcctggccggccgggtgagagatgcctgtggctgctgctgggagtgtgccaacctggagggccagctgtgtgacctggaccccagcgcccacttctacggccactgtggggagcagctggagtgccgcctggacaccggcggggacctgagcagaggagaggtgcctgagcccctgtgtgcctgccgcagccagagccccctgtgtggcagtgatggccacacctacagccagatctgccgcctgcaggaggccgcccgggcccggccagatgccaacctgactgtggcccaccctggcccctgtgagagcggcccccagatcgtgagccacccctatgacacctggaggggcccccggctgcagaccctgggcacagaggacaccctgaccaccctggtgggcgctgggggcatggcccgggctgtggcctgtggggaggcccctggagagcacctggccctgcaggtgctgtgcctgagcggcaagaggaggcacctgtggcaggtgggcagcacaggcagcagcgagggcgtgcccagcggcggcagcttctggtag

SEQ ID NO: 7098 - DNA, 1323 bp, Artificial Sequence
  Description of Artificial Sequence: Synthetic coding sequence
atgaagctggccctgctgctgccctgggcctgctgctgcctgtgtggcagcgccctggccaccggcttcctgtaccccttctctgctgctgccctgcagcagcacggctacccagagcccggggccggcagccctggcagcggctacgccagccgccgccactggtgccaccacacagtgaccaggacagtgtcctgccaggtgcagaatggcagcgagaccgtggtgcagagggtgtaccagagctgccgctggccaggcccctgtgccaacctggtgtcctaccgcaccctcatccggcccacctacagagtgtcctacagaacagtgacagtgctggagtggcgctgctgccccggcttcaccggcagcaactgtgatgaggagtgcatgaactgcacccggctgagtgacatgtctgagcggctgaccaccctggaggccaaggtgctgctgctggaggccgctgagcggcccagcagcccagacaatgacctgcctgcccctgagagcaccccacccacctggaatgaagacttcctgcctgatgccatccccctggcccaccctgtgccccggcagaggcggcccaccggccctgctggccccccaggccagacaggccccccaggccctgctggccccccaggcagcaaaggagaccggggccagacaggagagaagggccctgctggccccccaggcctgctgggccccccaggcccccggggcctgcccggggagatgggccggcccggccccccaggccccccaggccctgctggcaaccctggccccagccccaacagcccccagggcgccctgtacagcctgcagcccccaacagacaaggacaacggggacagccggctggccagcgccatcgtggacacagtgctggccggcgtgcccggcccccggggccccccaggccccccaggccccccaggcccccggggccccccaggccccccaggcaccccaggcagccagggcctggccggggagcggggcaccgtgggccccagcggggagcccggggtgaagggggaggagggggagaaggccgccacagctgagggggagggcgtgcagcagctgcgggaggccctgaagatcctggccgagcgggtgctgatcctggagcacatgattggcatccatgaccccctggccagccctgagggcagcggccaggatgctgccctgcgggccaacctgaagatgaagaggggcggggcccagccagatggagtgctggccgccctgctgggccctgaccccggccagaagtctgtggaccaggccagcagcaggaagtag

SEQ ID NO: 7099 - DNA, 1341 bp, Artificial Sequence
  Description of Artificial Sequence: Synthetic coding sequence
atgctgcaccctgagaccagccctggccggggccacctgctggccgtgctgctggccctgctgggcacagcctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctggactggagcgacagcctggcccagctggcccaggcccgggccgccctgtgtggcatccccacccccagcctggccagcggcctgtggaggaccctgcaggtgggctggaacatgcagctgctgcctgctggcctggccagctttgtggaggtggtgtccctgtggtttgctgagggccagcgctacagccatgctgctggggagtgtgccagaaatgccacctgcacccactacacccagctggtgtgggccaccagcagccagctgggctgcggccgccacctgtgcagcgctggccaggccgccatcgaggcctttgtgtgtgcctacagcccccggggcaactgggaggtgaatggcaagaccatcgtgccctacaagaagggggcctggtgcagcctgtgcacagcctctgtgtctggctgcttcaaggcctgggaccatgctgggggcctgtgtgaggtgcccaggaacccctgcaggatgagctgccagaaccacggccgcctgaacatcagcacctgccactgccactgccccccaggctacacaggccgctactgccaggtgcgctgcagcctgcagtgtgtgcacggccgcttccgggaggaggagtgcagctgtgtgtgtgacatcggctacggcggggcccagtgtgccaccaaggtgcacttccccttccacacctgtgacctgagaattgatggagactgcttcatggtgtcctctgaggccgacacctactaccgggccaggatgaagtgccagaggaagggcggcgtgctggcccagatcaagagccagaaggtgcaggacatcctggccttctacctgggccgcctggagaccaccaatgaagtcatcgacagcgactttgagaccaggaacttctggattggcctgacctacaagacagccaaggacagcttccgctgggccaccggggagcaccaggccttcaccagctttgccttcggccagcctgacaaccacggctttggaaactgtgtggagctgcaggccagcgctgccttcaactggaacaaccagcgctgcaagaccaggaaccgctacatctgccagtttgcccaggagcacatcagccgctggggccctggcagctag

SEQ ID NO: 7100 - DNA, 219 bp, Artificial Sequence
  Description of Artificial Sequence: Synthetic coding sequence
atgcagaggctggtgctgctgctggccatcagcctgctgctgtaccaggacctgcctgtgcgctcagaatttgagctggaccgcatctgtggctacggcacagcccgctgcaggaagaagtgccgcagccaggagtaccgcatcggccgctgccccaacacctacgcctgctgcctgaggaagtgggatgagagcctgctgaacagaaccaagccctag

SEQ ID NO: 7101 - DNA, 2349 bp, Artificial Sequence
  Description of Artificial Sequence: Synthetic coding sequence
ctgtggctgctgctgtgggccgccgcctggaggctgggcgccagcgcctgcccagccctgtgcacctgcaccggcaccaccgtggactgccacggcaccggcctgcaggccatccccaagaacatccccaggaacacagagcggctggagctgaatggaaacaacatcacccgcatccacaagaatgactttgctggcctgaagcagctgcgggtgctgcagctgatggagaaccagatcggggctgtggagcggggggcctttgatgacatgaaggagctggagcggctgcggctgaacagaaaccagctgcacatgctgcctgagctgctcttccagaacaaccaggccctgagccggctggacctgtctgaaaatgccatccaggccatccccaggaaggccttccggggggccacagacctgaagaacctgcagctggacaagaaccagatcagctgcatcgaggagggcgccttccgggccctgcggggcctggaggtgctgaccctgaacaacaacaacatcaccaccatccctgtgtcctccttcaaccacatgcccaagctgcggaccttccggctgcacagcaaccacctgttctgtgactgccacctggcctggctgagccagtggctgcggcagaggcccaccatcggcctcttcacccagtgcagcggccctgccagcctgcggggcctgaatgtggccgaggtgcagaagtctgagttcagctgcagcggccagggcgaggccggccgggtgcccacctgcaccctgagcagcggcagctgcccagccatgtgcacctgcagcaatggaattgtggactgccggggcaagggcctgacagccatcccagccaacctgcctgagaccatgacagagatccggctggagctgaatggcatcaagagcatccccccaggggccttcagcccctacaggaagctgcggcgcatctgccccctgtccttctgcagcccctgccgggacctgagcaacaaccagattgctgagatcgccccagatgccttccagggcctgcggagcctgaacagcctggtgctgtatggcaacaagatcacagacctgccccggggcgtgtttggaggcctgtacaccctgcagctgctgctgctgaatgccaacaagatcaactgcatccggccagatgccttccaggacctgcagaacctgagcctgctgagcctgtatgacaacaagatccagagcctggccaagggcaccttcaccagcctgcgggccatccagaccctgcacctggcccagaaccccttcatctgtgactgcaacctgaagtggctggccgacttcctgcggaccaaccccatcgagaccagcggggcccgctgtgccagcccccggcggctggccaacaagagaattggccagatcaagagcaagaagttccgctgcagcgccaaggagcagtacttcatccctggaacagaggactaccagctgaacagcgagtgcaacagtgatgtggtgtgcccccacaagtgccgctgtgaggccaacgtggtggagtgcagcagcctgaagctgaccaagatccctgagcgcatcccccagagcacagctgagctgcggctgaacaacaatgagatcagcatcctggaggccaccggcatgttcaagaagctgacccacctgaagaagatcaacctgagcaacaacaaggtgtctgaaattgaagatggagcctttgagggcgccgcctctgtgtctgagctgcacctgacagccaaccagctggagagcatccgcagcggcatgttccggggcctggatggcctgcggaccctgatgctgaggaacaaccgcatcagctgcatccacaatgacagcttcaccggcctgagaaatgtgcggctgctgagcctgtatgacaaccagatcaccaccgtgtcccctggggcctttgacaccctgcagagcctgagcaccctgaacctgctggccaaccccttcaactgcaactgccagctggcctggctgggcggctggctgaggaagaggaagatcgtgacaggcaacccccgctgccagaacccagacttcctgcggcagatccccctgcaggatgtggccttcccagacttccgctgtgaggagggccaggaggagggcggctgcctgccccggccccagtgcccccaggagtgtgcctgcctggacacagtggtgcgctgcagcaacaagcacctgcgggccctgcccaagggcatccccaagaatgtgacagagctgtacctggatggcaaccagttcaccctggtgcccggccagctgagcaccttcaagtacctgcagctggtgtag

SEQ ID NO: 7102 - DNA, 411 bp, Artificial Sequence
  Description of Artificial Sequence: Synthetic coding sequence
atgagcaatgtgccccacaagagcagcctgcctgagggcatccggcccggcaccgtgctgcgcatccggggcctggtgcccccaaatgccagccgcttccacgtgaacctgctgtgtggggaggagcagggcagtgatgctgccctgcacttcaacccccggctggacaccagcgaggtggtgttcaacagcaaggagcagggctcctggggccgggaggagcggggccctggggtgcccttccagaggggccagccctttgaggtgctgatcatcgccagtgatgatggcttcaaggctgtggtgggagatgcccagtaccaccacttccgccaccggctgcccctggcccgggtgcggctggtggaggtgggcggagatgtgcagctggacagcgtgcgcatcttctag

SEQ ID NO: 7103 - DNA, 1926 bp, Artificial Sequence
  Description of Artificial Sequence: Synthetic coding sequence
atgcccccacccctgcccctgctgctgctgactgtgctggtggtggccgccgcccggcccggctgtgaatttgagaggaacccagctgccacctgtgtggacctgcagctgcggacctgcagtgatgctgcctacaaccacaccaccttccccaacctgctgcagcaccgctcctgggaggtggtggaggccagcagcgagtacatcctgctgtctgtgctgcaccagctgctggagggccagtgcaacccagacctgcggctgctgggctgtgctgtgctggccccccgctgtgagggcggctgggtgcggcggccctgccgccacatctgtgagggcctgcgggaggtgtgccagcctgcctttgatgccatcgacatggcctggccctacttcctggactgccaccgctacttcacccgggaggatgagggctgctatgaccccctggagaagctgcggggcggcctggaggctgatgaggccctgcccagcggcctgccccccaccttcatccgcttcagccaccacagctatgcccagatggtgcgggtgctgcggaggacagccagccgctgtgcccacgtggcccggacctacagcatcggccgcagctttgatggccgggagctgctggtgattgagttcagcagccggcccggccagcacgagctgatggagcctgaggtgaagctgattggcaacatccatggaaatgaggtggccggccgggagatgctgatctacctggcccagtacctgtgcagcgagtacctgctgggcaacccccgcatccagaggctgctgaacaccacccgcatccacctgctgcccagcatgaacccagatggctatgaggtggccgctgctgagggcgccggctacaacggctggaccagcggccggcagaatgcccagaacctggacctgaacagaaacttcccagacctgaccagcgagtactaccgcctggccgagaccaggggggcccggagtgaccacatccccatcccccagcactactggtggggcaaggtggcccctgagaccaaggccatcatgaagtggatgcagaccatcccctttgtgctgagcgccagcctgcatggaggagacctggtggtgtcctacccctttgacttcagcaagcacccccaggaggagaagatgttcagccccaccccagatgagaagatgttcaagctgctgagccgggcctatgcagatgtgcaccccatgatgatggacagaagtgaaaatagatgtggcggcaacttcctgaagaggggcagcatcatcaacggggctgactggtacagcttcaccggcggcatgtctgacttcaactacctgcacaccaactgctttgagatcaccgtggagctgggctgtgtgaagttccccccagaggaggccctgtacatcctgtggcagcacaacaaggagagcctgctgaactttgtggagaccgtgcaccggggcatcaagggcgtggtgacagacaagtttgggaagcctgtgaagaatgcccgcatctctgtgaagggcatcagacatgacatcaccacagccccagatggagactactggaggctgctgcccccaggcatccacatcgtgattgcccaggcccctggctacgccaaggtgatcaagaaggtgatcatcccagccaggatgaagagagctggccgggtggacttcatcctgcagcccctgggcatgggccccaagaacttcatccacggcctgcggaggacaggcccccatgaccccctgggcggggccagcagcctgggggaggccacagagccagaccccctgcgggcccggcggcagcccagcgcagatggcagcaagccctggtggtggagctacttcaccagcctgagcacccaccggccccgctggctgctgaagtactag

SEQ ID NO: 7104 - DNA, 1305 bp, Artificial Sequence
  Description of Artificial Sequence: Synthetic coding sequence
atggccagcctgggcctgctgctgctgctgctgctgacagccctgccccccctgtggagcagcagcctgcccggcctggacacagctgagagcaaggccaccatcgctgacctgatcctgagcgccctggagcgggccaccgtcttcctggagcagaggctgcctgagatcaacctggatggcatggtgggcgtgcgggtgctggaggagcagctgaagtctgtgcgggagaagtgggcccaggagcccctgctgcagcccctgagcctgcgggtgggcatgctgggggagaagctggaggccgccatccagaggagcctgcactacctgaagctgagtgaccccaagtacctgcgggagttccagctgaccctgcagcccggcttctggaagctgccccacgcctggatccacacagatgccagcctggtgtaccccaccttcggcccccaggacagcttcagcgaggagaggagtgatgtgtgcctggtgcagctgctgggcactggaacagacagcagcgagccctgtggcctgagtgacctgtgccgcagcctgatgaccaagccaggctgcagcggctactgcctgagccaccagctgctcttcttcctgtgggccaggatgaggggctgcacccagggccccctgcagcagagccaggactacatcaacctcttctgtgccaacatgatggacctgaacagaagagctgaggccatcggctacgcctaccccacccgggacatcttcatggagaacaacgtgacaggccaccctgtgttctacctgcccctgtgtgacagcttcctgccccccaaggccgcccctgtgacagagctgtacacagatggccctgtgatgttctgtggcatgggcggcttcagtgacttctacaagctgcgctggctggaggccatcctgtcctggcagaagcagcaggagggctgcttcggggagccagatgctgaagatgaggagctgagcaaggccatccagtaccagcagcacttcagccggcgggtgaagaggcgggagaagcagttcccagacagccgctctgtggcccaggccggcgtgcagtggaggaacctgggcagcctgcagcccctgcccccaggcttcaagcagttcagctgcctgatcctgcccagctcctgggactacagatctgtgcccccctacctggccaacttctacatcttcctggtggagaccggcttccaccacgtggcccacgccggcctggagctgctgatcagccgggacccccccaccagcggcagccagagcgtgggcctgtag

SEQ ID NO: 7105 - DNA, 555 bp, Artificial Sequence
  Description of Artificial Sequence: Synthetic coding sequence
atgatgtccttcctgctgggcgccatcctgaccctgctgtgggcccccacagcccaggccgaggtgctgctgcagcctgacttcaatgctgagaagttcagcggcctgtggtacgtggtgtccatggccagtgactgcagggtcttcctgggcaagaaggaccacctgtccatgagcacccgggccatccggcccacagaggagggcggcctgcacgtgcacatggagttccctggagcagatggctgcaaccaggtggatgctgagtacctgaaggtgggcagcgagggccacttccgggtgcctgccctgggctacctggatgtgagaattgtggacacagactacagcagctttgctgtgctgtacatctacaaggagctggagggcgccctgagcaccatggtgcagctgtacagcaggacccaggatgtgagcccccaggccctgaagagcttccaggacttctaccccaccctgggcctgcccaaggacatgatggtgatgctgccccagagtgatgcctgcaaccctgagagcaaggaggccccctag

SEQ ID NO: 7106 - DNA, 219 bp, Artificial Sequence; identical to SEQ ID NO: 7100
  Description of Artificial Sequence: Synthetic coding sequence

SEQ ID NO: 7107 - DNA, 2247 bp, Artificial Sequence
  Description of Artificial Sequence: Synthetic coding sequence
atgggccgggccggggctgctgctgtgattcctggcctggccctgctgtgggccgtgggcctgggcagcgctgcccccccaccccggctgcggctgtccttccaggagctgcaggcctggcacggcctgcagaccttcagcctggagaggacctgctgctaccaggccctgctggtggatgaggagcggggccgcctgtttgtgggcgcagaaaatcatgtggccagcctgaacctggacaacatcagcaagagggccaagaagctggcctggccagcccctgtggagtggagggaggagtgcaactgggccggcaaggacatcggcacagagtgcatgaactttgtgaagctgctgcacgcctacaacagaacccacctgctggcctgtggcaccggggccttccaccccacctgtgcctttgtggaggtgggccacagagctgaggagcctgtgctgcggctggaccccggcagaattgaagatggcaagggcaagagcccctatgaccccaggcacagagctgcctctgtgctggtgggggaggagctgtacagcggcgtggccgctgacctgatgggccgggacttcaccatcttccgcagcctgggccagaggcccagcctgaggacagagccccatgacagccgctggctgaatgagcccaagtttgtgaaggtgttctggatccctgagagcgagaacccagatgatgacaagatctacttcttcttccgggagacagctgtggaggccgccccagccctgggccgcctgtctgtgtcccgggtgggccagatctgcagaaatgatgtgggcggccagaggagcctggtgaacaagtggaccaccttcctgaaggcccggctggtgtgcagcgtgcctggggtggagggggacacccactttgaccagctgcaggatgtgttcctgctgagcagccgggaccacaggacccccctgctgtatgctgtgttcagcaccagcagcagcatcttccagggcagcgctgtgtgtgtgtacagcatgaatgatgtgagaagagccttcctgggcccctttgcccacaaggagggccccatgcaccagtgggtgtcctaccagggccgggtgccctacccccggcccggcatgtgccccagcaagaccttcggcaccttcagcagcaccaaggacttcccagatgatgtgatccagtttgccaggaaccaccccctgatgtacaacagcgtgctgcccaccggcggccggcccctcttcctgcaggtgggcgccaactacaccttcacccagattgctgctgacagagtggccgctgctgatggccactatgatgtgctcttcatcggcacagatgtgggcaccgtgctgaaggtgatctctgtgcccaagggcagccggcccagcgctgagggcctgctgctggaggagctgcacgtgtttgaggacagcgctgctgtgacctccatgcagatcagcagcaagaggcaccagctgtatgtggccagccgctctgctgtggcccagatcgccctgcaccgctgtgccgcccacggccgggtgtgcacagagtgctgcctggcccgggacccctactgtgcctgggatggagtggcctgcacccgcttccagcccagcgccaagaggcgcttccggcggcaggatgtgagaaatggagaccccagcaccctgtgcagcggggacagcagcaggcctgccctgctggagcacaaggtgtttggagtggagggcagcagcgccttcctggagtgtgagcccaggagcctgcaggcccgggtggagtggaccttccagagagctggggtgacagcccacacccaggtgctggccgaggagaggacagagaggacagcccggggcctgctgctgcggcggctgcggcggcgggacagcggcgtgtacctgtgtgccgctgtggagcagggcttcacccagcccctgcggcggctgagcctgcacgtgctgagcgccacccaggccgagcggctggcccgggcagaggaggccgccccagctgcccctcctggccccaagctgtggtacagagacttcctgcagctggtggagcccggcggcggcggcagcgccaacagcctgaggatgtgccggccccagcctgccctgcagagcctgcccctggagagcagaagaaaaggaagaaacagaaggacccacgcccctgagcccagggctgagcggggccccaggtctgccacccactggtag

SEQ ID NO: 7108 - DNA, 369 bp, Artificial Sequence
  Description of Artificial Sequence: Synthetic coding sequence
atggtgctgctgtgcctcttcctggccagcctggccgccacccccagggctggggtgactggagcctggcccaccagcggcctgagcatcctggcccagctgcagcccagctgtgagctgcgctggacccagctgagccgcagctcctggagggacctggtgatgaccaccagcctgtggagcctggcctacttccagcacttcagccaggagaccaccacccaggagcagctggatgagatggaggagatcccccgggagagccagtgtggccggcaggacttccacgccctgagctgccccacagccagcccccgggacagagtgctgctgtgctgccccggctggagggccatggtgcccagctag

SEQ ID NO: 7109 - DNA, 570 bp, Artificial Sequence
  Description of Artificial Sequence: Synthetic coding sequence
atgctgctgggccagctgagcaccctgctgtgcctgctgagcggggccctgcccactggaagtggccggcctgagccccagagcccccggccccagagctgggccgccgccaaccagacctgggccctgggccctggggccctgccccccctggtgcctgccagcgccctgggctcctggaaggccttcctgggcctgcagaaggcccggcagctgggcatgggccgcctgcagaggggccaggatgaggtggccgctgtgaccctgcccctgaacccccaggaggtgatccagggcatgtgcaaggctgtgccctttgtgcaggtgttcagcaggcctggctgcagcgccatccggctgaggaaccacctgtgcttcggccactgcagcagcctgtacatccctggcagtgaccccacccccctggtgctgtgcaacagctgcatgcctgccaggaagcgctgggcccctgtggtgctgtggtgcctgaccggcagcagcgccagcagaagaagagtgaagatcagcaccatgctgattgagggctgccactgcagccccaaggcctag

SEQ ID NO: 7110 - DNA, 2505 bp, Artificial Sequence
  Description of Artificial Sequence: Synthetic coding sequence
atgaagcacaccctggccctgctggcccccctgctgggcctgggcctgggcctggccctgagccagctggccgccggggccacagactgcaagttcctgggccctgctgagcacctgaccttcaccccagctgcccgggcccgctggctggccccccgggtgcgggcccctggcctgctggacagcctgtatggcaccgtgcggcgcttcctgtctgtggtgcagctgaaccccttccccagcgagctggtgaaggccctgctgaatgagctggcctctgtgaaggtgaatgaggtggtgcgctatgaggccggctacgtggtgtgtgctgtgattgctggcctgtacctgctgctggtgcccacagctggcctgtgcttctgctgctgccgctgccaccggcgctgtggcggccgggtgaagacagagcacaaggccctggcctgtgagcgggccgccctgatggtgttcctgctgctgaccaccctgctgctgctgattggagtggtgtgtgcctttgtgaccaaccagaggacccatgagcagatgggccccagcattgaggccatgcctgagaccctgctgagcctgtggggcctggtgtctgatgtgccccaggagctgcaggccgtggcccagcagttcagcctgccccaggagcaggtgtctgaggagctggatggagtgggcgtgtccatcggcagcgccatccacacccagctgcggagctctgtgtaccccctgctggccgctgtgggcagcctgggccaggtgctgcaggtgtctgtgcaccacctgcagaccctgaatgccaccgtggtggagctgcaggccggccagcaggacctggagcccgccatccgggagcaccgggaccggctgctggagctgctgcaggaggcccgctgccagggcgactgtgccggggccctgtcctgggcccggaccctggagctgggcgctgacttcagccaggtgcccagcgtggaccacgtgctgcaccagctgaagggcgtgcctgaggccaacttcagctccatggtgcaggaggagaacagcaccttcaatgccctgcctgccctggccgccatgcagaccagctctgtggtgcaggagctgaagaaggctgtggcccagcagcctgagggcgtgaggaccctggccgagggcttccctggcctggaggccgccagccgctgggcccaggccctgcaggaggtggaggagagcagccggccctacctgcaggaggtgcagagatatgagacctaccgctggatcgtgggctgtgtgctgtgcagcgtggtgctgtttgtggtgctgtgcaacctgctgggcctgaacctgggcatctggggcctgagcgccagagatgaccccagccaccctgaggccaagggggaggccggggcccgcttcctgatggccggcgtgggcctgtccttcctgtttgctgcccccctcatcctgctggtgtttgccaccttcctggtgggcggcaatgtgcagaccctggtgtgccagagctgggagaatggagagctgtttgaatttgctgacaccccaggcaacctgccccccagcatgaacctgagccagctgctgggcctgaggaagaacatcagcatccaccaggcctaccagcagtgcaaggagggcgccgccctgtggacagtgctgcagctgaatgacagctatgacctggaggagcacctggacatcaaccagtacaccaacaagctgcggcaggagctgcagagcctgaaggtggacacccagagcctggacctgctgagcagcgctgcccggcgggacctggaggccctgcagagcagcggcctgcagaggatccactacccagacttcctggtgcagatccagaggcctgtggtgaagacctccatggagcagctggcccaggagctgcagggcctggcccaggcccaggacaacagcgtgctgggccagaggctgcaggaggaggcccagggcctgaggaacctgcaccaggagaaggtggtgccccagcagagcctggtggccaagctgaacctgtctgtgcgggccctggagagcagcgcccccaacctgcagctggagaccagtgatgtgctggccaacgtgacctacctgaagggggagctgcctgcctgggccgcccgcatcctgagaaatgtgtctgagtgcttcctggcccgggagatgggctacttcagccagtatgtggcctgggtgcgggaggaggtgacccagagaattgccacctgccagcccctgagcggggccctggacaacagcagggtcatcctgtgtgacatgatggctgacccctggaatgccttctggttctgcctggcctggtgcaccttcttcctgatccccagcatcatctttgctgtgaagaccagcaagtacttccggcccatcaggaagaggctgagcagcaccagcagcgaggagacccagctgttccacatcccccgggtgaccagcctgaagctgtag

SEQ ID NO: 7111 - DNA, 2505 bp, Artificial Sequence; identical to SEQ ID NO: 7110
  Description of Artificial Sequence: Synthetic coding sequence

SEQ ID NO: 7112 - DNA, 216 bp, Artificial Sequence
  Description of Artificial Sequence: Synthetic coding sequence
atgacccagctgctgctcttcctggtggccctgctggtgctgggccacgtgcccagcggccgctctgagttcaagcgctgctggaagggccagggcgcctgccagacctactgcacccggcaggagacctacatgcacctgtgcccagatgccagcctgtgctgcctgtcctatgccctgaagcccccacctgtgcccaagcatgaatatgaatag

SEQ ID NO: 7113 - DNA, 1377 bp, Artificial Sequence
  Description of Artificial Sequence: Synthetic coding sequence
atggaggccaccggcacagatgaggtggacaagctgaagaccaagttcatcagcgcctggaacaacatgaagtacagctgggtgctgaagaccaagacctacttcagcaggaacagccctgtgctgctgctgggcaagtgctaccacttcaagtatgaagatgaggacaagaccctgcctgctgagagcggctgcaccatcgaggaccacgtgattgctggaaatgtggaggagttcaggaaggacttcatcagccgcatctggctgacctaccgggaggagttcccccagatcgagggcagcgccctgaccacagactgtggctggggctgcaccctgaggacaggccagatgctgctggcccagggcctcatcctgcacttcctgggccgggcctggacctggccagatgccctgaacatcgagaacagcgacagcgagagctggaccagccacacagtgaagaagttcaccgccagctttgaggccagcctgagcggggagcgggagttcaagacccccaccatcagcctgaaggagaccatcggcaagtacagtgatgaccacgagatgagaaatgaggtgtaccacaggaagatcatctcctggtttggagacagccccctggccctgtttggcctgcaccagctgattgaatatggcaagaagagcggcaagaaggccggggactggtacggccctgctgtggtggcccacatcctgaggaaggctgtggaggaggcccggcacccagacctgcagggcatcaccatctacgtggcccaggactgcaccgtgtacaacagtgatgtgattgacaagcagagcgcctccatgaccagtgacaatgctgatgacaaggccgtcatcatcctggtgcctgtgcggctgggcggggagaggaccaacacagactacctggagtttgtgaagggcatcctgagcctggagtactgtgtgggcatcattggaggcaagcccaagcagagctactactttgctggcttccaggatgacagcctcatctacatggacccccactactgccagagctttgtggatgtgtccatcaaggacttccccctggagaccttccactgccccagccccaagaagatgtccttcaggaagatggaccccagctgcaccatcggcttctactgcagaaatgtgcaggacttcaagagggccagcgaggagatcaccaagatgctgaagttcagcagcaaggagaagtaccccctcttcacctttgtgaatggccacagccgggactatgacttcaccagcaccaccaccaatgaggaggacctcttctctgaagatgagaagaagcagctgaagcgcttcagcacagaggagtttgtgctgctgtag

SEQ ID NO: 7114 - DNA, 342 bp, Artificial Sequence
  Description of Artificial Sequence: Synthetic coding sequence
atgaggcagaggctgctgcccagcgtgaccagcctgctgctggtggccctgctcttccctggcagcagccaggcccggcacgtgaaccacagcgccacagaggccctgggggagctgcgggagcgggcccctggccagggcaccaacggcttccagctgctgcggcatgctgtgaagagggacctgctgccccccaggaccccaccctaccaggagcccgccagtgacctgaaggtggtggactgcagaagaagtgagggcttctgccaggagtactgcaactacatggagacccaggtgggctactgcagcaagaagaaggatgcctgctgcctgcactag

SEQ ID NO: 7115 - DNA, 258 bp, Artificial Sequence
  Description of Artificial Sequence: Synthetic coding sequence
atgaagaaggtgctgctgctgatcacagccatcctggccgtggccgtgggcttccctgtgtcccaggaccaggagcgggagaagaggagcatcagtgacagtgatgagctggccagcggcttctttgtgttcccctacccctaccccttccggcccctgccccccatccccttcccccgcttcccctggttcagaagaaacttccccatccccatccctgagagcgcccccaccacccccctgcccagcgagaagtag

SEQ ID NO: 7116 - DNA, 264 bp, Artificial Sequence
  Description of Artificial Sequence: Synthetic coding sequence
atggctgtgtctgtgctgcggctgactgtggtgctgggcctgctggtgctcttcctgacctgctacgcagatgacaagccagacaagccagatgacaagccagatgattctgggaaggaccccaagccagacttccccaagttcctgagcctgctgggcacagagatcattgaaaatgctgtggagttcatcctgcgctccatgagccgcagcacaggcttcatggagtttgatgacaatgaaggcaagcacagcagcaagtag

SEQ ID NO: 7117 - DNA, 945 bp, Artificial Sequence
  Description of Artificial Sequence: Synthetic coding sequence
atgagcagcgaggccgagacccagcagcccccagctgcccccccagctgccccagccctgtctgctgctgacaccaagccaggcaccaccggggcccagggcgctgtggcccgggcccacatcggcggggccggcggggacaagaaggtgattgccaccaaggtgctgggcaccgtgaagtggttcaacgtgagaaatggctacggcttcatcaacagaaatgacaccaaggaggatgtgtttgtgcaccagacagccatcaagaagaacaaccccaggaagtacctgcggtctgtgggagatggagagaccgtggagtttgatgtggtggagggggagaagggagctgaggccgccaacgtgacaggccctgggggcgtgcctgtgcagggcagcaaatatgctgctgacaggaaccactaccgccgctaccccaggagaagaggcccccccaggaactaccagcagaactaccagaacagcgagagcggggagaagaatgaaggcagcgagagcgcccctgagcggcccaacaatgccggcccccaggccaaggtgcccaccctgctgcacgccgagtatggccggcggccccagtacagcaacccccctgtgcagggcgaggtgatggagggcgctgacaaccagggcgctggggagcagggccggcctgtgcggcagtgcattggagacatcgaccatgacagcgctggggccctgctggcccggcagcccagagaagatggaaatgaggaggacaaggagaaccagggagatgagacccagggccagcagcccccccagaggcgctacagaagaaacttcaactacagaagaagaagacctgagaaccccaagccccaggacggcaaggagaccaaggctgctgaccccccagctgagaacagcagcgcccctgaggccgagcagggcggcgctgagtag

SEQ ID NO: 7118 - DNA, 636 bp, Artificial Sequence
  Description of Artificial Sequence: Synthetic coding sequence
atggtgttcctgaagttcttctgcatgtccttcttctgccacctgtgccagggctactttgatggccccctgtacccagagatgagcaatggcaccctgcaccactactttgtgcctgatggagactatgaagaaaatgatgatcctgagaagtgccagctgctcttccgggtgtctgaccaccggcgctgcagccagggcgagggcagccaggtgggcagcctgctgagcctgaccctgcgggaggagttcaccgtgctgggccggcaggtggaggatgctggccgggtgctggagggcatcagcaagagcatctcctatgacctggatggagaggagagctatggcaagtacctgcggcgggagagccaccagattggagatgcctacagcaacagcgacaagagcctgacagagctggagagcaagttcaagcagggccaggagcaggacagccggcaggagagccggctgaatgaagacttcctgggcatgctggtgcacaccaggagcctgctgaaggagaccctggacatctctgtgggcctgcgggacaagtatgagctgctggccctgaccatccgcagccacggcacccggctgggccgcctgaagaatgactacctgaaggtgtag

SEQ ID NO: 7119 - DNA, 1566 bp, Artificial Sequence
  Description of Artificial Sequence: Synthetic coding sequence
atgctgtgtgccctgctgctgctgcccagcctgctgggcgccacccgggccagccccaccagcggcccccaggagtgtgccaagggcagcacagtgtggtgccaggacctgcagacagctgcccgctgtggggctgtgggctactgccagggcgctgtgtggaacaagcccacagccaagagcctgccctgtgatgtgtgccaggacattgctgctgctgctggaaatggcctgaacccagatgccacagaaagtgacatcctggccctggtgatgaagacctgtgagtggctgcccagccaggagagcagcgctggctgcaagtggatggtggatgcccacagcagcgccatcctgtccatgctgcggggggccccagacagcgccccagcccaggtgtgcacagccctgagcctgtgtgagcccctgcagaggcacctggccaccctgcggcccctgagcaaggaggacacctttgaagctgtggcccccttcatggccaacggccccctgaccttccacccccggcaggcccctgagggcgccctgtgccaggactgtgtgcggcaggtgtcccggctgcaggaggccgtgcgcagcaacctgaccctggccgacctgaacatccaggagcagtgtgagagcctgggccctggcctggccgtgctgtgcaagaactacctgttccagttctttgtgcctgctgaccaggccctgcggctgctgcccccccaggagctgtgcaggaagggcggcttctgtgaggagctgggcgccccagcccggctgacccaggtggtggccatggatggagtgcccagcctggagctgggcctgcccaggaagcagagcgagatgcagatgaaggccggcgtgacctgtgaggtgtgcatgaatgtggtgcagaagctggaccactggctgatgagcaacagcagcgagctgatgatcacccacgccctggagcgggtgtgcagcgtgatgcctgccagcatcaccaaggagtgcatcatcctggtggacacctacagccccagcctggtgcagctggtggccaagatcaccccagagaaggtgtgcaagttcatccggctgtgtggcaacagaagaagagcccgggctgtgcatgatgcctatgccatcgtgcccagccctgagtgggatgctgagaaccagggcagcttctgcaatggctgcaagaggctgctgactgtgagcagccacaacctggagagcaagagcaccaagagggacatcctggtggccttcaagggcggctgcagcatcctgcccctgccctacatgatccagtgcaagcactttgtgacccagtatgagcctgtgctgattgagagcctgaaggacatgatggaccctgtggccgtgtgcaagaaggtgggcgcctgccacggccccaggacccccctgctgggcacagaccagtgtgccctgggccccagcttctggtgccgcagccaggaggccgccaagctgtgcaatgctgtgcagcactgccagaagcacgtgtggaaggagatgcacctgcatgctggggagcacgcctag

SEQ ID NO: 7120 - DNA, 2127 bp, Artificial Sequence
  Description of Artificial Sequence: Synthetic coding sequence
atggctgctgctgctgtggccgctgctgctgctgctgctgctgctgccagcctgcaggtgctggagatggagagcatggagacagctgctgctggcagcgctggcctggccgctgaggtgcggggcagcggcaccgtggactttggacctggccctggcatcagcgccatggaggccagcggcggggaccccggccctgaggctgaagattttgagtgcagcagccactgcagcgagctgtcctggaggcagaatgagcagaggcggcagggcctcttctgtgacatcaccctgtgcttcggcggggccggcggccgggagttccgggcccacaggtctgtgctggccgccgccacagagtacttcacccccctgctgagcggccagttcagcgagagccgcagcggccgggtggagatgaggaagtggagcagcgagcccggccctgagccagacacagtggaggccgtcatcgagtacatgtacacaggccgcatccgggtgtccacaggctctgtgcatgaggtgctggagctggccgaccgcttcctgctgatccggctgaaggagttctgtggggagttcctgaagaagaagctgcacctgagcaactgtgtggccatccacagcctggcccacatgtacaccctgagccagctggccctgaaggctgctgacatgatcagaagaaacttccacaaggtgatccaggatgaggagttctacaccctgcccttccacctgatccgggactggctgagtgacctggagatcaccgtggacagcgaggaggtgctgtttgaaacagtgctgaagtgggtgcagagaaatgctgaggagcgggagcgctactttgaggagctgttcaagctgctgcggctgagccagatgaagcccacctacctgaccaggcatgtgaagccagagcggctggtggccaacaatgaggtgtgtgtgaagctggtggctgatgctgtggagagacatgccctgcgggcagagaacatccagagcggcacctgccagcaccccaccagccacgtgtccctgctgcccaggtatggccagaacatggatgtgatcatggtgattggaggagtgtctgagggcggggactacctgtctgaatgtgtgggctactttgtggatgaggaccgctgggtgaacctgccccacatccacaaccacctggatggccatgctgtggccgtgacagagagctatgtgtatgtggccggctccatggagcccggctttgccaagacagtggagcgctacaaccccaacctgaacacctgggagcacgtgtgcagcctgatgaccaggaagcacagctttggcctgacagaggtgaagggcaagctgtacagcatcggcggccacggcaacttcagccctggcttcaaggatgtgacagtgtacaaccctgagctggacaagtggcacaacctggagagcgcccccaagatcctgagagatgtgaaggccctggccatcgaggacagatttgtgtacatcgccgcccggacccctgtggaccgggacacagaagatggcctgaaggccgtcatcacctgctatgacacagagacccggcagtggcaggatgtggagagcctgcccctgattgacaactactgcttcttccagatgtctgtggtgaacagcaacttctaccagacagccagctgctgccccaagagctactgcctggagaatgaggaggccgtgaggaagatcgccagccaggtgtctgatgagatcctggagagcctgcccccagaggtgctgagcattgaaggagctgccatctgctactacaaggatgatgtgttcatcatcggcggctggaagaacagtgatgacatcgacaagcagtacaggaaggaggcctaccgctactgtgccgagaggaagcgctggatgctgctgccccccatgccccagccccgctgccgggccacagcctgccacgtgcgcatcccctaccgctacctgcacggcacccagcgctaccccatgccccagaacctgatgtggcagaaggaccgcatccggcagatgcaggagatccacagacatgccctgaacatgagaagagtgcccagcagccagattgaatgttag

SEQ ID NO: 7121 - DNA, 1578 bp, Artificial Sequence
  Description of Artificial Sequence: Synthetic coding sequence
atgagcggcaactgggtgcaccctggccagatcctgatctgggccatctgggtgctggccgcccccaccaagggccccagcgctgagggcccccagaggaacacccggctgggctggatccagggcaagcaggtgacagtgctgggcagccctgtgcctgtgaatgtgttcctgggcgtgccctttgctgccccacccctgggcagcctgcgcttcaccaacccccagcctgccagcccctgggacaacctgcgggaggccaccagctaccccaacctgtgcctgcagaacagcgagtggctgctgctggaccagcacatgctgaaggtgcactaccccaagtttggagtgtctgaggactgcctgtacctgaacatctatgccccagcccacgccgacaccggcagcaagctgcctgtgctggtgtggttccctggaggagccttcaagacaggcagcgccagcatctttgatggcagcgccctggccgcctatgaagatgtgctggtggtggtggtgcagtaccgcctgggcatcttcggcttcttcaccacctgggaccagcacgcccctggcaactgggccttcaaggaccaggtggccgccctgtcctgggtgcagaagaacatcgagttctttggaggagaccccagctctgtgaccatctttggagagagcgctggggccatctctgtgagcagcctcatcctgagccccatggccaagggcctcttccacaaggccatcatggagagcggcgtggccatcatcccctacctggaggcccatgactatgagaagtctgaggacctgcaggtggtggcccacttctgtggcaacaatgccagtgacagcgaggccctgctgcgctgcctgcggaccaagcccagcaaggagctgctgaccctgagccagaagaccaagagcttcaccagggtggtggatggagccttcttccccaatgagcccctggacctgctgagccagaaggccttcaaggccatccccagcatcattggagtgaacaaccatgaatgtggcttcctgctgcccatgaaggaggcccctgagatcctgagcggcagcaacaagagcctggccctgcacctgatccagaacatcctgcacatccccccccagtacctgcacctggtggccaatgagtacttccatgacaagcacagcctgacagagatccgggacagcctgctggacctgctgggagatgtgttctttgtggtgcctgccctgatcacagcccgctaccaccgggagggcgccacagaggaggagaagctgctgagcaggaagatgatgaagtactgggccacctttgccaggacaggcaaccccaatggaaatgacctgagcctgtggccagcctacaacctgacagagcagtacctgcagctggacctgaacatgagcctgggccagaggctgaaggagccccgggtggacttctggaccagcaccatccccctcatcctgagcgccagtgacatgctgcacagccccctgagcagcctgaccttcctgagcctgctgcagcccttcttcttcttctgtgccccctag

SEQ ID NO: 7122 - DNA, 900 bp, Artificial Sequence
  Description of Artificial Sequence: Synthetic coding sequence
atggtgcgctgcctgggccctgccctgctgctgctgctgctgctgggcagcgccagctctgtgggcggcaacagatgtgtggatgctgctgaggcctgcacagcagatgcccgctgccagaggctgcggagtgaatatgtggcccagtgcctgggccgggccgcccagggcggctgcccccgggcccgctgcagaagagccctgcggcgcttctttgcccggggccccccagccctgacccacgccctgctcttctgcccctgtgccggccctgcctgtgccgagcggcggcggcagacctttgtgcccagctgtgccttcagcggccctggccctgccccacccagctgcctggagcccctgaacttctgtgagaggagccgggtgtgccgctgtgcccgggctgctgctggcccctggaggggctggggccggggcctgagccctgcccacaggcctcctgctgcccaggccagccccccaggcctgagcggcctggtgcaccccagcgcccagaggccccggcggctgcctgctggccctggccggcccctgcctgcccggctgcggggcccccggggcgtgcctgctggaacagctgtgacccccaactacgtggacaacgtgtctgcccgggtggccccctggtgtgactgtggggccagcggcaacagaagagaggactgtgaggccttccggggcctcttcaccaggaaccgctgcctggatggagccatccaggcctttgccagcggctggccccctgtgctgctggaccagctgaacccccagggcgaccctgagcacagcctgctgcaggtgagcagcacaggccgggccctggagaggaggagcctgctgagcatcctgcctgtgctggccctgcctgccctgctgtag

SEQ ID NO: 7123 - DNA, 270 bp, Artificial Sequence
  Description of Artificial Sequence: Synthetic coding sequence
atgcaggcctgcatggtgcccggcctggccctgtgcctgctgctgggccccctggccggggccaagcctgtgcaggaggagggggacccctatgcagagctgcctgccatgccctactggcccttcagcaccagtgacttctggaactacgtgcagcacttccaggccctgggcgcctacccccagatcgaggacatggcccggaccttctttgcccacttccccctgggcagcaccctgggcttccacgtgccctaccaggaggactag

SEQ ID NO: 7124 - DNA, 663 bp, Artificial Sequence
  Description of Artificial Sequence: Synthetic coding sequence
atggccagcgagcggctgcccaacagacctgcctgcctgctggtggccagcggggctgctgagggcgtgtctgcccagagcttcctgcactgcttcaccatggccagcacagccttcaacctgcaggtggccacccctgggggcaaggccatggagtttgtggatgtgacagagagcaatgcccgctgggtgcaggacttccggctgaaggcctatgccagccctgccaagctggagagcattgatggagcccgctaccacgccctgctgatccccagctgccctggggccctgacagacctggccagcagcggcagcctggcccgcatcctgcagcacttccacagcgagagcaagcccatctgtgctgtgggccacggcgtggccgccctgtgctgtgccaccaatgaagatcgctcctgggtgtttgacagctacagcctgaccggccccagcgtgtgtgagctggtgcgggcccctggctttgcccggctgcccctggtggtggaggactttgtgaaggacagcggggcctgcttcagcgccagcgagccagatgctgtgcacgtggtgctggacagacacctggtgacaggccagaatgccagcagcacagtgcctgctgtgcagaacctgctcttcctgtgtggcagcaggaagtag

SEQ ID NO: 7125 - DNA, 1158 bp, Artificial Sequence
  Description of Artificial Sequence: Synthetic coding sequence
atgtggggcttccggctgctgcggagcccccccctgctgctgctgctgccccagctgggcattggaaatgccagcagctgcagccaggcccggaccatgaaccctgggggcagcggcggggcccgctgcagcctgtctgctgaggtgagaagacggcagtgcctgcagctgagcacagtgcctggagctgacccccagaggagcaatgagctgctgctgctggccgctgctggggagggcctggagcggcaggacctgcccggggaccctgccaaggaggagccccagcccccaccccagcaccacgtgctgtacttccctggagatgtgcagaactaccacgagatcatgaccaggcaccctgagaactaccagtgggagaactggagcctggagaatgtggccaccatcctggcccaccgcttccccaacagctacatctgggtgatcaagtgcagcaggatgcacctgcacaagttcagctgctatgacaactttgtgaagagcaacatgtttggagcccctgagcacaacacagactttggagccttcaagcacctgtacatgctgctggtgaatgccttcaacctgagccagaacagcctgagcaagaagagcctgaatgtgtggaacaaggacagcatcgccagcaactgccgcagcagccccagccacaccaccaacggctgccagggcgagaaggtgaggacctgtgagaagagtgatgagagcgccatgtccttctacccacccagcctgaatgatgccagcttcaccctgattggcttcagcaagggctgtgtggtgctgaaccagctgctgtttgagctgaaggaggccaagaaggacaagaacattgatgccttcatcaagagcatccgcaccatgtactggctggatggcggccacagcggcggcagcaacacctgggtgacctacccagaggtgctgaaggagtttgcccagacaggcatcatcgtgcacacccacgtgaccccctaccaggtgcgggaccccatgaggtcctggattggcaaggagcacaagaagtttgtgcagatcctgggggacctgggcatgcaggtgaccagccagatccacttcaccaaggaggcccccagcattgagaaccacttccgggtgcatgaggtgttctag

SEQ ID NO: 7126 - DNA, 936 bp, Artificial Sequence
  Description of Artificial Sequence: Synthetic coding sequence
atgagaggagctgcccgggccgcctggggccgggccggccagccctggccccggcccccagcccctggccccccacctccacccctgcccctgctgctgctgctgctggccggcctgctgggcggggccggggcccagtacagcagtgaccgctgctcctggaagggcagcggcctgacccatgaggcccacaggaaggaggtggagcaggtgtacctgcgctgtgccgccggggctgtggagtggatgtaccccaccggggccctgattgtgaacctgcggcccaacaccttcagccctgcccggcacctgactgtgtgcatccgctccttcacagacagcagcggggccaacatctacctggagaagacaggagagctgcggctgctggtgcctgatggagatggccggcccggccgggtgcagtgcttcggcctggagcagggcggcctgtttgtggaggccaccccccagcaggacattggaagaaggaccaccggcttccagtatgagctggtgcggcggcaccgggccagtgacctgcacgagctgagcgccccctgccggccctgcagcgacacagaggtgctgctggccgtgtgcaccagtgactttgctgtgcggggcagcatccagcaggtgacccatgagcctgagcggcaggacagcgccatccacctgcgggtgtcccggctgtaccggcagaagagccgggtgtttgagcctgtgcctgaaggagatggccactggcagggccgggtgaggaccctgctggagtgtggggtgcggcccggccacggggacttcctgttcaccggccacatgcactttggagaggcccggctgggctgtgccccccgcttcaaggacttccagaggatgtacagagatgcccaggagcggggcctgaacccctgtgaggtgggcacagactag

SEQ ID NO: 7127 - DNA, 1221 bp, Artificial Sequence
  Description of Artificial Sequence: Synthetic coding sequence
atgggccccagcacccccctgctgatcctcttcctgctgtcctggagcggccccctgcagggccagcagcaccacctggtggagtacatggagcggcggctggccgccctggaggagcggctggcccagtgccaggaccagagcagcagacatgctgctgagctgcgggacttcaagaacaagatgctgcccctgctggaggtggccgagaaggagcgggaggccctgaggacagaggccgacaccatcagcggccgggtggaccggctggagcgggaggtggactacctggagacccagaacccagccctgccctgtgtggagtttgatgagaaggtgactggaggccctggcaccaagggcaagggcagaagaaatgagaagtatgacatggtgacagactgtggctacaccatcagccaggtgcgctccatgaagatcctgaagagatttggaggccctgctggcctgtggaccaaggaccccctgggccagacagagaagatctacgtgctggatggcacccagaatgacacagcctttgtgttcccccggctgcgggacttcaccctggccatggccgccaggaaggccagccgggtgcgggtgcccttcccctgggtgggcaccggccagctggtgtatggaggcttcctgtactttgcccggcggcccccaggccggcctgggggcggcggggagatggagaacaccctgcagctgatcaagttccacctggccaacagaacagtggtggacagctctgtgtttcctgctgagggcctcatccccccctacggcctgacagctgacacctacatcgacctggccgcagatgaggagggcctgtgggccgtgtatgccaccagagaagatgacagacacctgtgcctggccaagctggacccccagaccctggacacagagcagcagtgggacaccccctgccccagagaaaatgctgaggccgcctttgtgatctgtggcaccctgtatgtggtgtacaacaccaggcctgccagccgggcccgcatccagtgcagctttgatgccagcggcaccctgaccccagagcgggccgccctgccctacttccccaggagatatggagcccacgccagcctgcgctacaacccccgggagcggcagctgtatgcctgggatgatggctaccagatcgtgtacaagctggagatgaggaagaaggaggaggaggtgtag

SEQ ID NO: 7128 - DNA, 900 bp, Artificial Sequence
  Description of Artificial Sequence: Synthetic coding sequence
atgggcggcccccgggccctgctggccgccctgtgggccctggaggccgccggcacagctgccctgcgcatcggggccttcaacatccagagctttggagacagcaaggtgtctgaccctgcctgtggcagcatcatcgccaagatcctggccggctatgacctggccctggtgcaggaggtgcgggaccctgacctgtctgctgtgtctgccctgatggagcagatcaacagcgtgtctgagcacgagtacagctttgtgagcagccagcccctgggccgggaccagtacaaggagatgtacctgtttgtgtacaggaaggatgctgtgtctgtggtggacacctacctgtacccagaccctgaagatgtgttcagccgggagccctttgtggtgaagttcagcgcccctggcactggagagcgggccccacccctgcccagcagaagagccctgaccccaccacccctgcctgctgctgcccagaacctggtgctgatccccctgcatgctgccccccaccaggccgtggccgagattgatgccctgtatgatgtgtacctggatgtgattgacaagtggggcacagatgacatgctgttcctgggggacttcaatgctgactgcagctatgtgcgggcccaggactgggccgccatccggctgcggagcagcgaggtgttcaagtggctgatcccagattctgctgacaccaccgtgggcaacagcgactgtgcctatgaccgcatcgtggcctgtggggcccggctgcggcgcagcctgaagccccagagcgccaccgtgcatgacttccaggaggagtttggcctggaccagacccaggccctggccatcagtgaccacttccctgtggaggtgaccctgaagttccacaggtag

SEQ ID NO: 7129 - DNA, 1617 bp, Artificial Sequence
  Description of Artificial Sequence: Synthetic coding sequence
atgggctgcctgtggggcctggccctgcccctcttcttcttctgctgggaggtgggcgtgtctggcagcagcgctggccccagcacccggcgggctgacacagccatgaccacagatgacacagaggtgcctgccatgaccctggcccctggccatgctgccctggagacccagaccctgtctgctgagaccagcagccgggccagcaccccagctggccccatccctgaggccgagaccaggggggccaagaggatcagccctgcccgggagaccaggagcttcaccaagaccagccccaacttcatggtgctgattgccacctctgtggagaccagcgctgccagcggcagccctgagggcgccggcatgaccaccgtgcagaccatcactggaagtgacccccgggaggccatctttgacaccctgtgcacagatgacagcagcgaggaggccaagaccctgaccatggacatcctgaccctggcccacaccagcacagaggccaagggcctgagcagcgagagcagcgccagcagtgacagcccccaccctgtgatcacccccagccgggccagcgagagcagcgccagcagtgatggcccccaccctgtgatcacccccagccgggccagcgagagcagcgccagcagtgatggcccccaccctgtgatcacccccagctggagccctggcagtgatgtgaccctgctggccgaggccctggtgacagtgaccaacatcgaggtgatcaactgcagcatcacagaaattgagaccaccaccagcagcatccctggggccagtgacacagacctgatccccacagagggcgtgaaggccagcagcaccagtgaccccccagccctgcctgacagcacagaggccaagccccacatcacagaggtgacagccagcgctgagaccctgagcacagctggcaccacagagagcgctgccccagatgccaccgtgggcacccccctgcccaccaacagcgccacagagcgggaggtgacagcccctggggccaccaccctgagcggggccctggtgacagtgtccaggaaccccctggaggagaccagcgccctgtctgtggagacccccagctatgtgaaggtgtctggggccgcccctgtgtccattgaagctggcagcgctgtgggcaagaccaccagctttgctggcagcagcgccagcagctacagccccagcgaggccgccctgaagaacttcacccccagcgagacccccaccatggacatcgccaccaagggccccttccccaccagccgggaccccctgcccagcgtgccccccaccaccaccaacagcagccggggcaccaacagcaccctggccaagatcaccaccagcgccaagaccaccatgaagcccccaacagccacccccaccacagcccggacccggcccaccacagatgtgtctgctggagaaaatggaggcttcctgctgctgcggctgtctgtggccagccctgaggacctgacagacccccgggtggccgagcggctgatgcagcagctgcaccgggagctgcacgcccacgccccccacttccaggtgtccctgctgcgggtgcggcggggctag

SEQ ID NO: 7130 - DNA, 975 bp, Artificial Sequence
  Description of Artificial Sequence: Synthetic coding sequence
atgagcagcgaggccgagacccagcagcccccagctgcccccccagctgccccagccctgtctgctgctgacaccaagccaggcaccaccggcagcggggccggcagcggcggccctgggggcctgaccagcgctgccccagctggaggagacaagaaggtgattgccaccaaggtgctgggcaccgtgaagtggttcaacgtgagaaatggctacggcttcatcaacagaaatgacaccaaggaggatgtgtttgtgcaccagacagccatcaagaagaacaaccccaggaagtacctgcggtctgtgggagatggagagaccgtggagtttgatgtggtggagggggagaagggagctgaggccgccaacgtgacaggccctgggggcgtgcctgtgcagggcagcaaatatgctgctgacaggaaccactaccgccgctaccccaggagaagaggcccccccaggaactaccagcagaactaccagaacagcgagagcggggagaagaatgaaggcagcgagagcgcccctgagggccaggcccagcagaggcggccctacagaagaagacgcttccccccctactacatgagaagaccctacggccggcggccccagtacagcaacccccctgtgcagggcgaggtgatggagggcgctgacaaccagggcgctggggagcagggccggcctgtgcggcagaacatgtaccggggctaccggccccgcttccggcggggccccccccggcagaggcagcccagagaagatggaaatgaggaggacaaggagaaccagggagatgagacccagggccagcagcccccccagaggcgctacagaagaaacttcaactacagaagaagaagacctgagaaccccaagccccaggacggcaaggagaccaaggctgctgaccccccagctgagaacagcagcgcccctgaggccgagcagggcggcgctgagtag

SEQ ID NO: 7131 - DNA, 210 bp, Artificial Sequence
  Description of Artificial Sequence: Synthetic coding sequence
atgaggatcttctactacctgcacttcctgtgctacgtgaccttcatcctgcctgccacctgcaccctggtgaatgctgaccgctgcaccaagagatatggccgctgcaagagggactgcctggagagcgagaagcagattgacatctgcagcctgcccaggaagatctgctgcacagagaagctgtatgaagaagatgacatgttttag

SEQ ID NO: 7132 - DNA, 342 bp, Artificial Sequence
  Description of Artificial Sequence: Synthetic coding sequence
atgaagctgctgaccaccatctgccgcctgaagctggagaagatgtacagcaagaccaacaccagcagcaccatctttgagaaggcccggcatggaacagagaagatcagcacagcccggtctgagggccaccacatcaccttcagccgctggaagagctgcacagccatcggcggccgctgcaagaaccagtgtgatgacagcgagttccgcatctcctactgtgcccggcccaccacccactgctgcgtgacagaatgtgaccccacagaccccaacaactggatccccaaggacagcgtgggcacccaggagtggtaccccaaggacagccgccactag

SEQ ID NO: 7133 - DNA, 3030 bp, Artificial Sequence
  Description of Artificial Sequence: Synthetic coding sequence
atggacctgatccggggcgtgctgctgcggctgctgctgctggccagcagcctgggccctggagctgtgtccctgcgggccgccatcaggaagccaggcaaggtgggcccccccctggacatcaagctgggcgccctgaactgcacagccttcagcatccagtggaagatgcccaggcaccctggcagccccatcctgggctacacagtgttctacagcgaggtgggcgctgacaagagcctgcaggagcagctgcacagcgtgcccctgagccgggacatccccaccacagaggaggtgattggagacctgaagccaggcacagagtacagagtgtccattgctgcctacagccaggccggcaagggccgcctgagcagccccaggcatgtgaccaccctgagccaggacagctgcctgcccccagctgccccccagcagccccacgtgattgtggtgtctgacagcgaggtggccctgtcctggaagccaggggccagcgagggcagcgcccccatccagtactacagcgtggagttcatccggccagactttgacaagaagtggaccagcatccacgagcgcatccagatggacagcatggtgatcaagggcctggaccctgacaccaactaccagtttgctgtgcgggccatgaacagccacggccccagccccaggtcctggcccagcgacatcatccgcaccctgtgcccagaggaggccggcagcggccgctatggcccccgctacatcacagacatgggcgctggagaagatgatgagggctttgaagatgacctggacctggacatcagctttgaggaggtgaagcccctgcctgccaccaagggcggcaacaagaagttcctggtggagagcaagaagatgagcatcagcaaccccaagaccatcagccgcctcatcccccccaccagcgccagcctgcctgtgaccaccgtggccccccagcccatccccatccagaggaagggcaagaatggagtggccatcatgagccggctgtttgacatgccctgtgatgagaccctgtgcagcgctgacagcttctgtgtgaatgactacacctggggcggcagccgctgccagtgcaccctgggcaaaggaggagagagctgcagcgaggacatcgtcatccagtacccccagttcttcggccacagctatgtgacctttgagcccctgaagaacagctaccaggccttccagatcaccctggagttccgggcagaggccgaggatggcctgctgctgtactgtggagaaaatgagcacggccgcggggacttcatgagcctggccatcatccgccgcagcctgcagttccgcttcaactgtggcactggagtggccatcatcgtgtctgagaccaagatcaagctgggcggctggcacacagtgatgctgtacagagatggcctgaatggcctgctgcagctgaacaacggcacccctgtgacaggccagagccagggccagtacagcaagatcaccttccgcacccccctgtacctgggcggggcccccagcgcctactggctggtgcgggccaccggcaccaacagaggcttccagggctgtgtgcagagcctggccgtgaatggaagaagaattgacatgaggccctggcccctgggcaaggccctgtctggagcagatgtgggagaatgtagcagcggcatctgtgatgaggccagctgcatccacggcggcacctgcacagccatcaaggctgacagctacatctgcctgtgccccctgggcttcaagggccgccactgtgaagatgccttcaccctgaccatcccccagttccgggagagcctgcggagctatgctgccaccccctggcccctggagccccagcactacctgtccttcatggagtttgagatcaccttccggccagattctggagatggagtgctgctgtacagctatgacaccggcagcaaggacttcctgagcatcaacctggccggcggccacgtggagttccgctttgactgtggcagcggcactggagtgctgcggtctgaggaccccctgaccctgggcaactggcatgagctgcgggtgtccaggacagccaagaatggcatcctgcaggtggacaagcagaagatcgtggagggcatggccgagggcggcttcacccagatcaagtgcaacacagacatcttcatcggcggcgtgcccaactatgatgatgtgaagaagaacagcggcgtgctgaagcccttcagcggcagcatccagaagatcatcctgaatgacaggaccatccacgtgaagcatgacttcaccagcggcgtgaatgtggagaatgctgcccacccctgtgtgcgggccccctgtgcccatggaggcagctgccggcccaggaaggagggctatgactgtgactgccccctgggctttgagggcctgcactgccagaaggccatcatcgaggccatcgagatcccccagttcatcggccgcagctacctgacctatgacaacccagacatcctgaagagggtgtctggcagccgcagcaatgtgttcatgaggttcaagaccacagccaaggatggcctgctgctgtggaggggggacagccccatgaggcccaacagcgacttcatcagcctgggcctgagagatggagccctggtgttctcctacaacctgggcagcggcgtggccagcatcatggtgaatggcagcttcaatgatggccgctggcaccgggtgaaggctgtgagagatggccagagcggcaagatcaccgtggatgattatggagccaggacaggcaagagccctggcatgatgaggcagctgaacatcaatggagccctgtatgtgggcggcatgaaggagatcgccctgcacaccaaccggcagtacatgaggggcctggtgggctgcatcagccacttcaccctgagcacagactaccacatcagcctggtggaggatgctgtggatggcaagaacatcaacacctgtggggccaagtag

SEQ ID NO: 7134 - DNA, 1272 bp, Artificial Sequence
  Description of Artificial Sequence: Synthetic coding sequence
atgtctgtgcggggcatcctgcggctgggcacccaggagtaccccagccccctggaccctgaggtgggcccctactgtgacacccccaccatgaggaccctcttcaacctgctgtggctggccctggcctgcagccctgtgcacaccaccctgagcaagagtgatgccaagaaggccgccagcaagaccctgctggagaagagccagttcagtgacaagcctgtgcaggaccggggcctggtggtgacagacctgaaggccgagagcgtggtgctggagcacaggagctactgcagcgccaaggcccgggacagacactttgctggagatgtgctgggctacgtgaccccctggaacagccacggctatgatgtgaccaaggtgtttggcagcaagttcacccagatcagccctgtgtggctgcagctgaagagaagaggccgggagatgtttgaggtgacaggcctgcatgatgtggaccagggctggatgagagctgtgaggaagcacgccaagggcctgcacatcgtgccccggctgctgtttgaggactggacctatgatgacttcagaaatgtgctggacagtgaagatgaaattgaggagctgagcaagacagtggtgcaggtggccaagaaccagcactttgatggctttgtggtggaggtgtggaaccagctgctgagccagaagagggtgggcctcatccacatgctgacccacctggccgaggccctgcaccaggcccggctgctggccctgctggtgatccccccagccatcaccccaggcacagaccagctgggcatgttcacccacaaggagtttgagcagctggcccctgtgctggatggcttcagcctgatgacctatgactacagcacagcccaccagcccggccccaatgcccccctgtcctgggtgcgggcctgtgtgcaggtgctggaccccaagagcaagtggaggagcaagatcctgctgggcctgaacttctacggcatggactatgccaccagcaaggatgcccgggagcctgtggtgggcgcccgctacatccagaccctgaaggaccaccggcccaggatggtgtgggacagccaggccagcgagcacttctttgagtacaagaagagccgcagcggcagacatgtggtgttctaccccaccctgaagagcctgcaggtgcggctggagctggcccgggagctgggcgtgggcgtgtccatctgggagctgggccagggcctggactacttctatgacctgctgtag

SEQ ID NO: 7135 - DNA, 1182 bp, Artificial Sequence
  Description of Artificial Sequence: Synthetic coding sequence
atgaggaccctcttcaacctgctgtggctggccctggcctgcagccctgtgcacaccaccctgagcaagagtgatgccaagaaggccgccagcaagaccctgctggagaagagccagttcagtgacaagcctgtgcaggaccggggcctggtggtgacagacctgaaggccgagagcgtggtgctggagcacaggagctactgcagcgccaaggcccgggacagacactttgctggagatgtgctgggctacgtgaccccctggaacagccacggctatgatgtgaccaaggtgtttggcagcaagttcacccagatcagccctgtgtggctgcagctgaagagaagaggccgggagatgtttgaggtgacaggcctgcatgatgtggaccagggctggatgagagctgtgaggaagcacgccaagggcctgcacatcgtgccccggctgctgtttgaggactggacctatgatgacttcagaaatgtgctggacagtgaagatgaaattgaggagctgagcaagacagtggtgcaggtggccaagaaccagcactttgatggctttgtggtggaggtgtggaaccagctgctgagccagaagagggtgggcctcatccacatgctgacccacctggccgaggccctgcaccaggcccggctgctggccctgctggtgatccccccagccatcaccccaggcacagaccagctgggcatgttcacccacaaggagtttgagcagctggcccctgtgctggatggcttcagcctgatgacctatgactacagcacagcccaccagcccggccccaatgcccccctgtcctgggtgcgggcctgtgtgcaggtgctggaccccaagagcaagtggaggagcaagatcctgctgggcctgaacttctacggcatggactatgccaccagcaaggatgcccgggagcctgtggtgggcgcccgctacatccagaccctgaaggaccaccggcccaggatggtgtgggacagccaggccagcgagcacttctttgagtacaagaagagccgcagcggcagacatgtggtgttctaccccaccctgaagagcctgcaggtgcggctggagctggcccgggagctgggcgtgggcgtgtccatctgggagctgggccagggcctggactacttctatgacctgctgtag

SEQ ID NO: 7136 - DNA, 1959 bp, Artificial Sequence
  Description of Artificial Sequence: Synthetic coding sequence
atggcctctgtggcctgggccgtgctgaaggtgctgctgctgctgcccacccagacctggagccctgtgggcgccggcaaccccccagactgtgatgcccccctggccagcgccctgcccaggagcagcttcagcagcagcagcgagctgagcagcagccacggccctggcttcagccggctgaacagaagagatggagctgggggctggacccccctggtgagcaacaagtaccagtggctgcagattgacctgggggagaggatggaggtgacagctgtggccacccagggcggctacggcagcagtgactgggtgaccagctacctgctgatgttcagtgatggcggcaggaactggaagcagtaccgccgggaggagagcatctggggcttccctggcaacaccaatgctgacagcgtggtgcactaccgcctgcagcccccatttgaggcccgcttcctgcgcttcctgcccctggcctggaacccccggggccgcatcggcatgagaattgaggtgtatggctgtgcctacaagtctgaggtggtgtactttgatggccagagcgccctgctgtaccgcctggacaagaagcccctgaagcccatcagagatgtgatcagcctgaagttcaaggccatgcagagcaatggcatcctgctgcaccgggagggccagcacggcaaccacatcaccctggagctgatcaagggcaagctggtgttcttcctgaacagcggaaatgccaagctgcccagcaccatcgcccctgtgaccctgaccctgggcagcctgctggatgaccagcactggcacagcgtgctgattgagctgctggacacccaggtgaacttcaccgtggacaagcacacccaccacttccaggccaagggggacagcagctacctggacctgaactttgagatcagctttggaggcatccccaccccaggccgcagccgggccttccggaggaagagcttccacggctgcctggagaacctgtactacaatggagtggatgtgacagagctggccaagaagcacaagccccagatcctgatgatgggaaatgtgtccttcagctgcccccagccccagacagtgcctgtgaccttcctgagcagccgcagctacctggccctgcccggcaacagcggggaggacaaggtgtctgtgaccttccagttccgcacctggaacagagctggccacctgctgtttggagagctgcggcggggcagcggcagctttgtgctcttcctgaaggatggcaagctgaagctgagcctcttccagcccggccagagccccagaaatgtgacagctggggccggcctgaatgatggccagtggcacagcgtgtccttcagcgccaagtggagccacatgaatgtggtggtggatgatgacacagctgtgcagcccctggtggccgtgctgattgattctggggacacctactactttggagccctgtatgagcagagctgtgaggcccacaagcaccggggcaaccccagcggcctgtactacattgatgctgatggcagcggccccctgggccccttcctggtgtactgcaacatgacagatgctgcctggacagtggtgcagcacggcggcccagatgctgtgaccctgcggggggcccccagcggccaccccaggtctgctgtgtcctttgcctatgctgctggagctggccagctgcggtctgctgtgaacctggccgagcgctgtgagcagaggctggccctgcgctgtggcacagcccggcggccagacagcagagatggcacccccctgtcctggtgggtgggccgcaccaatgagacccacacctcctggggcggcagcctgcctgatgcccagaagtgcacctgtggcctggagggcaactgcatcgacagccagtactactgcaactgtgatgctggaagaaatgagtggtag

SEQ ID NO: 7137 - DNA, 1455 bp, Artificial Sequence
  Description of Artificial Sequence: Synthetic coding sequence
atgtggtacgtgtccacccggggcgtggccccccgggtgaactttgaaggagccctcttcagcggctacgccccagatggcggcctcttcatgcctgaggagctgccccagctggaccggggcaccctgtgccagtggagcaccctgagctacccaggcctggtgaaggagctgtgtgccctcttcatcggcagcgagctgctgcccaaggatgagctgaatgacctgattgaccgggccttcagccgcttccgccaccgggaggtggtgcacctgagccggctgagaaatggcctgaatgtgctggagctgtggcacggcgtgacctacgccttcaaggacctgagcctgagctgcaccacccagttcctgcagtacttcctggagaagcgggagaagcacgtgacagtggtggtgggcaccagcggggacaccggcagcgctgccatcgagagcgtgcagggcgccaagaacatggacatcatcgtgctgctgcccaagggccactgcaccaagatccaggagctgcagatgaccaccgtgctgaagcagaatgtgcacgtgtttggagtggagggcaacagtgatgagctggatgagcccatcaagacagtgtttgctgatgtggcctttgtgaagaagcacaacctgatgagcctgaacagcatcaactggagccgggtgctggtgcagatggcccaccacttctttgcctacttccagtgcacccccagcctggacacccaccccctgcccctggtggaggtggtggtgcccaccggggctgctggcaacctggccgccggctacatcgcccagaagattggcctgcccatccggctggtggtggccgtgaacagaaatgacatcatccacaggacagtgcagcagggcgacttcagcctgtctgaggccgtgaagagcaccctggccagcgccatggacatccaggtgccctacaacatggagagggtcttctggctgctgagcggcagtgacagccaggtgacccgggccctgatggagcagtttgagaggacccagagcgtgaacctgcccaaggagctgcacagcaagctgtctgaggccgtgacctctgtgtctgtgtctgatgaggccatcacccagaccatgggccgctgctgggatgagaaccagtacctgctgtgcccccacagcgctgtggccgtgaactaccactaccagcagattgaccggcagcagcccagcaccccccgctgctgcctggccccagccagcgctgccaagtttcctgaggccgtgctggccgccggcctgaccccagagaccccagctgagatcgtggccctggagcacaaggagacccgctgcaccctgatgagaagaggagacaactggatgctgatgctgcgggacaccatcgaggacctgagccggcagtggaggagccacgccctgaacaccagccagtag

SEQ ID NO: 7138 - DNA, 264 bp, Artificial Sequence
  Description of Artificial Sequence: Synthetic coding sequence
atggtgtccctgatgaagctgtggatccccatgctgatgaccttcttctgcaccgtgctgctgtctgtgctgggggagatgaggaagaagagatatgacaggaaggagctgctgctggaggagtgctggggcaagcccaacgtgaaggagtgcaccaacaagtgcagcaaggccttccgctgcaaggacaagaactacacctgctgctggacctactgcggcaacatctgctggatcaacgtggagaccagcggggactactag

SEQ ID NO: 7139 - DNA, 453 bp, Artificial Sequence
  Description of Artificial Sequence: Synthetic coding sequence
atgaggttcatggccggccctgctggcagccagagcctgggccccctgtgcttccacagcagcccccaggccctgtacacagtgctgctgattgtgctggtgatgatgagcctggtgtttgggaagtttgtgcctgtgaactgggagcccccccagcccctgcccttccccaagtacctgcgctgctaccgctgcctgctggagaccaaggagctgggctgcctgctgggcagtgacatctgcctgaccccagctggcagcagctgcatcaccctgcacaagaagaacagcagcggcagtgatgtgatggtgtctgactgccgcagcaaggagcagatgtctgactgcagcaacaccaggaccagccctgtgtctggcttctggatcttcagccagtactgcttcctggacttctgcaatgacccccagaacagaggcctgtacaccccctag

SEQ ID NO: 7140 - DNA, 873 bp, Artificial Sequence
  Description of Artificial Sequence: Synthetic coding sequence
atgtctgtgcggcggggcagaagacctgcccggcccggcacccggctgtcctggctgctgtgctgcagcgccctgctgagccctgctgctggctacgtgattgtgtcctctgtgtcctgggccgtgaccaatgaggtggatgaggagctggacagcgccagcacagaggaggccatgcctgccctgctggaggacagcggcagcatctggcagcagagcttccctgccagcgcccacaaggaggatgcccacctgcggcccagggctggagctgcccgggcccggcccccaccagcccctcctggcatgttctcctacagaagagagggcggccagacagccagcgcccctcctggcccccggctgcgggccgccacagcccggagcctggcccacgcctctgtgtggggctgcctggccaccgtgtccacccacaagaagatccagggcctgccctttggaaactgcctgcctgtgtctgatggccccttcaacaacagcacaggcatccccttcttctacatgacagccaaggaccctgtggtggccgacctgatgaagaaccccatggccagcctgatgctgcctgagagcgagggggagttctgcaggaagaacatcgtggaccctgaggacccccgctgtgtgcagctgaccctgaccggccagatgattgctgtgtccccagaggaggtggagtttgccaagcaggccatgttcagccgccaccctggcatgaggaagtggccccggcagtatgagtggttcttcatgaagatgagaattgagcacatctggctgcagaagtggtatggaggagccagcagcatcagccgggaggagtacttcaaggctgtgcccaggaaggcctag

SEQ ID NO: 7141 - DNA, 2742 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagagatggcctgctgagctacacagcccctgtgggccagaccatgtacctgtctgaggccgtgtacctgaatgacagcacctatgatggccacacagtgggcggcctgcagtatggaggcctgggccagctggctgatggagtggtgggcctggatgacttcaggaagagccaggagctgcgggtgtggccaggctatgactatgtgggctggagcaaccacagcttcagcagcggctacgtggagatggagtttgaatttgaccggctgcgggccttccaggccatgcaggtgcactgcaacaacatgcacaccctgggcgcccggctgcccggcggcgtggagtgccgcttccggcggggccctgccatggcctgggagggggagcccatgaggcacaacctgggcggcaacctgggggacccccgggcccgggctgtgtctgtgcccctgggcggccgggtggcccgcttcctgcagtgccgcttcctgtttgctggcccctggctgctcttcagcgagatctccttcatcagtgatgtggtgaacaacagcagccctgccctgggcggcaccttccccccagccccctggtggcccccaggccccccacccaccaacttcagcagcctggagctggagccccggggccagcagcctgtggccaaggccgagggcagccccacagccatcctgattggctgcctggtggccatcatcctgctgctgctgctgatcatcgccctgatgctgtggaggctgcactggaggcggctgctgagcaaggccgagcggcgggtgctggaggaggagctgactgtgcacctgtctgtgcctggggacaccatcctgatcaacaaccggcccggcccccgggagcccccaccctaccaggagccccggccccggggcaaccccccccacagcgccccctgtgtgcccaacggcagcgccctgctgctgagcaacccagcctaccgcctgctgctggccacctacgcccggcccccccggggccctggcccccccaccccagcctgggccaagcccaccaacacccaggcctacagcggggactacatggagcctgagaagccaggggcccccctgctgcccccaccaccccagaacagcgtgccccactacgccgaggccgacatcgtgaccctgcagggcgtgactggaggcaacacctatgctgtgcctgccctgcccccaggagctgtgggagatggccccccccgggtggacttccccaggagccggctgcgcttcaaggagaagctgggggagggccagtttggagaggtgcacctgtgtgaggtggacagcccccaggacctggtgtccctggacttccccctgaatgtgaggaagggccaccccctgctggtggccgtgaagatcctgcggccagatgccaccaagaatgccagaaatgacttcctgaaggaggtgaagatcatgagccggctgaaggaccccaacatcatccggctgctgggcgtgtgtgtgcaggatgaccccctgtgcatgatcacagactacatggagaatggagacctgaaccagttcctgagcgcccaccagctggaggacaaggctgctgagggcgcccctggagatggccaggccgcccagggccccaccatctcctaccccatgctgctgcacgtggccgcccagatcgccagcggcatgagatacctggccaccctgaactttgtgcaccgggacctggccaccaggaactgcctggtgggggagaacttcaccatcaagattgctgactttggcatgagcaggaacctgtatgctggggactactacagagtgcagggccgggctgtgctgcccatccgctggatggcctgggagtgcatcctgatgggcaagttcaccacagccagtgatgtgtgggcctttggagtgaccctgtgggaggtgctgatgctgtgccgggcccagcccttcggccagctgacagatgagcaggtgattgaaaatgctggggagttcttccgggaccagggccggcaggtgtacctgagccggcccccagcctgcccccagggcctgtatgagctgatgctgcgctgctggagccgggagagcgagcagaggcctcccttcagccagctgcaccgcttcctggctgaagatgccctgaacacagtgtag

SEQ ID NO: 7142 - DNA, 243 bp, Artificial Sequence
  Description of Artificial Sequence: Synthetic coding sequence
atgaagctgagcggcatgttcctgctgctgagcctggccctcttctgcttcctgactggagtcttcagccagggcggccaggtggactgtggggagttccaggaccccaaggtgtactgcacccgggagagcaacccccactgcggcagtgatggccagacctacggcaacaagtgtgccttctgcaaggccatcgtgaagagcggcggcaagatcagcctgaagcaccctggaaaatgttag

SEQ ID NO: 7143 - DNA, 270 bp, Artificial Sequence
  Description of Artificial Sequence: Synthetic coding sequence
atgaagccctggatcctgctgctggtgatgttcatctctggagtggtgatgctgctgcctgtgctgggcagcttctggaacaaggaccccttcctggacatgatccgggagacagagcagtgctgggtgcagcccccctacaagtactgtgagaagcgctgcaccaagatcatgacctgtgtgcggcccaaccacacctgctgctggacctactgcggcaacatctgcctggacaatgaggagcccctgaagtccatgctgaacccctag

SEQ ID NO: 7144 - DNA, 264 bp, Artificial Sequence
  Description of Artificial Sequence: Synthetic coding sequence
atgctgccctgcctggccctgctgctgctgatggagctgtctgtgtgcaccgtggccggagatggaggagaggagcagaccctgagcacagaggccgagacctgggagggcgccggccccagcatccagctgcagctgcaggaggtgaagacaggcaaggccagccagttcttcggcctgatgggcaagagggtgggcggccggcccctcatccagcccaggaggaagaagggccgggaggatgaggcccagggcagcgagtag

SEQ ID NO: 7145 - DNA, 285 bp, Artificial Sequence
  Description of Artificial Sequence: Synthetic coding sequence
atgcagcacagcctggtgttcttctttgctgtgatcctgcacctgagccacctgctgcacctggatgccagcatccaccccttccggctgcccttcagcagcaagcccttcctgctgatccccatgagcaacaccaccctgccccacacagcctggcccctgtccttcctgcaccagacagtgtccaccctgaaggctgtggccgtgacccacagcctgtggcacctgcagatccctgtggactgccaggcctgcaacaggaagagcaagaagatctactgctag

SEQ ID NO: 7146 - DNA, 327 bp, Artificial Sequence
  Description of Artificial Sequence: Synthetic coding sequence
atgaggcagaggctgctgcccagcgtgaccagcctgctgctggtggccctgctcttccctggcagcagccaggcccggcacgtgaaccacagcgccacagaggccctgggggagctgcgggagcgggcccctggccagggcaccaacggcttccagctgctgcggcatgctgtgaagagggacctgctgccccccaggaccccaccctaccagggagatgtgcccctgggcatccggaacaccatctgcaggatgcagcagggcatctgccgcctcttcttctgccacagcggcaccggccagcagcaccggcagagatgtggctag

SEQ ID NO: 7147 - DNA, 807 bp, Artificial Sequence
  Description of Artificial Sequence: Synthetic coding sequence
atgctgctgctggccgccgccttcctggtggcctttgtgctgctgctgtacatggtgagccccctcatcagccccaagcccctggccctgcccggggcccacgtggtggtgactggaggcagcagcggcatcggcaagtgcatcgccatcgagtgctacaagcagggcgccttcatcaccctggtggccagaaatgaagacaagctgctgcaggccaagaaggagattgagatgcacagcatcaatgacaagcaggtggtgctgtgcatctctgtggatgtgtcccaggactacaaccaggtggagaatgtcatcaagcaggcccaggagaagctgggccctgtggacatgctggtgaactgtgccggcatggctgtgtctgggaagtttgaggacctggaggtgtccacctttgaggtgaagccctacaacgtgtacatcaccgtggcctaccccccagacacagacaccccaggctttgctgaagaaaatagaaccaagcccctggagaccaggctcatcagcgagaccacctctgtgtgcaagccagagcaggtggccaagcagatcgtgaaggatgccatccagggcaacttcaacagcagcctgggcagtgatggctacatgctgagcgccctgacctgtggcatggcccctgtgaccagcatcacagagggcctgcagcaggtggtgaccatgggcctcttccgcaccatcgccctcttctacctgggcagctttgacagcatcgtgcggcgctgcatgatgcagcgggagaagtcagaaaatgctgacaagacagcctag

SEQ ID NO: 7148 - DNA, 1686 bp, Artificial Sequence
  Description of Artificial Sequence: Synthetic coding sequence
atgcgctggatcctgtgctggagcctgaccctgtgcctgatggcccagacagccctgggcgccctgcacaccaagaggccccaggtggtgaccaagtatggcaccctgcagggcaagcagatgcacgtgggcaagacccccatccaggtgttcctgggcgtgcccttcagcaggcctcccctgggcatcctgcgctttgcccctcctgagcccccagagccctggaagggcatcagagatgccaccacctacccacctggctgcctgcaggagagctggggccagctggcctccatgtatgtgtccacccgggagcgctacaagtggctgcgcttcagcgaggactgcctgtacctgaatgtgtatgccccagcccgggcccctggggacccccagctgcctgtgatggtgtggttccctgggggcgccttcatcgtgggcgccgccagcagctatgagggcagtgacctggccgcccgggagaaggtggtgctggtgttcctgcagcaccggctgggcatcttcggcttcctgagcacagatgacagccacgcccggggcaactggggcctgctggaccagatggccgccctgcgctgggtgcaggagaacattgctgccttcggcggggaccctggaaatgtgaccctgtttggccagagcgctggggccatgagcatcagcggcctgatgatgagccccctggccagcggcctcttccaccgggccatcagccagagcggcacagccctcttccgcctcttcatcaccagcaaccccctgaaggtggccaagaaggtggcccacctggccggctgcaaccacaacagcacccagatcctggtgaactgcctgcgggccctgagcggcaccaaggtgatgagggtgagcaacaagatgaggttcctgcagctgaacttccagagggaccctgaggagatcatctggagcatgagccctgtggtggatggagtggtgatcccagatgaccccctggtgctgctgacccagggcaaggtgtcctctgtgccctacctgctgggcgtgaacaacctggagttcaactggctgctgccctacatcatgaagttccccctgaaccggcaggccatgaggaaggagaccatcaccaagatgctgtggagcaccaggaccctgctgaacatcaccaaggagcaggtgcccctggtggtggaggagtacctggacaacgtgaatgaacatgactggaagatgctgaggaacaggatgatggacatcgtgcaggatgccacctttgtgtatgccaccctgcagacagcccactaccacagagatgctggcctgcctgtgtacctgtatgaatttgagcaccacgcccggggcatcatcgtgaagcccaggacagatggagctgaccatggagatgagatgtacttcctgtttggaggcccctttgccaccggcctgtccatgggcaaggagaaggccctgagcctgcagatgatgaagtactgggccaactttgccaggactggaaaccccaatgatggcaacctgccctgctggccccgctacaacaaggatgagaagtacctgcagctggacttcaccaccagggtgggcatgaagctgaaggagaagaagatggccttctggatgagcctgtaccagagccagaggcctgagaagcagaggcagttctag

SEQ ID NO: 7149 - DNA, 444 bp, Artificial Sequence
  Description of Artificial Sequence: Synthetic coding sequence
atggccagcagcctgaagatctggggcaccctgctggccctgctgtgcatcctgtgcaccctgctggtgcagagcaaggaggtgtcctggagggagttcatgaagcagcactacctgagccccagccgggagttccgggagtacaagtgtgatgtgctgatgagagaaaatgaggccctgaaggacaagagcagccacatgttcatctacatctcctggtacaagattgagcacatctgcaccagtgacaactggatggaccgcttcagaaatgcctacgtgtgggtgcagaaccccctgaaggtgctgaagtgccaccaggagaacagcaagaacagctacacagagagccgctccttcaactacatcgagttccactgcagcatggatggctacgtggacagcattgaggacctgaagatggtggagcccatcggcaactag

SEQ ID NO: 7150 - DNA, 444 bp, Artificial Sequence
  Description of Artificial Sequence: Synthetic coding sequence
atgaccagcagcctgaagatctggggcatcctgctggccctgctgtgcatcctgtgccgcctgtgtgtgtacagcaacaacatctactggagggagttcatcaagctgcactacctgagccccagccgggagttcaaggagtacaagtgtgatgtgctgatgagggagaaggaggccctgaagggcaagagcttccacatgttcatctacagcctgtggttcaagatccagagggcctgcatcaatgagaagggcagtgaccgctacagaaatgcctacgtgtgggcccctggggccctgaaggtgctggagtgccactgggagaagtacaacaaccgctacacagagagccgctccttctcctacatcgagttccactgcggcgtggatggctacgtggacaacatcgaggacctgcgcatcatcgagcccatcagcaactag

SEQ ID NO: 7151 - DNA, 1248 bp, Artificial Sequence
  Description of Artificial Sequence: Synthetic coding sequence
atgagccccttcctgtacctggtgctgctggtgctgggcctgcacgccaccatccactgtgccagccctgagggcaaggtgacagcctgccacagcagccagcccaatgccaccctgtacaagatgagcagcatcaatgctgactttgccttcaacctgtaccgccgcttcaccgtggagaccccagacaagaacatcttcttcagccctgtgtccatctctgctgccctggtgatgctgagctttggagcctgctgcagcacccagacagagatcgtggagaccctgggcttcaacctgacagacacccccatggtggagatccagcacggcttccagcacctgatctgcagcctgaacttccccaagaaggagctggagctgcagattggaaatgccctcttcatcggcaagcacctgaagcccctggccaagttcctgaatgatgtgaagaccctgtatgaaacagaggtgttcagcacagacttcagcaacatctctgctgccaagcaggagatcaacagccacgtggagatgcagaccaagggcaaggtggtgggcctcatccaggacctgaagcccaacaccatcatggtgctggtgaactacatccacttcaaggcccagtgggccaacccctttgaccccagcaagacagaggacagcagcagcttcctgattgacaagaccaccaccgtgcaggtgcccatgatgcaccagatggagcagtactaccacctggtggacatggagctgaactgcaccgtgctgcagatggactacagcaagaatgccctggccctgtttgtgctgcccaaggagggccagatggagagcgtggaggccgccatgagcagcaagaccctgaagaagtggaaccggctgctgcagaagggctgggtggacctgtttgtgcccaagttcagcatcagcgccacctatgacctgggcgccaccctgctgaagatgggcatccagcacgcctacagtgaaaatgctgacttcagcggcctgacagaggacaatggcctgaagctgagcaatgctgcccacaaggctgtgctgcacatcggggagaagggcacagaggccgctgctgtgcctgaggtggagctgagtgaccagcctgagaacaccttcctgcaccccatcatccagattgacaggagcttcatgctgctgatcctggagaggagcaccaggagcatcctcttcctgggcaaggtggtgaaccccacagaggcctag

SEQ ID NO: 7152 - DNA, 285 bp, Artificial Sequence
  Description of Artificial Sequence: Synthetic coding sequence
atgaggaccctggccatcctggccgccatcctgctggtggccctgcaggcccaggccgagcccctgcaggcccgggcagatgaggtggccgccgcccctgagcagattgctgctgacatccctgaggtggtggtgtccctggcctgggatgagagcctggcccccaagcaccctggcagcaggaagaacatggactgctactgccgcatcccagcctgcatcgccggggagcggcgctatggcacctgcatctaccagggccgcctgtgggccttctgctgctag

SEQ ID NO: 7153 - DNA, 1062 bp, Artificial Sequence
  Description of Artificial Sequence: Synthetic coding sequence
atgaggctgcccaggagagctgccctgggcctgctgcccctgctgctgctgctgcccccagcccctgaggccgccaagaagcccaccccctgccaccgctgccggggcctggtggacaagttcaaccagggcatggtggacacagccaagaagaactttggaggcggcaacacagcctgggaggagaagaccctgagcaaatatgagagcagcgagatccggctgctggagatcctggagggcctgtgtgagagcagtgactttgagtgcaaccagatgctggaggcccaggaggagcacctggaggcctggtggctgcagctgaagtctgagtacccagacctgtttgagtggttctgtgtgaagaccctgaaggtgtgctgcagccctggcacctacggccctgactgcctggcctgccagggcggcagccagaggccctgcagcggaaatggccactgcagcggagatggcagccggcagggagatggcagctgccgctgccacatgggctaccagggccccctgtgcacagactgcatggatggctacttcagcagcctgagaaatgagacccacagcatctgcacagcctgtgatgagagctgcaagacctgcagcggcctgaccaacagagactgtggggagtgtgaggtgggctgggtgctggatgagggcgcctgtgtggatgtggatgaatgtgccgctgagcccccaccctgcagcgctgcccagttctgcaagaatgccaacggcagctacacctgtgaggagtgtgacagcagctgtgtgggctgcacaggagagggccctggcaactgcaaggagtgcatcagcggctacgcccgggagcacggccagtgtgctgatgtggatgaatgttccctggccgagaagacctgtgtgaggaagaatgaaaactgctacaacaccccaggcagctatgtgtgtgtgtgcccagatggctttgaggagacagaagatgcctgtgtgcccccagctgaggccgaggccacagaaggagagagccccacccagctgcccagccgggaggacctgtag

SEQ ID NO: 7154 - DNA, 651 bp, Artificial Sequence
  Description of Artificial Sequence: Synthetic coding sequence
atgaagctgaacctggtgcagatcttcttcatgctgctgatgctgctgctgggcctgggcatgggcctgggcctgggcctgcacatggccacagctgtgctggaggagagtgaccagcccctgaatgagttctggagcagtgacagccaggacaaggccgaggccacagaggagggagatggcacccagaccacagagaccctggtgctgagcaacaaggaggtggtgcagcccggctggccagaggaccccatcctgggggaggatgaggtgggcggcaacaagatgctgcgggccagcgccctcttccagagcaacaaggactacctgcggctggaccagacagaccgggagtgcaatgacatgatggcccacaagatgaaggagcccagccagagctgcatcgcccagtatgccttcatccacgaggacctgaacacagtgaaggctgtgtgcaacagccctgtgattgcctgtgagctgaagggcggcaagtgccacaagagcagccggccctttgacctgaccctgtgtgagctgagccagcctgaccaggtgacccccaactgcaactacctgaccagcgtcatcaagaagcacatcatcatcacctgcaatgacatgaagaggcagctgcccaccggccagtag

SEQ ID NO: 7155 - DNA, 222 bp, Artificial Sequence
  Description of Artificial Sequence: Synthetic coding sequence
atgagaattgctgtgctgctgtttgccatcttcttcttcatgagccaggtgctgcctgcccggggcaagttcaaggagatctgtgagcggcccaacggcagctgccgggacttctgcctggagacagagatccacgtgggccgctgcctgaacagccagccctgctgcctgcccctgggccaccagcccagaattgagagcaccacccccaagaaggactag

SEQ ID NO: 7156 - DNA, 609 bp, Artificial Sequence
  Description of Artificial Sequence: Synthetic coding sequence
atggagagaggagctggggccaagctgctgcccctgctgctgctgctgcgggccaccggcttcacctgtgcccagacagatggaagaaatggctacacagctgtgattgaggtgaccagcggcggcccctggggagactgggcctggccagagatgtgcccagatggcttctttgccagcggcttcagcctgaaggtggagcccccccagggcatccctggagatgacacagccctgaatggcatccggctgcactgtgcccggggaaatgtgctgggcaacacccacgtggtggagagccagagcggctcctggggcgagtggagcgagcccctgtggtgccggggcggggcctacctggtggccttcagcctgcgggtggaggcccccaccaccctgggggacaacacagctgccaacaacgtgcgcttccgctgcagtgatggagaggagctgcagggccctggcctgtcctggggagactttggagactggagcgaccactgccccaagggggcctgtggcctgcagaccaagatccagggcccccggggcctgggagatgacacagccctgaatgatgcccggctcttctgctgccgctcctag

SEQ ID NO: 7157 - DNA, 759 bp, Artificial Sequence
  Description of Artificial Sequence: Synthetic coding sequence
atgcagctgacccgctgctgctttgtgttcctggtgcagggcagcctgtacctggtgatctgtggccaggatgatggccccccaggctctgaagatcctgagagagatgaccacgagggccagccccggccccgggtgcccaggaagaggggccacatcagccccaagagccggcccatggccaacagcaccctgctgggcctgctggcccctcctggagaggcctggggcatcctgggccagccccccaaccggcccaaccacagccccccaccttctgccaaggtgaagaagatcttcggctggggagacttctacagcaacatcaagacagtggccctgaacctgctggtgacaggcaagatcgtggaccatggaaatggcaccttctctgtgcacttccagcacaatgccaccggccagggcaacatcagcatcagcctggtgccccccagcaaggctgtggagttccaccaggagcagcagatcttcatcgaggccaaggccagcaagatcttcaactgcaggatggagtgggagaaggtggagcggggccgccgcaccagcctgtgcacccatgaccctgccaagatctgcagccgggaccacgcccagagcagcgccacctggagctgcagccagcccttcaaggtggtgtgtgtgtacatcgccttctacagcacagactaccgcctggtgcagaaggtgtgcccagactacaactaccacagcgacaccccctactaccccagcggctag

SEQ ID NO: 7158 - DNA, 555 bp, Artificial Sequence
  Description of Artificial Sequence: Synthetic coding sequence
atgaagatcctggtggccttcctggtggtgctgaccatcttcggcatccagagccacggctatgaggtgttcaacatcatcagccccagcaacaacggcggcaatgtgcaggagaccgtgaccatcgacaatgagaagaacacagccatcatcaacatccatgctggcagctgcagcagcaccaccatctttgactacaagcacggctacatcgccagccgggtgctgagccggcgggcctgcttcatcctgaagatggaccaccagaacatcccccccctgaacaacctgcagtggtacatctatgagaagcaggccctggacaacatgttcagcagcaagtacacctgggtgaagtacaaccccctggagagcctcatcaaggatgtggactggttcctgctgggcagccccatcgagaagctgtgcaagcacatccccctgtacaagggggaggtggtggagaacacccacaacgtgggcgctgggggctgtgccaaggccggcctgctgggcatcctgggcatcagcatctgtgccgacatccacgtgtag

SEQ ID NO: 7159 - DNA, 651 bp, Artificial Sequence
  Description of Artificial Sequence: Synthetic coding sequence
atgggcgctgtgatgggcaccttcagcagcctgcagaccaagcagaggcggcccagcaaggacaagattgaagatgagctggagatgaccatggtgtgccacaggcctgagggcctggagcagctggaggcccagaccaacttcaccaagcgggagctgcaggtgctgtaccggggcttcaagaatgaatgtcccagcggcgtggtgaatgaagacaccttcaagcagatctatgcccagttcttcccccatggagatgccagcacctacgcccactacctgttcaatgcctttgacaccacccagacaggctctgtgaagtttgaagattttgtgacagccctgagcatcctgctgcggggcaccgtgcatgagaagctgcgctggaccttcaacctgtatgacatcaacaaggatggctacatcaacaaggaggagatgatggacatcgtgaaggccatctatgacatgatgggcaagtacacctaccctgtgctgaaggaggacaccccccggcagcacgtggatgtgttcttccagaagatggacaagaacaaggatggcatcgtgaccctggatgagttcctggagagctgccaggaggatgacaacatcatgaggagcctgcagctgttccagaatgtgatgtag

SEQ ID NO: 7160 - DNA, 2736 bp, Artificial Sequence
  Description of Artificial Sequence: Synthetic coding sequence
atggcccagctgttcctgcccctgctggccgccctggtgctggcccaggccccagctgccctggctgatgtgctggagggggacagcagtgaagatcgggccttccgggtgagaattgctggagatgcccccctgcagggcgtgctgggcggggccctgaccatcccctgccacgtgcactacctgcggcccccacccagccggcgggctgtgctgggcagcccccgggtgaagtggaccttcctgagccggggccgggaggccgaggtgctggtggcccggggcgtgcgggtgaaggtgaatgaggcctaccgcttccgggtggccctgcctgcctacccagccagcctgacagatgtgtccctggccctgtctgagctgcggcccaatgacagcggcatctaccgctgtgaggtgcagcacggcattgatgacagcagtgatgctgtggaggtgaaggtgaagggcgtggtgttcctgtaccgggagggcagcgcccgctatgccttctccttcagcggggcccaggaggcctgtgcccgcatcggggcccacatcgccaccccagagcagctgtatgctgcctacctgggcggctatgagcagtgtgatgctggctggctgagtgaccagacagtgcgctaccccatccagaccccccgggaggcctgctatggagacatggatggcttccctggggtgagaaattatggagtggtggaccctgatgacctgtatgatgtgtactgctacgccgaggacctgaatggagagctgttcctgggggaccccccagagaagctgaccctggaggaggcccgggcctactgccaggagagaggagctgagatcgccaccaccggccagctgtatgctgcctgggatggcggcctggaccactgcagccctggctggctggctgatggctctgtgcgctaccccatcgtgacccccagccagagatgtggcggcggcctgcccggggtgaagaccctcttcctgttccccaaccagacaggcttccccaacaagcacagccgcttcaacgtgtactgcttccgggacagcgcccagcccagcgccatccctgaggccagcaacccagccagcaacccagccagtgatggcctggaggccatcgtgacagtgacagagaccctggaggagctgcagctgccccaggaggccacagaaagtgagagcagaggagccatctacagcatccccatcatggaggatggcggcggcggcagcagcaccccagaggaccctgctgaggcccccaggaccctgctggagtttgagacccagagcatggtgcccccaacaggcttcagcgaggaggagggcaaggccctggaggaggaggagaagtatgaagatgaggaggagaaggaggaggaggaggaggaggaggaggtggaggatgaggccctgtgggcctggcccagcgagctgagcagccctggccctgaggccagcctgcccacagagcctgctgcccaggaggagagcctgagccaggccccagcccgggctgtgctgcagcccggggccagccccctgcctgatggagagagcgaggccagccggcccccccgggtgcacggccccccaacagagaccctgcccaccccccgggagaggaacctggccagccccagccccagcaccctggtggaggcccgggaggtgggggaggccactggaggccctgagctgtctggagtgcccagaggagagagcgaggagaccggcagcagcgagggcgcccccagcctgctgcctgccacccgggcccctgagggcacccgggagctggaggcccccagcgaggacaacagcggccgcacagccccagctggcacctctgtgcaggcccagcctgtgctgcccacagattctgccagcagaggaggagtggccgtggtgcctgccagcggggactgtgtgcccagcccctgccacaatggaggcacctgcctggaggaggaggagggcgtgcgctgcctgtgcctgcccggctacggcggggacctgtgtgatgtgggcctgcgcttctgcaaccctggctgggatgccttccagggcgcctgctacaagcacttcagcacccggcgctcctgggaggaggccgagacccagtgcaggatgtatggagcccacctggccagcatcagcaccccagaggagcaggacttcatcaacaaccgctaccgggagtaccagtggattggcctgaatgacaggaccatcgagggggacttcctgtggagcgatggagtgcccctgctgtatgagaactggaaccctggccagcctgacagctacttcctgagcggggagaactgtgtggtgatggtgtggcatgaccagggccagtggagcgatgtgccctgcaactaccacctgagctacacctgcaagatgggcctggtgtcctgtggccccccacctgagctgcccctggcccaggtgtttggccggccccggctgcgctatgaggtggacacagtgctgcgctaccgctgccgggagggcctggcccagaggaacctgcccctcatccgctgccaggagaatggccgctgggaggccccccagatcagctgtgtgccccggcggcctgcccgggccctgcaccctgaggaggaccctgagggccggcagggccgcctgctgggccgctggaaggccctgctgatcccccccagcagccccatgcctggcccctag

SEQ ID NO: 7161 - DNA, 852 bp, Artificial Sequence
  Description of Artificial Sequence: Synthetic coding sequence
atgggcctgggcctgcggggctggggccggcccctgctgactgtggccacagccctgatgctgcctgtgaagcccccagctggctcctggggcgcccagatcattggaggccacgaggtgaccccccacagccggccctacatggcctctgtgcgctttggaggccagcaccactgcggcggcttcctgctgcgggcccgctgggtggtgtctgctgcccactgcttcagccaccgggacctgaggacaggcctggtggtgctgggcgcccacgtgctgagcacagctgagcccacccagcaggtgtttggaattgatgccctgaccacccacccagactaccaccccatgacccacgccaatgacatctgcctgctgcggctgaatggatctgctgtgctgggccctgctgtgggcctgctgcggcccccaggccggcgggcccggcccccaacagctggcacccgctgccgggtggccggctggggctttgtgtctgactttgaggagctgcccccaggcctgatggaggccaaggtgcgggtgctggaccctgatgtgtgcaacagctcctggaagggccacctgaccctgaccatgctgtgcaccaggtctggggacagccaccggcggggcttctgcagcgctgacagcggcggccccctggtgtgcaggaacagagcccacggcctggtgtccttcagcggcctgtggtgtggggaccccaagaccccagatgtgtacacccaggtgtctgcctttgtggcctggatctgggatgtggtgagaagaagcagcccccagcccggccccctgcccggcaccacccggcccccaggagaggccgcctag

SEQ ID NO: 7162 - DNA, 1209 bp, Artificial Sequence
  Description of Artificial Sequence: Synthetic coding sequence
atgatggtggccctgcggggggccagcgccctgctggtgctcttcctggccgccttcctgcccccaccccagtgcacccaggaccctgccatggtgcactacatctaccagcgcttccgggtgctggagcagggcctggagaagtgcacccaggccacccgggcctacatccaggagttccaggagttcagcaagaacatctctgtgatgctgggccgctgccagacctacaccagcgagtacaagtctgctgtgggcaacctggccctgcgggtggagcgggcccagcgggagattgactacatccagtacctgcgggaggctgatgagtgcatcgagagcgaggacaagaccctggccgagatgctgctgcaggaggccgaggaggagaagaagatccgcaccctgctgaatgccagctgtgacaacatgctgatgggcatcaagagcctgaagatcgtgaagaagatgatggacacccacggctcctggatgaaggatgctgtgtacaacagccccaaggtgtacctgctgattggcagcaggaacaacacagtgtgggagtttgccaacatccgggccttcatggaggacaacaccaagccagcccccaggaagcagatcctgaccctgtcctggcagggcaccggccaggtgatctacaagggcttcctgttcttccacaaccaggccaccagcaatgagatcatcaagtacaacctgcagaagaggacagtggaggacaggatgctgctgcctggaggagtgggccgggccctggtgtaccagcacagccccagcacctacatcgacctggccgtggatgaacatggcctgtgggccatccacagcggccctggcacccacagccacctggtgctgaccaagattgagcccggcaccctgggcgtggagcacagctgggacaccccctgccgcagccaggatgctgaggccagcttcctgctgtgtggggtgctgtatgtggtgtacagcactggaggccagggcccccaccgcatcacctgcatctatgaccccctgggcaccatcagcgaggaggacctgcccaacctcttcttccccaagaggcccaggagccacagcatgatccactacaacccccgggacaagcagctgtatgcctggaatgaaggcaaccagatcatctacaagctgcagaccaagaggaagctgcccctgaagtag

SEQ ID NO: 7163 - DNA, 1221 bp, Artificial Sequence
  Description of Artificial Sequence: Synthetic coding sequence
atgcagctgttcctgctgctgtgcctggtgctgctgagcccccagggcgccagcctgcaccgccaccacccccgggagatgaagaagagggtggaggacctgcacgtgggcgccaccgtggcccccagcagcagaagagacttcacctttgacctgtaccgggccctggccagcgctgcccccagccagagcatcttcttcagccctgtgtccatctccatgagcctggccatgctgagcctgggcgccggcagcagcaccaagatgcagatcctggagggcctgggcctgaacctgcagaagagcagcgagaaggagctgcaccggggcttccagcagctgctgcaggagctgaaccagcccagagatggcttccagctgagcctgggcaatgccctcttcacagacctggtggtggacctgcaggacacctttgtgtctgccatgaagaccctgtacctggccgacaccttccccaccaacttccgggacagcgctggggccatgaagcagatcaatgactatgtggccaagcagaccaagggcaagatcgtggacctgctgaagaacctggacagcaatgctgtggtgatcatggtgaactacatcttcttcaaggccaagtgggagaccagcttcaaccacaagggcacccaggagcaggacttctacgtgaccagcgagaccgtggtgcgggtgcccatgatgagccgggaggaccagtaccactacctgctggacaggaacctgagctgccgggtggtgggcgtgccctaccagggcaatgccacagccctcttcatcctgcccagcgagggcaagatgcagcaggtggagaatggcctgtctgagaagaccctgaggaagtggctgaagatgttcaagaagaggcagctggagctgtacctgcccaagttcagcattgagggcagctaccagctggagaaggtgctgcccagcctgggcatcagcaatgtgttcaccagccatgctgacctgagcggcatcagcaaccacagcaacatccaggtgtctgagatggtgcacaaggctgtggtggaggtggatgagagcggcaccagggctgctgctgccaccggcaccatcttcaccttccgcagcgcccggctgaacagccagaggctggtgttcaaccggcccttcctgatgttcatcgtggacaacaacatcctcttcctgggcaaggtgaaccggccctag

SEQ ID NO: 7164 - DNA, 1626 bp, Artificial Sequence
  Description of Artificial Sequence: Synthetic coding sequence
atgaggctgagccccttccacctgcagctggagttccacatgaaggagaagcgggaggacctgcagatctcctggagcttcatctctgtgcctgagatggctgtgaacatccagcccaaggccctgggggaggaccaggtggccgagaccagcgccatgtctgatgtgctgaaggacatcctgaagcacctggccggcagcgccagccccagcgtggtgctgatcaccaagcccaccaccgtgaaggaggcccagaacctgcagtgtgccgccagcacagcccaggagagctgcccccccaagccaccccgggcccacgagctgaagctgctggtgaggaacatccacgtgctgctgctgtctgagcccggggccagcggccacatcaatgctgtgtgtgtggtgcagctgaatgaccctgtgcagcgcttcagcagcaccctgaccaagaacaccccagacctgatgtgggaggaggagttcacctttgagctgaatgccaagagcaaggagctgcacctgcagatcagcgaggccggccgcagcagcgagggcctgctggccacagccaccgtgcccctggacctcttcaagaagcagcccagcggcccccagagcttcaccctgaccagcggcagcgcctgtggcagctctgtgctgggctctgtgacagctgagttctcctacatggagcccggggagctgaagtcctggcccatccccccacctgtgcctgctgccaagattgagaaggacagaacagtgatgccctgtggcaccgtggtgaccaccgtgacagctgtgaagaccaagccccgggtggatgtgggccgggccagccccctgagcagtgacagccctgtgaagacccccatcaaggtgaaggtgattgagaaggacatctctgtgcaggccatcgcctgccgcagcgcccctgtgtccaagaccctgagcagcagtgacacagagctgctggtgctgaatggaagtgaccctgtggccgaggtggccatccggcagctgtctgagagcagcaagctgaagctgaagagccccaggaagaagagcaccatcatcatcagcggcatcagcaagaccagcctgagccaggaccatgatgctgccctgatgcagggctacacagcctctgtggacagcacccaccaggaggatgcccccagccaccctgagagagctgctgccagcgcccctcctgaggaggccgagagcgcccaggccagcctggcccccaagccccaggaggatgagctggacagctgggacctggagaaggagccccaggccgccgcctggagcagccaggtgctgctggaccctgatggagatgagctgtctgagagctccatgtctgtgctggagcctggaacagccaagaagcacaagggcggcatcctgaggaagggggccaagctgttcttcagaagaagacaccagcagaaggaccccggcatgagccagagccacaatgacctggtgttcctggagcagcctgagggcagcaggaggaagggcatcaccctgacccgcatcctgaacaagaagctgctgagccgccacaggaacaagaacaccatgaatggagcccctgtggagccctgcacctag

SEQ ID NO: 7165 - DNA, 993 bp, Artificial Sequence
  Description of Artificial Sequence: Synthetic coding sequence
atggccttcctgcccagctgggtgtgtgtgctggtgggcagcttcagcgccagcctggccggcaccagcaacctgtctgaaacagagccccccctgtggaaggagagccctggccagctgagtgactacagagtggagaacagcatgtacatcatcaacccctgggtgtacctggagaggatgggcatgtacaagatcatcctgaaccagacagcccgctactttgccaagtttgccccagacaatgagcagaacatcctgtggggcctgcccctgcagtatggctggcagtacagaacaggccgcctggccgaccccaccaggaggaccaactgtggctatgagagcggggaccacatgtgcatctctgtggacagctggtgggccgacctgaactacttcctgagcagcctgcccttcctggccgctgtggacagcggcgtgatgggcatcagcagtgaccaggtgcggctgctgcccccacccaagaatgaaaggaagttctgctatgatgtgagcagctgccgcagcagcttccctgagaccatgaacaagtggaacaccttctaccagtacctgcagagccccttcagcaagtttgatgacctgctgaagtacctgtgggccgcccacaccagcaccctggccgacaacatcaagagctttgaagatagatatgactactacagcaaggccgaggcccactttgagaggtcctgggtgctggccgtggaccacctggccgctgtgctcttccccaccaccctcatccgcagctacaagttccagaagggcatgccaccccgcatcctgctgaacacagatgtggcccccttcatcagtgacttcaccgccttccagaatgtggtgctggtgctgctgaacatgctggacaacgtggacaagagcatcggctacctgtgcacagagaagagcaatgtgtacagagaccacagcgagagcagcagccgctcctatggcaacaacagctag

SEQ ID NO: 7166 - DNA, 813 bp, Artificial Sequence
  Description of Artificial Sequence: Synthetic coding sequence
atggacagcctggagtggaactgggccctggtgtatgagctgtctggagagcaccatgatgaggagtggagcgtgaagacctaccaggaggtggcccagaagtttgtggagacccaccctgagttcatcggcatcaagatcatctacagcgaccacaggagcaaggatgtggccgtgattgctgagagcatccgcatggccatgggcctgcgcatcaagttccccaccgtggtggccggctttgacctggtgggccacgaggacaccggccacagcctgcatgactacaaggaggccctgatgatcccagccaaggatggagtgaagctgccctacttcttccacgccggggagacagactggcagggcaccagcattgacaggaacatcctggatgccctgatgctgaacaccaccagaattggacatggctttgccctgagcaagcaccctgctgtgaggacctacagctggaagaaggacatccccatcgaggtgtgccccatcagcaaccaggtgctgaagctggtgtctgacctgaggaaccaccctgtggccaccctgatggccaccggccaccccatggtgatcagcagtgatgatcctgccatgtttggagccaagggcctgtcctatgacttctatgaggtgttcatgggcattggaggcatgaaggctgacctgcggaccctgaagcagctggccatgaacagcatcaagtacagcaccctgctggagagcgagaagaacaccttcatggagatctggaagaagcgctgggacaagttcatcgcagatgtggccaccaagtag

SEQ ID NO: 7167 - DNA, 939 bp, Artificial Sequence
  Description of Artificial Sequence: Synthetic coding sequence
atgggcgtgatggccatgctgatgctgcccctgctgctgctgggcatcagcggcctgctcttcatctaccaggaggtgtcccggctgtggagcaagtctgctgtgcagaacaaggtggtggtgatcacagatgccatcagcggcctgggcaaggaatgtgcccgggtcttccacactggaggagcccggctggtgctgtgtgggaagaactgggagcggctggagaacctgtatgatgccctgatctctgtggccgaccccagcaagcagaccttcacccccaagctggtgctgctggacctgagtgacatcagctgtgtgcctgatgtggccaaggaggtgctggactgctacggctgtgtggacatcctgatcaacaatgcctctgtgaaggtgaagggccctgcccacaagatcagcctggagctggacaagaagatcatggatgccaactacttcggccccatcaccctgaccaaggccctgctgcccaacatgatcagcagaagaacaggccagatcgtgctggtgaacaacatccagggcaagtttggcatccccttccgcaccacctatgctgccagcaagcacgccgccctgggcttctttgactgcctgcgggcagaggtggaggagtatgatgtggtgatcagcacagtgagccccaccttcatccgcagctaccacgtgtacccagagcagggcaactgggaggccagcatctggaagttcttcttcaggaagctgacctatggagtgcaccctgtggaggtggccgaggaggtgatgaggacagtgcggaggaagaagcaggaggtgttcatggccaaccccatccccaaggctgctgtgtatgtgaggaccttcttccctgagttcttctttgctgtggtggcctgtggggtgaaggagaagctgaatgtgcctgaggagggctag

SEQ ID NO: 7168 - DNA, 738 bp, Artificial Sequence
  Description of Artificial Sequence: Synthetic coding sequence
atggccagcacagccctgctggccctgtgcagcactggagccttcagcggcctggccgtggaggccggggccggcgtgtgccacgccacccccatctatgccggccacagctggcaccaggccaccttccggctgaatgtggccggcagcaccctgagccgctacctgcgggacctgctggtggccgccaacccagacctgctgcagcaggccctgcccaggaaggccatcacccacctgaagaagaggagctgctacgtgtccctggactttgaaggagacctgcgggaccctgcccggcaccacccagccagcttctctgtgggcaatggctgctgcgtgtgcctgagcagcgagcgcttccgctgcccagagcccatcttccagcccggcctgctgggccaggccgagcagggcctgcctgccctggccttccgggccctgcagaagatgcccaagaccctgcggacccggctggccgacacagtggtgctggccggcggcagcaccctcttccctggctttgctgagcggctggacaaggagctggaggcccagtgccgccgccacggctatgctgccctgcggccccacctggtggccaagcacggccggggcatggctgtgtggacaggaggctccatggtggccagcctgcacagcttccagaggcgctggatcacccgggccatgtaccaggagtgtggcagccggctgctgtatgatgtgttcaactag

SEQ ID NO: 7169 - DNA, 909 bp, Artificial Sequence
  Description of Artificial Sequence: Synthetic coding sequence
atgaggcgctgggcctgggccgctgtggtggtgctgctgggcccccagctggtgctgctgggcggcgtgggcgcccggcgggaggcccagaggacccagcagcccggccagagagctgaccccccaaatgccacagccagcgccagcagccgggagggcctgcctgaggcccccaagcccagccaggccagcggccctgagttcagtgatgcccacatgacctggctgaactttgtgcggcggccagatgatggagccctgaggaagagatgtggcagccgggacaagaagccccgggacctgtttggccccccaggccccccaggagctgaggtgacagctgagaccctgctgcacgagttccaggagctgctgaaggaggccacagaaagacgcttcagcggcctgctggaccccctgctgccccagggcgccggcctgcggctggtgggggaggccttccactgccgcctgcagggcccccggcgggtggacaagaggaccctggtggagctgcacggcttccaggccccagctgcccagggcgccttcctgcggggcagcggcctgagcctggccagcggccgcttcaccgcccctgtgtctggcatcttccagttcagcgccagcctgcacgtggaccacagcgagctgcagggcaaggcccggctgcgggccagagatgtggtgtgtgtgctgatctgcatcgagagcctgtgccagaggcacacctgcctggaggccgtgtctggcctggagagcaacagcagggtcttcaccctgcaggtgcagggcctgctgcagctgcaggccggccagtatgcctctgtgtttgtggacaatggaagtggagctgtgctgaccatccaggccggcagcagcttcagcggcctgctgctgggcacctag

SEQ ID NO: 7170 - DNA, 1416 bp, Artificial Sequence
  Description of Artificial Sequence: Synthetic coding sequence
atggattctgcccccctcttcccccggccccacctgttccagaacctgctgctcttcctgtgggccctgctgaactgtggcctgggcgtgtctgcccagggccctggagagtggaccccctgggtgtcctggacccgctgcagcagcagctgtggccggggcgtgtctgtgcgcagccgccgctgcctgcggctgcccggggaggagccctgctggggagacagccatgagtaccgcctgtgccagctgcctgactgccccccaggagctgtgcccttccgggacctgcagtgtgccctgtacaacggccggcctgtgctgggcacccagaagacctaccagtgggtgcccttccatggagcccccaaccagtgtgacctgaactgcctggccgagggccacgccttctaccacagctttggccgggtgctggatggaacagcctgcagccctggggcccagggcgtgtgtgtggccggccgctgcctgtctgctggctgtgatggcctgctgggcagcggggccctggaggacagatgtggccgctgtggcggggccaatgacagctgcctgtttgtgcagagggtcttcagagatgctggggcctttgctggctactggaatgtgaccctcatccctgagggcgcccggcacatccgggtggagcacaggagcaggaaccacctggccctgatgggaggagatggccgctacgtgctgaatggccactgggtggtgagccccccaggcacctatgaggccgccggcacccacgtggtgtacacccgggacaccggcccccaggagaccctgcaggccgccggccccaccagccatgacctgctgctgcaggtgctgctgcaggagcccaaccctggcatcgagtttgagttctggctgccccgggagcgctacagccccttccaggcccgggtgcaggccctgggctggcccctgcggcagccccagccccggggcgtggagccccagcccccagctgccccagctgtgaccccagcccagacccccaccctggccccagacccctgccccccctgcccagacacccggggccgggcccaccggctgctgcactactgcggcagtgactttgtgttccaggcccgggtgctgggccaccaccaccaggcccaggagaccaggtatgaggtgcgcatccagctggtgtacaagaacagaagccccctgcgggcccgggagtatgtgtgggcccctggccactgcccctgccccatgctggccccccaccgggactacctgatggctgtgcagaggctggtgtccccagatggcacccaggaccagctgctgctgccccacgccggctacgcccggccctggagccctgctgaggacagccgcatccggctgacagcccggcgctgccccggctag

SEQ ID NO: 7171 - DNA, 222 bp, Artificial Sequence
  Description of Artificial Sequence: Synthetic coding sequence
atggccccccagaccctgctgctggtgctggtgctgtgtgtgctgctgctgcaggcccagggcggctacagagacaagatgaggatgcagaggatcaaggtgtgtgagaagaggcccagcattgacctgtgcatccaccactgcagctacttccagaagtgtgagaccaacaagatctgctgcagcgccttctgtggcaacatctgcatgagcatcctgtag

SEQ ID NO: 7172 - DNA, 2349 bp, Artificial Sequence
  Description of Artificial Sequence: Synthetic coding sequence
atggcccgggcccgggccggggccctgctggccctgtgggtgctgggcgccgccgcccacccccagtgcctggacttccggccccccttccggcccacccagcccctgcggctgtgtgcccagtacagcgactttggctgctgtgatgagggcagagatgctgagctgacccggcgcttctgggccctggccagccgggtggatgctgctgagtgggccgcctgtgccggctacgcccgggacctgctgtgccaggagtgcagcccctatgctgcccacctgtatgatgctgaggaccccttcacccccctgaggacagtgcccggcctgtgccaggactactgcctggacatgtggcacaagtgccggggcctcttccgccacctgagcacagaccaggagctgtgggccctggagggcaacctggcccgcttctgccgctacctgagcctggatgacacagactactgcttcccctacctgctggtgaacaagaacctgaacagcaacctgggccacgtggtggctgatgccaagggctgcctgcagctgtgcctggaggaggtggccaacggcctgaggaaccctgtggccatggtgcacgccagagatggcacccaccgcttctttgtggccgagcaggtgggcctggtgtgggcctacctgcctgacaggagccggctgggcaagcccttcctgaacatcagccgggtggtgctgaccagcccctgggagggagatgagcggggcttcctgggcatcgccttccaccccagcttccagcacaacagaaggctgtatgtgtactacagcgtgggcatccgcagcagcgagtggatccgcatcagcgagttccgggtgtctgaagatgatgaaaatgctgtggaccacagcagcgagcgcatcatcctggaggtgaaggagcccgccagcaaccacaacggcggccagctgctgtttggagatgatggctacctgtacatcttcaccggagatggcggcatggccggggaccccttcggcacctttggaaatgcccagaacaagagcgccctgctgggcaaggtgctgagaattgatgtggacaggaaggagcggggcctgccctacggcatccccccagacaacccctttgtgggggaccctgctgcccagcctgaggtgtatgccctgggcgtgaggaacatgtggcgctgcagctttgacagaggagaccccagcagcggcaccggccggggccgcctcttctgtggagatgtgggccagaacaagtttgaggaggtggatgtggtggagcggggcggcaactacggctggagggcccgggagggctttgagtgctatgacaggagcctgtgtgccaacaccagcctgaatgacctgctgcccatctttgcctacccccacacagtgggcaagtctgtgactggaggctacgtgtaccggggctgtgagtaccccaacctgaatggcctgtacatctttggagacttcatgagcggccgcctgatgagcctgcaggagaaccctggcaccggccagtggcagtacagcgagatctgcatgggccacggccagacctgtgagttccctggcctcatcaacaactactacccctacatcatcagctttggagaagatgaagctggggagctgtacttcatgagcactggagagcccagcgccacagccccccggggcgtggtgtacaagatcattgatgccagcagaagagcccctcctgggaagtgccagatccagcctgcccaggtgaagatccgcagccgcctcatcccctttgtgcccaaggagaagttcatccccaagaccaggagcaccccccggcccacagcccgggcccccacccgggccccccggcggggccggcccacagctgcccccccagcccccacccccaggcctgcccggcccacccagcagcccggcagcagaagaggaggcggcagaagaagaggccgcctgaacagcgccagccgggccttcagagatggagaggtgcggctggtgcggcctgctggcctgagcagcggcagcggccgggtggaggtgtttgtgggcggccgctggggcaccgtgtgtgatgacagctggaacatctctggagctgctgtggtgtgccggcagctgggctttgcctatgctgtgcgggctgtgaagagagctgagtttggccagggcggcagcctgcccatcctgctggatgatgtgcgctgtgccggctgggagaggaacctgctggagtgccagcacaacggggtgggcacccacaactgtgaacatgatgaagatgctggggtggtgtgcagccaccagaacccagacctgtag

SEQ ID NO: 7173 - DNA, 1317 bp, Artificial Sequence
  Description of Artificial Sequence: Synthetic coding sequence
atgcaccccctgcccggctactggagctgctactgcctgctgctgctcttcagcctgggcgtgcagggcagcctgggcgcccccagcgctgcccctgagcaggtgcacctgagctacccaggagagcccggctccatgacagtgacctggaccacctgggtgcccaccaggtctgaggtgcagtttggcctgcagcccagcggccccctgcccctgcgggcccagggcacctttgtgccctttgtggatggcggcatcctgcggaggaagctgtacatccaccgggtgaccctgaggaagctgctgcccggggtgcagtatgtgtaccgctgtggcagcgcccagggctggagccgccgcttccgcttccgggccctgaagaatggagcccactggagcccccggctggccgtgtttggagacctgggcgctgacaaccccaaggctgtgccccggctgcggcgggacacccagcagggcatgtatgatgctgtgctgcacgtgggggactttgcctacaacctggaccaggacaatgcccgggtgggggaccgcttcatgaggctcatcgagcctgtggccgccagcctgccctacatgacctgccccggcaaccacgaggagcgctacaacttcagcaactacaaggcccgcttctccatgcctggggacaatgaaggcctgtggtacagctgggacctgggccctgcccacatcatctccttcagcacagaggtgtacttcttcctgcactacggccgccacctggtgcagaggcagttccgctggctggagagtgacctgcagaaggccaacaagaacagagctgcccggccctggatcatcaccatgggccaccggcccatgtactgcagcaatgctgacctggatgactgcaccaggcatgagagcaaggtgaggaagggcctgcagggcaagctgtatggcctggaggacctcttctacaagtatggagtggacctgcagctgtgggcccacgagcacagctatgagcggctgtggcccatctacaactaccaggtgttcaacggcagccgggagatgccctacaccaacccccggggccctgtgcacatcatcaccggcagcgctggctgtgaggagcggctgaccccatttgctgtgttcccccggccctggagcgctgtgcgggtgaaggagtatggctacacccggctgcacatcctgaatggcacccacatccacatccagcaggtgtctgatgaccaggacggcaagatcgtggatgatgtgtgggtggtgcggcccctgtttggccgcaggatgtacctgtag

SEQ ID NO: 7174 - DNA, 411 bp, Artificial Sequence
  Description of Artificial Sequence: Synthetic coding sequence
atggcccggaccaagcagacagccaggaagagcactggaggcaaggcccccaggaagcagctggccaccaaggccgccaggaagagcgccccagccactggaggagtgaagaagccccaccgctaccggcccggcaccgtggccctgcgggagatccgccgctaccagaagagcacagagctgctgatcaggaagctgcccttccagaggctggtgcgggagatcgcccaggacttcaagacagacctgcgcttccagagcagcgctgtgatggccctgcaggaggccagcgaggcctacctggtgggcctgtttgaggacaccaacctgtgtgccatccacgccaagagggtgaccatcatgcccaaggacatccagctggcccggcgcatccggggggagcgggcctag

SEQ ID NO: 7175 - DNA, 1209 bp, Artificial Sequence
  Description of Artificial Sequence: Synthetic coding sequence
atggccgcccggcccggccccctgtggctgctgggcctgaccctgtgtgccctgggcggcggcggccctggcctgcggcccccacctggctgcccccagaggcggctgggcgcccgggagaggagagatgtgcagcgggagatcctggccgtgctgggcctgcccggccggccccggccccgggcccctcctgctgccagccggctgcctgccagcgcccccctcttcatgctggacctgtaccacgccatggctggagatgatgatgaagatggagccccagctgagcagaggctgggccgggctgacctggtgatgagctttgtgaacatggtggagcgggaccgggccctgggccaccaggagccccactggaaggagttccgctttgacctgacccagatcccagctggggaggccgtgacagctgctgagttccgcatctacaaggtgcccagcatccacctgctgaacagaaccctgcacgtgtccatgttccaggtggtgcaggagcagagcaaccgggagagtgacctcttcttcctggacctgcagaccctgcgggctggagatgagggctggctggtgctggatgtgacagctgccagtgactgctggctgctgaagaggcacaaggacctgggcctgcggctgtatgtggagacagaagatggccacagcgtggaccccggcctggccggcctgctgggccagagggcccccaggagccagcagccctttgtggtgaccttcttccgggccagccccagccccatccgcacccccagggctgtgcggcccctgcggcggcggcagcccaagaagagcaatgagctgccccaggccaaccggctgcccggcatctttgatgatgtgcggggcagccacggccggcaggtgtgcagaagacatgagctgtatgtgtccttccaggacctgggctggctggactgggtgattgccccccagggctacagcgcctactactgtgaaggagaatgttccttccccctggacagctgcatgaatgccaccaaccacgccatcctgcagagcctggtgcacctgatgaagcccaatgctgtgcccaaggcctgctgtgcccccaccaagctgagcgccacctctgtgctgtactatgacagcagcaacaacgtcatcctgaggaagcacaggaacatggtggtgaaggcctgtggctgccactag

SEQ ID NO: 7176 - DNA, 957 bp, Artificial Sequence
  Description of Artificial Sequence: Synthetic coding sequence
atggctgctgctgccctgcccccccggcccctgctgctgctgcccctggtgctgctgctgagcggccggcccaccagggctgacagcaaggtgtttggagacctggaccaggtgaggatgaccagcgagggcagtgactgccgctgcaagtgcatcatgaggcccctgagcaaggatgcctgcagccgggtgcgcagcggccgggcccgggtggaggacttctacacagtggagaccgtgagcagcggcacagactgccgctgcagctgcacagccccacccagcagcctgaacccctgtgaaaatgagtggaagatggagaagctgaagaagcaggcccctgagctgctgaagagcatcaaggccaacctgagcagagaaaatgaggtggtgaaggacagcgtgcgccacctgtctgagcagctgcggcactatgagaaccacagcgccatcatgctgggcatcaagaaggagctgagccggctgggcctgcagctgctgcagaaggatgctgctgctgccccagccaccccagccaccggcaccggcagcaaggcccaggacacagcccggggcaagggcaaggacatcagcaaatatggctctgtgcagaagagctttgctgaccggggcctgcccaagccacccaaggagaagctgctgcaggtggagaagctgaggaaggagagcggcaagggcagcttcctgcagcccacagccaagccccgggccctggcccagcagcaggccgtcatccggggcttcacctactacaaggccggcaagcaggaggtgacagaggccgtggccgacaacaccctgcagggcacctcctggctggagcagctgccccccaaggtggagggccgcagcaacagcgctgagcccaacagcgctgagcaggatgaggccgagcccaggagcagcgagcgggtggacctggccagcggcacctag

SEQ ID NO: 7177 - DNA, 402 bp, Artificial Sequence
  Description of Artificial Sequence: Synthetic coding sequence
atggccctgggcgtgcccatctctgtgtacctgctcttcaatgccatgacagccctgacagaggaggccgctgtgacagtgaccccacccatcacagcccagcaggccgacaacatcgagggccccatcgccctgaagttcagccacctgtgcctggaggaccacaacagctactgcatcaatggagcctgtgccttccaccacgagctggagaaggccatctgccgctgcttcaccggctacaccggggagcgctgtgagcacctgaccctgaccagctatgctgtggacagctatgagaagtacatcgccatcggcattggagtgggcctgctgctgagcggcttcctggtgatcttctactgctacatcaggaagagatatgagaaggacaagatctag

SEQ ID NO: 7178 - DNA, 651 bp, Artificial Sequence
  Description of Artificial Sequence: Synthetic coding sequence
atgagcagcgaggccgagacccagcagcccccagctgcccccccagctgccccagccctgtctgctgctgacaccaagccaggcaccaccggcagcggggccggcagcggcggccctgggggcctgaccagcgctgccccagctggaggagacaagaaggtgattgccaccaaggtgctgggcaccgtgaagtggttcaacgtgagaaatggctacggcttcatcaacagaaatgacaccaaggaggatgtgtttgtgcaccagggcgctgaggccgccaacgtgacaggccctgggggcgtgcctgtgcagggcagcaaatatgctgctgacaggaaccactaccgccgctaccccaggagaagaggcccccccaggaactaccagcagaactaccagaacagcgagagcggggagaagaatgaaggcagcgagagcgcccctgagggccaggcccagcagaggcggccctacagaagaagacgcttccccccctactacatgagaagaccctacggccggcggccccagtacagcaacccccctgtgcagggcgaggtgatggagggcgctgacaaccagggcgctggggagcagggccggcctgtgcggcagaacatgtaccggggctaccggccccgcttcagatag

SEQ ID NO: 7179 - DNA, 756 bp, Artificial Sequence
  Description of Artificial Sequence: Synthetic coding sequence
aatgactggagcgctgaccagctgtacctggagaccaccgggaagagcaggaccctgcagagcggcctggccctgctgtatggcttcctgcctgactttgactggaagaagatctacttccgccaccagcccagcgccctcttctgcagcggcagctgctactgccctgtgaggaaccagtacctggagaaggagcagaggcggcagtacctgctgcggctgaagaacagccagctggagaagacctatggagagatggccaagatcgtggatgtgcccaccaagcagctgcgggccgccaaccccatcgacagcatgctgtgccacttctgccacaacgtgtccttcccctgcaccagaaatggctgtgtggacatggagcacttcaaggtgatcaagacccaccagattgaagatgagcgggagcggcgggagaagaagctgtacttcggctacagcctgctgggcgcccaccccatcctgaaccagaccatcggccgcatgcagagggccacagagggcaggaaggaggagctgtttgccctgtacagcgcccatgatgtgaccctgagccctgtgctgagcgccctgggcctgtctgaggcccgcttccccaggtttgctgcccgggtgaacatccccagcggcttcttcaccatggcctccatgagccacagcacccccctgagcgccaagaccaccacctctgtgctgcccagcccctgtgcccggctgaagacctggagcgccctgtag

SEQ ID NO: 7180 - DNA, 576 bp, Artificial Sequence
  Description of Artificial Sequence: Synthetic coding sequence
atggccgccccccggggccgggccgccccctggaccacagccctgctgctgctgctggccagccaggtgctgagccctggcagctgtgctgatgaggaggaggtgcctgaggagtgggtgctgctgcacgtggtgcagggccagattggagctggcaactacagctacctgcggctgaaccacgagggcaagatcgtgctgaggatgaggagcctgaagggagatgctgacctgtatgtgtctgccagcagcctgcaccccagctttgatgattatgagctgcagagcgccacctgtggcccagatgctgtgtccatcccagcccacttcagaagacctgtgggcatcggcgtgtatggccaccccagccacctggagagcgagtttgagatgaaggtgtactatgatggcaccgtggagcagcacccctttggagaggccgcctacccagcagatggagcagatgctggccagaagcatgctggggccccagaagatgccagccaggaggaggagagcgtgctgtggaccatcctgatcagcatcctgaagctggtgctggagatcctcttctag

SEQ ID NO: 7181 - DNA, 2301 bp, Artificial Sequence
  Description of Artificial Sequence: Synthetic coding sequence
atgggcagaagaaggctgctggtgtggctgtgtgctgtggccgccctgctgagcggggcccaggcccggggcacccccctgctggcccggcctgcccctcctggggccagccgctacagcctgtacaccaccggctggaggccccggctgcggcccggcccccacaaggccctgtgtgcctacgtggtgcacagaaatgtgacctgcatcctgcaggagggcgctgagagctatgtgaaggccgagtaccggcagtgccgctggggccccaagtgccccggcaccgtgacctacagaacagtgctgcggcccaagtacaaggtgggctacaagacagtgacagacctggcctggcgctgctgccccggcttcaccgggaagcgctgcccagagcacctgacagaccacggggccgccagcccccagctggagcctgagccccagatccccagcggccagctggaccccggcccccggccccccagctacagccgggccgcccccagcccccacggcaggaagggccctggcctgtttggagagcggctggagcggctggagggagatgtgcagaggctggcccagacctacggcaccctgagcggcctggtggccagccatgaggaccccaacaggatgactggaggcccccgggccccagctgtgcctgtgggctttggagtcatccctgagggcctggtgggccctggggaccgggcccggggccccctgaccccacccctggatgagatcctgagcaaggtgacagaggtgagcaacaccctgcagaccaaggtgcagctgctggacaaggtgcacggcctggccctgggccacgaggcccacctgcagaggctgcgggaggccccacccagccccctgaccagcctggccctgctggaggagtatgtggaccggcggctgcaccggctgtggggcagcctgctggatggctttgagcagaagctgcagggcgtgcagagtgaatgtgacctgcgggtgcaggaggtgcggcggcagtgtgaggagggccaggccgccagccggcggctgcaccagagcctggatggccgggagctggccctgcggcaggagctgagccagctgggcagccagctgcagggcctgtctgtgtctggccggggcagctgctgcggccagctggccctgatcaatgccaggatggatggcctggagcgggccctgcaggccgtgacagagacccagaggggccctggggccccagctggagatgagctgacccggctgtctgctgccatgctggagggcggcgtggatggcctgctggagggcctggagaccctgaatggaacagaaggaggagcccggggctgctgcctgcggctggacatgggcggctggggcgtgggcggcttcggcaccatgctggaggagcgggtgcagagcctggaggagcggctggccaccctggccggggagctgagccatgacagcgccagccctggccgcagcgcccggcccctggtgcagacagagctggccgtgctggagcagaggctggtgtccctggagaccagctgcacccccagcaccaccagcgccatcctggacagcctggtggccgaggtgaaggcctggcagagccgctctgaggccctgctgcggcaggtggccagccatgctgccctgctgcagcagctgaatggcaccgtggccgaggtgcagggccagctggccgagggcaccggcagcagcctgcagggcgagatcaccctgctgaaggtgaacctgaacagcgtgtccaagagcctgaccggcctgagtgacagcgtgtcccagtacagtgatgccttcctggccgccaacaccagcctggatgagcgggagaggaaggtggaggccgaggtgcaggccatccaggagcaggtgagcagccagggcagccggctgcaggccggccaccggcaggtgctgaacctgcggggggagctggagcagctgaaggccggcgtggccaaggtggccagcggcctgagccgctgccaggacacagcccagaagctgcagcacacagtgggccactttgaccagagggtggcccaggtggagggcgcctgccggcggctgggcctgctggccgccggcctggacagcctgcccacagagcccctgcggccccgggagggcctgtggagccacgtggaccagctgaacagaaccctggcccagcacacccaggacatcgcccggctgagagatgacctgctggactgccaggcccagctggccgagcaggtgcggcccggccaggccaactag

SEQ ID NO: 7182 - DNA, 1251 bp, Artificial Sequence
  Description of Artificial Sequence: Synthetic coding sequence
atgtaccgccacggcatcagcagccagaggtcctggcccctgtggaccaccatcttcatcttcctgggcgtggccgccatcctgggcgtgaccatcggcctgctggtgcacttcctggccgtggagaagacctactactaccagggcgacttccacatcagcggcgtgacctacaatgacaactgtgaaaatgctgccagccaggccagcaccaacctgagcaaggacatcgagaccaagatgctgaatgccttccagaacagcagcatctacaaggagtatgtgaagtctgaggtgatcaagctgctgcccaatgccaacggcagcaatgtgcagctgcagctgaagttcaagttccccccagctgagggcgtgtccatgaggaccaagatcaaggccaagctgcaccagatgctgaagaacaacatggcctcctggaatgctgtgcctgccagcatcaagctgatggagatcagcaaggccgccagcgagatgctgaccaacaactgctgcggccggcaggtggccaacagcatcatcactggaaacaagatcgtgaatggcaagagcagcctggagggcgcctggccctggcaggcctccatgcagtggaagggccgccactactgtggggccagcctcatcagcagccgctggctgctgtctgctgcccactgctttgccaagaagaacaacagcaaggactggacagtgaactttggcatcgtggtgaacaagccctacatgaccaggaaggtgcagaacatcatcttccacgagaactacagcagccctggcctgcatgatgacatcgccctggtgcagctggccgaggaggtgtccttcacagagtacatcaggaagatctgcctgcctgaggccaagatgaagctgtctgaaaatgacaacgtggtggtgacaggctggggcaccctgtacatgaatggcagcttccctgtgatcctgcaggaggacttcctgaagatcatcgacaacaagatctgcaatgccagctatgcctacagcggctttgtgacagacaccatgctgtgtgccggcttcatgtctggagaggctgatgcctgccagaatgacagcggcggccccctggcctacccagacagcaggaacatctggcacctggtgggcatcgtgtcctggggagatggctgcggcaagaagaacaagccaggagtgtacaccagggtgaccagctacagaaactggatcaccagcaagacaggcctgtag

SEQ ID NO: 7183 - DNA, 639 bp, Artificial Sequence
  Description of Artificial Sequence: Synthetic coding sequence
atgctgagctctgtggtgttctggggcctgattgccctgattggcaccagccggggcagctaccccttcagccacagcatgaagccccacctgcacccccggctgtaccacggctgctacggggacatcatgaccatgaagaccagcggggccacctgtgatgccaacagcgtgatgaactgtggcatccggggcagcgagatgtttgctgagatggacctgcgggccatcaagccctaccagaccctcatcaaggaggtgggccagaggcactgtgtggaccctgctgtgattgctgccatcatcagccgggagagccatggaggctctgtgctgcaggacggctgggaccaccggggcctgaagtttggcctgatgcagctggacaagcagacctaccaccctgtgggcgcctgggacagcaaggagcacctgagccaggccaccggcatcctgacagagcgcatcaaggccatccagaagaagttccccacctggagcgtggcccagcacctgaagggcggcctgagcgccttcaagtctggaattgaggccatcgccacccccagcgacatcgacaatgactttgtgaatgacatcatcgcccgggccaagttctacaagaggcagagcttctag

SEQ ID NO: 7184 - DNA, 378 bp, Artificial Sequence
  Description of Artificial Sequence: Synthetic coding sequence
atggcccggagcgccaccctggccgccgccgccctggccctgtgcctgctgctggcccctcctggcctggcctggtacaagccagctgctggccacagcagctacagcgtgggccgggctgctggcctgctgagcggcctgcggcgcagcccctatgcccggcgcagccagccctacagaggagctgagcccccaggaggagctggggccagccctgagctgcagctgcacccccggctgcggagcctggccgtgtgtgtgcaggatgtggcccccaacctgcagagatgtgagcggctgcctgatggccggggcacctaccagtgcaaggccaacgtgttcctgagcctgcgggctgctgactgcctggccgcctag

SEQ ID NO: 7185 - DNA, 867 bp, Artificial Sequence
  Description of Artificial Sequence: Synthetic coding sequence
atgaacaacctgtccttcagcgagctgtgctgcctcttctgctgccccccctgccctgggaagatcgccagcaagctggccttcctgcccccagaccccacctacaccctgatgtgtgatgagagcggcagccgctggaccctgcacctgtctgaaagagctgactggcagtacagcagccgggagaaggatgccatcgagtgcttcatgaccaggaccagcaaaggaaacagaattgcctgcatgtttgtgcgctgcagccccaatgccaagtacaccctgctcttcagccacggcaatgctgtggacctgggccagatgagcagcttctacatcggcctgggcagccgcatcaactgcaacatcttctcctatgactacagcggctacggggccagcagcggcaagcccacagagaagaacctgtatgctgacatcgaggccgcctggctggccctgcggaccaggtatggcatccggccagaaaatgtcatcatctacggccagagcattggaacagtgcccagcgtggacctggccgcccgctatgaatctgctgctgtgatcctgcacagccccctgaccagcggcatgagggtggccttcccagacaccaagaagacctactgctttgatgccttccccaacatcgacaagatcagcaagatcaccagccctgtgctgatcatccatggaacagaagatgaagtcatcgacttcagccacggcctggccctgtttgagcgctgccagaggcctgtggagcccctgtgggtggagggcgccggccacaatgatgtggagctgtatggccagtacctggagcggctgaagcagtttgtgtcccaggagctggtgaacctgtag

SEQ ID NO: 7186 - DNA, 417 bp, Artificial Sequence
  Description of Artificial Sequence: Synthetic coding sequence
atggtggccccagctgcccgggtcttcctgcgggctgtgcgggccgccctgaccagcacagtgcctgacctgctgtgcctgctggcccggggcagcccccggggcctggccagcggccgcctgcccctggccgtgcacagcgcccagcacggccctggcagcggggccccctggctgagaattgcccggcgggccctgcgctttgtgctgagcaagcactggggagatgactgctacctgaccaaccggctgtggcaggacctgaagccacccagccacgtggagaatggccaggagctgcggctggcccctcctgtgcagtgggccctgcaggtgcagggcaaccagctgcagacagctgtgctgtgcctgaggatggcccctcctgagcccgccggcagccggcagaggatctag

SEQ ID NO: 7187 - DNA, 1332 bp, Artificial Sequence
  Description of Artificial Sequence: Synthetic coding sequence
atgggcggcccccgggcctgggccctgctgtgcctgggcctgctgctgcccggcggcggggccgcctggagcattggagctgcccccttctctggaagaagaaactggtgcagctatgtggtgaccaggaccatcagctgccacgtgcagaatggcacctacctgcagagggtgctgcagaactgcccctggcccatgagctgccccggcagcagctacagaacagtggtgcggcccacctacaaggtgatgtacaagatcgtgacagcccgggagtggcgctgctgccccggccacagcggcgtgtcctgtgaggaggtggccgccagcagcgccagcctggagcccatgtggagcggcagcaccatgaggaggatggccctgcggcccacagccttcagcggctgcctgaactgcagcaaggtgtctgagctgacagagcggctgaaggtgctggaggccaagatgaccatgctgaccgtcatcgagcagcctgtgccccccaccccagccaccccagaggaccctgcccccctgtggggccccccaccagcccagggcagccctggagatggcggcctgcaggaccaggtgggcgcctggggcctgcccggccccaccggccccaagggagatgctggcagccggggccccatgggcatgaggggccccccaggcccccagggccccccaggcagccctggccgggccggggctgtgggcaccccaggagagcggggccccccaggccccccaggccccccaggccccccaggccccccagcccctgtgggccccccccacgcccgcatcagccagcacggggaccccctgctgagcaacaccttcacagagaccaacaaccactggccccagggccccactggacctcctggccccccaggccccatgggccccccaggccccccaggccccactggagtgcccggcagccctggccacatcggccccccaggccccaccggccccaagggcatcagcggccaccctggagagaagggggagcggggcctgcggggggagcccggcccccagggcagcgctggccagagaggagagcccggccccaagggggaccctggagagaagagccactggggcgagggcctgcaccagctgcgggaggccctgaagatcctggccgagcgggtgctgatcctggagaccatgattggcctgtatgagcctgagctgggcagcggggccggccctgctggcaccggcacccccagcctgctgcggggcaagagaggaggccacgccaccaactacagaattgtggcccccaggagcagagatgagcggggctag

SEQ ID NO: 7188 - DNA, 717 bp, Artificial Sequence
  Description of Artificial Sequence: Synthetic coding sequence
atggtgctgctgctgctggtggccatccccctgctggtgcacagcagccggggccctgcccactatgagatgctgggccgctgcaggatggtgtgtgacccccacggcccccggggccctggcccagatggagccccagcctctgtgccccccttccccccaggggccaagggggaggtgggccggcggggcaaggccggcctgcggggccccccaggccccccaggcccccggggccccccaggagagcccggccggcccggccccccaggccccccaggccctggccctggaggagtggccccagctgctggctacgtgccccgcatcgccttctacgccggcctgcggcggccccatgagggctatgaggtgctgcgctttgatgatgtggtgaccaacgtgggcaatgcctatgaagctgccagcggcaagttcacctgccccatgcctggggtgtacttctttgcctaccacgtgctgatgagaggaggagatggcacctccatgtgggccgacctgatgaagaatggccaggtgcgggccagcgccatcgcccaggatgctgaccagaactatgactatgccagcaacagcgtcatcctgcacctggatgtgggagatgaggtgttcatcaagctggatggcggcaaggtgcacggcggcaacaccaacaagtacagcaccttcagcggcttcatcatctacccagactag

SEQ ID NO: 7189 - DNA, 282 bp, Artificial Sequence
  Description of Artificial Sequence: Synthetic coding sequence
atgaagctgttcctggtgctgatcatcctgctgtttgaggtgctgacagatggagcccggctgaagaagtgcttcaacaaggtgacaggctactgcaggaagaagtgcaaggtgggggagagatatgagatcggctgcctgagcggcaagctgtgctgtgccaatgatgaggaggagaagaagcacgtgtccttcaagaagccccaccagcacagcggggagaagctgtctgtgctgcaggactacatcatcctgcccaccatcaccatcttcaccgtgtag

SEQ ID NO: 7190 - DNA, 609 bp, Artificial Sequence
  Description of Artificial Sequence: Synthetic coding sequence
atggtgcgcatctggaccaccatcatgattgtgctgatcctgctgctgcgcatcggccccaacaagcccagcctgagcggccggcaggccccagcccaggcccagaccagtgacctggtgcccagcctcttccccctgggcctgtgggcccctggcttctgcacctggagcagcccagatgaggacaaggtgtggaggcctgcctgggagcagggccccaagggggagccagacccccggggcctgcggcccaggaagcctgtgcccggcactggaaacagagacagcggcacccggcggcggctgcaggatgccacagagcaggaccccaggcctggaaatgatgtggccagcgctgagacagctggcccccccagccccagcggcatccgggcccaggaccgggcccccaggcaccggcgggcccccccagccaggatgcctgtggccccagcccccagcgcagatggagagcccctgcaggagcagggcggcggcctcttccacaggaccaggtctgtgtacaacggcctggagctgaacacctggatgaaggtggagcggctgtttgtggagaagttccaccagagcttcagcctggacaactag

SEQ ID NO: 7191 - DNA, 342 bp, Artificial Sequence
  Description of Artificial Sequence: Synthetic coding sequence
atgctgccctgcctggccctgctgctgctgatggagctgtctgtgtgcaccgtggccggagatggaggagaggagcagaccctgagcacagaggccgagacctgggtgattgtggccctggaggagggcgccggccccagcatccagctgcagctgcaggaggtgaagacaggcaaggccagccagttcttcggcctgatgggcaagagggtgggcggccggcccctcatccagcccaggaggaagaaggcctaccagctggagcacaccttccagggcctgctgggcaagaggagcctcttcacagagggccgggaggatgaggcccagggcagcgagtag

SEQ ID NO: 7192 - DNA, 1269 bp, Artificial Sequence
  Description of Artificial Sequence: Synthetic coding sequence
atgggccctgcctggctgtggctgctgggcaccggcatcctggcctctgtgcactgccagcccctgctggcccatggagacaagagcctgcagggcccccagcccccaagacaccagctgtctgagcccgccccagcctaccaccgcatcacccccaccatcaccaactttgccctgcggctgtacaaggagctggccgcagatgcccctggcaacatcttcttcagccctgtgtccatcagcaccaccctggccctgctgagcctgggcgcccaggccaacaccagcgccctgatcctggagggcctgggcttcaacctgacagagaccccagaggccgacatccaccagggcttccgcagcctgctgcacaccctggccctgcccagccccaagctggagctgaaggtgggcaacagcctcttcctggacaagaggctgaagccccggcagcactacctggacagcatcaaggagctgtatggagcctttgccttcagcgccaacttcacagattctgtgaccaccggccggcagatcaatgactacctgcggcggcagacctacggccaggtggtggactgcctgcctgagttcagccaggacaccttcatggtgctggccaactacatcttcttcaaggccaagtggaagcaccccttcagccgctaccagacccagaagcaggagagcttctttgtggatgagaggaccagcctgcaggtgcccatgatgcaccagaaggagatgcaccgcttcctgtatgaccaggacctggcctgcaccgtgctgcagatcgagtacagaggaaatgccctggccctgctggtgctgcctgaccccgggaagatgaagcaggtggaggccgccctgcagccccagaccctgaggaagtggggccagctgctgctgcccagcctgctggacctgcacctgccccgcttcagcatcagcggcacctacaacctggaggacatcctgccccagatcggcctgaccaacatcctgaacctggaggccgacttctctggagtgacaggccagctgaacaagaccatcagcaaggtgagccacaaggccatggtggacatgtctgagaagggcacagaagctggagctgccagcggcctgctgagccagccccccagcctgaacaccatgtctgacccccacgcccacttcaaccggcccttcctgctgctgctgtgggaggtgaccacccagagcctgctcttcctgggcaaggtggtgaaccctgtggccggctag

SEQ ID NO: 7193 - DNA, 237 bp, Artificial Sequence
  Description of Artificial Sequence: Synthetic coding sequence
atggccctgatcaggaagaccttctacttcctgtttgccatgttcttcatcctggtgcagctgcccagcggctgccaggccggcctggacttcagccagcccttccccagcggggagtttgctgtgtgtgagagctgcaagctgggccggggcaagtgcaggaaggagtgcctggagaatgagaagccagatggcaactgccgcctgaacttcctgtgctgccggcagaggatctag

SEQ ID NO: 7194 - DNA, 2139 bp, Artificial Sequence
  Description of Artificial Sequence: Synthetic coding sequence
atggctgctgctggcctggtggccgtggccgctgctgctgagtacagcggcaccgtggccagcggcggcaacctgcccggggtgcactgcggccccagcagcggggccggccctggcttcggccctggctcctggagccgcagcctggaccgggccctggaggaggccgctgtgactggagtgctgagcctgagcggcaggaagctgcgggagttccccaggggggccgccaaccacgacctgacagacaccaccagggctgacctgagcaggaaccggctgtctgagatccccatcgaggcctgccactttgtgtccctggagaacctgaacctgtaccagaactgcatccgctacatccctgaggccatcctgaacctgcaggccctgaccttcctgaacatcagcaggaaccagctgagcaccctgcctgtgcacctgtgcaacctgcccctgaaggtgctgattgccagcaacaacaagctggtgtccctgcctgaggagatcggccacctgcggcacctgatggagctggatgtgtcctgcaatgagatccagaccatccccagccagatcggcaacctggaggccctgcgggacctgaatgtgagaagaaaccacctggtgcacctgcctgaggagctggccgagctgcccctcatccggctggacttcagctgcaacaagatcaccaccatccctgtgtgctacagaaacctgcggcacctgcagaccatcaccctggacaacaaccccctgcagagccccccagcccagatctgcatcaagggcaaggtgcacatcttcaagtacctgaacatccaggcctgcaagatcgccccagacctgcctgactatgaccggcggcccctgggcttcggcagctgccacgaggagctgtacagcagccggccctacggggccctggacagcggcttcaacagcgtggacagcggggacaagcgctggagcggaaatgagcccacagatgagttcagtgacctgcccctgcgggtggccgagatcaccaaggagcagaggctgcggcgggagagccagtaccaggagaacagaggcagcctggtggtgaccaatggaggagtggagcatgacctggaccagattgactacatcgacagctgcacagctgaggaggaggaggccgaggtgcggcagcccaagggccctgaccctgacagcctgagcagccagttcatggcctacatcgagcagaggcgcatcagccatgagggcagccctgtgaagcctgtggccatccgggagttccagaagacagaggacatgaggcgctacctgcaccagaacagagtgcctgctgagcccagcagcctgctgagcctgagcgccagccacaaccagctgagccacacagacctggagctgcaccagaggcgggagcagctggtggagaggacccggcgggaggcccagctggccgccctgcagtatgaggaggagaagatccgcaccaagcagatccagagagatgctgtgctggactttgtgaagcagaaggccagccagagcccccagaagcagcaccccctgctggatggagtggatggagagtgccccttccccagccgccgcagccagcacacagatgacagcgccctgtgcatgagcctgagcggcctgaaccaggtgggctgtgccgccaccctgccccacagcagcgccttcacccccctgaagagtgatgaccggcccaatgccctgctgagcagccctgccacagagaccgtgcaccacagccctgcctacagcttccctgctgccatccagaggaaccagccccagaggcctgagagcttcctgttccgggccggcgtgcgggcagagaccaacaagggccacgccagccccctgcccccatctgctgcccccaccacagacagcacagacagcatcaccggccagaacagccggcagcgggaggaggagctggagctgattgaccagctgaggaagcacatcgagtaccgcctgaaggtgtccctgccctgtgacctgggcgccgccctgacagatggagtggtgctgtgccacctggccaaccacgtgcggcccaggtctgtgcccagcatccacgtgcccagccctgctgtggtgtcctag

SEQ ID NO: 7195 - DNA, 213 bp, Artificial Sequence
  Description of Artificial Sequence: Synthetic coding sequence
atgagggtgctcttctttgtgtttggagtgctgagcctgatgttcaccgtgcccccagcccggagcttcatcagcaatgatgagtgccccagcgagtactaccactgccgcctgaagtgcaatgctgatgaacatgccatccgctactgtgccgacttcagcatctgctgcaagctgaagatcatcgagattgatggccagaagaagtggtag

SEQ ID NO: 7196 - DNA, 789 bp, Artificial Sequence
  Description of Artificial Sequence: Synthetic coding sequence
atggctgctgccagcgctggggccacccggctgctgctgctgctgctgatggctgtggccgcccccagccgggcccggggcagcggctgccgggccggcaccggggcccggggagctggagctgagggccgggagggggaggcctgtggcaccgtgggcctgctgctggagcacagctttgaaattgatgattctgccaacttcaggaagaggggcagcctgctgtggaaccagcaggacggcaccctgagcctgagccagaggcagctgtctgaggaggagcggggccgcctgagagatgtggccgccctgaatggcctgtacagagtgcgcatcccccggcggcctggggccctggatggcctggaggccggcggctacgtgagcagctttgtgcctgcctgcagcctggtggagagccacctgagtgaccagctgaccctgcacgtggatgtggccggaaatgtggtgggcgtgtctgtggtgacccaccctgggggctgccggggccacgaggtggaggatgtggacctggagctgttcaacacctctgtgcagctgcagccccccaccacagcccctggccctgagacagctgccttcatcgagcggctggagatggagcaggcccagaaggccaagaacccccaggagcagaagagcttctttgccaagtactggatgtacatcatccctgtggtgctcttcctgatgatgtctggggccccagacacaggaggccagggcggcggcggcggcggcggcggcggcggcggcagcggccgctag

SEQ ID NO: 7197 - DNA, 150 bp, Artificial Sequence
  Description of Artificial Sequence: Synthetic coding sequence
atggacagcagccgggagcccaccctgggccgcctggatgctgctggcttctggcaggtgtggcagagatttgatgctgatggccacggccacgagagcaagtttgcccagggcgagacagctgtgtatgactacccccgctgcctgtag

SEQ ID NO: 7198 - DNA, 213 bp, Artificial Sequence
  Description of Artificial Sequence: Synthetic coding sequence
atgcctggggccatgaagatctttgtgttcatcctggccgccctgatcctgctggcccagatcttccaggccaggacagccatccaccgggccctgatcagcaagaggatggagggccactgtgaggccgagtgcctgacctttgaggtgaagattggaggctgcagagctgagctggcccccttctgctgcaagaacaggaagaagcactag

SEQ ID NO: 7199 - DNA, 711 bp, Artificial Sequence
  Description of Artificial Sequence: Synthetic coding sequence
atgatgcctgctgagcggcggctgcccctgagctttgtgctggatgtgctggagggccgggcccagcaccctggggtgctgtatgtgcagaagcagtgcagcaacctgcccagcgagctgccccagctgctgcctgacctggagagccacgtgccctgggccagcgaggccctgggcaagatgccagatgctgtgaacttctggctgggggaggccgctgctgtgaccagcctgcacaaggaccactatgagaacctgtactgtgtggtgtctggagagaagcacttcctgttccacccccccagcgaccggcccttcatcccctacggcctgcgggtgcccggctgcctgcagttcccccacaccctgctgccctgggcccctgagctgtacaccccagccacctaccagctgacagaggagggcaccttcaaggtggtggatgaggaggccatggagaaggtgccctggatccccctggaccccctggccccagacctggcccgctaccccagctacagccaggcccaggccctgcgctgcaccgtgcgggccggggagatgctgtacctgcctgccctgtggttccaccacgtgcagcagagccagggctgcatcgctgtgaacttctggtatgacatggagtatgacctgaagtacagctacttccagctgctggacagcctgaccaaggccagcggcctggactag

SEQ ID NO: 7200 - DNA, 1098 bp, Artificial Sequence
  Description of Artificial Sequence: Synthetic coding sequence
atggcccccaagctgatcaccgtgctgtgcctgggcttctgcctgaaccagaagatctgcccccatgctggggcccaggacaagttcagcctgagcgcctggcccagccctgtggtgcccctgggcggccgggtgaccctgagctgccacagccacctgcgctttgtgatctggaccatcttccagaccaccggcaccaggagccatgagctgcacacaggcctgagcaacaacatcaccatcagccctgtgaccccagagcacgccggcacctaccgctgtgtgggcatctacaagcacgccagcaagtggagcgctgagagcaacagcctgaagatcatcgtgacaggcctcttcaccaagcccagcatcagcgcccaccccagcagcctggtgcacgccggggcccgggtgtccctgcgctgccacagcgagctggcctttgatgagttcatcctgtacaaggagggccacatccagcacagccagcagctggaccagggcatggaggccggcatccactacgtggaggccgtgttctccatgggccctgtgaccccagcccacgccggggcctaccgctgctgcggctgcttcagccacagccgctatgagtggagcgcccccagcgaccccctggacatcgtcatcaccgggaagtacaagaagcccagcctgagcacccaggtggaccccatgatgaggctgggggagaagctgaccctcttctgcagcagcgagatcagctttgaccagtaccacctgttcagacatggagtggcccacggccagtggctgagcggcggccagaggcaccgggaggccttccaggccaacttctctgtgggccgggccacccctgtgcctgggggcacctaccgctgctacggcagcttcaatgacagcccctacaagccccctgtgacccgctgcaacttcaccccccaggagaccctgcgggtgctgctgtgccacagccagaacccccccctgaacctgaccccaccctggcagacccagagccccaggaaggccaacggccgcatgaagaggagcctgcagcagaagaggcacagaagaagctacatgcccagctag

SEQ ID NO: 7201 - DNA, 198 bp, Artificial Sequence
  Description of Artificial Sequence: Synthetic coding sequence
atgaggaccttcctgttcctgtttgctgtgctcttcttcctgaccccagccaagaatgccttctttgatgagaagtgcaacaagctgaagggcacctgcaagaacaactgtgggaagaatgaggagctgattgccctgtgccagaagagcctgaagtgctgcaggaccatccagccctgtggcagcatcatcgactag

SEQ ID NO: 7202 - DNA, 198 bp, Artificial Sequence; identical to SEQ ID NO: 7201
  Description of Artificial Sequence: Synthetic coding sequence

SEQ ID NO: 7203 - DNA, 237 bp, Artificial Sequence; identical to SEQ ID NO: 7193
  Description of Artificial Sequence: Synthetic coding sequence

SEQ ID NO: 7204 - DNA, 2868 bp, Artificial Sequence
  Description of Artificial Sequence: Synthetic coding sequence
atgtgggccggcctgctgctgcgggccgcctgtgtggccctgctgctgcccggggccccagcccggggctacacaggcaggaagcccccaggccactttgctgctgagcggcggcggctgggcccccacgtgtgcctgagcggctttggaagtggctgctgccccggctgggcccccagcatgggcggcggccactgcaccctgcccctgtgcagctttggctgcggcagcggcatctgcatcgcccccaacgtgtgcagctgccaggatggagagcagggcgccacctgcccagagacccacggcccctgtggggagtatggctgtgacctgacctgcaaccacggcggctgccaggaggtggcccgggtgtgccctgtgggcttctccatgacagaaacagctgtgggcatccgctgcacagacattgatgaatgtgtgaccagcagctgtgagggccactgtgtgaacacagagggcggctttgtgtgtgaatgtggccctggcatgcagctgtctgctgacagacacagctgccaggacacagatgagtgcctgggcaccccctgccagcagcgctgcaagaacagcatcggcagctacaagtgcagctgcaggacaggcttccacctgcacggcaacagacacagctgtgtggatgtgaatgaatgtagaagacccctggagcggcgggtgtgccaccacagctgccacaacacagtgggcagcttcctgtgcacctgccggcccggcttccggctgcgggctgacagagtgtcctgtgaggccttccccaaggctgtgctggcccccagcgccatcctgcagccccggcagcaccccagcaagatgctgctgctgctgcctgaggccggccggcctgccctgagccctggccacagcccccccagcggggcccctggccccccagctggggtgaggaccacccggctgcccagccccaccccccggctgcccaccagcagccccagcgcccctgtgtggctgctgagcaccctgctggccacccctgtgcccacagccagcctgctgggcaacctgcggccccccagcctgctgcagggcgaggtgatgggcacccccagcagcccccggggccctgagagcccccggctggccgccggccccagcccctgctggcacctgggcgccatgcatgagagccgcagccgctggacagagcccggctgcagccagtgctggtgtgaagatggcaaggtgacctgtgagaaggtgcgctgtgaggccgcctgcagccaccccatccccagcagagatggcggctgctgccccagctgcaccggctgcttccacagcggcgtggtgcgggcagaaggagatgtgttcagccccccaaatgaaaactgcaccgtgtgtgtgtgcctggccggaaatgtgtcctgcatcagcccagaatgtcccagcggcccctgccagaccccaccccagacagactgctgcacctgtgtgcctgtgcgctgctacttccacggccgctggtatgcagatggagctgtgttttctggaggaggagatgagtgcaccacctgtgtgtgccagaatggagaggtggagtgcagcttcatgccctgcccagagctggcctgcccccgggaggagtggaggctgggccctggccagtgctgcttcacctgccaggagcccacccccagcacaggctgcagcctggatgacaatggagtggagttccccatcggccagatctggagccctggggacccctgtgagctgtgcatctgccaggctgatggctctgtgtcctgcaagaggacagactgtgtggacagctgcccccaccccatccgcatccctggccagtgctgcccagactgcagcgctggctgcacctacacaggccgcatcttctacaacaatgagaccttccccagcgtgctggacccctgcctgagctgcatctgcctgctgggctctgtggcctgcagccctgtggactgccccatcacctgcacctaccccttccacccagatggagagtgctgccctgtgtgccgggactgcaactatgagggcaggaaggtggccaacggccaggtgttcaccctggatgatgagccctgcacccgctgcacctgccagctgggggaggtgtcctgtgagaaggtgccctgccagagggcctgtgccgaccctgccctgctgcccggggactgctgcagcagctgcccagacagcctgagccccctggaggagaagcagggcctgagcccccacggcaatgtggccttcagcaaggccggccgcagcctgcatggagacacagaggcccctgtgaactgcagcagctgccccggccccccaacagccagccccagcaggcctgtgctgcacctgctgcagctgctgctgcggaccaacctgatgaagacccagaccctgcccaccagccctgctggggcccacggcccccacagcctggccctgggcctgacagccaccttccctggagagcccggggccagcccccggctgagccctggccccagcaccccacctggggcccccaccctgcccctggccagccctggggccccccagcccccacctgtgaccccagagaggagcttcagcgccagcggggcccagatcgtgagccgctggccacccctgcccggcaccctgctgacagaggccagcgccctgtccatgatggaccccagccccagcaagacccccatcaccctgctgggcccccgggtgctgagccccaccaccagccggctgagcacagccctggccgccaccacccaccctggcccccagcagccccctgtgggcgccagcagaggagaggagagcaccatgtag

SEQ ID NO: 7205 - DNA, 270 bp, Artificial Sequence
  Description of Artificial Sequence: Synthetic coding sequence
atggtgtcctgtgagcggcgggccagcaagtctgtgggccagatcctgctgtgggactttggctacacctgccgcctgagccacagaagaagaaacagcacagagatcctgagcaggaacctgcctgccctgtacacaggcatcaaggtgtgtgagaagaggcccagcattgacctgtgcatccaccactgcagctacttccagaagtgtgagaccaacaagatctgctgcagcgccttctgtggcaacatctgcatgagcatcctgtag

SEQ ID NO: 7206 - DNA, 600 bp, Artificial Sequence
  Description of Artificial Sequence: Synthetic coding sequence
atggagaccttccccctgctgctgctgagcctgggcctggtgctggccgaggccagcgagagcaccatgaagatcatcaaggaggagttcacagatgaggagatgcagtatgacatggccaagagcggccaggagaagcagaccatcgagatcctgatgaaccccatcctgctggtgaagaacaccagcctgtccatgagcaaggatgacatgagcagcaccctgctgaccttccgcagcctgcactacaatgaccccaagggcaacagcagtggaaatgacaaggagtgctgcaatgacatgacagtgtggaggaaggtgtctgaggccaacggcagctgcaagtggagcaacaacttcatccgcagcagcacagaggtgatgagaagagtgcaccgggcccccagctgcaagtttgtgcagaaccctggcatcagctgctgtgagagcctggagctggagaacacagtgtgccagttcaccaccgggaagcagttcccccgctgccagtaccacagcgtgaccagcctggagaagatcctgactgtgctgaccggccacagcctgatgtcctggctggtgtgtggcagcaagctgtag

SEQ ID NO: 7207 - DNA, 729 bp, Artificial Sequence
  Description of Artificial Sequence: Synthetic coding sequence
atggctgctgccacccggggctgccggccctggggcagcctgctgggcctgctgggcctggtgtctgctgctgctgctgcctgggacctggccagcctgcgctgcaccctgggcgccttctgtgaatgtgacttccggccagacctgcccggcctggagtgtgacctggcccagcacctggccggccagcacctggccaaggccctggtggtgaaggccctgaaggcctttgtgcgggaccctgcccccaccaagcccctggtgctgagcctgcacggctggacaggaacaggcaagagctatgtgagcagcctgctggcccactacctgttccagggcggcctgcggagcccccgggtgcaccacttcagccctgtgctgcacttcccccaccccagccacatcgagcgctacaagaaggacctgaagtcctgggtgcagggcaacctgacagcctgtggccgcagcctcttcctgtttgatgagatggacaagatgcctcctggcctgatggaggtgctgcggcccttcctgggcagctcctgggtggtgtatggcaccaactacaggaaggccatcttcatcttcatccgctggctgctgaagctgggccaccacggccgggccccaccccggcgcagcggggccctgcccccagccccagctgcccccaggcctgccctgcgggcccagagagctggccctgctggccctggggccaagggctag

SEQ ID NO: 7208 - DNA, 627 bp, Artificial Sequence
  Description of Artificial Sequence: Synthetic coding sequence
atgctgggcctgctggtggccctgctggccctgggcctggccgtgtttgccctgctggatgtgtggtacctggtgcggctgccctgtgctgtgctgcgggcccggctgctgcagccccgggtgcgggacctgctggccgagcagcgcttccctggccgggtgctgcccagcgacctggacctgctgctgcacatgaacaatgcccgctacctgcgggaggccgactttgcccgggtggcccacctgacccgctgtggggtgctgggcgccctgcgggagctgcgggcccacacagtgctggccgccagctgtgcccggcaccggcgcagcctgcggctgctggagccctttgaggtgaggacccggctgctgggctgggatgaccgggccttctacctggaggccaggtttgtgtccctgagagatggctttgtgtgtgccctgctgcgcttccggcagcacctgctgggcaccagccctgagcgggtggtgcagcacctgtgccagaggagagtggagcccccagagctgcctgctgacctgcagcactggatctcctacaatgaggccagcagccagctgctgaggatggagagcggcctgagtgatgtgaccaaggaccagtag

SEQ ID NO: 7209 - DNA, 423 bp, Artificial Sequence
  Description of Artificial Sequence: Synthetic coding sequence
atgctggtgaagctgaacagccaggcccggctgagctccatggtgaagaaggtgcggctgcccagccgctgtgagcccccaggcaccacctgcaccgtgtctggctggggcaccaccaccagcccagatgtgaccttccccagcgacctgatgtgtgtggatgtgaagctgatcagcccccaggactgcaccaaggtgtacaaggacctgctggagaacagcatgctgtgtgccggcatcccagacagcaagaagaatgcctgcaatggagacagcggcggccccctggtgtgccggggcaccctgcagggcctggtgtcctggggcaccttcccctgtggccagcccaatgaccccggggtgtacacccaggtgtgcaagttcaccaagtggatcaatgacaccatgaagaagcacaggtag

SEQ ID NO: 7210 - DNA, 354 bp, Artificial Sequence
  Description of Artificial Sequence: Synthetic coding sequence
atgctgagcaaggcccacggctgcaagacagccctgagcctgggccgctgccccaagatccgggaggagtgtgagttccaggagagagatgtgtgcaccaaggaccggcagtgccaggacaacaagaagtgctgcgtgttcagctgtgggaagaagtgcctggacctgaagcaggatgtgtgtgagatgcccaaggagaccggcccctgcctggcctacttcctgcactggtggtatgacaagaaggacaacacctgcagcatgtttgtgtatggaggctgccagggcaacaacaacaacttccagagcaaggccaactgcctgaacacctgcaagaacaagcgcttcccctag

SEQ ID NO: 7211 - DNA, 2328 bp, Artificial Sequence
  Description of Artificial Sequence: Synthetic coding sequence
atgcaccctggccctgaggaggccggcagcggccgctatggcccccgctacatcacagacatgggcgctggagaagatgatgagggctttgaagatgacctggacctggacatcagctttgaggaggtgaagcccctgcctgccaccaagggcggcaacaagaagttcctggtggagagcaagaagatgagcatcagcaaccccaagaccatcagccgcctcatcccccccaccagcgccagcctgcctgtgaccaccgtggccccccagcccatccccatccagaggaagggcaagaatggagtggccatcatgagccggctgtttgacatgccctgtgatgagaccctgtgcagcgctgacagcttctgtgtgaatgactacacctggggcggcagccgctgccagtgcaccctgggcaaaggaggagagagctgcagcgaggacatcgtcatccagtacccccagttcttcggccacagctatgtgacctttgagcccctgaagaacagctaccaggccttccagatcaccctggagttccgggcagaggccgaggatggcctgctgctgtactgtggagaaaatgagcacggccgcggggacttcatgagcctggccatcatccgccgcagcctgcagttccgcttcaactgtggcactggagtggccatcatcgtgtctgagaccaagatcaagctgggcggctggcacacagtgatgctgtacagagatggcctgaatggcctgctgcagctgaacaacggcacccctgtgacaggccagagccagggccagtacagcaagatcaccttccgcacccccctgtacctgggcggggcccccagcgcctactggctggtgcgggccaccggcaccaacagaggcttccagggctgtgtgcagagcctggccgtgaatggaagaagaattgacatgaggccctggcccctgggcaaggccctgtctggagcagatgtgggagaatgtagcagcggcatctgtgatgaggccagctgcatccacggcggcacctgcacagccatcaaggctgacagctacatctgcctgtgccccctgggcttcaagggccgccactgtgaagatgccttcaccctgaccatcccccagttccgggagagcctgcggagctatgctgccaccccctggcccctggagccccagcactacctgtccttcatggagtttgagatcaccttccggccagattctggagatggagtgctgctgtacagctatgacaccggcagcaaggacttcctgagcatcaacctggccggcggccacgtggagttccgctttgactgtggcagcggcactggagtgctgcggtctgaggaccccctgaccctgggcaactggcatgagctgcgggtgtccaggacagccaagaatggcatcctgcaggtggacaagcagaagatcgtggagggcatggccgagggcggcttcacccagatcaagtgcaacacagacatcttcatcggcggcgtgcccaactatgatgatgtgaagaagaacagcggcgtgctgaagcccttcagcggcagcatccagaagatcatcctgaatgacaggaccatccacgtgaagcatgacttcaccagcggcgtgaatgtggagaatgctgcccacccctgtgtgcgggccccctgtgcccatggaggcagctgccggcccaggaaggagggctatgactgtgactgccccctgggctttgagggcctgcactgccagaaggccatcatcgaggccatcgagatcccccagttcatcggccgcagctacctgacctatgacaacccagacatcctgaagagggtgtctggcagccgcagcaatgtgttcatgaggttcaagaccacagccaaggatggcctgctgctgtggaggggggacagccccatgaggcccaacagcgacttcatcagcctgggcctgagagatggagccctggtgttctcctacaacctgggcagcggcgtggccagcatcatggtgaatggcagcttcaatgatggccgctggcaccgggtgaaggctgtgagagatggccagagcggcaagatcaccgtggatgattatggagccaggacaggcaagagccctggcatgatgaggcagctgaacatcaatggagccctgtatgtgggcggcatgaaggagatcgccctgcacaccaaccggcagtacatgaggggcctggtgggctgcatcagccacttcaccctgagcacagactaccacatcagcctggtggaggatgctgtggatggcaagaacatcaacacctgtggggccaagtag

SEQ ID NO: 7212 - DNA, 1257 bp, Artificial Sequence
  Description of Artificial Sequence: Synthetic coding sequence
atgaggaccctcttcaacctgctgtggctggccctggcctgcagccctgtgcacaccaccctgagcaagagtgatgccaagaaggccgccagcaagaccctgctggagaaggtgaagttctgcagctgctgccccggctggagcgccatggcccgctcctggctgacagccaccagcgccacccagagccagttcagtgacaagcctgtgcaggaccggggcctggtggtgacagacctgaaggccgagagcgtggtgctggagcacaggagctactgcagcgccaaggcccgggacagacactttgctggagatgtgctgggctacgtgaccccctggaacagccacggctatgatgtgaccaaggtgtttggcagcaagttcacccagatcagccctgtgtggctgcagctgaagaggcggggccgggagatgtttgaggtgacaggcctgcatgatgtggaccagggctggatgagagctgtgaggaagcacgccaagggcctgcacatcgtgccccggctgctgtttgaggactggacctatgatgacttcagaaatgtgctggacagtgaagatgaaattgaggagctgagcaagacagtggtgcaggtggccaagaaccagcactttgatggctttgtggtggaggtgtggaaccagctgctgagccagaagagggtgggcctcatccacatgctgacccacctggccgaggccctgcaccaggcccggctgctggccctgctggtgattcctccagccatcaccccaggcacagaccagctgggcatgttcacccacaaggagtttgagcagctggcccctgtgctggatggcttcagcctgatgacctatgactacagcacagcccaccagcccggccccaatgcccccctgtcctgggtgcgggcctgtgtgcaggtgctggaccccaagagcaagtggaggagcaagatcctgctgggcctgaacttctacggcatggactatgccaccagcaaggatgcccgggagcctgtggtgggcgcccgctacatccagaccctgaaggaccaccggcccaggatggtgtgggacagccaggccagcgagcacttctttgagtacaagaagagccgcagcggccgccacgtggtgttctaccccaccctgaagagcctgcaggtgcggctggagctggcccgggagctgggcgtgggcgtgtccatctgggagctgggccagggcctggactacttctatgacctgctgtag

SEQ ID NO: 7213 - DNA, 813 bp, Artificial Sequence
  Description of Artificial Sequence: Synthetic coding sequence
atgatgctgcggctgctgagcagcctgctgctggtggccgtggccagcggctacggcccccccagcagccggcccagcagccgggtggtgaatggagaagatgctgtgccctacagctggccctggcaggtgtccctgcagtatgagaagagcggcagcttctaccacacctgtggcggcagcctgattgccccagactgggtggtgacagctggccactgcatcagcagcagcaggacctaccaggtggtgctgggggagtatgacagagctgtgaaggagggccctgagcaggtgatccccatcaacagcggggacctgtttgtgcaccccctgtggaacagaagctgtgtggcctgtggaaatgacatcgccctgatcaagctgagccgcagcgcccagctgggagatgctgtgcagctggccagcctgcccccagctggggacatcctgcccaatgagaccccctgctacatcaccggctggggccgcctgtacaccaacggccccctgcctgacaagctgcaggaggccctgctgcctgtggtggactatgagcactgcagccgctggaactggtggggcagctctgtgaagaagaccatggtgtgtgccggcggggacatccgcagcggctgcaatggagacagcggcggccccctgaactgccccacagaagatggcggctggcaggtgcatggagtgaccagctttgtgtctgccttcggctgcaacaccaggaggaagcccaccgtcttcaccagggtgtctgccttcatcgactggattgaggagaccatcgccagccactag

SEQ ID NO: 7214 - DNA, 585 bp, Artificial Sequence; identical to SEQ ID NO: 6927
  Description of Artificial Sequence: Synthetic coding sequence

SEQ ID NO: 7215 - DNA, 1308 bp, Artificial Sequence
  Description of Artificial Sequence: Synthetic coding sequence
atgcagggccagggcagaagaagaggcacctgcaaggacatcttctgcagcaagatggccagctacctgtatggagtgctgtttgctgtgggcctgtgtgcccccatctactgtgtgtccccagccaatgcccccagcgcctacccccggcccagcagcaccaagagcaccccagccagccaggtgtacagcctgaacacagactttgccttccggctgtacagaaggctggtgctggagacccccagccagaacatcttcttcagccctgtgtctgtgtccaccagcctggccatgctgagcctgggcgcccacagcgtgaccaagacccagatcctgcagggcctgggcttcaacctgacccacaccccagagagcgccatccaccagggcttccagcacctggtgcacagcctgactgtgcccagcaaggacctgaccctgaagatgggcagcgccctgtttgtgaagaaggagctgcagctgcaggccaacttcctgggcaatgtgaagaggctgtatgaggccgaggtgttcagcacagacttcagcaaccccagcatcgcccaggcccgcatcaacagccacgtgaagaagaagacccagggcaaggtggtggacatcatccagggcctggacctgctgacagccatggtgctggtgaaccacatcttcttcaaggccaagtgggagaagcccttccaccctgagtacaccaggaagaacttccccttcctggtgggggagcaggtgacagtgcacgtgcccatgatgcaccagaaggagcagtttgccttcggcgtggacacagagctgaactgctttgtgctgcagatggactacaagggagatgctgtggccttctttgtgctgcccagcaagggcaagatgaggcagctggagcaggccctgagcgcccggaccctgaggaagtggagccacagcctgcagaagcgctggattgaggtgttcatcccccgcttcagcatcagcgccagctacaacctggagaccatcctgcccaagatgggcatccagaatgtgtttgacaagaatgctgacttcagcggcatcgccaagagggacagcctgcaggtgtccaaggccacccacaaggctgtgctggatgtgtctgaggagggcacagaggccacagctgccaccaccaccaagttcatcgtgcgcagcaaggatggccccagctacttcaccgtgtccttcaacagaaccttcctgatgatgatcaccaacaaggccacagatggcatcctcttcctgggcaaggtggagaaccccaccaagagctag

SEQ ID NO: 7216 - DNA, 393 bp, Artificial Sequence
  Description of Artificial Sequence: Synthetic coding sequence
atggccagtgacctgatccgcaccatcctggccgtggccctgatcagcaagctgggcacagctgtggatgctgagctgatgcccagcggggccatcctgcagaacaagcgggagaacctgccccgggtgtgccacgccctggccttcctgggcatggcccgctgccaggacctcttcctggtgcggctgcagggctggaagctgggcacccgcttccaggacggccccaggagcaccccccaggaggagggcggcagcccccagaggaagaggggcatgcctgtgcagatccacttcctgctgaagagcttcctgagcagccccatcacctttgccttcatcagcctggccaggacagtgtccctggccacagccatctgcaagatcgtgtag

SEQ ID NO: 7217 - DNA, 837 bp, Artificial Sequence
  Description of Artificial Sequence: Synthetic coding sequence
atgcagtggctgcgggtgcgggagagccctggagaggccaccggccaccgggtgaccatgggcacagctgccctgggccctgtgtgggccgccctgctgctcttcctgctgatgtgtgagatccccatggtggagctgacctttgacagagctgtggccagcggctgccagcgctgctgtgacagcgaggaccccctggaccctgcccacgtgtcctctgccagcagcagcggccggccccacgccctgcctgagatccggccctacatcaacatcaccatcctgaagggggacaagggggaccccggccccatgggcctgcccggctacatgggccgggagggcccccagggcgagcccggcccccagggcagcaagggggacaagggggagatgggcagccctggggccccctgccagaagcgcttctttgccttctctgtgggcaggaagacagccctgcacagcggggaggacttccagaccctgctgtttgagcgggtgtttgtgaacctggatggctgctttgacatggccaccggccagtttgctgcccccctgcggggcatctacttcttcagcctgaatgtgcacagctggaactacaaggagacctacgtgcacatcatgcacaaccagaaggaggccgtcatcctgtatgcccagcccagcgagaggagcatcatgcagagccagagcgtgatgctggacctggcctacggggacagagtgtgggtgcggctcttcaagaggcagcgggagaatgccatctacagcaatgactttgacacctacatcaccttcagcggccacctgatcaaggccgaggatgactag

SEQ ID NO: 7218 - DNA, 1635 bp, Artificial Sequence
  Description of Artificial Sequence: Synthetic coding sequence
atgtgcaccgtggtggaccccagaattgtgcggcgctacctgctgcggcggcagctgggccagggcgcctacggcatcgtgtggaaggctgtggacagaagaactggagaggtggtggccatcaagaagatctttgatgccttccgggacaagacagatgcccagaggaccttccgggagatcaccctgctgcaggagtttggagaccaccccaacatcatcagcctgctggatgtgatccgggcagaaaatgaccgggacatctacctggtgtttgagttcatggacacagacctgaatgctgtgatcagaaaaggaggcctgctgcaggatgtgcacgtgcgcagcatcttctaccagctgctgcgggccacccgcttcctgcacagcggccacgtggtgcaccgggaccagaagcccagcaatgtgctgctggatgccaactgcaccgtgaagctgtgtgactttggcctggcccggagcctgggggacctgcctgagggccctgaggaccaggccgtgacagaatatgtggccacccgctggtaccgggcccctgaggtgctgctgagcagccaccgctacaccctgggcgtggacatgtggagcctgggctgcatcctgggggagatgctgcggggccggcccctcttccctggcaccagcaccctgcaccagctggagctgatcctggagaccatccccccacccagcgaggaggacctgctggccctgggcagcggctgccgggcctctgtgctgcaccagctgggcagccggccccggcagaccctggatgccctgctgcccccagacaccagccctgaggccctggacctgctgcggcggctgctggtgtttgccccagacaagaggctgagcgccacccaggccctgcagcacccctacgtgcagcgcttccactgccccagtgatgagtgggcccgggaggctgatgtgcggccccgggcccatgaaggagtgcagctgtctgtgcctgagtaccgcagccgggtgtaccagatgatcctggagtgtggcggcagcagcggcaccagccgggagaagggccctgagggcgtgagccccagccaggcccacctgcacaagcccagggctgacccccagctgcccagcaggacccctgtgcagggcccccggccccggccccagagcagccctggccatgaccctgctgagcacgagagcccccgggccgccaagaatgtgccccggcagaacagcgcccccctgctgcagacagccctgctgggcaatggagagcggcccccaggggccaaggaggccccacccctgaccctgagcctggtgaagcccagcggcagaggagctgcccccagcctgaccagccaggccgccgcccaggtggccaaccaggccctgatccggggggactggaacagaggaggcggcgtgcgggtggcctctgtgcagcaggtgcccccccggctgcccccagaggcccggcctggaagaaggatgttcagcaccagcgccctgcagggcgcccagggcggggcccgggccctgctgggcggctacagccaggcctatggaacagtgtgccacagcgccctgggccacctgcccctgctggagggccaccacgtgtag

SEQ ID NO: 7219 - DNA, 399 bp, Artificial Sequence
  Description of Artificial Sequence: Synthetic coding sequence
atgaagagcagcggcctcttccccttcctggtgctgctggccctgggcaccctggccccctgggccgtggagggcagcggcaagagcttcaaggccggcgtgtgcccccccaagaagagcgcccagtgcctgcgctacaagaagccagagtgccagagcgactggcagtgccctgggaagaagcgctgctgcccagacacctgtggcatcaagtgcctggaccctgtggacacccccaaccccaccaggaggaagccaggcaagtgccctgtgacctacggccagtgcctgatgctgaacccccccaacttctgtgagatggatggccagtgcaagagggacctgaagtgctgcatgggcatgtgtgggaagagctgtgtgtcccctgtgaaggcctag

SEQ ID NO: 7220 - DNA, 1401 bp, Artificial Sequence
  Description of Artificial Sequence: Synthetic coding sequence
atgaagccacccctgctggtgttcatcgtgtgcctgctgtggctgaaggacagccactgtgcccccacctggaaggacaagacagccatcagcgagaacctgaagagcttcagcgaggtgggggagattgatgctgatgaggaggtgaagaaggccctgaccggcatcaagcagatgaagatcatgatggagaggaaggagaaggagcacaccaacctgatgagcaccctgaagaagtgccgggaggagaagcaggaggccctgaagctgctgaatgaggtgcaggagcacctggaggaggaggagcggctgtgccgggagagcctggccgacagctggggagaatgtcgcagctgcctggagaacaactgcatgaggatctacaccacctgccagcccagctggagctctgtgaagaacaagattgagcgcttcttcaggaagatctaccagttcctgttccccttccacgaggacaatgagaaggacctgcccatcagcgagaagctgattgaagaagatgcccagctgacccagatggaggatgtgttcagccagctgactgtggatgtgaacagcctcttcaacagaagcttcaacgtgttccggcagatgcagcaggagtttgaccagaccttccagagccacttcatcagtgacacagacctgacagagccctacttcttccctgccttcagcaaggagcccatgaccaaggctgacctggagcagtgctgggacatccccaacttcttccagctgttctgcaacttctctgtgtccatctatgaatctgtgtctgagaccatcaccaagatgctgaaggccatcgaggacctgcccaagcaggacaaggccccagaccatggaggcctcatcagcaagatgctgcccggccaggaccggggcctgtgtggggagctggaccagaacctgagccgctgcttcaagttccacgagaagtgccagaagtgccaggcccacctgtctgaggactgcccagatgtgcctgccctgcacacagagctggatgaggccatccggctggtgaatgtgagcaaccagcagtatggccagatcctgcagatgaccaggaagcacctggaggacacagcctacctggtggagaagatgaggggccagtttggctgggtgtctgagctggccaaccaggcccctgagacagagatcatcttcaacagcatccaggtggtgccccgcatccacgagggcaacatcagcaagcaggatgagaccatgatgacagacctgagcatcctgcccagcagcaacttcaccctgaagatccccctggaggagagcgctgagagcagcaacttcatcggctacgtggtggccaaggccctgcagcacttcaaggagcacttcaagacctggtag

SEQ ID NO: 7221 - DNA, 522 bp, Artificial Sequence
  Description of Artificial Sequence: Synthetic coding sequence
atgcactggaagatgctgctgctgctgctgctgtactacaatgctgaggcctccatgtgccaccgctggagcagagctgtgctcttccctgctgcccaccggcccaagaggagcagcagcctgcccctgaaccctgtgctgcagaccagcctggaggaggtggagctgctgtatgagttcctgctggccgagctggagatcagcccagacctgcagatcagcatcaaggatgaggagctggccagcctgaggaaggccagtgacttcagaacagtgtgcaacaacgtcatccccaagagcatcccagacatccggcggctgagcgccagcctgagcagccaccctggcatcctgaagaaggaggactttgagaggacagtgctgaccctggcctacacagcctacagaacagccctgagccacggccaccagaaggacatctgggcccagagcctggtgtccctcttccaggccctgcggcatgacctgatgaggagcagccagcccggggtgcccccatag

SEQ ID NO: 7222 - DNA, 1473 bp, Artificial Sequence
  Description of Artificial Sequence: Synthetic coding sequence
atggaggacagcgacagcgctgccaagcagctgggcctggccgaggccgctgctgtggccgctgctgctgctgtggccgctgctgctgctgctgctgctggaggagaggccgaggagcctgtgctgagcagagatgaggacagcgaggaggatgctgacagcgaggccgagcgggagaccccccgggtgacagctgtggccgtgatggctgctgagcccggccacatggacatgggcgctgaggccctgcccggcccagatgaagctgctgctgctgctgcctttgctgaggtgaccaccgtgacagtggccaacgtgggcgctgctgctgacaacgtgttcaccacctctgtggccaatgctgccagcatcagcggccacgtgctgagcggccgcacagccctgcagattggagacagcctgaacacagagaaggccaccctgattgtggtgcacacagatggcagcatcgtggagaccaccggcctgaagggccctgctgcccccctgaccccaggcccccagagcccccccacccccctggcccctggccaggagaagggcggcaccaagtacaactgggaccccagcgtgtatgattctgagctgcctgtgcgctgcaggaacatcagcggcaccctgtacaagaaccggctgggcagcggctgggacctgaagcccagccgctgcctgctgcacctgtgctgcctgctgcggagacatgacctgatcaccgtgaccccatctggccagatcaccaccagcggggccctgacctttgaccgggccagcacagtggaggccacagctgtgatcagcgagagccctgcccagggagatgtgtttgctggggccaccgtgcaggaggcctctgtgcagcccccctgccgggccagccaccctgagccccactacccaggctaccaggacagctgccagatcgcccccttccctgaggccgccctgcccaccagccaccccaagatcgtgctgaccagcctgcctgccctggccgtgcccccacccacccccaccaaggccgcccccccagccctggtgaatggcctggagctgtctgagcccaggtcctggctgtacctggaggagatggtgaacagcctgctgaacacagcccagcagctgaagaccctgtttgagcaggccaagcacgccagcacctaccgggaggccgccaccaaccaggccaagatccacgcagatgctgagaggaaggaggtgatccaccccccccggctgcccaaggtgctgggcctgcagcagagctgtgtgaactgtggccgggaggccatgtctgaatgtacaggctgccacaaggtgaactactgcagcaccttctgccagaggaaggactggaaggaccaccagcacatctgtggccagagcgctgctgtgacagtgcaggctgatgaggtgcacgtggccgagagcgtgatggagaaggtgacagtgtag

SEQ ID NO: 7223 - DNA, 1476 bp, Artificial Sequence
  Description of Artificial Sequence: Synthetic coding sequence
atgcccagcacagtgctgcccagcacagtgctgcccagcctgctgcccacagctggggccggctggagcatgcgctggatcctgtgctggagcctgaccctgtgcctgatggcccagacagccctgggcgccctgcacaccaagaggccccaggtggtgaccaagtatggcaccctgcagggcaagcagatgcacgtgggcaagacccccatccaggtgttcctgggcgtgcccttcagccggccccccctgggcatcctgcgctttgcccctcctgagcccccagagccctggaagggcatcagagatgccaccacctacccacctggctgcctgcaggagagctggggccagctggcctccatgtatgtgtccacccgggagcgctacaagtggctgcgcttcagcgaggactgcctgtacctgaatgtgtatgccccagcccgggcccctggggacccccagctgcctgtgatggtgtggttccctggaggagccttcatcgtgggcgccgccagcagctatgagggcagtgacctggccgcccgggagaaggtggtgctggtgttcctgcagcaccggctgggcatcttcggcttcctgagcacagatgacagccacgcccggggcaactggggcctgctggaccagatggccgccctgcgctgggtgcaggagaacattgctgcctttggaggagaccctggaaatgtgaccctgtttggccagagcgctggggccatgagcatcagcggcctgatgatgagccccctggccagcggcctcttccaccgggccatcagccagagcggcacagccctcttccgcctcttcatcaccagcaaccccctgaaggtggccaagaaggtggcccacctggccggctgcaaccacaacagcacccagatcctggtgaactgcctgcgggccctgagcggcaccaaggtgatgagggtgagcaacaagatgaggttcctgcagctgaacttccagagggaccctgaggagatcatctggagcatgagccctgtggtggatggagtggtgatcccagatgaccccctggtgctgctgacccagggcaaggtgtcctctgtgccctacctgctgggcgtgaacaacctggagttcaactggctgctgccctacatcatgaagttccccctgaaccggcaggccatgaggaaggagaccatcaccaagatgctgtggagcaccaggaccctgctgaacatcaccaaggagcaggtgcccctggtggtggaggagtacctggacaacgtgaatgaacatgactggaagatgctgaggaacaggatgatggacatcgtgcaggatgccacctttgtgtatgccaccctgcagacagcccactaccaccgggagacccccatgatgggcatctgcccagctggccacgccaccaccaggatgaagagcacctgctcctggatcctgccccaggagtgggcctag

SEQ ID NO: 7224 - DNA, 753 bp, Artificial Sequence
  Description of Artificial Sequence: Synthetic coding sequence
atgcctgccagcagccccttcctgctggcccccaagggccccccaggcaacatgggcggccctgtgcgggagcccgccctgtctgtggccctgtggctgtcctggggcgccgccctgggcgctgtggcctgtgccatggccctgctgacccagcagacagagctgcagagcctgcggcgggaggtgtcccggctgcagggcaccggcggccccagccagaatggagagggctacccctggcagagcctgcctgagcagagcagtgatgccctggaggcctgggagaatggagagaggagcaggaagagaagagctgtgctgacccagaagcagaagaagcagcacagcgtgctgcacctggtgcccatcaatgccaccagcaaggatgacagtgatgtgacagaggtgatgtggcagcctgccctgcggcggggccggggcctgcaggcccagggctatggagtgcgcatccaggatgctggggtgtacctgctgtacagccaggtgctcttccaggatgtgaccttcaccatgggccaggtggtgtcccgggagggccagggccggcaggagaccctcttccgctgcatccgctccatgcccagccacccagaccgggcctacaacagctgctacagcgctggggtcttccacctgcaccagggcgacatcctgagcgtcatcatcccccgggcccgggccaagctgaacctgagcccccacggcaccttcctgggctttgtgaagctgtag

SEQ ID NO: 7225 - DNA, 1437 bp, Artificial Sequence
  Description of Artificial Sequence: Synthetic coding sequence
atgagcccccccctgctgaagctgggcgctgtgctgagcaccatggccatgatcagcaactggatgagccagaccctgcccagcctggtgggcctgaacaccacccggctgagcaccccagacaccctgacccagatcagccccaaggagggctggcaggtgtacagcagcgcccaggaccctgatggccgctgcatctgcaccgtggtggcccctgagcagaacctgtgcagcagagatgccaagagccggcagctgcggcagctgctggagaaggtgcagaacatgagccagagcattgaggtgctgaacctgcggacccagagggacttccagtatgtgctgaagatggagacccagatgaagggcctgaaggccaagttccggcagattgaagatgacaggaagaccctgatgaccaagcacttccaggagctgaaggagaagatggatgagctgctgcccctcatccctgtgctggagcagtacaagacagatgccaagctgatcacccagttcaaggaggagatccggaacctgtctgctgtgctgaccggcatccaggaggagattggagcctatgactatgaggagctgcaccagagggtgctgagcctggagacccggctgcgggactgcatgaagaagctgacctgtgggaagctgatgaagatcaccggccctgtgacagtgaagaccagcggcaccaggtttggagcctggatgacagaccccctggccagcgagaagaacaacagagtgtggtacatggacagctacaccaacaacaagatcgtgcgggagtacaagagcattgctgactttgtgtctggagctgagagcaggacctacaacctgcccttcaagtgggccggcaccaaccacgtggtgtacaacggcagcctgtacttcaacaagtaccagagcaacatcatcatcaagtacagctttgacatgggccgggtgctggcccagaggagcctggagtatgccggcttccacaacgtgtacccctacacctggggcggcttcagtgacatcgacctgatggctgatgagatcggcctgtgggccgtgtatgccaccaaccagaatgccggcaacatcgtcatcagccagctgaaccaggacaccctggaggtgatgaagtcctggagcacaggctaccccaagaggtctgctggggagagcttcatgatctgtggcaccctgtatgtgaccaacagccacctgaccggggccaaggtgtactacagctacagcaccaagaccagcacctatgagtacacagacatccccttccacaaccagtacttccacatctccatgctggactacaatgcccgggaccgggccctgtatgcctggaacaacggccaccaggtgctcttcaacgtgaccctcttccacatcatcaagacagaagatgacacctag

SEQ ID NO: 7226 - DNA, 1101 bp, Artificial Sequence
  Description of Artificial Sequence: Synthetic coding sequence
atggcccgggagcggcccccaggccggggctgcggcgtgctgcggcgctgcctgctgggcgctgtgctgctgtttggcctgcggctgtgtgccgagctgcggcgggccggccctggcagccccaccaggtctgcccctcctggccctgcctggaggcctcctggcccccacctgcccccagcccctggccagcccaggggggccagccggcggcaggtgacctacgtgcgcagcggccggcgggcccctcctgggggcggcggcagcggcaccccagagcccggctgctgtgccccccggggccggcccaggaggaagggcccccgctggcacatcgacctgcagccctgggccggcagcgcccagagcctggatgaggaggcctggaggttcctgcgctacatcagcaccacccagatcgcctgcaaccacatgaacacagacagcctggccacagacagcagccccacccacaagccctggagcgtgtgcctggatgaccgcttcaacctggcccaccagatccggaacaagcagtgccgcctgtacagcctgggcctgggcagtgatgacacccactttgaggtgtccatggccaacaacggctgtgaggtgcacagatttgaccccagcgtgaagagcgcccacatcctggagagccagcacctgtggtaccaccggctgagcattgactggagggacccccaccctgctgtggccgcccagaagccccacagcaacaccaggaagctgggcagcatcctgaatgaatttggccaccacaagattgatgtgctgaaggctgacctggagagcgctgagtggaaggtgctggagaacctgatcctggaggatgtgctggagcagatcggccagctgatctttgagatccacctgcactggccaggctttgaggtgtctggcagtgacagctctgtggtgcgcttctggtacagcctgctgaaggagctggagcagaaggacttccgcctcttccacagctacaaggacctgagcaagccccagctgttcctgaagaaggacatcttcaatgccagcagctgctacaccctgtcctgggtgaacacccgctggaagtag

SEQ ID NO: 7227 - DNA, 300 bp, Artificial Sequence
  Description of Artificial Sequence: Synthetic coding sequence
atgaagatccctgtgctgcctgctgtggtgctgctgagcctgctggtgctgcacagcgcccagggcgccaccctgggcggccctgaggaggagagcaccattgaaaattatgccagcaggcctgaggccttcaacacccccttcctgaacatcgacaagctgcggagcgccttcaaggcagatgagttcctgaactggcacgccctgtttgagagcatcaagaggaagctgcccttcctgaactgggatgccttccccaagctgaagggcctgcggagcgccaccccagatgcccagtag

SEQ ID NO: 7228 - DNA, 618 bp, Artificial Sequence
  Description of Artificial Sequence: Synthetic coding sequence
atgatgaggaccctcatcaccacccaccccctgcccctgctgctgctgccccagcagctgctgcagctggtgcagttccaggaggtggacacagactttgacttccctgaggaggacaagaaggaggagtttgaggagtgcctggagaagttcttcagcacaggccctgcccggccccccaccaaggagaaggtgaagagaagagtgctgattgagcccggcatgcccctgaaccacatcgagtactgcaaccacgagatcatgggcaagaatgtgtactacaagcaccgctgggtggccgagcactacttcctgctgatgcagtatgatgagctgcagaagatctgctacaacagatttgtgccctgcaagaatggcatcaggaagtgcaacagaagcaagggcctggtggagggcgtgtactgcaacctgacagaggcctttgagatcccagcctgcaagtatgagagcctgtacaggaagggctacgtgctgatcacctgctcctggcagaatgagatgcagaagaggatcccccacaccatcaatgacctggtggagcccccagagcaccgctccttcctgtctgaagatggagtgtttgtgatcagcccctag

SEQ ID NO: 7229 - DNA, 402 bp, Artificial Sequence
  Description of Artificial Sequence: Synthetic coding sequence
atgctggactggaggctggccagcgcccacttcatcctggccgtgaccctgaccctgtggagcagcggcaaggtgctgtctgtggatgtgaccaccacagaggcctttgacagcggcgtgattgatgtgcagagcacccccaccgtgcgggaggagaagagcgccacagacctgacagccaagctgctgctgctggatgagctggtgtccctggagaatgatgtgattgagaccaagaagaagaggagcttcagcggcttcggcagccccctggaccggctgtctgctggctctgtggaccacaagggcaagcagaggaaggtggtggaccaccccaagaggcgcttcggcatccccatggacagaattggaagaaaccggctgagcaacagccggggctag

SEQ ID NO: 7230 - DNA, 846 bp, Artificial Sequence
  Description of Artificial Sequence: Synthetic coding sequence
atgggcagccggggccagggcctgctgctggcctactgcctgctgctggcctttgccagcggcctggtgctgagccgggtgccccacgtgcagggcgagcagcaggagtgggagggcacagaggagctgcccagccccccagaccacgccgagagagctgaggagcagcacgagaagtaccggcccagccaggaccagggcctgcctgccagccgctgcctgcgctgctgtgaccccggcacctccatgtacccagccacagctgtgccccagatcaacatcaccatcctgaagggggagaagggggacagaggagaccggggcctgcagggcaagtatggcaagacaggcagcgctggggcccggggccacacaggccccaagggccagaagggctccatgggcgcccctggagagcgctgcaagagccactacgccgccttctctgtgggcaggaagaagcccatgcacagcaaccactactaccagaccgtcatctttgacacagaatttgtgaacctgtatgaccacttcaacatgttcaccgggaagttctactgctacgtgcccggcctgtacttcttcagcctgaatgtgcacacctggaaccagaaggagacctacctgcacatcatgaagaatgaggaggaggtggtgatcctgtttgcccaggtgggggacaggagcatcatgcagagccagagcctgatgctggagctgcgggagcaggaccaggtgtgggtgcggctgtacaagggggagcgggagaatgccatcttcagcgaggagctggacacctacatcaccttcagcggctacctggtgaagcacgccacagagccctag

SEQ ID NO: 7231 - DNA, 132 bp, Artificial Sequence
  Description of Artificial Sequence: Synthetic coding sequence
atgaagctgctgtacctgttcctggccatcctgctggccatcgaggagcctgtgatcagcgccctggtgaggacagtgggctgctgcctggacacagcccggcagaccccccaccccagcatgcacggctag

SEQ ID NO: 7232 - DNA, 861 bp, Artificial Sequence
  Description of Artificial Sequence: Synthetic coding sequence
atgaaggtgctgctgctgaccggcctgggcgccctcttctttgcctactactgggatgacaactttgatcctgccagcctgcagggcgcccgggtgctgctgactggagccaatgccggcgtgggggaggagctggcctaccactacgcccggctgggcagccacctggtgctgacagcccacacagaggccctgctgcagaaggtggtgggcaactgcaggaagctgggcgcccccaaggtgttctacatcgctgctgacatggccagccctgaggcccctgagagcgtggtgcagtttgccctggacaagctgggcggcctggactacctggtgctgaaccacatcggcggggccccagctggcacccgggcccggagcccccaggccacccgctggctgatgcaggtgaactttgtgtcctatgtgcagctgaccagccgggccctgcccagcctgacagacagcaagggcagcctggtggtggtgagcagcctgctgggccgggtgcccaccagcttcagcaccccctacagcgctgccaagtttgccctggatggcttcttcggcagcctgcggcgggagctggatgtgcaggatgtgaatgtggccatcaccatgtgtgtgctgggcctgcgggaccgggccagcgctgctgaggccgtgcggggcgtgaccagggtgaaggccgcccctggccccaaggccgccctggccgtcatccggggcggggccaccagggctgctggggtcttctacccctggaggttccggctgctgtgcctgctgcggcgctggctgccccggccccgggcctggttcatccggcaggagctgaatgtgacagctgctgctgcctag

SEQ ID NO: 7233 - DNA, 1326 bp, Artificial Sequence
  Description of Artificial Sequence: Synthetic coding sequence
atgagggtggtgaccatcgtcatcctgctgtgcttctgcaaggctgctgagctgaggaaggccagccctggctctgtgcgcagccgggtgaaccacggccgggccggcggcggcagaagaggcagcaaccctgtgaagagatatgcccctggcctgccctgtgatgtgtacacctacctgcacgagaagtacctggactgccaggagaggaagctggtgtatgtgctgcccggctggccccaggacctgctgcacatgctgctggccaggaacaagatccgcaccctgaagaacaacatgttcagcaagttcaagaagctgaagagcctggacctgcagcagaatgagatcagcaagattgagagcgaggccttcttcggcctgaacaagctgaccaccctgctgctgcagcacaaccagatcaaggtgctgacagaggaggtgttcatctacacccccctgctgagctacctgcggctgtatgacaacccctggcactgcacctgtgaaattgagaccctcatctccatgctgcagatccccaggaacagaaacctgggcaactatgccaagtgtgagagcccccaggagcagaagaacaagaagctgcggcagatcaagtctgagcagctgtgcaatgaggaggagaaggagcagctggaccccaagccccaggtgtctggccggccccctgtgatcaagccagaggtggacagcaccttctgccacaactacgtgttccccatccagaccctggactgcaagaggaaggagctgaagaaggtgcccaacaacatccccccagacatcgtgaagctggacctgagctacaacaagatcaaccagctgcggcccaaggagtttgaagatgtgcatgagctgaagaagctgaacctgagcagcaatggcatcgagttcattgatcctgctgccttcctgggcctgacccacctggaggagctggacctgagcaacaacagcctgcagaactttgattatggagtgctggaggacctgtacttcctgaagctgctgtggctgcgggacaacccctggaggtgtgactacaacatccactacctgtactactggctgaagcaccactacaacgtgcacttcaacggcctggagtgcaagaccccagaggagtacaagggctggagcgtgggcaagtacatccgcagctactatgaagaatgtcccaaggacaagctgcctgcctacccagagagctttgaccaggacacagaagatgatgagtgggagaagaagcaccgggaccacacagccaagaagcagagcgtcatcatcaccatcgtgggctag

SEQ ID NO: 7234 - DNA, 1539 bp, Artificial Sequence
  Description of Artificial Sequence: Synthetic coding sequence
atggccgagagcggcctggccatgtggcccagcctgctgctgctgctgctgctgcccggccccccacctgtggccggcctggaggatgctgccttcccccacctgggggagagcctgcagcccctgccccgggcctgccccctgcgctgcagctgcccccgggtggacacagtggactgtgatggcctggacctgcgggtcttcccagacaacatcaccagggctgcccagcacctgagcctgcagaacaaccagctgcaggagctgccctacaatgagctgagccggctgagcggcctgcggaccctgaacctgcacaacaacctgatcagcagcgagggcctgcctgatgaggcctttgagagcctgacccagctgcagcacctgtgtgtggcccacaacaagctgtctgtggccccccagttcctgcccaggagcctgcgggtggccgacctggccgccaaccaggtgatggagatcttccccctgacctttggagagaagccagccctgcggtctgtgtacctgcacaacaaccagctgagcaatgccggcctgcccccagatgccttccggggcagcgaggccatcgccaccctgagcctgagcaacaaccagctgagctacctgccccccagcctgccccccagcctggagcggctgcacctgcagaacaacctgatcagcaaggtgcccaggggggccctgagccggcagacccagctgcgggagctgtacctgcagcacaaccagctgacagattctggcctggatgccaccaccttcagcaagctgcacagcctggagtacctggacctgagccacaaccagctgaccaccgtgcctgctggcctgcccaggaccctggccatcctgcacctgggcaggaaccgcatccggcaggtggaggccgcccggctgcacggggcccggggcctgcgctacctgctgctgcagcacaaccagctgggcagcagcggcctgcctgctggggccctgcggcccctgcggggcctgcacaccctgcacctgtatggaaatggcctggacagagtgcccccagccctgccccggcggctgcgggccctggtgctgccccacaaccacgtggccgccctgggcgcccgggacctggtggccaccccaggcctgacagagctgaacctggcctacaaccggctggccagcgcccgggtgcaccaccgggccttccggcggctgcgggccctgcggagcctggacctggccggcaaccagctgacccggctgcccatgggcctgcccaccggcctgcggaccctgcagctgcagaggaaccagctgaggatgctggagcctgagcccctggccggcctggaccagctgcgggagctgagcctggcccacaaccggctgcgggtgggggacatcggccctggcacctggcatgagctgcaggccctgcaggtgcgccaccggctggtgagccacacagtgccccgggccccacccagcccctgcctgccctgccacgtgcccaacatcctggtgtcctggtag

SEQ ID NO: 7235 - DNA, 2328 bp, Artificial Sequence
  Description of Artificial Sequence: Synthetic coding sequence
atgaaggagggccctgaggaggccggcagcggccgctatggcccccgctacatcacagacatgggcgctggagaagatgatgagggctttgaagatgacctggacctggacatcagctttgaggaggtgaagcccctgcctgccaccaagggcggcaacaagaagttcctggtggagagcaagaagatgagcatcagcaaccccaagaccatcagccgcctcatcccccccaccagcgccagcctgcctgtgaccaccgtggccccccagcccatccccatccagaggaagggcaagaatggagtggccatcatgagccggctgtttgacatgccctgtgatgagaccctgtgcagcgctgacagcttctgtgtgaatgactacacctggggcggcagccgctgccagtgcaccctgggcaaaggaggagagagctgcagcgaggacatcgtcatccagtacccccagttcttcggccacagctatgtgacctttgagcccctgaagaacagctaccaggccttccagatcaccctggagttccgggcagaggccgaggatggcctgctgctgtactgtggagaaaatgagcacggccgcggggacttcatgagcctggccatcatccgccgcagcctgcagttccgcttcaactgtggcactggagtggccatcatcgtgtctgagaccaagatcaagctgggcggctggcacacagtgatgctgtacagagatggcctgaatggcctgctgcagctgaacaacggcacccctgtgacaggccagagccagggccagtacagcaagatcaccttccgcacccccctgtacctgggcggggcccccagcgcctactggctggtgcgggccaccggcaccaacagaggcttccagggctgtgtgcagagcctggccgtgaatggaagaagaattgacatgaggccctggcccctgggcaaggccctgtctggagcagatgtgggagaatgtagcagcggcatctgtgatgaggccagctgcatccacggcggcacctgcacagccatcaaggctgacagctacatctgcctgtgccccctgggcttcaagggccgccactgtgaagatgccttcaccctgaccatcccccagttccgggagagcctgcggagctatgctgccaccccctggcccctggagccccagcactacctgtccttcatggagtttgagatcaccttccggccagattctggagatggagtgctgctgtacagctatgacaccggcagcaaggacttcctgagcatcaacctggccggcggccacgtggagttccgctttgactgtggcagcggcactggagtgctgcggtctgaggaccccctgaccctgggcaactggcatgagctgcgggtgtccaggacagccaagaatggcatcctgcaggtggacaagcagaagatcgtggagggcatggccgagggcggcttcacccagatcaagtgcaacacagacatcttcatcggcggcgtgcccaactatgatgatgtgaagaagaacagcggcgtgctgaagcccttcagcggcagcatccagaagatcatcctgaatgacaggaccatccacgtgaagcatgacttcaccagcggcgtgaatgtggagaatgctgcccacccctgtgtgcgggccccctgtgcccatggaggcagctgccggcccaggaaggagggctatgactgtgactgccccctgggctttgagggcctgcactgccagaaggccatcatcgaggccatcgagatcccccagttcatcggccgcagctacctgacctatgacaacccagacatcctgaagagggtgtctggcagccgcagcaatgtgttcatgaggttcaagaccacagccaaggatggcctgctgctgtggaggggggacagccccatgaggcccaacagcgacttcatcagcctgggcctgagagatggagccctggtgttctcctacaacctgggcagcggcgtggccagcatcatggtgaatggcagcttcaatgatggccgctggcaccgggtgaaggctgtgagagatggccagagcggcaagatcaccgtggatgattatggagccaggacaggcaagagccctggcatgatgaggcagctgaacatcaatggagccctgtatgtgggcggcatgaaggagatcgccctgcacaccaaccggcagtacatgaggggcctggtgggctgcatcagccacttcaccctgagcacagactaccacatcagcctggtggaggatgctgtggatggcaagaacatcaacacctgtggggccaagtag

SEQ ID NO: 7236 - DNA, 1431 bp, Artificial Sequence
  Description of Artificial Sequence: Synthetic coding sequence
atgaagttccagggccccctggcctgcctgctgctggccctgtgcctgggcagcggggaggccggccccctgcagagcggggaggagagcacaggcaccaacattggagaggccctgggccacggcctgggagatgccctgtctgagggcgtgggcaaggccatcggcaaggaggccggcggcgctgctggcagcaaggtgtctgaggccctgggccagggcacccgggaggccgtgggcactggagtgcggcaggtgcccggctttggagtggctgatgccctgggcaacagagtgggggaggccgcccacgccctgggcaacacaggccatgaaattggccggcaggccgaggatgtgatcagacatggagcagatgctgtgcggggctcctggcagggcgtgcccggccacaatggagcctgggagaccagcggcggccacggcatcttcggcagccagggcggcctgggcggccagggccagggcaaccctgggggcctgggcaccccctgggtgcacggctacccaggcaacagcgctggcagctttggcatgaacccccagggcgccccctggggccagggcggcaatggaggcccccccaactttggcaccaacacccagggcgctgtggcccagcccggctacggctctgtgcgggccagcaaccagaatgaaggctgcaccaaccccccaccttctggcagcggcggcggcagcagcaacagcggcggcggcagcggcagccagagcggcagcagcggcagcggcagcaatggagacaacaacaacggcagcagcagcggcggcagcagcagcggcagcagcagcggcggcagcagcggcggcagcagcggcggcagcagcggcaacagcggcggcagcagaggagacagcggcagcgagagctcctggggcagcagcacaggcagcagcagcggcaaccacggcggcagcggcggcggcaatggccacaagccaggctgtgagaagccaggaaatgaggcccggggcagcggggagagcggcatccagaacagcgagaccagccctggcatgttcaactttgacaccttctggaagaacttcaagagcaagctgggcttcatcaactgggatgccatcaacaagaaccaggtgcccccacccagcacccgggccctgctgtacttcagccggctgtgggaggacttcaagcagaacacccccttcctgaactggaaggccatcatcgagggcgcagatgccagcagcctgcagaagagagctggaagagatgaccagaactacaactacaaccagcacgcctaccccacagcctacggcggcaagtacagcgtgaagaccccagccaagggcggcgtgagccccagcagcagcgccagccgggtgcagcccggcctgctgcagtgggtgaagttctggtag

SEQ ID NO: 7237 - DNA, 1911 bp, Artificial Sequence
  Description of Artificial Sequence: Synthetic coding sequence
atgaccacctggagcctgcggcggcggcctgcccggaccctgggcctgctgctgctggtggtgctgggcttcctggtgctgcggcggctggactggagcaccctggtgcccctgcggctgcggcaccggcagctgggcctgcaggccaagggctggaacttcatgctggaggacagcaccttctggatctttggaggcagcatccactacttccgggtgccccgggagtactggagggaccggctgctgaagatgaaggcctgtggcctgaacaccctgaccacctacgtgccctggaacctgcacgagcctgagcggggcaagtttgacttcagcggcaacctggacctggaggcctttgtgctgatggctgctgagatcggcctgtgggtgatcctgcggcccggcccctacatctgcagcgagatggacctgggcggcctgcccagctggctgctgcaggaccccggcatgaggctgcggaccacctacaagggcttcacagaggccgtggacctgtactttgaccacctgatgagccgggtggtgcccctgcagtacaagaggggcggccccatcatcgctgtgcaggtggagaatgaatatggcagctacaacaaggaccctgcctacatgccctacgtgaagaaggccctggaggaccggggcatcgtggagctgctgctgaccagtgacaacaaggatggcctgagcaaaggaattgtgcagggcgtgctggccaccatcaacctgcagagcacccatgagctgcagctgctgaccaccttcctgttcaacgtgcagggcacccagcccaagatggtgatggagtactggacaggctggtttgacagctggggcggcccccacaacatcctggacagcagcgaggtgctgaagacagtgtctgccatcgtggatgctggcagcagcatcaacctgtacatgttccacggcggcaccaactttggcttcatgaatggagccatgcacttccatgactacaagagtgatgtgaccagctatgactatgatgctgtgctgacagaagctggggactacacagccaagtacatgaagctgcgggacttcttcggcagcatcagcggcatccccctgcccccacctccagacctgctgcccaagatgccctatgagcccctgacccctgtgctgtacctgagcctgtgggatgccctgaagtacctgggggagcccatcaagtctgagaagcccatcaacatggagaacctgcctgtgaatggaggaaatggccagagctttggctacatcctgtatgagaccagcatcaccagcagcggcatcctgagcggccacgtgcatgaccggggccaggtgtttgtgaacacagtgtccatcggcttcctggactacaagaccaccaagattgctgtgcccctcatccagggctacacagtgctgcgcatcctggtggagaacagaggccgggtgaactatggagaaaatattgatgaccagaggaagggcctgattggcaacctgtacctgaatgacagccccctgaagaacttccgcatctacagcctggacatgaagaagagcttcttccagagatttggcctggacaagtggagcagcctgcctgagacccccaccctgcctgccttcttcctgggcagcctgagcatcagcagcaccccctgtgacaccttcctgaagctggagggctgggagaagggcgtggtgttcatcaatggccagaacctgggccgctactggaacatcggcccccagaagaccctgtacctgcccggcccctggctgagcagcggcatcaaccaggtgattgtgtttgaggagaccatggccggccctgccctgcagttcacagagaccccccacctgggcaggaaccagtacatcaagtag

SEQ ID NO: 7238 - DNA, 672 bp, Artificial Sequence
  Description of Artificial Sequence: Synthetic coding sequence
atgacccgctggagcagctacctgctgggctggaccaccttcctgctgtacagctatgagagcagcggcggcatgcatgaggagtgtgtgttccccttcacctacaagggctctgtgtacttcacctgcacccacatccacagcctgagcccctggtgtgccaccagggctgtgtacaacggccagtggaagtactgccagagcgaggactacccccgctgcatcttccccttcatctaccggggcaaggcctacaacagctgcatcagccagggcagcttcctgggcagcctgtggtgcagcgtgacctctgtgtttgatgagaagcagcagtggaagttctgtgagaccaatgaatatggaggcaacagcctgaggaagccctgcatcttccccagcatctacagaaacaacgtggtgtctgactgcatggaggatgagagcaacaagctgtggtgccccaccacagagaacatggacaaggatggcaagtggagcttctgtgccgacacccgcatcagcgccctggtgcccggcttcccctgccacttccccttcaactacaagaacaagaactacttcaactgcaccaatgaaggcagcaaagaaaacctggtgtggtgtgccaccagctacaactatgaccaggaccacacctgggtgtactgctag

SEQ ID NO: 7239 - DNA, 1368 bp, Artificial Sequence
  Description of Artificial Sequence: Synthetic coding sequence
atgctgcaccctgagaccagccctggccggggccacctgctggccgtgctgctggccctgctgggcaccacctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctggactggagcgacagcctggcccagctggcccaggcccgggccgccctgtgtggcatccccacccccagcctggccagcggcctgtggaggaccctgcaggtgggctggaacatgcagctgctgcctgctggcctggccagctttgtggaggtggtgtccctgtggtttgctgagggccagcgctacagccatgctgctggggagtgtgccagaaatgccacctgcacccactacacccagctggtgtgggccaccagcagccagctgggctgcggccgccacctgtgcagcgctggccagacagccatcgaggcctttgtgtgtgcctacagccctgggggcaactgggaggtgaatggcaagaccatcatcccctacaagaagggggcctggtgcagcctgtgcacagcctctgtgtctggctgcttcaaggcctgggaccatgctgggggcctgtgtgaggtgcccaggaacccctgcaggatgagctgccagaaccacggccgcctgaacatcagcacctgccactgccactgccccccaggctacacaggccgctactgccaggtgcgctgcagcctgcagtgtgtgcacggccgcttccgggaggaggagtgcagctgtgtgtgtgacatcggctacggcggggcccagtgtgccaccaaggtgcacttccccttccacacctgtgacctgagaattgatggagactgcttcatggtgtcctctgaggccgacacctactaccgggccaggatgaagtgccagaggaagggcggcgtgctggcccagatcaagagccagaaggtgcaggacatcctggccttctacctgggccgcctggagaccaccaatgaagtcatcgacagcgactttgagaccaggaacttctggattggcctgacctacaagacagccaaggacagcttccgctgggccaccggggagcaccaggccttcaccagctttgccttcggccagcctgacaaccacggcctggtgtggctgtctgctgccatgggcttcggcaactgtgtggagctgcaggccagcgctgccttcaactggaatgaccagcgctgcaagaccaggaaccgctacatctgccagtttgcccaggagcacatcagccgctggggccctggcagctag

SEQ ID NO: 7240 - DNA, 1425 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaaggagctgccccctacgtgcaggcctttgacagcctgctggccggccctgtggccgagtacctgaagatcagcaaggagattggaggagatgtgcagaagcacgccgagatggtgcacacaggcctgaagctggagcgggccctgctggtgacagccagccagtgccagcagcctgctgagaacaagctgagtgacctgctggcccccatcagcgagcagatcaaggaggtgatcaccttccgggagaagaacagaggcagcaagctgttcaaccacctgtctgctgtgtctgagagcatccaggccctgggctgggtggccatggcccccaagccaggcccctacgtgaaggagatgaatgatgctgccatgttctacaccaacagagtgctgaaggagtacaaggatgtggacaagaagcacgtggactgggtgaaggcctacctgagcatctggacagagctgcaggcctacatcaaggagttccacaccaccggcctggcctggagcaagacaggccctgtggccaaggagctgagcggcctgcccagcggccccagcgctggcagctgccccccacctcctccaccctgccccccacctcctcctgtgtccaccatcagctgcagctatgagagcgccagccgcagcagcctgtttgcccagatcaaccagggcgagagcatcacccacgccctgaagcacgtgtctgatgacatgaagacccacaagaacccagccctgaaggcccagagcggccctgtgcgcagcggccccaagcccttcagcgcccccaagccccagaccagccccagccccaagagggccaccaagaaggagcctgctgtgctggagctggagggcaagaagtggagggtggagaaccaggagaatgtgagcaacctggtgattgaggacacagagctgaagcaggtggcctacatctacaagtgtgtgaacaccaccctgcagatcaagggcaagatcaacagcatcaccgtggacaactgcaagaagctgggcctggtgtttgatgatgtggtgggcatcgtggagatcatcaacagcaaggatgtgaaggtgcaggtgatgggcaaggtgcccaccatcagcatcaacaagacagatggctgccacgcctacctgagcaagaacagcctggactgtgagatcgtgtctgccaagagcagcgagatgaatgtgctgatccccacagagggcggggacttcaatgagttccctgtgcctgagcagttcaagaccctgtggaatggccagaagctggtgaccaccgtgacagaaattgctggatag

SEQ ID NO: 7241 - DNA, 360 bp, Artificial Sequence
  Description of Artificial Sequence: Synthetic coding sequence
atgaacaagatcctgagcagcacagtgtgcttcggcctgctgaccctgctgtctgtgctgtccttcctgcagagcgtgcacggccggccctacctgacccagggcaatgagatcttcccagacaagaagtacaccaaccgggaggagctgctgctggccctgctgaacaagaactttgacttccagaggcccttcaacacagacctggccctgcccaacaagctggaggagctgaaccagctggagaagctgaaggagcagctggtggaggagaaggacagcgagaccagctatgctgtggatggcctcttcagcagccaccccagcaagagggcctgcttctggaagtactgtgtgtag

SEQ ID NO: 7242 - DNA, 3756 bp, Artificial Sequence
  Description of Artificial Sequence: Synthetic coding sequence
atgaggctgctgctgctggtgcccctgctgctggccccagcccctggcagcagcgcccccaaggtgcggcggcagagcgacacctggggcccctggagccagtggagcccctgcagcaggacctgtggcggcggcgtgtccttccgggagcggccctgctacagccagaggagagatggcggcagcagctgtgtgggccctgcccggagccacaggagctgcaggacagagagctgcccagatggagcccgggacttccgggcagagcagtgtgccgagtttgatggagctgagttccagggccgccgctaccgctggctgccctactacagcgcccccaacaagtgtgagctgaactgcatccccaagggggagaacttctactacaagcaccgggaggccgtggtggatggcaccccctgtgagcccgggaagagagatgtgtgtgtggatggcagctgccgggtggtgggctgtgaccacgagctggacagcagcaagcaggaggacaagtgcctgcgctgtggaggagatggcaccacctgctaccctgtggccggcacctttgatgccaatgacctgagcagagctgtgaagaatgtgcggggggagtactacctgaatggccactggaccattgaagctgcccgggccctgcctgctgccagcaccatcctgcactatgaaagaggagctgagggggacctggcccctgagcggctgcacgcccggggccccaccagcgagcccctggtgattgagctgatcagccaggagcccaaccctggggtgcactatgagtaccacctgcccctgcggcggcccagccctggcttctcctggagccacggctcctggagcgactgcagcgcagaatgtggcggcggccaccagagccggctggtgttctgcaccatcgaccacgaggcctacccagaccacatgtgccagaggcagcccaggcctgctgacagaagaagctgcaacctgcacccctgcccagagaccaagcgctggaaggccggcccctgggccccctgcagcgccagctgtggcggcggcagccagagccgctctgtgtactgcatcagcagtgatggagctggcatccaggaggccgtggaggaggccgagtgtgccggcctgcccgggaagcccccagccatccaggcctgcaacctgcagagatgtgccgcctggagccctgagccctggggagaatgttctgtgtcctgtggggtgggcgtgaggaagaggtctgtgacctgccgcggggagcggggcagcctgctgcacacagctgcctgcagcctggaggaccggccccccctgacagagccctgtgtgcatgaggactgccccctgctgagtgaccaggcctggcacgtgggcacctggggcctgtgcagcaagagctgcagcagcggcacccggcggcggcaggtgatctgtgccatcggcccccccagccactgcggcagcctgcagcacagcaagcctgtggatgtggagccctgcaacacccagccctgccacctgccccaggaggtgcccagcatgcaggatgtgcacaccccagccagcaacccctggatgcccctgggcccccaggagagccctgccagtgacagccggggccagtggtgggccgcccaggagcaccccagcgcccggggggaccacagaggagagcggggggaccccaggggggaccagggcacccacctgagcgccctgggccctgcccccagcctgcagcagcccccctaccagcagcccctgcggagcggcagcggcccccatgactgccgccacagcccccacggctgctgcccagatggccacacagccagcctgggcccccagtggcagggctgccctggggccccctgccagcagagccgctatggctgctgcccagacagagtgtctgtggccgagggcccccaccacgccggctgcaccaagagctatggaggagacagcactggaggcatgcccaggagcagagctgtggccagcacagtgcacaacacccaccagccccaggcccagcagaatgagcccagtgaatgtcggggcagccagtttggctgctgctatgacaacgtggccacagctgctggccccctgggggagggctgtgtgggccagcccagccacgcctaccctgtgcgctgcctgctgcccagcgcccacggcagctgtgccgactgggccgcccgctggtactttgtggcctctgtgggccagtgcaaccgcttctggtatggaggctgccacggcaatgccaacaactttgccagcgagcaggagtgcatgagcagctgccagggcagcctgcacggcccccggcggccccagcccggggccagcggccgcagcacccacacagatggcggcggcagcagccctgctggggagcaggagcccagccagcacaggactggagctgctgtgcagaggaagccctggcccagcggcggcctgtggaggcaggaccagcagcccggccctggagaggccccccacacccaggccttcggggagtggccctggggccaggagctgggcagccgggcccctggcctgggcggagatgctggcagccctgccccacccttccacagcagcagctaccgcatcagcctggccggcgtggagcccagcctggtgcaggccgccctgggccagctggtgcggctgagctgcagtgatgacacagcccctgagagccaggccgcctggcagaaggatggccagcccatcagcagtgacagacaccggctgcagtttgatggcagcctcatcatccaccccctgcaggccgaggatgctggcacctacagctgtggcagcacccggcccggccgggacagccagaagatccagctgcgcatcatcggcggggacatggctgtgctgtctgaggccgagctgagccgcttcccccagccccgggaccctgcccaggactttggccaggccggggctgctggccccctgggcgccatccccagcagccacccccagcctgccaaccggctgcggctggaccagaaccagccccgggtggtggatgccagccctggccagaggatccgcatgacctgcagagctgagggcttccccccaccagccatcgagtggcagagagatggccagcctgtgagcagccccaggcaccagctgcagccagatggcagcctggtgatcagccgggtggccgtggaggatggcggcttctacacctgtgtggccttcaacggccaggaccgggaccagcgctgggtgcagctgcgggtgctgggggagctgaccatcagcggcctgccccccaccgtgacagtgcctgagggggacacagcccggctgctgtgtgtggtggccggggagagcgtgaacatccgctggagcagaaatggcctgcctgtgcaggctgatggccaccgggtgcaccagagcccagatggcaccctgctgatctacaacctgcgggccagagatgagggcagctacacctgcagcgcctaccagggcagccaggccgtgagccgcagcacagaggtgaaggtggtgtccccagcccccacagcccagccccgggaccccggccgggactgtgtggaccagcctgagctggccaactgtgacctgatcctgcaggcccagctgtgtggaaatgagtactacagcagcttctgctgtgccagctgcagccgcttccagccccacgcccagcccatctggcagtag

SEQ ID NO: 7243 - DNA, 1731 bp, Artificial Sequence
  Description of Artificial Sequence: Synthetic coding sequence
atggcccagggcgtgctgtggatcctgctgggcctgctgctgtggagcgaccccggcacagccagcctgcccctgctgatggattctgtcatccaggccctggccgagctggagcagaaggtgcctgctgccaagaccaggcacacagccagcgcctggctgatgtctgcccccaacagcggcccccacaaccggctgtaccacttcctgctgggcgcctggagcctgaatgccacagagctggacccctgccccctgagccctgagctgctgggcctgaccaaggaggtggcccggcatgatgtgcgggagggcaaggagtatggagtggtgctggccccagatggcagcacagtggccgtggagcccctgctggccggcctggaggccggcctgcagggcagaagagtcatcaacctgcccctggacagcatggccgccccctgggagactggagacaccttcccagatgtggtggccatcgccccagatgtgcgggccaccagcagccctggcctgagagatggcagcccagatgtgaccacagctgacattggagccaacaccccagatgccaccaagggctgcccagatgtgcaggccagcctgcctgatgccaaggccaagagcccccccaccatggtggacagcctgctggccgtgaccctggccggcaacctgggcctgaccttcctgcggggcagccagacccagagccacccagacctgggcacagagggctgctgggaccagctgagcgcccccaggaccttcaccctgctggaccccaaggccagcctgctgaccatggccttcctgaatggagccctggatggagtcatcctgggggactacctgagcaggaccccagagccccggcccagcctgagccacctgctgagccagtactacggggccggcgtggcccgggaccccggcttccgcagcaacttccggcggcagaatggagctgccctgaccagcgccagcatcctggcccagcaggtgtggggcaccctggtgctgctgcagaggctggagcctgtgcacctgcagctgcagtgcatgagccaggagcagctggcccaggtggccgccaatgccaccaaggagttcacagaggccttcctgggctgcccagccatccacccccgctgccgctggggcgccgccccctaccggggccggcccaagctgctgcagctgcccctgggcttcctgtatgtgcaccacacctacgtgcctgccccaccctgcacagacttcacccgctgtgccgccaacatgaggtccatgcagcgctaccaccaggacacccagggctggggagacatcggctacagctttgtggtgggcagtgatggctacgtgtatgagggccggggctggcactgggtgggcgcccacaccctgggccacaacagccggggcttcggcgtggccatcgtgggcaactacacagctgccctgcccacagaggccgccctgaggacagtgcgggacaccctgcccagctgtgctgtgcgggccggcctgctgcggccagactatgccctgctgggccaccggcagctggtgaggacagactgccctggagatgccctgtttgacctgctgcggacctggccccacttcaccgccaccgtgaagcccaggcctgcccggtctgtgtccaagaggagccggcgggagcccccacccaggaccctgcctgccacagacctgcagtag

SEQ ID NO: 7244 - DNA, 846 bp, Artificial Sequence
  Description of Artificial Sequence: Synthetic coding sequence
atgctgcccaagagccggcgggccctgaccatccaggagattgctgccctggcccggagcagcctgcacggcatcagccaggtggtgaaggaccacgtgaccaagcccacagccatggcccagggccgggtggcccacctgattgagtggaagggctggagcaagcccagcgacagccctgctgccctggagagcgccttcagcagctacagcgacctgtctgagggggagcaggaggccaggtttgctgctggggtggccgagcagtttgccatcgccgaggccaagctgcgggcctggagctctgtggatggagaggacagcacagatgacagctatgatgaagattttgctgggggcatggacacagacatggccggccagctgcccctgggcccccacctgcaggacctcttcaccggccaccgcttcagcaggcctgtgcggcagggctctgtggagcctgagagtgactgcagccagacagtgtccccagacaccctgtgcagcagcctgtgcagcctggaggatggcctgctgggcagccctgcccggctggccagccagctgctgggagatgagctgctgctggccaagctgccccccagccgggagagcgccttccgcagcctgggccccctggaggcccaggacagcctgtacaacagccccctgacagagagctgcctgagccctgctgaggaggagcccgccccctgcaaggactgccagcccctgtgcccccccctgaccggctcctgggagcggcagaggcaggccagtgacctggccagcagcggcgtggtgtccctggatgaagatgaggccgagcctgaggagcagtag

SEQ ID NO: 7245 - DNA, 2619 bp, Artificial Sequence
  Description of Artificial Sequence: Synthetic coding sequence
atgggcatcgtgtggatcctgatgtctgtgctgccctggtggggccgctgtgccgacctggccatcgccagcacccagctggtgcccagcacagccagcgccaggatggccctgagcagccagctgatgggccgcacagtgtggacccccatgtctgccagcgccctgcaggagcccgcctacccagccctggcccggaccagccgggcccccagcgctgcctctgtgcccctggccagccgctgccgggtgaccacagccctgatcagcaccagcgcccagaggagccccaccagcgccagcctggcccctgtgcccacagccctgggcgccagcagcgccagcgcccacctggccctgagcagcctgaccatgggcaccgtggccctgacccacggccgggtgtctgccagccctgtgctgcggctgggcagcgcccgctgccccaagctgagcaccccacccaggcctgctgctgctgctgtgcggggcctgggccgggccggggagaccccagccaactgtgtgccccggcgggctgtgcccggcccagatgacagcagagaagatgtgaatgaatgtgccgagaaccctggggtgtgcaccaatggagtgtgtgtgaacacagatggcagcttccgctgtgagtgccccttcggctacagcctggacttcaccggcatcaactgtgtggacacagatgaatgttctgtgggccacccctgtggccagggcacctgcaccaacgtgattggaggctttgaatgtgcctgtgctgatggctttgagcccggcctgatgatgacctgtgaagatattgatgaatgttccctgaaccccctgctgtgtgccttccgctgccacaacacagagggcagctacctgtgcacctgcccagctggctacaccctgcgggaggatggagccatgtgcagagatgtggatgaatgtgctgatggccagcaggactgccacgcccggggcatggagtgcaagaacctgattggcacctttgcctgtgtgtgccccccaggcatgaggcccctgcccggcagcggggagggctgcacagatgacaatgaatgtcatgcccagcctgacctgtgtgtgaatggccgctgtgtgaacacagctggcagcttccgctgtgactgtgatgagggcttccagcccagccccaccctgacagaatgtcatgacatccggcagggcccctgctttgctgaggtgctgcagaccatgtgccgcagcctgagcagcagcagcgaggccgtgaccagggctgagtgctgctgcggcggcggccggggctggggcccccgctgtgagctgtgccccctgcccggcaccagcgcctacaggaagctgtgcccccacggcagcggctacacagctgagggcagagatgtggatgagtgcaggatgctggcccacctgtgtgcccacggggagtgcatcaacagcctgggcagcttccgctgccactgccaggccggctacaccccagatgccacagccaccacctgcctggacatggatgagtgcagccaggtgcccaagccctgcaccttcctgtgcaagaacaccaagggcagcttcctgtgcagctgcccccggggctacctgctggaggaggatggccgcacctgcaaggacctggatgaatgtaccagccggcagcacaactgccagttcctgtgtgtgaacacagtgggcgccttcacctgccgctgccccccaggcttcacccagcaccaccaggcctgctttgatgtgaatgaatgtgatggcccccaccgctgccagcacggctgccagaaccagctgggcggctaccgctgcagctgcccccagggcttcacccagcacagccagtgggcccagtgtgtggatgaaaatgaatgtgccctgagcccccccacctgtggcagcgccagctgcaggaacaccctgggcggcttccgctgtgtgtgccccagcggctttgattttgaccaggccctgggcggctgccaggaggtggatgaatgtgccggccggcggggcccctgcagctacagctgtgccaacacccctgggggcttcctgtgtggctgcccccagggctacttccgggccggccagggccactgtgtgtctggcctgggcttcagccctggcccccaggacaccccagacaaggaggagctgctgagcagcgaggcctgctatgagtgcaagatcaatggcctgagcccccgggaccggcccaggagaagtgcccaccgggaccaccaggtgaacctggccaccctggacagcgaggccctgctgaccctgggcctgaacctgagccacctgggccgggcagagcgcatcctggagctgcggcctgccctggagggcctggagggccgcatccgctacgtgattgtgagaggaaatgagcagggcttcttcaggatgcaccacctgcggggcgtgagcagcctgcagctgggcagaagaagacctggccctggcacctaccgcctggaggtggtgagccacatggccggcccctggggcgtgcagcctgagggccagcccggcccctggggccaggccctgcggctgaaggtgcagctgcagctgctgtag

SEQ ID NO: 7246 - DNA, 1368 bp, Artificial Sequence
  Description of Artificial Sequence: Synthetic coding sequence
atggccaggaaggccctgaagctggcctcctggacctccatggccctggccgccagcggcatctacttctacagcaacaagtacctggaccccaatgactttggagctgtgcgggtgggccgggctgtggccaccacagctgtgatctcctatgactacctgaccagcctgaagtctgtgccctacggcagcgaggagtacctgcagctgcggagcaagatccatgacctcttccagagctttgatgacacccccctgggcacagccagcctggcccaggtgcacaaggctgtgctgcatgatggccgcacagtggccgtgaaggtgcagcaccccaaggtgcgggcccagagcagcaaggacatcctgctgatggaggtgctggtgctggccgtgaagcagctgtttcctgagtttgagttcatgtggctggtggatgaggccaagaagaacctgcccctggagctggacttcctgaatgaaggaagaaatgctgagaaggtgtcccagatgctgcggcactttgacttcctgaaggtgccccgcatccactgggacctgagcacagagcgggtgctgctgatggagtttgtggatggcggccaggtgaatgaccgggactacatggagaggaacaagattgatgtgaatgagatcagccgccacctgggcaagatgtacagcgagatgatctttgtgaatggatttgtgcactgtgacccccaccctggaaatgtgctggtgaggaagcaccctggcaccgggaaggccgagatcgtgctgctggaccacggcctgtaccagatgctgacagaggagttccggctgaactactgccacctgtggcagagcctcatctggacagacatgaagagggtgaaggagtacagccagaggctgggcgctggggacctgtaccccctgtttgcctgcatgctgacagcccgctcctgggacagcgtgaacagaggcatcagccaggcccctgtgacagccacagaggacctggagatcagaaataatgctgccaactacctgccccagatcagccacctgctgaaccacgtgccccggcagatgctgctgatcctgaagaccaatgacctgctgcggggcattgaagctgccctgggcacccgggccagcgccagcagcttcctgaacatgagccgctgctgcatccgggccctggccgagcacaagaagaagaacacctgcagcttcttccggaggacccagatctccttcagcgaggccttcaacctgtggcagatcaacctgcacgagctgatcctgcgggtgaagggcctgaagctggccgacagagtgctggccctgatctgctggctgtttcctgcccccctgtag

SEQ ID NO: 7247 - DNA, 1245 bp, Artificial Sequence
  Description of Artificial Sequence: Synthetic coding sequence
atgaaccccaccctgggcctggccatcttcctggccgtgctgctgactgtgaagggcctgctgaagcccagcttcagccccaggaactacaaggccctgtctgaggtgcagggctggaagcagaggatggccgccaaggagctggcccggcagaacatggacctgggcttcaagctgctgaagaagctggccttctacaaccctggcaggaacatcttcctgagccccctgagcatcagcacagccttctccatgctgtgcctgggcgcccaggacagcaccctggatgagatcaagcagggcttcaacttcaggaagatgcctgagaaggacctgcacgagggcttccactacatcatccacgagctgacccagaagacccaggacctgaagctgagcatcggcaacaccctcttcatcgaccagaggctgcagccccagaggaagttcctggaggatgccaagaacttctacagcgctgagaccatcctgaccaacttccagaacctggagatggcccagaagcagatcaatgacttcatcagccagaagacccacggcaagatcaacaacctgattgagaacatcgaccccggcaccgtgatgctgctggccaactacatcttcttccgggcccgctggaagcatgaatttgaccccaacgtgaccaaggaggaggacttcttcctggagaagaacagctctgtgaaggtgcccatgatgttccgcagcggcatctaccaggtgggctatgatgacaagctgagctgcaccatcctggagatcccctaccagaagaacatcacagccatcttcatcctgcctgatgagggcaagctgaagcacctggagaagggcctgcaggtggacaccttcagccgctggaagaccctgctgagcagaagagtggtggatgtgtctgtgccccggctgcacatgacaggcacctttgacctgaagaagaccctgagctacatcggcgtgtccaagatctttgaggagcacggggacctgaccaagatcgccccccacaggagcctgaaggtgggggaggccgtgcacaaggccgagctgaagatggatgagcggggcacagaaggagctgctggcactggagcccagaccctgcccatggagacccccctggtggtgaagattgacaagccctacctgctgctgatctacagcgagaagatccccagcgtgctcttcctgggcaagatcgtgaaccccatcggcaagtag

SEQ ID NO: 7248 - DNA, 942 bp, Artificial Sequence
  Description of Artificial Sequence: Synthetic coding sequence
atgtctgacctgctgctgctgggcctcatcggcggcctgaccctgctgctgctgctgaccctgctggcctttgctggctacagcggcctgctggccggcgtggaggtgtctgctggcagcccccccatcagaaatgtgacagtggcctacaagttccacatgggcctgtatggagagaccggccgcctcttcacagagagctgcagcatcagccccaagctgcggagcattgctgtgtactatgacaacccccacatggtgcccccagacaagtgccgctgtgctgtgggcagcatcctgtctgagggggaggagagccccagccctgagctgattgacctgtaccagaagtttggcttcaaggtgttctccttccctgcccccagccacgtggtgacagccaccttcccctacaccaccatcctgagcatctggctggccaccaggagagtgcacccagccctggacacctacatcaaggagaggaagctgtgtgcctacccccggctggagatctaccaggaggaccagatccacttcatgtgccccctggcccggcagggcgacttctacgtgcctgagatgaaggagacagagtggaagtggaggggcctggtggaggccatcgacacccaggtggatggcaccggggctgacaccatgtctgacaccagctctgtgtccctggaggtgtccccaggcagccgggagaccagcgctgccaccctgagccctggggccagcagccggggctgggatgatggagacaccaggtctgagcacagctacagcgagagcggggccagcggcagcagctttgaggagctggacctggagggggagggccccctgggggagagccggctggaccctggaacagagcccctgggcaccaccaagtggctgtgggagcccacagcccctgagaagggcaaggagtag

SEQ ID NO: 7249 - DNA, 603 bp, Artificial Sequence
  Description of Artificial Sequence: Synthetic coding sequence
atggcctggggcggcgtgcacacctgctgcttccacctgtgctgctgctgctcctggccccagggcgctgtgcctgaggagctgcacaagcaccctggccagaccctgctgctgcagtgccagtacagccccaagaggggcccctaccagcccaagtcctggtgccagcagaccagccccagccgctgcaccctgctggtgaccagcagcaagccctggacagctgtgcagaagagccactacaccatctgggacaagcccaatgccggcttcttcaacatcaccatgatccagctgacccagaatgacagcggcttctactggtgtggcatctacaatgccagcgagaacatcatcaccgtgctgaggaacatcagcctggtggtgtccccagcccccaccaccagccccatgtggaccctgccctggctgcccaccagcacagtgctgatcaccagccctgagggcaccagcggccaccccagcatcaatggcagcgagaccaggaagagccgggccccagcctgcctgggcagcggcggcccccgcttcctggtgctggtgctgtgtggcctgctgctggccaagggcctgatgctgtag

SEQ ID NO: 7250 - DNA, 1035 bp, Artificial Sequence
  Description of Artificial Sequence: Synthetic coding sequence
accacccccagccgggccctgcccggctggagcaactgccggccccgctggagggctggccccaccccccagagccccaccccccagagcaggatgaggctgagccctggcccccccagcgagtggacctggctgctgccccacttcaacccctgccaccaccaccaccgccaccaccaccccaaccccaccaccagcctgctgcccacagagccccccagcggccctgaggtgagcagccagggccgggaggccagctgtgagggcaccctgcgggctgtggacccccctgtgcgccaccacagctatggaagacatgagggcgcctggatgaaggaccctgctgccagagatgaccgcatctacgtgaccaactactactacggcaacagcctggtggagttcaggaacctggagaacttcaagcagggccgctggagcaacatgtacaagctgccctacaactggattggaactggacatgtggtgtaccagggcgccttctactacaacagagccttcaccaagaacatcatcaagtatgacctgcggcagagatttgtggcctcctgggccctgctgcctgatgtggtgtatgaggacaccaccccctggaagtggaggggccacagcgacatcgactttgctgtggatgagagcggcctgtgggtgatctacccagctgtggatgacagagatgaggcccagcctgaggtgattgtgctgagccggctggaccccggggacctgtctgtgcaccgggagaccacctggaagacccggctgcggaggaacagctatggcaactgcttcctggtgtgtggcatcctgtatgctgtggacacctacaaccagcaggagggccaggtggcctatgcctttgacacccacactggaacagatgcccggccccagctgcccttcctgaatgagcacgcctacaccacccagattgactacaaccccaaggagcgggtgctgtatgcctgggacaatggccaccagctgacctacaccctgcactttgtggtgtag

SEQ ID NO: 7251 - DNA, 2682 bp, Artificial Sequence
  Description of Artificial Sequence: Synthetic coding sequence
atggccgaggccgccctggaggccgtgcgctctgagctgcgggagttccctgctgctgcccgggagctgtgtgtgcccctggccgtgccctacctggacaagccacccacccccctgcacttctacagagactgggtgtgccccaaccggccctgcatcatcagaaatgccctgcagcactggccagccctgcagaagtggagcctgccctacttccgggccaccgtgggcagcacagaggtgtctgtggccgtgaccccagatggctatgcagatgctgtgcggggggaccgcttcatgatgcctgctgagcggcggctgcccctgagctttgtgctggatgtgctggagggccgggcccagcaccctggggtgctgtatgtgcagaagcagtgcagcaacctgcccagcgagctgccccagctgctgcctgacctggagagccacgtgccctgggccagcgaggccctgggcaagatgccagatgctgtgaacttctggctgggggaggccgctgctgtgaccagcctgcacaaggaccactatgaaaatctctactgtgtggtgtctggagagaagcacttcctgttccaccccccaagtgaccggcccttcatcccctatgagctgtacaccccagccacctaccagctgacagaggagggcaccttcaaggtggtggatgaggaggccatggagaaggccgaggtgtccaggacctgcctgctgactgtgcgggtgctgcaggcccaccggctgcccagcaaggacctggtgacccccagcgactgctacgtgaccctgtggctgcccacagcctgcagccaccggctgcagaccaggacagtgaagaacagcagcagccctgtgtggaaccagagcttccacttccgcatccaccggcagctgaagaatgtgatggagctgaaggtgtttgaccaggacctggtgactggagatgatcctgtgctgtctgtgctgtttgatgctggcaccctgcgggccggggagttcagaagagagagcttcagcctgagcccccagggcgagggccgcctggaggtggagttccggctgcagagcctggccgacagaggagagtggctggtgtccaatggagtgctggtggcccgggagctgagctgcctgcacgtgcagctggaggagaccggggaccagaagagcagcgagcaccgggtgcagctggtggtgcccggcagctgtgagggcccccaggaggcctctgtgggcaccggcaccttccgcttccactgcccagcctgctgggagcaggagctgagcatccggctgcaggatgcccctgaggagcagctgaaggcccccctgagcgccctgcccagcggccaggtggtgcggctggtgttccccaccagccaggagcccctgatgagggtggagctgaagaaggaggccggcctgcgggagctggccgtgcggctgggcttcggcccctgtgccgaggagcaggccttcctgagcaggaggaagcaggtggtggccgccgccctgcggcaggccctgcagctggatggagacctgcaggaggatgagatccctgtggtggccatcatggccactggaggcggcatccgggccatgaccagcctgtatggccagctggccggcctgaaggagctgggcctgctggactgtgtgtcctacatcactggagccagcggcagcacctgggccctggccaacctgtatgaagatcctgagtggagccagaaggacctggccggccccacagagctgctgaagacccaggtgaccaagaacaagctgggcgtgctggcccccagccagctgcagcgctaccggcaggagctggccgagcgggcccggctgggctaccccagctgcttcaccaacctgtgggccctgatcaatgaggccctgctgcatgatgagccccatgaccacaagctgagtgaccagcgggaggccctgagccacggccagaaccccctgcccatctactgtgccctgaacaccaagggccagagcctgaccacctttgaatttggagagtggtgtgagttcagcccctatgaggtgggcttccccaagtacggggccttcatccccagcgagctgtttggaagtgagttcttcatgggccagctgatgaagaggctgcctgagagccgcatctgcttcctggagggcatctggagcaacctgtatgctgccaacctgcaggacagcctgtactgggccagcgagcccagccagttctgggaccgctgggtgaggaaccaggccaacctggacaaggagcaggtgcccctgctgaagattgaggagccccccagcacagctggaagaattgctgagttcttcacagacctgctgacctggaggcccctggcccaggccacccacaacttcctgcggggcctgcacttccacaaggactacttccagcacccccacttcagcacctggaaggccaccaccctggatggcctgcccaaccagctgacccccagcgagccccacctgtgcctgctggatgtgggctacctgatcaacaccagctgcctgcccctgctgcagcccaccagagatgtggacctgatcctgagcctggactacaacctgcacggggccttccagggcagcggcggccacccccggcggcggcagctgggccgctag

SEQ ID NO: 7252 - DNA, 354 bp, Artificial Sequence
  Description of Artificial Sequence: Synthetic coding sequence
atgatcatcgacagcagccgcatccccagcttcacccagctgcacagcaccatgacccgggcccccctgctgctgctgtgtgtggccctggtgctgctgggccacgtgaatggagccaccgtgagaaatgaagacaagtggaagcccctgaacaaccccaggaacagagacctcttcttccggcggctgcaggcctacttcaagggccggggcctggacctgggcaccttccccaaccccttccccaccaatgaaaacccccggcccctgtccttccagagcgagctgacagccagcgccagcgctgactatgaggagcagaagaacagcttccacaactacctgaagggctag

SEQ ID NO: 7253 - DNA, 4143 bp, Artificial Sequence
  Description of Artificial Sequence: Synthetic coding sequence
atgagacatggagtggcctgggccctgctggtggccgccgccctgggcctgggcgcccggggcgtgagaggagctgtggccctggccgacttctacccctttggagctgagagaggagatgctgtgacccccaagcaggatgatggcggcagcggcctgcggcccctgtctgtgcccttccccttctttggagctgagcacagcggcctgtatgtgaacaacaacggcatcatctccttcctgaaggaggtgtcccagttcacccctgtggccttccccatcgccaaggacagatgtgtggtggccgccttctgggcagatgtggacaacagaagagctggagatgtgtactaccgggaggccacagatcctgccatgctgcggcgggccacagaagatgtgcgccactacttccctgagctgctggacttcaatgccacctgggtgtttgtggccacctggtacagagtgaccttcttcggcggcagcagcagcagccctgtgaacaccttccagacagtgctgatcacagatggcaagctgtccttcaccatcttcaactatgagagcatcgtgtggaccaccggcacccacgccagcagcggcggcaatgccaccggcctgggcggcattgctgcccaggccggcttcaatgctggagatggccagcgctacttcagcatccctggcagcaggacagctgacatggccgaggtggagaccaccaccaacgtgggcgtgcccggccgctgggccttcagaattgatgatgcccaggtgcgggtgggcggctgcggccacaccacctctgtgtgcctggccctgcggccctgcctgaatggaggaaaatgtattgatgactgtgtgacaggcaaccccagctacacctgcagctgcctgagcggcttcaccggccgccgctgccacctggatgtgaatgaatgtgccagccagccctgccagaatggaggcacctgcacccacggcatcaacagcttccgctgccagtgcccagctggctttggaggccccacctgtgaaacagcccagagcccctgtgacaccaaggagtgccagcacggcggccagtgccaggtggagaatggcagcgctgtgtgtgtgtgccaggccggctacaccggggccgcctgtgagatggatgtggatgactgcagcccagacccctgcctgaatggaggcagctgtgtggacctggtgggcaactacacctgcctgtgtgccgagcccttcaagggcctgcgctgtgagaccggggaccaccctgtgcctgatgcctgcctgagcgccccctgccacaacggcggcacctgtgtggatgctgaccagggctacgtgtgtgagtgcccagagggcttcatgggcctggactgccgggagcgggtgcctgatgactgtgaatgtagaaatggaggccgctgcctgggcgccaacaccaccctgtgccagtgccccctgggcttcttcggcctgctgtgtgaatttgagatcacagccatgccctgcaacatgaacacccagtgcccagatggcggctactgcatggagcacggcggcagctacctgtgtgtgtgccacacagaccacaatgccagccacagcctgcccagcccctgtgacagcgacccctgcttcaacggcggcagctgtgatgcccatgatgacagctacacctgtgagtgcccccggggcttccacggcaagcactgtgagaaggcccggccccacctgtgcagcagcggcccctgcagaaatggaggcacctgcaaggaggccggcggggagtaccactgcagctgcccctaccgcttcaccggccgccactgtgaaattggcaagccagacagctgtgccagcggcccctgccacaacggcggcacctgcttccactacatcggcaagtacaagtgtgactgccccccaggcttcagcggccgccactgtgagatcgcccccagcccctgcttccgcagcccctgtgtgaatggaggcacctgtgaagatcgggacacagacttcttctgccactgccaggccggctacatgggccgccgctgccaggccgaggtggactgtggccccccagaggaggtgaagcacgccaccctgcgcttcaacggcacccggctgggcgctgtggccctgtatgcctgtgaccggggctacagcctgagcgcccccagccgcatccgggtgtgccagccccacggcgtgtggagcgagcccccccagtgcctggagattgatgagtgccgcagccagccctgcctgcacggcggcagctgccaggacagagtggccggctacctgtgcctgtgcagcacaggctatgaaggagcccactgtgagctggagagagatgagtgccgggcccacccctgcagaaatggaggcagctgcaggaacctgcccggggcctacgtgtgccgctgcccagctggctttgtgggcgtgcactgtgaaacagaggtggatgcctgtgacagcagcccctgccagcacggcggccgctgtgagagcggcggcggggcctacctgtgtgtgtgcccagagagcttcttcggctaccactgtgagaccgtgtctgacccctgcttcagcagcccctgtggcggccggggctactgcctggccagcaatggcagccacagctgcacctgcaaggtgggctacaccggggaggactgtgccaaggagctgttccccccaacagccctgaagatggagcgggtggaggagagcggcgtgtccatctcctggaacccccccaacggccctgctgcccggcagatgctggatggctatgctgtgacctacgtgtccagtgatggcagctacagaagaacagactttgtggacaggaccaggagcagccaccagctgcaggccctggccgccggccgggcctacaacatctctgtgttttctgtgaagaggaacagcaacaacaagaatgacatcagcaggcctgctgtgctgctggcccggacccggcccaggcctgtggagggctttgaggtgaccaacgtgacagccagcaccatctctgtgcagtgggccctgcaccgcatcagacatgccaccgtgtctggagtgcgggtgtccatccgccaccctgaggccctgcgggaccaggccacagatgtggacagatctgtggaccgcttcaccttccgggccctgctgcccgggaagcgctacaccatccagctgaccaccctgagcggcctgcggggggaggagcaccccacagagagcctggccacagcccccacccacgtgtggacccggcccctgcccccagccaacctgacagctgcccgggtgacagccaccagcgcccacgtggtgtgggatgcccccaccccaggcagcctgctggaggcctacgtgatcaacgtgaccaccagccagagcaccaagagccgctacgtgcccaacgggaagctggccagctacacagtgcgggacctgctgcccggccgccgctaccagctgtctgtgattgctgtgcagagcacagagctgggcccccagcacagcgagcccgcccacctgtacatcatcaccagccccagagatggagctgaccggcgctggcaccagggcggccaccacccccgggtgctgaagaaccggcccccaccagcccggctgcctgagctgcggctgctgaatgaccacagcgcccctgagacccccacccagcccccacgcttcagcgagctggtggatggccggggccgggtgtctgccaggtttggaggcagccccagcaaggccgccaccgtgcgcagccacgtgcccggcaactgcagcgagaacccctgccagaatggaggcacctgtgtgcctggagcagatgcccacagctgtgactgtggccctggcttcaagggcagaagatgtgagctggcctgcatcaaggtgtcccggccctgcaccaggctcttcagcgagaccaaggccttccctgtgtgggagggcggcgtgtgccaccacgtgtacaagagggtgtacagagtgcaccaggacatctgcttcaaggagagctgtgagagcaccagcctgaagaagacccccaacaggaagcagagcaagagccagaccctggagaagagctag

SEQ ID NO: 7254 - DNA, 474 bp, Artificial Sequence
  Description of Artificial Sequence: Synthetic coding sequence
atggaggccctgcggcgggcccacgaggtggccctgcggctgctgctgtgccggccctgggccagcagagctgctgcccggcccaagcccagcgccagcgaggtgctgaccaggcacctgctgcagaggcggctgccccactggaccagcttctgtgtgccctacagcgctgtgagaaatgaccagtttggcctgagccacttcaactggcctgtgcagggcgccaactaccacgtgctgaggacaggctgcttccccttcatcaagtaccactgcagcaaggccccctggcaggacctggcccggcagaaccgcttcttcaccgccctgaaggtggtgaacctgggcatccccaccctgctgtatggcctgggctcctggctgtttgcccgggtgacagaaacagtgcacaccagctatggccccatcaccgtgtacttcctgaacaaggaggatgagggcgccatgtactag

SEQ ID NO: 7255 - DNA, 288 bp, Artificial Sequence
  Description of Artificial Sequence: Synthetic coding sequence
atgaagggcagccgggccctgctgctggtggccctgaccctcttctgcatctgcaggatggccaccggggaggacaatgatgagttcttcatggacttcctgcagaccctgctggtgggcaccccagaggagctgtatgagggcaccctgggcaagtacaacgtgaatgaagatgccaaggccgccatgacagagctgaagagctgcattgatggcctgcagcccatgcacaaggccgagctggtgaagctgctggtgcaggtgctgggcagccaggatggagcctag

SEQ ID NO: 7256 - DNA, 1053 bp, Artificial Sequence
  Description of Artificial Sequence: Synthetic coding sequence
atgaagtgcagcctgcgggtgtggttcctgtctgtggccttcctgctggtgttcatcatgagcctgctcttcacctacagccaccacagcatggccaccctgccctacctggacagcggggccctggatggcacccaccgggtgaagctggtgcccggctacgccggcctgcagaggctgagcaaggagcggctgagcggcaagagctgtgcctgccgccgctgcatgggagatgctggggccagtgactggtttgacagccactttgatggcaacatcagccctgtgtggacccgggagaacatggacctgcccccagatgtgcagcgctggtggatgatgctgcagccccagttcaagagccacaacaccaatgaggtgctggagaagctgttccagatcgtgcctggagagaacccctaccgcttccgggacccccaccagtgccgccgctgtgctgtggtgggcaacagcggcaacctgcggggcagcggctacggccaggatgtggatggccacaacttcatcatgaggatgaaccaggcccccaccgtgggctttgagcaggatgtgggcagcaggaccacccaccacttcatgtacccagagagcgccaagaacctgcctgccaacgtgtcctttgtgctggtgcccttcaaggtgctggacctgctgtggatcgccagcgccctgagcacaggccagatccgcttcacctacgcccctgtgaagagcttcctgcgggtggacaaggagaaggtgcagatctacaacccagccttcttcaagtacatccatgaccgctggacagagcaccacggccgctaccccagcacaggcatgctggtgctcttctttgccctgcacgtgtgtgatgaggtgaatgtgtatggctttggagctgacagccggggcaactggcaccactactgggagaacaacagatatgctggggagttcaggaagacaggagtgcatgatgctgactttgaggcccacatcatcgacatgctggccaaggccagcaagattgaggtgtaccggggcaactag

SEQ ID NO: 7257 - DNA, 600 bp, Artificial Sequence
  Description of Artificial Sequence: Synthetic coding sequence
atggccagccctgaggcccctgagagcgtggtgcagtttgccctggacaagctgggcggcctggactacctggtgctgaaccacatcggcggggccccagctggcacccgggcccggagcccccaggccacccgctggctgatgcaggtgaactttgtgtcctatgtgcagctgaccagccgggccctgcccagcctgacagacagcaagggcagcctggtggtggtgagcagcctgctgggccgggtgcccaccagcttcagcaccccctacagcgctgccaagtttgccctggatggcttcttcggcagcctgcggcgggagctggatgtgcaggatgtgaatgtggccatcaccatgtgtgtgctgggcctgcgggaccgggccagcgctgctgaggccgtgcggggcgtgaccagggtgaaggccgcccctggccccaaggccgccctggccgtcatccggggcggggccaccagggctgctggggtcttctacccctggaggttccggctgctgtgcctgctgcggcgctggctgccccggccccgggcctggttcatccggcaggagctgaatgtgacagctgctgctgcctag

SEQ ID NO: 7258 - DNA, 411 bp, Artificial Sequence
  Description of Artificial Sequence: Synthetic coding sequence
atggtgcggccctaccccctcatctacttcctgttcctgcccctgggcgcctgcttccccctgctggaccggcgggagcccacagatgccatgggcggcctgggcgctggggagcgctgggccgacctggccatgggcccccggccccacagcgtgtggggcagcagccgctggctgcgggccagccagccccaggccctgctggtgattgcccggggcctgcagaccagcggccgggagcacgccggctgccgcttccgcttcggccggcaggatgagggcagcgaggccaccggcttcctgcctgctgctggggagaagaccagcggccccctgggcaacctggccgaggagctgaatggctacagcaggaagaagggcggcttctccttccgctttggaagaagatag

SEQ ID NO: 7259 - DNA, 663 bp, Artificial Sequence
  Description of Artificial Sequence: Synthetic coding sequence
atgaggggccagggcaggaaggagagcctgagtgacagccgggacctggatggcagctatgaccagctgacagacagcgtggatgatgaatttgagctgagcacagtgtgccacaggcctgagggcctggagcagctgcaggagcagaccaagttcaccaggaaggagctgcaggtgctgtaccggggcttcaagaatgaatgtcccagcggcatcgtgaatgaggagaacttcaagcagatctacagccagttcttcccccagggcgacagcagcacctacgccaccttcctgttcaatgcctttgacaccaaccatgatggctctgtgtcctttgaagattttgtggccggcctgagcgtcatcctgcggggcaccgtggatgaccggctgaactgggccttcaacctgtatgacctgaacaaggatggctgcatcaccaaggaggagatgctggacatcatgaagagcatctatgacatgatgggcaagtacacctacccagccctgcgggaggaggccccccgggagcacgtggagagcttcttccagaagatggacaggaacaaggatggagtggtgaccatcgaggagttcatcgagagctgccagaaggatgagaacatcatgaggtccatgcagctgtttgacaacgtcatctag

SEQ ID NO: 7260 - DNA, 2175 bp, Artificial Sequence
  Description of Artificial Sequence: Synthetic coding sequence
atgctgcggaccagcacccccaacctgtgtggcggcctgcactgccgggccccctggctgagcagcggcatcctgtgcctgtgcctgatcttcctgctgggccaggtgggcctgctgcagggccacccccagtgcctggactatggcccccccttccagccccccctgcacctggagttctgcagcgactatgagagctttggctgctgtgaccagcacaaggacagaagaattgctgcccgctactgggacatcatggagtactttgacctgaagagacatgagctgtgtggggactacatcaaggacatcctgtgccaggagtgcagcccctatgctgcccacctgtatgatgctgagaacacccagacccccctgaggaacctgcccggcctgtgcagcgactactgcagcgccttccacagcaactgccacagcgccatcagcctgctgaccaatgaccggggcctgcaggagagccacggcagagatggcacccgcttctgccacctgctggacctgcctgacaaggactactgcttccccaacgtgctgagaaatgactacctgaacagacacctgggcatggtggcccaggacccccagggctgcctgcagctgtgcctgtctgaggtggccaacggcctgagaaatcctgtgtccatggtgcatgctggagatggcacccaccgcttctttgtggccgagcaggtgggcgtggtgtgggtgtacctgcctgatggcagccggctggagcagcccttcctggacctgaagaacatcgtgctgaccaccccctggattggagatgagcggggcttcctgggcctggccttccaccccaagttccgccacaacaggaagttctacatctactacagctgcctggacaagaagaaggtggagaagatccgcatcagcgagatgaaggtgtccagagctgaccccaacaaggctgacctgaagtctgagagggtcatcctggagattgaggagcccgccagcaaccacaacggcggccagctgctgtttggcctggatggctacatgtacatcttcaccggagatggcggccaggccggggaccccttcggcctgtttggaaatgcccagaacaagagcagcctgctgggcaaggtgctgagaattgatgtgaacagagctggcagccacggcaagcgctacagagtgcccagcgacaacccctttgtgtctgagcccggggcccacccagccatctatgcctacggcatccggaacatgtggaggtgtgctgtggacagaggagaccccatcacccggcagggccggggccgcatcttctgtggagatgtgggccagaacagatttgaggaggtggacctgatcctgaagggcggcaactacggctggagggccaaggagggctttgcctgctatgacaagaagctgtgccacaatgccagcctggatgatgtgctgcccatctatgcctacggccatgctgtgggcaagtctgtgactggaggctacgtgtaccggggctgtgagagccccaacctgaatggcctgtacatctttggagacttcatgagcggccgcctgatggccctgcaggaggacaggaagaacaagaagtggaagaagcaggacctgtgcctgggcagcaccaccagctgtgccttccctggcctcatcagcacccacagcaagttcatcatcagctttgctgaagatgaggccggggagctgtacttcctggccaccagctaccccagcgcctatgccccccggggcagcatctacaagtttgtggaccccagccggcgggcccctcctgggaagtgcaagtacaagcctgtgcctgtgaggaccaagagcaagaggatccccttccggcccctggccaagacagtgctggacctgctgaaggagcagagcgagaaggccgccaggaagagcagcagcgccaccctggccagcggccctgcccagggcctgtctgagaagggcagcagcaagaagctggccagccccaccagcagcaagaacaccctgcggggccctggcaccaagaagaaggcccgggtgggcccccacgtgcggcagggcaagaggaggaagagcctgaagagccacagcggccgcatgaggccttctgctgagcagaagagagctggccgcagcctgccctag

SEQ ID NO: 7261 - DNA, 1218 bp, Artificial Sequence
  Description of Artificial Sequence: Synthetic coding sequence
atgtggtacgtgtccacccggggcgtggccccccgggtgaactttgaaggagccctcttcagcggctacgccccagatggcggcctcttcatgcctgaggagctgccccagctggaccggggcaccctgtgccagtggagcaccctgagctacccaggcctggtgaaggagctgtgtgccctcttcatcggcagcgagctgctgcccaaggatgagctgaatgacctgattgaccgggccttcagccgcttccgccaccgggaggtggtgcacctgagccggctgagaaatggcctgaatgtgctggagctgtggcacggcgtgacctacgccttcaaggacctgagcctgagctgcaccacccagttcctgcagtacttcctggagaagcgggagaagcacgtgacagtggtggtgggcaccagcggggacaccggcagcgctgccatcgagagcgtgcagggcgccaagaacatggacatcatcgtgctgctgcccaagggccactgcaccaagatccaggagctgcagatgaccaccgtgctgaagcagaatgtgcacgtgtttggagtggagggcaacagtgatgagctggatgagcccatcaagacagtgtttgctgatgtggcctttgtgaagaagcacaacctgatgagcctgaacagcatcaactggagccgggtgctggtgcagatggcccaccacttctttgcctacttccagtgcacccccagcctggacacccaccccctgcccctggtggaggtggtggtgcccaccggggctgctggcaacctggccgccggctacatcgcccagaagattggcctgcccatccggctggtggtggccgtgaacagaaatgacatcatccacaggacagtgcagcagggcgacttcagcctgtctgaggccgtgaagagcaccctggccagcgccatggacatccaggtgccctacaacatggagagggtcttctggctgctgagcggcagtgacagccaggtgacccgggccctgatggagcagtttgagaggacccagagcgtgaacctgcccaaggagctgcacagcaagtgggagcggcaggactatgagaagatggctgtgatggagtgtgatggctgctgcgtggagctgtgcctgggcaactgtggcccccggcggggctctgtgacagacatccctggaacagccatggtgcggggcggcggctag

SEQ ID NO: 7262 - DNA, 492 bp, Artificial Sequence
  Description of Artificial Sequence: Synthetic coding sequence
atgaccatgaggcacaactggaccccagacctgagccccctgtgggtgctgctgctgtgtgcccacgtggtgaccctgctggtgcgggccacccctgtgtcccagaccaccacagctgccacagcctctgtgcgcagcaccaaggacccctgccccagccagccccctgtgtttcctgctgccaagcagtgcccagccctggaggtgacctggccagaggtggaggtgcccctgaatggcaccctgagcctgagctgtgtggcctgcagccgcttccccaacttcagcatcctgtactggctgggcaatggcagcttcatcgagcacctgcccggccgcctgtgggagggcagcaccagccgggagcggggcagcacaggctgggccgagggcaacctggccccccaccccaggagccctgccctgcagccccagcagagcacagctgctggcctgcggctgagcacaggccctgctgctgcccagccctag

SEQ ID NO: 7263 - DNA, 1590 bp, Artificial Sequence
  Description of Artificial Sequence: Synthetic coding sequence
atggccccagcccggaccatggcccgggcccggctggccccagctggcatcccagctgtggccctgtggctgctgtgcaccctgggcctgcagggcacccaggccggccccccaccagcccctcctggcctgcctgctggagctgactgcctgaacagcttcaccgctggggtgcccggctttgtgctggacaccaatgcctctgtgtccaatggagccaccttcctggagagccccaccgtgcggcggggctgggactgtgtgcgggcctgctgcaccacccagaactgcaacctggccctggtggagctgcagcctgacagaggagaagatgccatcgccgcctgcttcctgatcaactgcctgtatgagcagaactttgtgtgcaagtttgccccccgggagggcttcatcaactacctgacccgggaggtgtaccgcagctaccggcagctgcggacccagggctttggaggcagcggcatccccaaggcctgggccggcatcgacctgaaggtgcagccccaggagcccctggtgctgaaggatgtggagaacacagactggaggctgctgcggggggacacagatgtgcgggtggagaggaaggaccccaaccaggtggagctgtggggcctgaaggagggcacctacctgttccagctgactgtgaccagcagtgaccaccctgaggacacagccaacgtgacagtgacagtgctgagcaccaagcagacagaggactactgcctggccagcaacaaggtgggccgctgccggggcagcttcccccgctggtactatgaccccacagagcagatctgcaagagctttgtgtatggaggctgcctgggcaacaagaacaactacctgcgggaggaggagtgcatcctggcctgccggggcgtgcagggcggccccctgcggggcagcagcggggcccaggccaccttcccccagggccccagcatggagcggcggcaccctgtgtgcagcggcacctgccagcccacccagttccgctgcagcaatggctgctgcatcgacagcttcctggagtgtgatgacacccccaactgcccagatgccagtgatgaagctgcctgtgagaagtacaccagcggctttgatgagctgcagaggatccacttccccagcgacaagggccactgtgtggacctgcctgacaccggcctgtgcaaggagagcatcccccgctggtactacaaccccttcagcgagcactgtgcccgcttcacctatggaggctgctacggcaacaagaacaactttgaggaggagcagcagtgcctggagagctgccggggcatcagcaagaaggatgtgtttggcctgcggcgggagatccccatccccagcactggatctgtggagatggctgtggccgtgttcctggtgatctgcatcgtggtggtggtggccatcctgggctactgcttcttcaagaaccagaggaaggacttccacggccaccaccaccaccccccacccaccccagccagcagcacagtgtccaccacagaggacacagagcacctggtgtacaaccacaccacccggcccctgtag

SEQ ID NO: 7264 - DNA, 1803 bp, Artificial Sequence
  Description of Artificial Sequence: Synthetic coding sequence
atgcagggccccctgctgctgcccggcctgtgcttcctgctgagcctgtttggagctgtgacccagaagaccaagaccagctgtgccaagtgccccccaaatgccagctgtgtgaacaacacccactgcacctgcaaccacggctacaccagcggcagcggccagaagctgttcaccttccccctggagacctgcaatgacaccaccagcagcaagaccacagagggcaggaaggagctgcagaagatcgtggacaagtttgagagcctgctgaccaaccagaccctgtggaggacagagggccggcaggagatcagcagcacagccaccaccatcctgagagatgtggagagcaaggtgctggagacagccctgaaggaccctgagcagaaggtgctgaagatccagaatgattctgtggccatcgagacccaggccatcacagacaactgcagcgaggagaggaagaccttcaacctgaatgtgcagatgaacagcatggacatccgctgcagcgacatcatccagggcgacacccagggccccagcgccatcgccttcatctcctacagcagcctgggcaacatcatcaatgccaccttctttgaggagatggacaagaaggaccaggtgtacctgaacagccaggtggtgtctgctgccatcggccccaagagaaatgtgtccctgagcaagtctgtgaccctgaccttccagcacgtgaagatgacccccagcaccaagaaggtgttctgtgtgtactggaagagcacaggccagggcagccagtggagcagagatggctgcttcctgattcatgtgaacaagagccacaccatgtgcaactgcagccacctgagcagctttgctgtgctgatggccctgaccagccaggaggaggaccctgtgctgaccgtcatcacctacgtgggcctgtctgtgtccctgctgtgcctgctgctggccgccctgaccttcctgctgtgcaaggccatccggaacaccagcaccagcctgcacctgcagctgagcctgtgcctcttcctggcccacctgctcttcctggtgggcatcgacagaacagagcccaaggtgctgtgcagcatcatcgccggggccctgcactacctgtacctggccgccttcacctggatgctgctggagggcgtgcacctgttcctgacagccaggaacctgactgtggtgaactacagcagcatcaaccggctgatgaagtggatcatgtttcctgtgggctacggcgtgcctgctgtgacagtggccatctctgctgcctcctggccccacctgtatggaacagctgaccgctgctggctgcacctggaccagggcttcatgtggagcttcctgggccctgtgtgtgccatcttcagcgccaacctggtgctcttcatcctggtgttctggatcctgaagaggaagctgagcagcctgaacagcgaggtgtccaccatccagaacaccaggatgctggccttcaaggccacagcccagctgttcatcctgggctgcacctggtgcctgggcctgctgcaggtgggccctgctgcccaggtgatggcctacctgttcaccatcatcaacagcctgcagggcttcttcatcttcctggtgtactgcctgctgagccagcaggtgcagaagcagtaccagaagtggttccgggagatcgtgaagagcaagtctgagagcgagacctacaccctgagcagcaagatgggccctgacagcaagcccagtgaaggagatgtgtttcctggccaggtgaagaggaagtactag

SEQ ID NO: 7265 - DNA, 660 bp, Artificial Sequence
  Description of Artificial Sequence: Synthetic coding sequence
atgaagctgctgctgtgggcctgcatcgtgtgtgtggcctttgccaggaagaggcgcttccccttcatcggagaagatgacaatgatgatggccaccccctgcaccccagcctgaacatcccctacggcatccggaacctgcccccacccctgtactacagacctgtgaacacagtgcccagctacccaggcaacacctacacagacaccggcctgcccagctacccctggatcctgaccagccctggcttcccctacgtgtaccacatccggggcttccccctggccacccagctgaatgtgccccccctgcccccccggggcttcccctttgtgccccccagccgcttcttctctgctgctgctgccccagctgccccacccatcgctgctgagcctgctgctgctgcccccctgacagccacccctgtggccgctgagcctgctgctggggcccctgtggccgctgagcctgctgctgaggcccctgtgggcgctgagcctgctgctgaggcccctgtggccgctgagcctgctgctgaggcccctgtgggcgtggagcctgctgctgaggagcccagccctgctgagcccgccacagccaagccagctgcccctgagccccaccccagccccagcctggagcaggccaaccagtag

SEQ ID NO: 7266 - DNA, 1743 bp, Artificial Sequence
  Description of Artificial Sequence: Synthetic coding sequence
atgcacctgtctgctgtgttcaatgccctgctggtgtctgtgctggccgctgtgctgtggaagcacgtgcggctgcgggagcacgccgccaccctggaggaggagctggccctgagccggcaggccacagagcccgccccagccctgagaattgactaccccaaggccctgcagatcctgatggagggcggcacccacatggtgtgcaccggccgcacccacacagaccgcatctgccgcttcaagtggctgtgctacagcaatgaggccgaggagttcatcttcttccacggcaacacctctgtgatgctgcccaacctgggcagccgccgcttccagcctgccctgctggacctgagcacagtggaggaccacaacacccagtacttcaactttgtggagctgcctgctgctgccctgcgcttcatgcccaagcctgtgtttgtgcctgatgtggccctgattgccaaccgcttcaacccagacaacctgatgcacgtgttccatgatgacctgctgcccctcttctacaccctgcggcagtttcctggcctggcccacgaggcccggctcttcttcatggagggctggggcgagggcgcccactttgacctgtacaagctgctgagccccaagcagcccctgctgcgggcccagctgaagaccctgggccgcctgctgtgcttcagccacgcctttgtgggcctgagcaagatcaccacctggtaccagtatggctttgtgcagccccagggccccaaggccaacatcctggtgtctggaaatgagatccggcagtttgcccgcttcatgacagagaagctgaatgtgagccacactggagtgcccctgggggaggagtacatcctggtgttcagcaggacccagaacagactcatcctgaatgaggccgagctgctgctggccctggcccaggagttccagatgaagacagtgacagtgtccctggaggaccacacctttgctgatgtggtgcggctggtgtccaatgcctccatgctggtgtccatgcatggagcccagctggtgaccaccctcttcctgcccaggggggccaccgtggtggagctgttcccctatgctgtgaacccagaccactacaccccctacaagaccctggccatgctgcccggcatggacctgcagtatgtggcctggaggaacatgatgccagaaaatacagtgacccaccctgagcggccctgggaccagggcggcatcacccacctggacagagctgagcaggcccgcatcctgcagagccgggaggtgcccaggcacctgtgctgcaggaaccctgagtggctgttccgcatctaccaggacaccaaggtggacatccccagcctcatccagaccatccggcgggtggtgaagggccggcccggccccaggaagcagaagtggacagtgggcctgtacccaggcaaggtgcgggaggcccgctgccaggcctctgtgcatggagccagcgaggcccggctgactgtgtcctggcagatcccctggaacctgaagtacctgaaggtgcgggaggtgaagtatgaggtgtggctgcaggagcagggcgagaacacctacgtgccctacatcctggccctgcagaaccacaccttcacagagaacatcaagcccttcaccacctacctggtgtgggtgcgctgcatcttcaacaagatcctgctgggcccctttgctgatgtgctggtgtgcaacacctag

SEQ ID NO: 7267 - DNA, 5130 bp, Artificial Sequence
  Description of Artificial Sequence: Synthetic coding sequence
atgggcttcctgcccaagctgctgctgctggccagcttcttccctgctggccaggcctcctggggcgtgagcagcccccaggatgtgcagggcgtgaagggcagctgcctgctgatcccctgcatcttctccttcccagcagatgtggaggtgcctgatggcatcacagccatctggtactatgactacagcggccagaggcaggtggtgagccacagcgctgaccccaagctggtggaggcccgcttccggggccgcacagagttcatgggcaaccctgagcaccgggtgtgcaacctgctgctgaaggacctgcagcctgaggacagcggcagctacaacttccgctttgagatcagcgaggtgaaccgctggagcgatgtgaagggcaccctggtgacagtgacagaggagccccgggtgcccaccatcgccagccctgtggagctgctggagggcacagaggtggacttcaactgcagcaccccctacgtgtgcctgcaggagcaggtgcggctgcagtggcagggccaggaccctgcccggtctgtgaccttcaacagccagaagtttgagcccaccggggtgggccacctggagaccctgcacatggccatgtcctggcaggaccacggccgcatcctgcgctgccagctgtctgtggccaaccaccgggcccagagcgagatccacctgcaggtgaagtatgcccccaagggcgtgaagatcctgctgagccccagcggcaggaacatcctgcccggggagctggtgaccctgacctgccaggtgaacagcagctacccagctgtgagcagcatcaagtggctgaaggatggagtgcggctgcagaccaagacaggagtgctgcacctgccccaggccgcctggagcgatgctggggtgtacacctgccaggccgagaatggagtgggcagcctggtgtccccacccatcagcctgcacatcttcatggccgaggtgcaggtgtccccagctggccccatcctggagaaccagacagtgaccctggtgtgcaacaccccaaatgaggcccccagcgacctgcgctacagctggtacaagaaccacgtgctgctggaggatgcccacagccacaccctgcggctgcacctggccaccagggctgacaccggcttctacttctgtgaggtgcagaatgtgcacggcagcgagaggagcggccctgtgtctgtggtggtgaaccacccccccctgacccctgtgctgacagccttcctggagacccaggccggcctggtgggcatcctgcactgcagcgtggtgtctgagcccctggccaccctggtgctgagccatggaggccacatcctggccagcaccagcggggacagcgaccacagcccccgcttcagcggcaccagcggccccaacagcctgcggctggagatccgggacctggaggagacagacagcggggagtacaagtgcagcgccaccaacagcctgggcaatgccaccagcaccctggacttccacgccaatgctgcccggctgctgatcagccctgctgctgaggtggtggagggccaggccgtgaccctgagctgccgcagcggcctgagccccaccccagatgcccgcttctcctggtacctgaatggagccctgctgcacgagggccctggcagcagcctgctgctgcctgctgccagcagcacagatgctggcagctaccactgccgggccagagatggccacagcgccagcggccccagcagccctgctgtgctgactgtgctgtacccaccccggcagcccaccttcaccacccggctggacctggatgctgctggggccggggccggccggcggggcctgctgctgtgccgggtggacagcgaccccccagcccggctgcagctgctgcacaaggacagagtggtggccaccagcctgcccagcggcggcggctgcagcacctgtggcggctgcagccccaggatgaaggtgaccaaggcccccaacctgctgcgggtggagatccacaaccccctgctggaggaggagggcctgtacctgtgtgaggccagcaatgccctgggcaatgccagcaccagcgccaccttcaacggccaggccaccgtgctggccatcgcccccagccacaccctgcaggagggcacagaggccaacctgacctgcaatgtgtcccgggaggccgccggcagccctgccaacttctcctggttcagaaatggagtgctgtgggcccagggccccctggagaccgtgaccctgctgcctgtggccaggacagatgctgccctgtatgcctgccgcatcctgacagaggccggggcccagctgagcacccctgtgctgctgtctgtgctgtaccccccagaccggcccaagctgagcgccctgctggacatgggccagggccacatggccctcttcatctgcaccgtggacagccggcccctggccctgctggccctcttccatggagagcacctgctggccaccagcctgggcccccaggtgcccagccacggccgcttccaggccaaggccgaggccaacagcctgaagctggaggtgcgggagctgggcctgggggacagcggcagctaccgctgtgaggccaccaacgtgctgggcagcagcaacaccagcctcttcttccaggtgcggggggcctgggtgcaggtgagccccagccctgagctgcaggagggccaggccgtggtgctgagctgccaggtgcacactggagtgcctgagggcaccagctaccgctggtacagagatggccagcccctgcaggagagcaccagcgccaccctgcgctttgctgccatcaccctgacccaggccggggcctaccactgccaggcccaggcccctggcagcgccaccaccagcctggccgcccccatcagcctgcacgtgtcctatgcccccaggcatgtgaccctgaccaccctgatggacaccggccctggccgcctgggcctgctgctgtgccgggtggacagcgaccccccagcccagctgcggctgctgcatggagaccggctggtggccagcaccctgcagggcgtgggcggccctgagggcagcagcccccggctgcacgtggccgtggcccccaacaccctgcggctggagatccatggagccatgctggaggatgaaggagtgtacatctgtgaggccagcaacaccctgggccaggccagcgccagcgctgactttgatgcccaggccgtgaatgtgcaggtgtggccaggggccaccgtgcgggagggccagctggtgaacctgacctgcctggtgtggaccacccacccagcccagctgacctacacctggtaccaggacggccagcagaggctggatgcccacagcatccccctgcccaacgtgacagtgagagatgccaccagctaccgctgtggggtgggccccccaggccgggccccccggctgagccggcccatcaccctggatgtgctgtatgcccccaggaacctgcggctgacctacctgctggagagccacggcggccagctggccctggtgctgtgcaccgtggacagccggcccccagcccagctggccctgagccacgccggccgcctgctggccagcagcacagctgcctctgtgcccaacaccctgcggctggagctgcggggcccccagcccagagatgagggcttctacagctgcagcgcccggagccccctgggccaggccaacaccagcctggagctgcggctggagggcgtgcgggtcatcctggcccctgaggccgctgtgcctgagggcgcccccatcaccgtgacctgtgccgaccctgctgcccacgcccccaccctgtacacctggtaccacaacggccgctggctgcaggagggccctgctgccagcctgtccttcctggtggccacccgggcccatgctggggcctacagctgccaggcccaggatgcccagggcaccaggagcagcaggcctgctgccctgcaggtgctgtatgccccccaggatgctgtgctgagcagcttccgggacagccgggcccgctccatggctgtgatccagtgcaccgtggacagcgagcccccagctgagctggccctgagccatgatggcaaggtgctggccaccagcagcggcgtgcacagcctggccagcggcactggacatgtgcaggtggccagaaatgccctgcggctgcaggtgcaggatgtgcctgctggagatgacacctacgtgtgcacagcccagaacctgctgggcagcatcagcaccatcggccgcctgcaggtggagggcgcccgggtggtggccgagcccggcctggatgtgcctgagggcgccgccctgaacctgagctgccgcctgctgggcggccctggccctgtgggcaacagcacctttgcctggttctggaatgaccggcggctgcacgccgagcctgtgcccaccctggccttcacccacgtggcccgggcccaggccggcatgtaccactgcctggccgagctgcccactggagctgctgccagcgcccctgtgatgctgcgggtgctgtacccacccaagacccccaccatgatggtgtttgtggagcctgagggcggcctgcggggcatcctggactgccgggtggacagcgagcccctggccagcctgaccctgcacctgggcagccggctggtggccagcagccagccccagggcgccccagctgagccccacatccacgtgctggccagccccaatgccctgcgggtggacatcgaggccctgcggcccagcgaccagggcgagtacatctgcagcgccagcaatgtgctgggcagcgccagcaccagcacctactttggagtgcgggccctgcaccggctgcaccagttccagcagctgctgtgggtgctgggcctgctggtgggcctgctgctgctgctgctgggcctgggcgcctgctacacctggaggagaagaagagtgtgcaagcagagcatgggagaaaattctgtggagatggccttccagaaggagaccacccagctgattgatcctgatgctgccacctgtgagaccagcacctgtgccccacccctgggctag

SEQ ID NO: 7268 - DNA, 693 bp, Artificial Sequence
  Description of Artificial Sequence: Synthetic coding sequence
atgtgtgtgacctaccacaatggaacaggctactgcaagtgcccagagggcttcctgggggagtactgccagcaccgggacccctgtgagaagaaccgctgccagaatggaggcacctgtgtggcccaggccatgctgggcaaggccacctgccgctgtgccagcggcttcaccggggaggactgccagtacagcaccagccacccctgctttgtgtcccggccctgcctgaatggaggcacctgccacatgctgagccgggacacctatgaatgtacctgccaggtgggcttcaccgggaaggagtgccagtggacagatgcctgcctgagccacccctgtgccaacggcagcacctgcaccaccgtggccaaccagttcagctgcaagtgcctgaccggcttcaccggccagaagtgtgaaacagatgtgaatgaatgtgacatccctggccactgccagcacggcggcacctgcctgaacctgcccggcagctaccagtgccagtgcctgcagggcttcaccggccagtactgtgacagcctgtatgtgccctgtgcccccagcccctgtgtgaatggaggcacctgccggcagacaggagacttcacctttgagtgcaactgcctgcctgccacctggcccatcttccccaagctgctgagcctgcaggagaaggagagctactgctag

SEQ ID NO: 7269 - DNA, 660 bp, Artificial Sequence
  Description of Artificial Sequence: Synthetic coding sequence
atgtttgtgtcctacctgatcctgaccctgctgcacgtgcagacagctgtgctggcccggcctggaggagagagcatcggctgtgatgactacctgggcagtgacaaggtggtggacaagtgtggggtgtgtggcggggacaacacaggctgccaggtggtgtctggagtcttcaagcacgccctgaccagcctgggctaccaccgggtggtggagatccctgagggcgccaccaagatcaacatcacagagatgtacaagagcaacaagaagaagagccacctgaagccagccacccggggcagccagttcagctctgtgaaggtgtgcagcgtgcctgctgcctgcaagctgctgggcaccccaggccgggcccggcagcctgtgcctgccccccgggagctggagcatgacaagaacagcccccactgtgcctacctgagcctgtacctgaccagcctggcccagagctcctggagggtcttcagcctcttctcctatgtgctgatctacctgttcagcaagtacctggccttcaacaccctgtttgccctgaagaggatggccctgcagagggacaggaaggagaagacccgggcctggtgcatcttcatcaagctgtgtggccgggagatccagatcctgcccggccctgtgtag

SEQ ID NO: 7270 - DNA, 363 bp, Artificial Sequence
  Description of Artificial Sequence: Synthetic coding sequence
atggacaacgtgcagcccaagatcaagcaccggcccttctgcttctctgtgaagggccacgtgaagatgctgcggctggccctgactgtgacctccatgaccttcttcatcatcgcccaggcccctgagccctacatcgtcatcactggatttgaggtgaccgtcatcctcttcttcatcctgctgtatgtgctgcggctggaccggctgatgaagtggctgttctggcccctgctggtgtttgccctggtgacagctgtgtgctgcctggctgatggagccctgatctacaggaagctgctcttcaaccccagcggcccctaccagaagaagcctgtgcatgagaagaaggaggtgctgtag

SEQ ID NO: 7271 - DNA, 864 bp, Artificial Sequence
  Description of Artificial Sequence: Synthetic coding sequence
atggccccctggagccaccccagcgcccagctgcagcctgtgggcggagatgctgtgtccccagccctgatggtgctgctgtgcctgggcaacctgagcaaggccaccctgtgggccgagcccggcagcgtcatcagccggggcaacagcgtgaccatccgctgccagggcaccctggaggcccaggagtaccgcctggtgaaggagggcagccctgagccctgggacacccagaaccccctggagcccaagaacaaggcccgcttcagcatccccagcatgacagagcaccacgccggccgctaccgctgctactactacagccctgctggctggagcgagcccagcgaccccctggagctggtggtgacaggcttctacaacaagcccaccctgagcgccctgcccagccctgtggtgaccagcggggagaatgtgaccctgcagtgtggcagccggctgcgctttgaccgcttcatcctgacagaggagggggaccacaagctgtcctggaccctggacagccagctgacccccagcggccagttccaggccctcttccctgtgggccctgtgacccccagccaccgctggatgctgcgctgctacggcagccgccgccacatcctgcaggtgtggagcgagcccagcgacctgctggagatccctgtgtctggagctgctgacaacctgagccccagccagaacaagagtgacagcggcacagccagccacctgcaggactatgctgtggagaacctgatccgcatgggcatggccggcctcatcctggtggtgctgggcatcctgatcttccaggactggcacagccagaggagcccccaggccgctgctggaagatag

SEQ ID NO: 7272 - DNA, 438 bp, Artificial Sequence; identical to SEQ ID NO: 6893
  Description of Artificial Sequence: Synthetic coding sequence

SEQ ID NO: 7273 - DNA, 1776 bp, Artificial Sequence
  Description of Artificial Sequence: Synthetic coding sequence
atgcagcaggacggcctgggcgtgggcaccagaaatggcagcggcaagggccgctctgtgcaccccagctggccctggtgtgccccccggcccctgcgctacttcggcagagatgcccgggcccggcgggcccagacagctgccatggccctggccatccaggtgacagtgagcaacccctaccacgtggtgatcctcttccagcctgtgaccctgccctgcacctaccagatgaccagcacccccacccagcccatcgtcatctggaagtacaagagcttctgccgggacagaattgctgatgccttctccccagcctctgtggacaaccagctgaatgcccagctggccgccggcaaccctggctacaacccctacgtggagtgccaggacagcgtgaggacagtgcgggtggtggccaccaagcagggcaatgctgtgaccctgggggactactaccagggccgccgcatcaccatcactggaaatgctgacctgacctttgaccagacagcctggggagacagcggcgtgtactactgcagcgtggtgtctgcccaggacctgcagggcaacaatgaggcctatgcagagctgattgtgctgggccgcaccagcggcgtggccgagctgctgcccggcttccaggccggccccatcgaggactggctgtttgtggtggtggtgtgcctggccgccttcctgatcttcctgctgctgggcatctgctggtgccagtgctgcccccacacctgctgctgctacgtgcgctgcccctgctgcccagacaagtgctgctgcccagaggccctgtatgctgctgggaaggccgccaccagcggcgtgcccagcatctatgcccccagcacctacgcccacctgagccctgccaagaccccacctcctccagccatgatccccatgggccctgcctacaacggctacccaggcggctacccaggagatgtggacaggagcagctctgtgcgcagcggctaccgcatccaggccagccagcaggatgacagcatgagggtgctgtactacatggagaaggagctggccaactttgaccccagccggcccggcccccccagcggccgggtggagcgggccatgtctgaggtgaccagcctgcatgaagatgactggaggagccggcccagccggggccctgccctgacccccatcagagatgaggagtggggcggccacagccccaggagcccccggggctgggaccaggagcccgcccgggagcaggccggcggcggctggagggcccggcggccccgggcccggtctgtggatgccctggatgacctgaccccacccagcacagctgagagcggcagccgcagccccaccagcaatggaggccgcagccgggcctacatgccacccaggagccgcagcagagatgacctgtatgaccaggatgacagccgggacttccccaggagccgggacccccactatgatgacttccgcagccgggagcggcccccagctgaccccaggagccaccaccacaggacccgggacccccgggacaatggcagccgcagcggggacctgccctatgatggccgcctgctggaggaggccgtgaggaagaagggcagcgaggagcggcggcggccccacaaggaggaggaggaggaggcctactaccccccagcccccccaccctacagcgagacagacagccaggccagccgggagcggcggctgaagaagaacctggccctgagccgggagagcctggtggtgtag

SEQ ID NO: 7274 - DNA, 678 bp, Artificial Sequence
  Description of Artificial Sequence: Synthetic coding sequence
atgaaccgctgcccccggcgctgccgcagccccctgggccaggccgcccggagcctgtaccagctggtgacaggcagcctgagcccagattctgtggatgatgaatttgagctgagcacagtgtgccacaggcctgagggcctggagcagctgcaggagcagaccaagttcaccaggaaggagctgcaggtgctgtaccggggcttcaagaatgaatgtccttctggaattgtgaatgaggagaacttcaagcagatctacagccagttcttcccccagggcgacagcagcacctacgccaccttcctgttcaatgcctttgacaccaaccatgatggctctgtgtcctttgaggactttgtggccggcctgagcgtcatcctgcggggcaccgtggatgaccggctgaactgggccttcaacctgtatgacctgaacaaggatggctgcatcaccaaggaggagatgctggacatcatgaagagcatctatgacatgatgggcaagtacacctacccagccctgcgggaggaggccccccgggagcacgtggagagcttcttccagaagatggacaggaacaaggatggagtggtgaccatcgaggagttcatcgagagctgccagaaggatgagaacatcatgaggtccatgcagctgtttgacaacgtcatctag

SEQ ID NO: 7275 - DNA, 705 bp, Artificial Sequence
  Description of Artificial Sequence: Synthetic coding sequence
atgcctgccagcagccccttcctgctggcccccaagggccccccaggcaacatgggcggccctgtgcgggagcccgccctgtctgtggccctgtggctgtcctggggcgccgccctgggcgctgtggcctgtgccatggccctgctgacccagcagacagagctgcagagcctgcggcgggaggtgtcccggctgcagggcaccggcggccccagccagaatggagagggctacccctggcagagcctgcctgagcagagcagtgatgccctggaggcctgggagaatggagagaggagcaggaagagaagagctgtgctgacccagaagcagaagaatgacagtgatgtgacagaggtgatgtggcagcctgccctgcggcggggccggggcctgcaggcccagggctatggagtgcgcatccaggatgctggggtgtacctgctgtacagccaggtgctcttccaggatgtgaccttcaccatgggccaggtggtgtcccgggagggccagggccggcaggagaccctcttccgctgcatccgctccatgcccagccacccagaccgggcctacaacagctgctacagcgctggggtcttccacctgcaccagggcgacatcctgagcgtcatcatcccccgggcccgggccaagctgaacctgagcccccacggcaccttcctgggctttgtgaagctgtag

SEQ ID NO: 7276 - DNA, 2400 bp, Artificial Sequence
  Description of Artificial Sequence: Synthetic coding sequence
atgaagcccatgctgaaggacttcagcaacctgctgctggtggtgctgtgtgactatgtgctgggggaggccgagtacctgctgctgcgggagcccggccacgtggccctgagcaatgacacagtgtatgtggacttccagtactttgatggagccaacggcaccctgagaaatgtgtctgtgctgctgctggaggccaacaccaaccagacagtgaccaccaagtacctgctgaccaaccagagccagggcaccctgaagtttgagtgcttctacttcaaggaggccggggactactggttcaccatgaccccagaggccacagacaacagcacccccttcccctggtgggagaagagcgccttcctgaaggtggagtggcctgtgttccacgtggacctgaacagaagtgccaaggctgctgagggcaccttccaggtgggcctcttcaccagccagcccctgtgccccttccctgtggacaagcccaacatcgtggtggatgtgatcttcaccaacagcctgcctgaggcccggaggaacagccggcagcccctggagatccgcaccagcaagaggacagagctggcccagggccagtgggtggagtttggctgtgcccccctgggccctgaggcctacgtgacagtggtgctgaagctgctgggccgggacagcgtcatcaccagcacaggccccatcgacctggcccagaagtttggctacaagctggtgatggtgcctgagctgacctgtgagagcggcgtggaggtgacagtgctgcccccaccctgcacctttgtgcagggcgtggtgacagtgttcaaggaggccccccgctacccaggcaagaggaccatccacctggccgagaacagcctgcccctgggggagaggaggaccatcttcaactgcaccctgtttgacatgggcaagaacaagtactgctttgattttggcatcagcagccgcagccacttcagcgccaaggaggagtgcatgctgatccagaggaacacagccttccagcccagcagccccagccccctgcagccccagggccctgtgaagagcaacaacatcgtgacagtgacaggcatcagcctgtgcctcttcatcatcatcgccaccgtgctgatcaccctgtggaggcgcttcggccgcccagccaagtgcagcaccccagcccggcacaacagcatccacagccccagcttcaggaagaacagtgatgaggagaacatctgtgagctgtctgagcagaggggcagcttcagtgatggaggagatggccccaccggcagccctggggacaccggcatccccctgacctaccgccgcagcggccctgtgcccccagaagatgatgccagcggcagcgagagcttccagagcaatgcccagaagatcatccccccactcttctcctaccgcctggcccagcagcagctgaaggagatgaagaagaagggcctgacagagaccaccaaggtgtaccacgtgtcccagagccccctgacagacacagccattgatgctgcccccagcgcccccctggacctggagagccctgaggaggccgccgccaacaagttccgcatcaagagccccttccctgagcagcctgctgtgtctgctggggagcggccccccagccggctggacctgaatgtgacccaggccagctgtgccatcagccccagccagaccctcatcaggaagagccaggcccggcacgtgggcagccggggcggccccagcgagaggagccacgccagaaatgcccacttccggaggacagccagcttccacgaggcccggcaggcccggcccttccgggagaggtccatgagcaccctgaccccccggcaggccccagcctacagcagcaggaccaggacctgtgagcaggctgaagatcgcttccggccccagagcagaggagcccacctgtttcctgagaagctggagcacttccaggaggccagcggcacccggggccccctgaaccccctgcccaagagctacaccctgggccagcccctgaggaagccagacctgggggaccaccaggccggcctggtggccggcatcgagaggacagagccccaccgggcccggcggggccccagccccagccacaagtctgtgtccaggaagcagagcagccccatcagccccaaggacaactaccagagggtgagcagcctgagccccagccagtgcaggaaggacaagtgccagagcttccccacccaccctgagtttgccttctatgacaacaccagctttggcctgacagaagctgagcagaggatgctggacctgcccggctacttcggcagcaatgaagaagatgagaccaccagcaccctgtctgtggagaagctggtgatctag

SEQ ID NO: 7277 - DNA, 927 bp, Artificial Sequence
  Description of Artificial Sequence: Synthetic coding sequence
atgaggctgctgcctgagtggttcctgctgctgtttggcccctggctgctgaggaaggctgtgtctgcccagatccctgagagcggccggccccagtacctgggcctgcggcctgctgctgctggagctggggcccctggccagcagctgcctgagcccaggagcagtgatggcctgggcgtgggccgggcctggagctgggcctggcccaccaaccacactggagccctggcccgggccggggctgctggggccctgcctgcccagaggaccaagaggaagcccagcatcaaggccgcccgggccaagaagatcttcggctggggagacttctacttccgggtgcacaccctgaagttcagcctgctggtgacaggcaagatcgtggaccacgtgaatggcaccttctctgtgtacttccgccacaacagcagcagcctgggcaacctgtctgtgtccatcgtgccccccagcaagagggtggagtttggaggagtgtggctgcccggccctgtgccccaccccctgcagagcaccctggccctggagggcgtgctgcccggcctgggcccccccctgggcatggctgctgctgctgctggccctggcctgggcggcagcctgggcggggccctggccggccccctgggcggggccctgggcgtgcctggggccaaggagagccgggccttcaactgccacgtggagtatgagaagaccaacagagccaggaagcaccggccctgcctgtatgaccccagccaggtgtgcttcacagagcacacccagagccaggccgcctggctgtgtgccaagcccttcaaggtgatctgcatctttgtgtccttcctgagctttgactacaagctggtgcagaaggtgtgcccagactacaacttccagagcgagcacccctactttggatag

SEQ ID NO: 7278 - DNA, 795 bp, Artificial Sequence
  Description of Artificial Sequence: Synthetic coding sequence
atgaagctgggctgtgtgctgatggcctgggccctgtacctgagcctgggcgtgctgtgggtggcccagatgctgctggccgccagctttgagaccctgcagtgtgagggccctgtgtgcacagaggagagcagctgccacacagaagatgacctgacagatgcccgggaggccggcttccaggtgaaggcctacaccttcagcgagcccttccacctgattgtgtcctatgactggctgatcctgcagggccctgccaagcctgtgtttgaaggagacctgctggtgctgcgctgccaggcctggcaggactggcccctgacccaggtgaccttctacagagatggcagcgccctgggccccccaggccccaaccgggagttcagcatcaccgtggtgcagaaggctgacagcggccactaccactgcagcggcatcttccagagccctggccctggcatccctgagacagcctctgtggtggccatcaccgtgcagggcgccagcagcagcgctgccccacccaccctgaacccagccccccagaagtctgctgcccctggaacagcccctgaggaggcccctggccccctgcccccaccacccacccccagcagtgaagatcctggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 7279 - DNA, 1362 bp, Artificial Sequence
  Description of Artificial Sequence: Synthetic coding sequence
atgctgcgcatcctgtgcctggccctgtgcagcctgctgaccggcaccagggctgaccccggggccctgctgcggctgggcatggacatcatgaaccaggtgcagagcgccatggatgagagccacatcctggagaagatggctgctgaggccggcaagaagcagcccggcatgaagcccatcaagggcatcaccaacctgaaggtgaaggatgtgcagctgcctgtgatcaccctgaactttgtgcctggggtgggcatcttccagtgtgtgtccacaggcatgacagtgacaggcaagagcttcatgggcggcaacatggagatcatcgtggccctgaacatcacagccaccaaccggctgctgagagatgaggagaccggcctgcccgtcttcaagtctgagggctgtgaggtgatcctggtgaatgtgaagaccaacctgcccagcaacatgctgcccaagatggtgaacaagttcctggacagcaccctgcacaaggtgctgcccggcctgatgtgcccagccattgatgctgtgctggtgtatgtgaacaggaagtggaccaacctgagtgaccccatgcctgtgggccagatgggcaccgtgaagtatgtgctgatgtctgccccagccaccacagccagctacatccagctggacttcagccctgtggtgcagcagcagaagggcaagaccatcaagctggctgatgctggggaggccctgaccttccctgagggctacgccaagggcagcagccagctgctgctgcctgccaccttcctgtctgctgagctggccctgctgcagaagagcttccacgtgaacatccaggacaccatgattggagagctgcccccccagaccaccaagaccctggcccgcttcatccctgaggtggccgtggcctaccccaagagcaagcccctgaccacccagatcaagatcaagaagccacccaaggtgaccatgaagacaggcaagagcctgctgcacctgcacagcaccctggagatgtttgctgcccgctggaggagcaaggcccccatgagcctcttcctgctggaggtgcacttcaacctgaaggtgcagtacagcgtgcatgagaaccagctgcagatggccaccagcctggaccggctgctgagcctgagcaggaagagcagcagcatcggcaacttcaatgaaagagagctgaccggcttcatcaccagctacctggaggaggcctacatccctgtggtgaatgatgtgctgcaggtgggcctgcccctgcctgacttcctggccatgaactacaacctggccgagctggacatcgtggagaatgccctgatgctggacctgaagctgggctag

SEQ ID NO: 7280 - DNA, 1323 bp, Artificial Sequence
  Description of Artificial Sequence: Synthetic coding sequence
atgtctgcccggggccgctgggagggcggcggccggcgggcctgccggggcagcctgggcctggcccgggcccagggcgctgagcgggtgaccagcagcgagcagaggcctgccatggccagcctgggcctgctgctgctgctgctgctgacagccctgccccccctgtggagcagcagcctgcccggcctggacacagctgagagcaaggccaccatcgctgacctgatcctgagcgccctggagcgggccaccgtcttcctggagcagaggctgcctgagatcaacctggatggcatggtgggcgtgcgggtgctggaggagcagctgaagtctgtgcgggagaagtgggcccaggagcccctgctgcagcccctgagcctgcgggtgggcatgctgggggagaagctggaggccgccatccagaggagcctgcactacctgaagctgagtgaccccaagtacctgcgggagttccagctgaccctgcagcccggcttctggaagctgccccacgcctggatccacacagatgccagcctggtgtaccccaccttcggcccccaggacagcttcagcgaggagaggagtgatgtgtgcctggtgcagctgctgggcactggaacagacagcagcgagccctgtggcctgagtgacctgtgccgcagcctgatgaccaagccaggctgcagcggctactgcctgagccaccagctgctcttcttcctgtgggccaggatgaggggctgcacccagggccccctgcagcagagccaggactacatcaacctcttctgtgccaacatgatggacctgaacagaagagctgaggccatcggctacgcctaccccacccgggacatcttcatggagaacatcatgttctgtggcatgggcggcttcagtgacttctacaagctgcgctggctggaggccatcctgtcctggcagaagcagcaggagggctgcttcggggagccagatgctgaagatgaggagctgagcaaggccatccagtaccagcagcacttcagccggcgggtgaagaggcgggagaagcagttcccagacagccgctctgtggcccaggccggcgtgcagtggaggaacctgggcagcctgcagcccctgcccccaggcttcaagcagttcagctgcctgatcctgcccagctcctgggactacagatctgtgcccccctacctggccaacttctacatcttcctggtggagaccggcttccaccacgtggcccacgccggcctggagctgctgatcagccgggacccccccaccagcggcagccagagcgtgggcctgtag

SEQ ID NO: 7281 - DNA, 708 bp, Artificial Sequence
  Description of Artificial Sequence: Synthetic coding sequence
atgaagtatgtgttctacctgggcgtgctggccggcaccttcttctttgctgacagctctgtgcagaaggaggaccctgccccctacctggtgtacctgaagagccacttcaacccctgtgtgggcgtgctgatcaagcccagctgggtgctggccccagcccactgctacctgcccaacctgaaggtgatgctgggcaacttcaagagccgggtgagagatggaacagagcagaccatcaaccccatccagatcgtgcgctactggaactacagccacagcgccccccaggatgacctgatgctgatcaagctggccaagccagccatgctgaaccccaaggtgcagcccctgaccctggccaccaccaacgtgcggcccggcaccgtgtgcctgctgagcggcctggactggagccaggagaacagcggccgccacccagacctgcggcagaacctggaggcccctgtgatgtctgaccgggagtgccagaagacagagcagggcaagagccacaggaacagcctgtgtgtgaagtttgtgaaggtgttcagccgcatctttggagaggtggccgtggccaccgtcatctgcaaggacaagctgcagggcatcgaggtgggccacttcatgggaggagatgtgggcatctacaccaacgtgtacaagtatgtgtcctggattgaaaatacagccaaggacaagtag

SEQ ID NO: 7282 - DNA, 426 bp, Artificial Sequence
  Description of Artificial Sequence: Synthetic coding sequence
atgctgaagaagatctctgtgggcgtggccggggacctgaacacagtgaccatgaagctgggctgtgtgctgatggcctgggccctgtacctgagcctgggcgtgctgtgggtggcccagatgctgctgggcgccagcagcagcgctgccccacccaccctgaacccagccccccagaagtctgctgcccctggaacagcccctgaggaggcccctggccccctgcccccaccacccacccccagcagcgaggaccccggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 7283 - DNA, 2886 bp, Artificial Sequence
  Description of Artificial Sequence: Synthetic coding sequence
atgctggcccccagaggagctgctgtgctgctgctgcacctggtgctgcagcgctggctggccgccggggcccaggccaccccccaggtgtttgacctgctgcccagcagcagccagaggctgaaccctggggccctgctgcctgtgctgacagatcctgccctgaatgacctgtatgtgatcagcaccttcaagctgcagaccaagagcagcgccaccatcttcggcctgtacagcagcacagacaacagcaagtactttgagttcaccgtgatgggccgcctgaacaaggccatcctgcgctacctgaagaatgatggcaaggtgcacctggtggtgttcaacaacctgcagctggctgatggaagaagacaccgcatcctgctgcggctgagcaacctgcagagaggagctggcagcctggagctgtacctggactgcatccaggtggacagcgtgcacaacctgccccgggcctttgctggccccagccagaagccagagaccatcgagctgcggaccttccagaggaagccccaggacttcctggaggagctgaagctggtggtgcggggcagcctcttccaggtggccagcctgcaggactgcttcctgcagcagagcgagcccctggccgccaccggcaccggggacttcaaccggcagttcctgggccagatgacccagctgaaccagctgctgggggaggtgaaggacctgctgcggcagcaggtgaaggagaccagcttcctgaggaacaccatcgccgagtgccaggcctgtggccccctgaagttccagagccccacccccagcacagtggtgcccccagcccccccagccccacccacccggcccccccggcgctgtgacagcaacccctgcttccggggcgtgcagtgcacagacagcagagatggcttccagtgtggcccctgcccagagggctacacaggaaatggcatcacctgcattgatgtggatgagtgcaagtaccacccctgctacccaggagtgcactgcatcaacctgagccctggcttccgctgtgatgcctgccctgtgggcttcaccggccccatggtgcagggcgtgggcatcagctttgccaagagcaacaagcaggtgtgcacagacattgatgagtgcagaaatggagcctgtgtgcccaacagcatctgtgtgaacaccctgggcagctaccgctgtggcccctgcaagccaggctacacaggagaccagatccggggctgcaaggccgagaggaactgcagaaatcctgagctgaacccctgcagcgtgaatgcccagtgcatcgaggagcggcagggagatgtgacctgtgtgtgtggggtgggctgggccggagatggctacatctgtgggaaggatgtggacatcgacagctacccagatgaggagctgccctgcagcgccaggaactgcaagaaggacaactgcaagtatgtgcccaacagcggccaggaggatgctgacagagatggcattggagatgcctgtgatgaagatgctgatggagatggcatcctgaatgagcaggacaactgtgtgctgatccacaacgtggaccagaggaacagcgacaaggacatctttggagatgcctgtgacaactgcctgtctgtgctgaacaatgaccagaaggacacagatggagatggaagaggagatgcctgtgatgatgacatggatggagatggcatcaagaacatcctggacaactgccccaagttccccaacagagaccagagggacaaggatggagatggagtgggagatgcctgtgacagctgcccagatgtgagcaaccccaaccagagtgatgtggacaatgacctggtgggggacagctgtgacaccaaccaggacagtgatggagatggccaccaggacagcacagacaactgccccaccgtcatcaacagcgcccagctggacacagacaaggatggcattggagatgaatgtgatgatgatgatgacaatgatggcatcccagacctggtgcccccaggccctgacaactgccgcctggtgcccaacccagcccaggaggacagcaacagtgatggagtgggggacatctgtgagagtgactttgaccaggaccaggtgattgacagaattgatgtgtgcccagaaaatgctgaggtgaccctgacagacttccgggcctaccagacagtggtgctggaccctgaaggagatgcccagattgaccccaactgggtggtgctgaaccagggcatggagatcgtgcagaccatgaacagcgaccccggcctggccgtgggctacacagccttcaatggagtggactttgagggcaccttccacgtgaacacccagacagatgatgattatgccggcttcatcttcggctaccaggacagcagcagcttctacgtggtgatgtggaagcagacagagcagacctactggcaggccacccccttccgggctgtggccgagcccggcatccagctgaaggctgtgaagagcaagacaggccctggagagcacctgaggaacagcctgtggcacactggagacaccagtgaccaggtgcggctgctgtggaaggacagcagaaatgtgggctggaaggacaaggtgtcctaccgctggttcctgcagcaccggccccaggtgggctacatccgggtgcgcttctatgagggcagcgagctggtggccgacagcggcgtgaccatcgacaccaccatgaggggcggccgcctgggcgtcttctgcttcagccaggagaacatcatctggagcaacctgaagtaccgctgcaatgacaccatccctgaggacttccaggagttccagacccagaactttgacagatttgacaactag

SEQ ID NO: 7284 - DNA, 300 bp, Artificial Sequence
  Description of Artificial Sequence: Synthetic coding sequence
atggacaacgtgcagcccaagatcaagcaccggcccttctgcttctctgtgaagggccacgtgaagatgctgcggctggacatcatcaacagcctggtgaccaccgtcttcatgctgattgtgtctgtgctggccctgatccctgagaccaccaccctgactgtgggcggcggcgtgtttgccctggtgacagctgtgtgctgcctggctgatggagccctgatctacaggaagctgctcttcaaccccagcggcccctaccagaagaagcctgtgcatgagaagaaggaggtgctgtag

SEQ ID NO: 7285 - DNA, 408 bp, Artificial Sequence
  Description of Artificial Sequence: Synthetic coding sequence
atgagcccccacctgacagccctgctgggcctggtgctgtgcctggcccagaccatccacacccaggagggcgccctgccccggcccagcatctctgctgagcccggcaccgtcatcagccctggcagccacgtgaccttcatgtgccggggccctgtgggcgtgcagaccttccggctggagagagaagatcgggccaagtacaaggacagctacaacgtgttccggctgggccccagcgagagcgaggcccgcttccacatcgacagcgtgtctgagggcaatgccggcctgtaccgctgcctgtactacaagcccccaggctggagcgagcacagcgacttcctggagctgctggtgaagggcaccgtgcctggaacagaggccagcggctttgatgccccctag

SEQ ID NO: 7286 - DNA, 231 bp, Artificial Sequence
  Description of Artificial Sequence: Synthetic coding sequence
atgctgccctgcctggccctgctgctgctgatggagctgtctgtgtgcaccgtggccggagatggaggagaggagcagaccctgagcacagaggccgagacctgggagggcgccggccccagcatccagctgcagctgcaggaggtgaagacaggcaaggccagccagttcttcggcctgatgggcaagagggtgggcggcagagaagatgaggcccagggcagcgagtag

SEQ ID NO: 7287 - DNA, 684 bp, Artificial Sequence
  Description of Artificial Sequence: Synthetic coding sequence
atgaggggccagggcaggaaggagagcctgagtgacagccgggacctggatggcagctatgaccagctgacagacagcgtggatgatgaatttgagctgagcacagtgtgccacaggcctgagggcctggagcagctgcaggagcagaccaagttcaccaggaaggagctgcaggtgctgtaccggggcttcaagaaccctggggccctgtccttccaggagtgccccagcggcatcgtgaatgaggagaacttcaagcagatctacagccagttcttcccccagggcgacagcagcacctacgccaccttcctgttcaatgcctttgacaccaaccatgatggctctgtgtcctttgaggactttgtggccggcctgagcgtcatcctgcggggcaccgtggatgaccggctgaactgggccttcaacctgtatgacctgaacaaggatggctgcatcaccaaggaggagatgctggacatcatgaagagcatctatgacatgatgggcaagtacacctacccagccctgcgggaggaggccccccgggagcacgtggagagcttcttccagaagatggacaggaacaaggatggagtggtgaccatcgaggagttcatcgagagctgccagaaggatgagaacatcatgaggtccatgcagctgtttgacaacgtcatctag

SEQ ID NO: 7288 - DNA, 876 bp, Artificial Sequence
  Description of Artificial Sequence: Synthetic coding sequence
atgatgtctgccactggacctggcaggaagatgggcagccggggccagggcctgctgctggcctactgcctgctgctggcctttgccagcggcctggtgctgagccgggtgccccacgtgcagggcgagcagcaggagtgggagggcacagaggagctgcccagccccccagaccacgccgagagagctgaggagcagcacgagaagtaccggcccagccaggaccagggcctgcctgccagccgctgcctgcgctgctgtgaccccggcacctccatgtacccagccacagctgtgccccagatcaacatcaccatcctgaagggggagaagggggacagaggagaccggggcctgcagggcaagtatggcaagacaggcagcgctggggcccggggccacacaggccccaagggccagaagggctccatgggcgcccctggagagcgctgcaagagccactacgccgccttctctgtgggcaggaagaagcccatgcacagcaaccactactaccagaccgtcatctttgacacagaatttgtgaacctgtatgaccacttcaacatgttcaccgggaagttctactgctacgtgcccggcctgtacttcttcagcctgaatgtgcacacctggaaccagaaggagacctacctgcacatcatgaagaatgaggaggaggtggtgatcctgtttgcccaggtgggggacaggagcatcatgcagagccagagcctgatgctggagctgcgggagcaggaccaggtgtgggtgcggctgtacaagggggagcgggagaatgccatcttcagcgaggagctggacacctacatcaccttcagcggctacctggtgaagcacgccacagagccctag

SEQ ID NO: 7289 - DNA, 213 bp, Artificial Sequence
  Description of Artificial Sequence: Synthetic coding sequence
atggagagaggagctggggccaagctgctgcccctgctgctgctgctgcgggccaccggcttcacctgtgcccagacagatggaagaaatggctacacagctgtgattgaggtgaccagcggcggcccctggggagactgggcctggccagagatgtgcccagatggcttctttgccagcggcttcagcctgaagctgggccgcatggagtag

SEQ ID NO: 7290 - DNA, 402 bp, Artificial Sequence
  Description of Artificial Sequence: Synthetic coding sequence
atgggcagcagcggcctgctgagcctgctggtgctgtttgtgctgctggccaacgtgcagggccctggcctgacagactggctgttcccccggcgctgccccaagatccgggaggagtgtgagttccaggagagagatgtgtgcaccaaggaccggcagtgccaggacaacaagaagtgctgcgtgttcagctgtgggaagaagtgcctggacctgaagcaggatgtgtgtgagatgcccaaggagaccggcccctgcctggcctacttcctgcactggtggtatgacaagaaggacaacacctgcagcatgtttgtgtatggaggctgccagggcaacaacaacaacttccagagcaaggccaactgcctgaacacctgcaagaacaagcgcttcccctag

SEQ ID NO: 7291 - DNA, 771 bp, Artificial Sequence
  Description of Artificial Sequence: Synthetic coding sequence
atgttccagacaggaggcctcatcgtgttctacggcctgctggcccagaccatggcccagtttggaggcctgcctgtgcccctggaccagaccctgcccctgaatgtgaacccagccctgcccctgagccccaccggcctggccggcagcctgaccaatgccctgagcaatggcctgctgagcggcggcctgctgggcatcctggagaacctgcccctgctggacatcctgaagccaggcggcggcaccagcggcggcctgctgggcggcctgctgggcaaggtgaccagcgtcatccctggcctgaacaacatcatcgacatcaaggtgacagacccccagctgctggagctgggcctggtgcagagcccagatggccaccggctgtatgtgaccatccccctgggcatcaagctgcaggtgaacacccccctggtgggcgccagcctgctgcggctggccgtgaagctggacatcacagctgagatcctggccgtgcgggacaagcaggagcgcatccacctggtgctgggggactgcacccacagccctggcagcctgcagatcagcctgctggatggcctgggccccctgcccatccagggcctgctggacagcctgaccggcatcctgaacaaggtgctgcctgagctggtgcagggcaatgtgtgccccctggtgaatgaggtgctgcggggcctggacatcaccctggtgcatgacatcgtgaacatgctgatccacggcctgcagtttgtgatcaaggtgtag

SEQ ID NO: 7292 - DNA, 1386 bp, Artificial Sequence
  Description of Artificial Sequence: Synthetic coding sequence
atgagcctggacatccagagcctggacatccagtgtgaggagctgagtgatgcccgctgggccgagctgctgcccctgctgcagcagtgccaggtggtgcggctggatgactgtggcctgacagaggcccgctgcaaggacatcagcagcgccctgcgggtgaacccagccctggccgagctgaacctgcggagcaatgagctgggagatgtgggcgtgcactgtgtgctgcagggcctgcagacccccagctgcaagatccagaagctgagcctgcagaactgctgcctgaccggggccggctgcggcgtgctgagcagcaccctgcggaccctgcccaccctgcaggagctgcacctgagtgacaacctgctgggagatgctggcctgcagctgctgtgtgagggcctgctggacccccagtgccgcctggagaagctgcagctggagtactgcagcctgtctgctgccagctgtgagcccctggcctctgtgctgcgggccaagccagacttcaaggagctgactgtgagcaacaatgacatcaatgaagctggggtgcgggtgctgtgccagggcctgaaggacagcccctgccagctggaggccctgaagctggagagctgtggggtgaccagtgacaactgccgggacctgtgtggcatcgtggccagcaaggccagcctgcgggagctggccctgggcagcaacaagctgggagatgtgggcatggccgagctgtgccccggcctgctgcaccccagcagccggctgcggaccctgtggatctgggagtgtggcatcacagccaagggctgtggggacctgtgccgggtgctgcgggccaaggagagcctgaaggagctgagcctggccggaaatgagctgggagatgagggcgcccggctgctgtgtgagaccctgctggagcccggctgccagctggagagcctgtgggtgaagagctgcagcttcaccgctgcctgctgcagccacttcagctctgtgctggcccagaaccgcttcctgctggagctgcagatcagcaacaaccggctggaggatgctggggtgcgggagctgtgccagggcctgggccagcccggctctgtgctgcgggtgctgtggctggccgactgtgatgtgtctgacagcagctgcagcagcctggccgccaccctgctggccaaccacagcctgcgggagctggacctgagcaacaactgcctgggagatgctggcatcctgcagctggtggagagcgtgcggcagcccggctgcctgctggagcagctggtgctgtatgacatctactggagcgaggagatggaggaccggctgcaggccctggagaaggacaagcccagcctgcgggtcatctcctag

SEQ ID NO: 7293 - DNA, 534 bp, Artificial Sequence
  Description of Artificial Sequence: Synthetic coding sequence
atgaggctgctgatcctgacctgcctggtggccgtggccctggcccggcccaagctgcccctgcgctacccagagcggctgcagaaccccagcgagagcagcgagcccatccccctggagagccgggaggagtacatgaatggcatgaaccggcagaggaacatcctgcgggagaagcagacagatgagatcaagaactgtgtggtggccgagcctgagaagatggagagcagcatcagcagcagcagcgaggagatgagcctgagcaaatgtgccgagcagttctgccgcctgaatgagtacaaccagctgcagctgcagaagatgagcaagcaggagcagatccggaggatgaatgaaaacagccacgtgcaggtgcccttccagcagctgaaccagctggccgcctacccctatgctgtgtggtactacccccagatcatgcagtatgtgcccttcccccccttcagtgacatcagcaaccccacagcccacgagaactatgagaagaacaacgtgatgctgcagtggtag

SEQ ID NO: 7294 - DNA, 3054 bp, Artificial Sequence
  Description of Artificial Sequence: Synthetic coding sequence
atggacctgatccggggcgtgctgctgcggctgctgctgctggccagcagcctgggccctggagctgtgtccctgcgggccgccatcaggaagccaggcaaggtgggcccccccctggacatcaagctgggcgccctgaactgcacagccttcagcatccagtggaagatgcccaggcaccctggcagccccatcctgggctacacagtgttctacagcgaggtgggcgctgacaagagcctgcaggagcagctgcacagcgtgcccctgagccgggacatccccaccacagaggaggtgattggagacctgaagccaggcacagagtacagagtgtccattgctgcctacagccaggccggcaagggccgcctgagcagccccaggcatgtgaccaccctgagccaggacagctgcctgcccccagctgccccccagcagccccacgtgattgtggtgtctgacagcgaggtggccctgtcctggaagccaggggccagcgagggcagcgcccccatccagtactacagcgtggagttcatccggccagactttgacaagaagtggaccagcatccacgagcgcatccagatggacagcatggtgatcaagggcctggaccctgacaccaactaccagtttgctgtgcgggccatgaacagccacggccccagccccaggtcctggcccagcgacatcatccgcaccctgtgcccagaggaggccggcagcggccgctatggcccccgctacatcacagacatgggcgctggagaagatgatgagggctttgaagatgacctggacctggacatcagctttgaggaggtgaagcccctgcctgccaccaagggcggcaacaagaagttcctggtggagagcaagaagatgagcatcagcaaccccaagaccatcagccgcctcatcccccccaccagcgccagcctgcctgtgaccaccgtggccccccagcccatccccatccagaggaagggcaagaatggagtggccatcatgagccggctgtttgacatgccctgtgatgagaccctgtgcagcgctgacagcttctgtgtgaatgactacacctggggcggcagccgctgccagtgcaccctgggcaaaggaggagagagctgcagcgaggacatcgtcatccagtacccccagttcttcggccacagctatgtgacctttgagcccctgaagaacagctaccaggccttccagatcaccctggagttccgggcagaggccgaggatggcctgctgctgtactgtggagaaaatgagcacggccgcggggacttcatgagcctggccatcatccgccgcagcctgcagttccgcttcaactgtggcactggagtggccatcatcgtgtctgagaccaagatcaagctgggcggctggcacacagtgatgctgtacagagatggcctgaatggcctgctgcagctgaacaacggcacccctgtgacaggccagagccagggccagtacagcaagatcaccttccgcacccccctgtacctgggcggggcccccagcgcctactggctggtgcgggccaccggcaccaacagaggcttccagggctgtgtgcagagcctggccgtgaatggaagaagaattgacatgaggccctggcccctgggcaaggccctgtctggagcagatgtgggagaatgtagcagcggcatctgtgatgaggccagctgcatccacggcggcacctgcacagccatcaaggctgacagctacatctgcctgtgccccctgggcttcaagggccgccactgtgaagatgccttcaccctgaccatcccccagttccgggagagcctgcggagctatgctgccaccccctggcccctggagccccagcactacctgtccttcatggagtttgagatcaccttccggccagattctggagatggagtgctgctgtacagctatgacaccggcagcaaggacttcctgagcatcaacctggccggcggccacgtggagttccgctttgactgtggcagcggcactggagtgctgcggtctgaggaccccctgaccctgggcaactggcatgagctgcgggtgtccaggacagccaagaatggcatcctgcaggtggacaagcagaagatcgtggagggcatggccgagggcggcttcacccagatcaagtgcaacacagacatcttcatcggcggcgtgcccaactatgatgatgtgaagaagaacagcggcgtgctgaagcccttcagcggcagcatccagaagatcatcctgaatgacaggaccatccacgtgaagcatgacttcaccagcggcgtgaatgtggagaatgctgcccacccctgtgtgcgggccccctgtgcccatggaggcagctgccggcccaggaaggagggctatgactgtgactgccccctgggctttgagggcctgcactgccagaaggaatgtggcaactactgcctgaacaccatcatcgaggccatcgagatcccccagttcatcggccgcagctacctgacctatgacaacccagacatcctgaagagggtgtctggcagccgcagcaatgtgttcatgaggttcaagaccacagccaaggatggcctgctgctgtggaggggggacagccccatgaggcccaacagcgacttcatcagcctgggcctgagagatggagccctggtgttctcctacaacctgggcagcggcgtggccagcatcatggtgaatggcagcttcaatgatggccgctggcaccgggtgaaggctgtgagagatggccagagcggcaagatcaccgtggatgattatggagccaggacaggcaagagccctggcatgatgaggcagctgaacatcaatggagccctgtatgtgggcggcatgaaggagatcgccctgcacaccaaccggcagtacatgaggggcctggtgggctgcatcagccacttcaccctgagcacagactaccacatcagcctggtggaggatgctgtggatggcaagaacatcaacacctgtggggccaagtag

SEQ ID NO: 7295 - DNA, 1893 bp, Artificial Sequence
  Description of Artificial Sequence: Synthetic coding sequence
atgcagcaggacggcctgggcgtgggcaccagaaatggcagcggcaagggccgctctgtgcaccccagctggccctggtgtgccccccggcccctgcgctacttcggcagagatgcccgggcccggcgggcccagacagctgccatggccctgctggccggcggcctgagccggggcctgggcagccaccctgctgctgctggaagagatgctgtggtgtttgtgtggctgctgctgagcacctggtgcacagccccagcccgggccatccaggtgacagtgagcaacccctaccacgtggtgatcctcttccagcctgtgaccctgccctgcacctaccagatgaccagcacccccacccagcccatcgtcatctggaagtacaagagcttctgccgggacagaattgctgatgccttcagccctgcctctgtggacaaccagctgaatgcccagctggccgccggcaaccctggctacaacccctacgtggagtgccaggacagcgtgaggacagtgcgggtggtggccaccaagcagggcaatgctgtgaccctgggggactactaccagggccgccgcatcaccatcactggaaatgctgacctgacctttgaccagacagcctggggagacagcggcgtgtactactgcagcgtggtgtctgcccaggacctgcagggcaacaatgaggcctatgcagagctgattgtgctggactggctgtttgtggtggtggtgtgcctggccgccttcctgatcttcctgctgctgggcatctgctggtgccagtgctgcccccacacctgctgctgctacgtgcgctgcccctgctgcccagacaagtgctgctgcccagaggccctgtatgctgctgggaaggccgccaccagcggcgtgcccagcatctatgcccccagcacctacgcccacctgagccctgccaagaccccacctcctccagccatgatccccatgggccctgcctacaacggctacccaggcggctacccaggagatgtggacaggagcagcagcgctgggggccagggcagctatgtgcccctgctgcgggacacagacagctctgtggccagcgaggtgcgcagcggctaccgcatccaggccagccagcaggatgacagcatgagggtgctgtactacatggagaaggagctggccaactttgaccccagcaggcctggccccccatctggccgggtggagcgggccatgtctgaggtgaccagcctgcatgaagatgactggaggagccggcccagccggggccctgccctgacccccatcagagatgaggagtggggcggccacagccccaggagcccccggggctgggaccaggagcccgcccgggagcaggccggcggcggctggagggcccggcggccccgggcccggtctgtggatgccctggatgacctgaccccacccagcacagctgagagcggcagccgcagccccaccagcaatggaggccgcagccgggcctacatgccacccaggagccgcagcagagatgacctgtatgaccaggatgacagccgggacttccccaggagccgggacccccactatgatgacttccgcagccgggagaggcctcctgctgaccccaggagccaccaccacaggacccgggacccccgggacaatggcagccgcagcggggacctgccctatgatggccgcctgctggaggaggccgtgaggaagaagggcagcgaggagaggagaagaccccacaaggaggaggaggaggaggcctactaccccccagcccccccaccctacagcgagacagacagccaggccagccgggagcggcggctgaagaagaacctggccctgagccgggagagcctggtggtgtag

SEQ ID NO: 7296 - DNA, 750 bp, Artificial Sequence; identical to SEQ ID NO: 6908
  Description of Artificial Sequence: Synthetic coding sequence

SEQ ID NO: 7297 - DNA, 3057 bp, Artificial Sequence; identical to SEQ ID NO: 6932
  Description of Artificial Sequence: Synthetic coding sequence

SEQ ID NO: 7298 - DNA, 1311 bp, Artificial Sequence
  Description of Artificial Sequence: Synthetic coding sequence
atgcagggcaccccaggcggcggcaccaggcctggccccagccctgtggacaggaggaccctgctggtgttctccttcatcctggccgccgccctgggccagatgaacttcaccggggaccaggtgctgcgggtgctggccaaggatgagaagcagctgagcctgctgggggacctggagggcctgaagccccagaaggtggacttctggaggggccctgcccggcccagcctgcctgtggacatgagggtgcccttcagcgagctgaaggacatcaaggcctacctggagagccacggcctggcctacagcatcatgatcaaggacatccaggtgctgctggatgaggagcggcaggccatggccaagagccggcggctggagaggagcaccaacagcttctcctacagcagctaccacaccctggaggagatctacagctggattgacaactttgtgatggagcacagcgacatcgtgtccaagatccagatcggcaacagctttgagaaccagagcatcctggtgctgaagttcagcactggaggcagccgccacccagccatctggattgacaccggcatccacagccgggagtggatcacccacgccaccggcatctggacagccaacaagatcgtgtctgactatggcaaggacagagtgctgacagacatcctgaatgccatggacatcttcatcgagctggtgaccaacccagatggctttgccttcacccacagcatgaaccggctgtggaggaagaacaagagcatccggcccggcatcttctgcatcggcgtggacctgaacagaaactggaagagcggctttggaggaaatggcagcaacagcaacccctgcagcgagacctaccacggccccagcccccagagcgagcctgaggtggccgccatcgtgaacttcatcacagcccacggcaacttcaaggccctgatcagcatccacagctacagccagatgctgatgtacccctacggccgcctgctggagcctgtgagcaaccagcgggagctgtatgacctggccaaggatgctgtggaggccctgtacaaggtgcatggaattgagtacatcttcggcagcatcagcaccaccctgtatgtggccagcggcatcaccgtggactgggcctatgacagcggcatcaagtatgccttctcctttgagctgcgggacaccggccagtatggcttcctgctgcctgccacccagatcatccccacagcccaggagacctggatggccctgcggaccatcatggagcacaccctgaaccacccctactag

SEQ ID NO: 7299 - DNA, 492 bp, Artificial Sequence
  Description of Artificial Sequence: Synthetic coding sequence
atgttccagggcctgctgctgctgctgctgctgtccatgggcggcacctgggccagcaaggagcccctgcggccccgctgccggcccatcaatgccaccctggccgtggagaaggagggctgccctgtgtgcatcaccgtgaacaccaccatctgtgccggctactgccccaccatgaccagggtgctgcagggcgtgctgcctgccctgccccaggtggtgtgcaactacagagatgtgcgctttgagagcatccggctgcccggctgcccccggggcgtgaaccctgtggtgtcctatgctgtggccctgagctgccagtgtgccctgtgccgccgcagcaccacagactgtggcggccccaaggaccaccccctgacctgtgatgacccccgcttccaggacagcagcagcagcaaggcccccccacccagcctgcccagccccagccggctgcccggccccagcgacacccccatcctgccccagtag

SEQ ID NO: 7300 - DNA, 213 bp, Artificial Sequence; identical to SEQ ID NO: 7198
  Description of Artificial Sequence: Synthetic coding sequence

SEQ ID NO: 7301 - DNA, 1098 bp, Artificial Sequence
  Description of Artificial Sequence: Synthetic coding sequence
atgtggctgctgctgaccatggccagcctcatctctgtgctgggcaccacccacggcctgtttgggaagctgcaccctggcagccctgaggtgaccatgaacatcagccagatgatcacctactggggctacccaaatgaggagtatgaggtggtgacagaagatggctacatcctggaggtgaaccgcatcccctacggcaagaagaacagcggcaacacagatgctggctatgatgtgtggctgggcaacagccggggcaacacctgggcccggaggaacctgtactacagcccagattctgtggagttctgggccttctcctttgatgagatggccaagtatgacctgcctgccaccatcgacttcatcgtgaagaagacaggccagaagcagctgcactacgtgggccacagccagggcaccaccatcggcttcatcgccttcagcaccaaccccagcctggccaagaggatcaagaccttctacgccctggcccctgtggccaccgtgaagtacaccaagagcctcatcaacaagctgcgctttgtgccccagagcctcttcaagttcatctttggagacaagatcttctacccccacaacttctttgaccagttcctggccacagaggtgtgcagccgggagatgctgaacctgctgtgcagcaatgccctcttcatcatctgtggctttgacagcaagaacttcaacaccagccggctggatgtgtacctgagccacaacccagctggcacctctgtgcagaacatgttccactggacccaggccgtgaagagcggcaagttccaggcctatgactggggcagccctgtgcagaacaggatgcactatgaccagagccagcccccctactacaacgtgacagccatgaatgtgcccatcgctgtgtggaatggaggcaaggacctgctggccgacccccaggatgtgggcctgctgctgcccaagctgcccaacctgatctaccacaaggagatccccttctacaaccacctggacttcatctgggccatggatgccccccaggaggtgtacaatgacatcgtgtccatgatcagcgaggacaagaagtag

SEQ ID NO: 7302 - DNA, 2535 bp, Artificial Sequence
  Description of Artificial Sequence: Synthetic coding sequence
atgggccctggggccccctttgcccgggtgggctggcccctgcccctgctggtggtgatggccgccggcgtggcccctgtgtgggccagccacagcccccacctgccccggccccacagccgggtgcccccccaccccagcagcgagcggcgggctgtgtacatcggggccctcttccccatgtctgggggctggccaggcggccaggcctgccagcctgctgtggagatggccctggaggatgtgaacagcagaagagacatcctgcctgactatgagctgaagctgatccaccacgacagcaaatgtgaccccggccaggccaccaagtacctgtatgagctgctgtacaatgaccccatcaagatcatcctgatgcctggctgcagctctgtgtccaccctggtggccgaggccgccaggatgtggaacctgattgtgctgtcctatggcagcagcagccctgccctgagcaaccggcagcgcttccccaccttcttccgcacccaccccagcgccaccctgcacaaccccaccagggtgaagctgtttgagaagtggggctggaagaagatcgccaccatccagcagaccacagaggtgttcaccagcaccctggatgacctggaggagcgggtgaaggaggccggcatcgagatcaccttccggcagagcttcttcagtgaccctgctgtgcctgtgaagaacctgaagaggcaggatgcccgcatcatcgtgggcctcttctatgaaacagaggccaggaaggtgttctgtgaggtgtacaaggagcggctgtttgggaagaagtatgtgtggttcctgattggctggtacgccgacaactggttcaagatctatgaccccagcatcaactgcaccgtggatgagatgacagaagctgtggagggccacatcaccacagagatcgtgatgctgaacccagccaacaccaggagcatcagcaacatgaccagccaggagtttgtggagaagctgaccaagaggctgaagaggcaccctgaggagaccggcggcttccaggaggcccccctggcctatgatgccatctgggccctggccctggccctgaacaagaccagcggcggcggcggccgcagcggcgtgcggctggaggacttcaactacaacaaccagaccatcacagaccagatctaccgggccatgaacagcagcagctttgaaggagtgtctggccacgtggtgtttgatgccagcggcagcaggatggcctggaccctcatcgagcagctgcagggcggcagctacaagaagattggctactatgacagcaccaaggatgacctgtcctggagcaagacagacaagtggattggaggcagccccccagctgaccagaccctggtgatcaagaccttccgcttcctgagccagaagctgttcatctctgtgtctgtgctgagcagcctgggcatcgtgctggccgtggtgtgcctgtccttcaacatctacaacagccacgtgcgctacatccagaacagccagcccaacctgaacaacctgacagctgtgggctgcagcctggccctggccgctgtgttccccctgggcctggatggctaccacatcggcaggaaccagttcccctttgtgtgccaggcccggctgtggctgctgggcctgggcttcagcctgggctacggctccatgttcaccaagatctggtgggtgcacacagtgttcaccaagaaggaggagaagaaggagtggaggaagaccctggagccctggaagctgtatgccaccgtgggcctgctggtgggcatggatgtgctgaccctggccatctggcagatcgtggaccccctgcacaggaccatcgagacctttgccaaggaggagcccaaggaggacattgatgtgtccatcctgccccagctggagcactgcagcagcaggaagatgaacacctggctgggcatcttctacggctacaagggcctgctgctgctgctgggcatcttcctggcctatgagaccaagtctgtgtccacagagaagatcaatgaccacagagctgtgggcatggccatctacaacgtggccgtgctgtgcctgatcacagcccctgtgaccatgatcctgagcagccagcaggatgctgcctttgcctttgccagcctggccatcgtgttcagcagctacatcaccctggtggtgctgtttgtgcccaagatgagaagactcatcaccagaggagagtggcagagcgaggcccaggacaccatgaagacaggcagcagcaccaacaacaatgaggaggagaagagccggctgctggagaaggaaaatcgggagctggagaagatcatcgccgagaaggaggagcgggtgtctgagctgcggcaccagctgcagagccggcagcagctgcggagccgccgccacccccccaccccacctgagcccagcggcggcctgccccggggccccccagagcccccagaccggctgagctgtgatggcagccgggtgcacctgctgtacaagtag

SEQ ID NO: 7303 - DNA, 1020 bp, Artificial Sequence
  Description of Artificial Sequence: Synthetic coding sequence
atggtgtccaagagccgctggaagctgctggccatgctggccctggtgctggtggtgatggtgtggtacagcatcagccgggaggaccgctacatcgagctgttctacttccccatccctgagaagaaggagccctgcctgcagggcgaggccgagagcaaggccagcaagctgtttgggaagctgagccccctgtgcagctacagccgggaccagcccatcttcctgcggctggaggactacttctgggtgaagacccccagcgcctatgagctgccctacggcaccaagggcagcgaggacctgctgctgcgggtgctggccatcaccagcagcagcatccccaagaacatccagagcctgcgctgccgccgctgtgtggtggtgggcaatggccaccggctgaggaacagcagcctgggagatgccatcaacaagtatgatgtggtgatccggctgaacaatgcccctgtggccggctatgaaggagatgtgggcagcaagaccaccatgaggctcttctacccagagagcgcccactttgaccccaaggtggagaacaacccagacaccctgctggtgctggtggccttcaaggccatggacttccactggattgagaccatcctgagtgacaagaagagggtgaggaagggcttctggaagcagcccccactcatctgggatgtgaaccccaagcagatccgcatcctgaaccccttcttcatggagattgctgctgacaagctgctgagcctgcccatgcagcagcccaggaagatcaagcagaagcccaccaccggcctgctggccatcaccctggccctgcacctgtgtgacctggtgcacatcgccggcttcggctacccagatgcctacaacaagaagcagaccatccactactatgagcagatcaccctgaagtccatggccggcagcggccacaacgtgtcccaggaggccctggccatcaagaggatgctggagatgggcgccatcaagaacctgaccagcttctag

SEQ ID NO: 7304 - DNA, 1386 bp, Artificial Sequence; identical to SEQ ID NO: 7292
  Description of Artificial Sequence: Synthetic coding sequence

SEQ ID NO: 7305 - DNA, 1695 bp, Artificial Sequence
  Description of Artificial Sequence: Synthetic coding sequence
atggcccccaagaagctgagctgcctgcggagcctgctgctgcccctgagcctgaccctgctgctgccccaggccgacaccaggagctttgtggtggaccggggccatgaccgcttcctgctggatggagcccccttccgctacgtgtctggcagcctgcactacttccgggtgccccgggtgctgtgggccgaccggctgctgaagatgcgctggagcggcctgaatgccatccagttctacgtgccctggaactaccacgagccccagcccggggtgtacaacttcaacggcagccgggacctgattgccttcctgaatgaagctgccctggccaacctgctggtgatcctgcggcccggcccctacatctgtgccgagtgggagatgggcggcctgcccagctggctgctgaggaagccagagatccacctgcggaccagtgaccctgctgacaacatgaccaagatcttcaccctgctgaggaaatatgagccccacggccccctggtgaacagcgagtactacacaggctggctggactactggggccagaaccacagcaccaggtctgtgtctgctgtgaccaagggcctggagaacatgctgaagctgggcgcctctgtgaacatgtacatgtttcatggaggcaccaactttggctactggaatggagctgacaagaagggccgcttcctgcccatcaccaccagctatgactatgatgcccccatcagcgaggccggggaccccacccccaagctgtttgccctgagagatgtgatcagcaagttccaggaggtgcccctgggccccctgcccccacccagccccaagatgatgctgggccctgtgaccctgcacctggtgggccacctgctggccttcctggacctgctgtgcccccggggccccatccacagcatcctgcccatgacctttgaggccgtgaagcaggaccacggcttcatgctgtaccgcacctacatgacccacaccatctttgagcccacccccttctgggtgcccaacaatggagtgcatgaccgggcctacgtgatggtggatggagtcttccagggcgtggtggagaggaacatgagggacaagctgttcctgaccgggaagctgggcagcaagctggacatcctggtggagaacatgggccgcctgagctttggcagcaacagcagtgacttcaagggcctgctgaagccacccatcctgggccagaccatcctgacccagtggatgatgttccccctgaagattgacaacctggtgaagtggtggttccccctgcagctgcccaagtggccctacccccaggcccccagcggccccaccttctacagcaagaccttccccatcctgggctctgtgggggacaccttcctgtacctgcccggctggaccaagggccaggtgtggatcaatggcttcaacctgggccgctactggaccaagcagggcccccagcagaccctgtatgtgccccgcttcctgctcttccccaggggggccctgaacaagatcaccctgctggagctggaggatgtgcccctgcagccccaggtgcagttcctggacaagcccatcctgaacagcaccagcaccctgcacaggacccacatcaacagcctgtctgctgacaccctgagcgccagcgagcccatggagctgagcggccactag

SEQ ID NO: 7306 - DNA, 1317 bp, Artificial Sequence
  Description of Artificial Sequence: Synthetic coding sequence
atgatgtatgcccctgtggagttcagcgaggccgagttcagcagagctgagtaccagaggaagcagcagttctgggacagcgtgcggctggccctcttcaccctggccatcgtggccatcattggaattgccatcggcatcgtgacccactttgtggtggaggatgacaagagcttctactacctggccagcttcaaggtgaccaacatcaagtacaaggagaactacggcatccgcagcagccgggagttcatcgagaggagccaccagattgaaagaatgatgagccgcatcttccgccacagctctgtgggcggccgcttcatcaagagccacgtgatcaagctgagcccagatgagcagggcgtggacatcctgattgtgctgatcttccgctaccccagcacagacagcgctgagcagatcaagaagaagattgagaaggccctgtaccagagcctgaagaccaagcagctgagcctgaccatcaacaagcccagcttccggctgacccccatcgacagcaagaagatgaggaacctgctgaacagccgctgtggcatccgcatgaccagcagcaacatgcccctgcctgccagcagcagcacccagagaattgtgcagggccgggagacagccatggagggggagtggccctggcaggccagcctgcagctgattggcagcggccaccagtgtggggccagcctcatcagcaacacctggctgctgacagctgcccactgcttctggaagaacaaggaccccacccagtggatcgccacctttggagccaccatcaccccacctgctgtgaagagaaatgtgaggaagatcatcctgcacgagaactaccaccgggagaccaatgaaaatgacatcgccctggtgcagctgagcactggagtggagttcagcaacatcgtgcagagggtgtgcctgcctgacagcagcatcaagctgccccccaagacctctgtgtttgtgacaggcttcggcagcatcgtggatgatggccccatccagaacaccctgcggcaggcccgggtggagaccatcagcacagatgtgtgcaacaggaaggatgtgtatgatggcctcatcaccccaggcatgctgtgtgccggcttcatggagggcaagattgatgcctgcaagggggacagcggcggccccctggtgtatgacaaccacgacatctggtacatcgtgggcatcgtgtcctggggccagagctgtgccctgcccaagaagccaggagtgtacaccagggtgaccaagtacagagactggatcgccagcaagacaggcatgtag

SEQ ID NO: 7307 - DNA, 4392 bp, Artificial Sequence
  Description of Artificial Sequence: Synthetic coding sequence
atggagcccaggctcttctgctggaccaccctcttcctgctggccggctggtgcctgcccggcctgccctgccccagccgctgcctgtgcttcaagagcacagtgcgctgcatgcacctgatgctggaccacatcccccaggtgccccagcagaccaccgtgctggacctgcgcttcaaccgcatccgggagatccctggcagcgccttcaagaagctgaagaacctgaacaccctgctgctgaacaacaaccacatcaggaagatcagcagaaatgcctttgagggcctggagaacctgctgtacctgtacctgtacaagaatgagatccacgccctggacaagcagaccttcaagggcctcatcagcctggagcacctgtacatccacttcaaccagctggagatgctgcagcctgagaccttcggggacctgctgcggctggagcggctcttcctgcacaacaacaagctgagcaagatcccagctggcagcttcagcaacctggacagcctgaagaggctgcggctggacagcaatgccctggtgtgtgactgtgacctgatgtggctgggggagctgctgcagggctttgcccagcacggccacacccaggccgccgccacctgtgagtacccccggcggctgcacggccgggctgtggcctctgtgacagtggaggagttcaactgccagagcccccgcatcacctttgagccccaggatgtggaggtgcccagcggcaacacagtgtacttcacctgcagagctgagggcaaccccaagccagagatcatctggatccacaacaaccacagcctggacctggaggatgacacccggctgaatgtgtttgatgatggcaccctgatgatccggaacacccgggagagtgaccagggcgtgtaccagtgcatggccaggaacagcgctggggaggccaagacccagagcgccatgctgcgctacagcagcctgcctgccaagcccagctttgtgatccagccccaggacacagaggtgctgattggcaccagcaccaccctggagtgcatggccaccggccacccccaccccctcatcacctggacccgggacaatggcctggagctggatggcagccgccacgtggccaccagcagcggcctgtacctgcagaacatcacccagagggaccacggccgcttcacctgccacgccaacaacagccacggcaccgtgcaggccgccgccaacatcatcgtgcaggccccaccccagttcaccgtgacccccaaggaccaggtggtgctggaggagcacgctgtggagtggctgtgtgaggctgatggcaaccccccacctgtgattgtgtggaccaagacaggaggccagctgcctgtggagggccagcacacagtgctgagcagcggcaccctgagaattgaccgggccgcccagcacgaccagggccagtatgagtgccaggccgtgagcagcctgggcgtgaagaaggtgtctgtgcagctgactgtgaagcccaaggccctggccgtgttcacccagctgccccaggacacctctgtggaggtgggcaagaacatcaacatcagctgccacgcccagggcgagccccagcccatcatcacctggaacaaggagggcgtgcagatcacagagagcggcaagttccacgtggatgatgagggcaccctgaccatctatgatgctggcttcccagaccagggccgctatgaatgtgtggccagaaattcctttggcctggccgtgaccaacatgttcctgactgtgacagccatccagggccggcaggccggagatgactttgtggagagcagcatcctggatgctgtgcagagggtggacagcgccatcaacagcaccaggaggcacctgttcagccagaagccccacaccagcagtgacctgctggcccagttccactacccccgggaccccctgattgtggagatggcccgggccggggagatctttgagcacaccctgcagctgatccgggagcgggtgaagcagggcctgactgtggacctggagggcaaggagttccgctacaatgacctggtgagccccaggagcctgagcctgattgccaacctgagcggctgcacagcccggcggcccctgcccaactgcagcaaccgctgcttccacgccaagtaccgggcccatgatggcacctgcaacaacctgcagcagcccacctggggcgccgccctgacagcctttgcccggctgctgcagcctgcctacagagatggcatccgggccccccggggcctgggcctgcctgtgggcagccggcagcccctgcccccaccccggctggtggccaccgtgtgggcccgggctgctgctgtgaccccagaccacagctacaccaggatgctgatgcactggggctggttcctggagcatgacctggaccacacagtgcctgccctgagcacagcccgcttcagtgatggccggccctgcagctctgtgtgcaccaatgaccccccctgcttccccatgaacaccaggcatgctgacccccggggcacccacgccccctgcatgctgtttgcccggagcagccctgcctgtgccagcggccggcccagcgccaccgtggacagcgtgtatgcccgggagcagatcaaccagcagacagcctacattgatggcagcaatgtgtatggcagcagcgagcgggagagccaggccctgcgggaccccagcgtgccccggggcctgctgaagacaggcttcccctggcccccatctgggaagcccctgctgcccttcagcacaggccccccaacagaatgtgcccggcaggagcaggagagcccctgcttcctggccggggaccaccgggccaatgagcacctggccctggccgccatgcacaccctgtggttccgggagcacaacaggatggccacagagctgagcgccctgaacccccactgggagggcaacacagtgtaccaggaggccaggaagatcgtgggcgctgagctgcagcacatcacctacagccactggctgcccaaggtgctgggggaccccggcaccaggatgctgcggggctaccggggctacaaccccaacgtgaatgccggcatcatcaacagctttgccacagctgccttccgcttcggccacaccctcatcaaccccatcctgtaccgcctgaatgccaccctgggggagatcagcgagggccacctgcccttccacaaggccctcttcagccccagccgcatcatcaaggagggcggcattgatcctgtgctgcggggcctgtttggagtggccgccaagtggagggcccccagctacctgctgagccctgagctgacccagaggctcttctctgctgcctacagcgctgctgtggacagcgctgccaccatcatccagaggggccgggaccacggcatccccccctacgtggacttccgggtcttctgcaacctgacctctgtgaagaactttgaggacctgcagaatgagatcaaggacagcgagatccggcagaagctgaggaagctgtatggcagccctggggacatcgacctgtggccagccctgatggtggaggacctgatccctggcaccagggtgggccccaccctgatgtgcctgtttgtgacccagttccagaggctgagagatggagaccgcttctggtatgaaaatcctggggtcttcaccccagcccagctgacccagctgaagcaggccagcctgagccgggtgctgtgtgacaacggggacagcatccagcaggtgcaggctgatgtgtttgtgaaggccgagtacccccaggactacctgaactgcagcgagatccccaaggtggacctgcgggtgtggcaggactgctgtgccgactgccgcagccggggccagttccgggctgtgacccaggagagccagaagaagaggtctgcccagtacagctaccctgtggacaaggacatggagctgagccacctgcggagccggcagcaggacaagatctacgtgggggaggatgccagaaatgtgacagtgctggccaagaccaagttcagccaggacttcagcacctttgctgctgagatccaggagaccatcacagccctgcgggagcagatcaacaagctggaggcccggctgcggcaggccggctgcacagatgtgcggggcgtgcccaggaaggccgaggagcgctggatgaaggaggactgcacccactgcatctgtgagagcggccaggtgacctgtgtggtggagatctgccccccagccccctgccccagccctgagctggtgaagggcacctgctgccctgtgtgccgggaccggggcatgcccagcgacagccctgagaagaggtag

SEQ ID NO: 7308 - DNA, 1206 bp, Artificial Sequence
  Description of Artificial Sequence: Synthetic coding sequence
atgggcctgaaggccctgtgcctgggcctgctgtgtgtgctgtttgtgagccacttctacacccccatgccagacaacatcgaggagagctggaagatcatggccctggatgccatcgccaagacctgcaccttcaccgccatgtgctttgagaacatgaggatcatgagatatgaggagttcatctccatgatcttccggctggactacacccagcccctgagtgatgagtacatcaccgtgacagacaccacctttgtggacatccctgtgcggctgtacctgcccaagaggaagtctgagacccggcggcgggccgtcatctacttccatggaggcggcttctgcttcggcagcagcaagcagagggcctttgacttcctgaaccgctggacagccaacaccctggatgctgtggtggtgggcgtggactaccgcctggccccccagcaccacttccctgcccagtttgaagatggcctggccgctgtgaagttcttcctgctggagaagatcctgaccaagtatggagtggaccccacccgcatctgcatcgccggggacagcagcggcggcaacctggccacagctgtgacccagcaggtgcagaatgatgctgagatcaagcacaagatcaagatgcaggtgctgctgtacccaggcctgcagatcacagacagctacctgcccagccaccgggagaatgaacatggaattgtgctgaccagagatgtggccatcaagctggtgtccctgtacttcaccaaggatgaggccctgccctgggccatgagaagaaaccagcacatgcccctggagagccgccacctgttcaagtttgtgaactggagcatcctgctgcctgagaagtacaggaaggactatgtgtacacagagcccatcctgggcggcctgagctacagcctgcccggcctgacagacagccgggccctgcccctgctggccaatgacagccagctgcagaacctgcccctgacctacatcctgacctgccagcacgacctgctgagagatgatggcctgatgtatgtgacccggctgagaaatgtgggcgtgcaggtggtgcatgagcacattgaagatggcatccatggagccctgtccttcatgaccagccccttctacctgcggctgggcctgcgcatccgggacatgtatgtgtcctggctggacaagaacctgtag

SEQ ID NO: 7309 - DNA, 264 bp, Artificial Sequence; identical to SEQ ID NO: 7138
  Description of Artificial Sequence: Synthetic coding sequence

SEQ ID NO: 7310 - DNA, 813 bp, Artificial Sequence
  Description of Artificial Sequence: Synthetic coding sequence
atgaggggccagggcaggaaggagagcctgagtgacagccgggacctggatggcagctatgaccagctgaccggccaccccccaggccccaccaagaaggccctgaagcagcgcttcctgaagctgctgccctgctgcggcccccaggccctgcccagcgtgtctgagaccctggccgccccagccagcctgcggccccaccggccccggctgctggaccctgacagcgtggatgatgaatttgagctgagcacagtgtgccacaggcctgagggcctggagcagctgcaggagcagaccaagttcaccaggaaggagctgcaggtgctgtaccggggcttcaagaatgaatgtcccagcggcatcgtgaatgaggagaacttcaagcagatctacagccagttcttcccccagggcgacagcagcacctacgccaccttcctgttcaatgcctttgacaccaaccatgatggctctgtgtcctttgaagattttgtggccggcctgagcgtcatcctgcggggcaccgtggatgaccggctgaactgggccttcaacctgtatgacctgaacaaggatggctgcatcaccaaggaggagatgctggacatcatgaagagcatctatgacatgatgggcaagtacacctacccagccctgcgggaggaggccccccgggagcacgtggagagcttcttccagaagatggacaggaacaaggatggagtggtgaccatcgaggagttcatcgagagctgccagaaggatgagaacatcatgaggtccatgcagctgtttgacaacgtcatctag

SEQ ID NO: 7311 - DNA, 819 bp, Artificial Sequence
  Description of Artificial Sequence: Synthetic coding sequence
atgcacctgcggctcatctcctggctgttcatcatcctgaacttcatggagtacatcggcagccagaatgccagccggggccggcggcagaggaggatgcaccccaacgtgtcccagggctgccagggcggctgtgccacctgcagcgactacaacggctgcctgagctgcaagcccaggctcttctttgccctggagcgcatcggcatgaagcagattggagtgtgcctgagcagctgccccagcggctactacggcacccgctacccagacatcaacaagtgcaccaagtgcaaggctgactgtgacacctgcttcaacaagaacttctgcaccaagtgcaagagcggcttctacctgcacctgggcaagtgcctggacaactgcccagagggcctggaggccaacaaccacaccatggagtgtgtgtccatcgtgcactgtgaggtgtctgagtggaacccctggagcccctgcaccaagaagggcaagacctgtggcttcaagaggggcacagagaccagggtgcgggagatcatccagcaccccagcgccaagggcaacctgtgcccccccaccaatgagaccaggaagtgcaccgtgcagaggaagaagtgccagaagggggagcggggcaagaagggccgggagaggaagaggaagaagcccaacaagggggagagcaaggaggccatcccagacagcaagagcctggagagcagcaaggagatccctgagcagcgggagaacaagcagcagcagaagaagaggaaggtgcaggacaagcagaagtctgtgtctgtgtccacagtgcactag

SEQ ID NO: 7312 - DNA, 294 bp, Artificial Sequence
  Description of Artificial Sequence: Synthetic coding sequence
atggccaagagcttccctgtgttcagcctgctgtccttcatcctgatccacctggtgctgagctctgtgtctggccccaggcactggtggccaccccggggcatcatcaaggtgaagtgcccctatgagaaggtgaacctgtcctggtacaatggaacagtgaacccctgccccggcctgtaccagcccatctgtggcaccaacttcatcacctatgacaacccctgcatcctgtgtgtggagagcctgaagagccacggccgcatccgcttctaccatgatggcaagtgctag

SEQ ID NO: 7313 - DNA, 726 bp, Artificial Sequence; identical to SEQ ID NO: 7000
  Description of Artificial Sequence: Synthetic coding sequence

SEQ ID NO: 7314 - DNA, 1827 bp, Artificial Sequence
  Description of Artificial Sequence: Synthetic coding sequence
atggcccgggcccgggccggggccctgctggccctgtgggtgctgggcgccgccgcccacccccagtgcctggacttccggccccccttccggcccacccagcccctgcggctgtgtgcccagtacagcgactttggctgctgtgatgagggcagagatgctgagctgacccggcgcttctgggccctggccagccgggtggatgctgctgagtgggccgcctgtgccggctacgcccgggacctgctgtgccaggagtgcagcccctatgctgcccacctgtatgatgctgaggaccccttcacccccctgaggacagtgcccggcctgtgccaggactactgcctggacatgtggcacaagtgccggggcctcttccgccacctgagcacagaccaggagctgtgggccctggagggcaacctggcccgcttctgccgctacctgagcctggatgacacagactactgcttcccctacctgctggtgaacaagaacctgaacagcaacctgggccacgtggtggctgatgccaagggctgcctgcagctgtgcctggaggaggtggccaacggcctgaggaaccctgtggccatggtgcacgccagagatggcacccaccgcttctttgtggccgagcaggtgggcctggtgtgggcctacctgcctgacaggagccggctgggcaagcccttcctgaacatcagccgggtggtgctgaccagcccctgggagggagatgagcggggcttcctgggcatcgccttccaccccagcttccagcacaacagaaggctgtatgtgtactacagcgtgggcatccgcagcagcgagtggatccgcatcagcgagttccgggtgtctgaagatgatgaaaatgctgtggaccacagcagcgagcgcatcatcctggaggtgaaggagcccgccagcaaccacaacggcggccagctgctgtttggagatgatggctacctgtacatcttcaccggagatggcggcatggccggggaccccttcggcacctttggaaatgcccagaacaagagcgccctgctgggcaaggtgctgagaattgatgtggacaggaaggagcggggcctgccctacggcatccccccagacaacccctttgtgggggaccctgctgcccagcctgaggtgtatgccctgggcgtgaggaacatgtggcgctgcagctttgacagaggagaccccagcagcggcaccggccggggccgcctcttctgtggagatgtgggccagaacaagtttgaggaggtggatgtggtggagcggggcggcaactacggctggagggcccgggagggctttgagtgctatgacaggagcctgtgtgccaacaccagcctgaatgacctgctgcccatctttgcctacccccacacagtgggcaagtctgtgactggaggctacgtgtaccggggctgtgagtaccccaacctgaatggcctgtacatctttggagacttcatgagcggccgcctgatgagcctgcaggagaaccctggcaccggccagtggcagtacagcgagatctgcatgggccacggccagacctgtgagttccctggcctcatcaacaactactacccctacatcatcagctttggagaagatgaagctggggagctgtacttcatgagcactggagagcccagcgccacagccccccggggcgtggtgtacaagatcattgatgccagcagctgcaaggcccggagcgccatgcctggctacgtgcctgcccccagcgtgtgcagcagcctgaccagccagcccttcatcctgcagtggtggaagtag

SEQ ID NO: 7315 - DNA, 351 bp, Artificial Sequence
  Description of Artificial Sequence: Synthetic coding sequence
atggcccctccttctgtgcccctggtgctgctgctggtgctgctgctgagcctggccgagaccccagccagcgccccagcccaccggggccggggcggctggaccctgaacagcgctggctacctgctgggccctgtgctgcacctgccccagatgggagaccaggacggcaagcgggagacagccctggagatcctggacctgtggaaggccattgatggcctgccctacagccaccccccccagcccagcaagagaaatgtgatggagacctttgccaagccagaaattggagacctgggcatgctgtccatgaagatccccaaggaggaggatgtgctgaagagctag

SEQ ID NO: 7316 - DNA, 3618 bp, Artificial Sequence
  Description of Artificial Sequence: Synthetic coding sequence
atgaggaagcccaggaggaagagccggcagaatgctgagggcagaagaagccccagcccctacagcctgaagtgcagccccacccgggagaccctgacctacgcccaggcccagagaattgtggaggtggacattgatggccgcctgcaccgcatcagcatctatgaccccctgaagatcatcacagaagatgagctgacagcccaggacatcacagagtgcaacagcaacaaggaaaattctgagcagccccagtttcctgggaagagcaagaagcccagcagcaagggcaagaagaaggagagctgcagcaagcacgccagcggcaccagcttccacctgccccagcccagcttcaggatggtggacagcggcatccagcctgaggccccacccctgcctgctgcctactaccgctacatcgagaagcccccagaggacctggatgctgaggtggagtatgacatggatgaggaggacctggcctggctggacatggtgaatgagaagagaagagtggatggccacagcctggtgtctgctgacacctttgagctgctggtggaccggctggagaaggagagctacctggagagccgcagcagcggggcccagcagagcctgattgatgaagatgccttctgctgcgtgtgcctggatgatgagtgccacaacagcaatgtcatcctcttctgtgacatctgcaacctggccgtgcaccaggagtgctacggcgtgccctacatccctgagggccagtggctgtgccgctgctgcctgcagagccccagcaggcctgtggactgcatcctgtgccccaacaagggcggggccttcaagcagaccagtgatggccactgggcccacgtggtgtgtgccatctggatccctgaggtgtgctttgccaacacagtgttcctggagcccatcgagggcatcgacaacatccccccagcccgctggaagctgacctgctacatctgcaagcagaagggcctgggcgccgccatccagtgccacaaggtgaactgctacacagccttccacgtgacctgtgcccagagagctggcctcttcatgaagattgagcccatgagggagaccagcctgaatggcaccatcttcaccgtgaggaagacagcctactgtgaggcccacagccccccaggagctgccacagcccggaggaaaggagacagccccaggagcatcagcgagactggagatgaggagggcctgaaggagggagatggagaggaggaggaggaggaggaggtggaggaggaggagcaggaggcccagggcggcgtgtctggcagcctgaagggcgtgcccaagaagagcaagatgagcctgaagcagaagatcaagaaggagcctgaggaggccggccaggacacccccagcaccctgcccatgctggccgtgccccagatccccagctaccgcctgaacaagatctgcagcggcctgtccttccagaggaagaaccagttcatgcagaggctgcacaactactggctgctgaagaggcaggccagaaatggagtgcccctcatccggcggctgcacagccacctgcagagccagagaaatgctgagcagcgggagcaggatgagaagaccagcgctgtgaaggaggagctgaagtactggcagaagctgcggcatgacctggagcgggcccggctgctgattgagctgatcaggaagcgggagaagctgaagcgggagcaggtgaaggtgcagcaggccgccatggagctggagctgatgcccttcaacgtgctgctgcggaccaccctggacctgctgcaggagaaggaccctgcccacatctttgctgagcctgtgaacctgtctgaggtgcctgactacctggagttcatcagcaagcccatggacttcagcaccatgaggaggaagctggagagccacctgtaccgcaccctggaggagtttgaggaggacttcaacctgattgtgaccaactgcatgaagtacaatgccaaggacaccatcttccacagagctgctgtgcggctgcgggacctgggcggggccatcctgcggcatgcccggcggcaggccgagaacatcggctatgaccctgagcggggcacccacctgcctgagagccccaagctggaggacttctaccgcttctcctgggaggatgtggacaacatcctgatccctgagaacagagcccacctgagccctgaggtgcagctgaaggagctgctggagaagctggacctggtgtctgccatgaggagcagcggggcccggacccggcgggtgcggctgctgcggcgggagatcaatgccctgcggcagaagctggcccagcccccaccaccccagccccccagcctgaacaagacagtgtccaatggagagctgcctgctggcccccagggagatgctgctgtgctggagcaggccctgcaggaggagccagaagatgatggagacagagatgacagcaagctgcccccaccacccaccctggagcccactggacctgcccccagcctgtctgagcaggagagccccccagagccccccaccctgaagcccatcaatgacagcaagccacccagccgcttcctgaagcccaggaaggtggaggaggatgagctgctggagaagagccccctgcagctgggcaatgagcccctgcagaggctgctgagtgacaatggcatcaaccggctgagcctgatggccccagacaccccagctggcacccccctgtctggagtgggccgccgcacctctgtgctcttcaagaaggccaagaatggagtgaagctgcagaggagcccagacagagtgctggagaatggagaggaccacggcgtggccggcagccctgccagccctgccagcattgaggaggagcggcacagcaggaagaggcccaggagccgcagctgcagcgagagcgagggggagaggagcccccagcaggaggaggagaccggcatgaccaacggctttgggaagcacacagagagcggcagtgacagtgaatgttccctgggcctgagcggcggcctggcctttgaggcctgcagcggcctgaccccacccaagaggagccggggcaagccagccctgagccgggtgcccttcctggagggcgtgaatggagacagcgactacaacggcagcggccgcagcctgctgctgccctttgaagatagaggagacctggagcccctggagctggtgtgggccaagtgccggggctaccccagctacccagccctgatcatcgaccccaagatgccccgggagggcctgctgcacaatggagtgcccatccctgtgccccccctggatgtgctgaagctgggggagcagaagcaggccgaggccggggagaagctgttcctggtgctcttctttgacaacaagaggacctggcagtggctgccccgggacaaggtgctgcccctgggcgtggaggacacagtggacaagctgaagatgctggagggcaggaagaccagcatcaggaagtctgtgcaggtggcctatgaccgggccatgatccacctgagccgggtgcggggcccccacagctttgtgaccagcagctacctgtag

SEQ ID NO: 7317 - DNA, 1977 bp, Artificial Sequence
  Description of Artificial Sequence: Synthetic coding sequence
atgtttgtgtcctacctgatcctgaccctgctgcacgtgcagacagctgtgctggcccggcctggaggagagagcatcggctgtgatgactacctgggcagtgacaaggtggtggacaagtgtggggtgtgtggcggggacaacacaggctgccaggtggtgtctggagtcttcaagcacgccctgaccagcctgggctaccaccgggtggtggagatccctgagggcgccaccaagatcaacatcacagagatgtacaagagcaacaactacctggccctgcggagccgcagcggccgcagcatcatcaatggaaactgggccatcgacaggcctgggaagtatgaaggaggcggcaccatgttcacctacaagaggcccaatgagatcagcagcacagctggggagagcttcctggccgagggccccaccaatgagatcctggatgtgtacatgatccaccagcagcccaaccctggggtgcactatgaatatgtgatcatgggcaccaatgccatcagcccccaggtgcccccccacagaagacctggagagcccttcaacggccagatggtgacagagggccgcagccaggaggagggggagcagaagggcagaaatgaggagaaggaggacctgcggggggaggcccctgagatgttcaccagcgagagcgcccagaccttccctgtgcgccacccagaccgcttcagcccccacaggccagacaacctggtgcccccagccccccagcccccccggcgcagccgggaccacaactggaagcagctgggcaccacagagtgcagcaccacctgtgggaagggcagccagtaccccatcttccgctgtgtgcacaggagcacccatgaggaggcccctgagagctactgtgacagctccatgaagcccaccccagaggaggagccctgcaacatcttcccctgcccagccttctgggacatcggggagtggagcgaatgttccaagacctgtggcctgggcatgcagcaccggcaggtgctgtgccggcaggtgtatgccaacagaagcctgactgtgcagccctaccgctgccagcacctggagaagccagagaccaccagcacctgccagctgaagatctgcagcgagtggcagatcagaacagactggaccagctgcagcgtgccctgtggggtgggccagaggaccagagatgtgaagtgtgtgagcaacattggagatgtggtggatgatgaggagtgcaacatgaagctgcggcccaatgacatcgagaactgtgacatgggcccctgtgccaagtcctggttcctgacagagtggagcgagcgctgcagcgcagaatgtggggccggcgtgaggaccaggtctgtggtgtgcatgaccaaccacgtgagcagcctgcccctggagggctgcggcaacaacagacctgctgaggccaccccctgtgacaatggcccctgcaccgggaaggtggagtggtttgctggctcctggagccagtgcagcattgaatgtggcagcggcacccagcagcgggaggtgatctgtgtgaggaagaatgctgacacctttgaggtgctggaccccagcgagtgcagcttcctggagaagccacccagccagcagagctgccacctgaagccctgtggggccaagtggttcagcacagagtggagcatgtgcagcaagagctgccagggcggcttccgggtgcgggaggtgcgctgcctgagtgatgacatgaccctgagcaacctgtgtgacccccagctgaagccagaggagcgggagagctgcaacccccaggactgtgtgcctgaggtggatgagaactgcaaggacaagtactacaactgcaatgtggtggtgcaggcccggctgtgtgtgtacaactactacaagacagcctgctgtgccagctgcaccagggtggccaaccggcagacaggcttcctgggcagcaggtag

SEQ ID NO: 7318 - DNA, 708 bp, Artificial Sequence
  Description of Artificial Sequence: Synthetic coding sequence
atgaggcccctggccggcggcctgctgaaggtggtgtttgtggtgtttgccagcctgtgtgcctggtacagcggctacctgctggccgagctgatcccagatgcccccctgagcagcgctgcctacagcatccgcagcattggagagaggcctgtgctgaaggcccctgtgcccaagaggcagaagtgtgaccactggaccccctgccccagcgacacctacgcctaccgcctgctgagcggcggcggccgcagcaaatatgccaagatctgctttgaggacaacctgctgatgggagagcagctgggcaatgtggcccggggcatcaacatcgccatcgtgaactacgtgactggaaatgtgacagccacccgctgctttgacatgtatgaaggagacaacagcggccccatgaccaagttcatccagagcgctgcccccaagagcctgctcttcatggtgacctatgatgatggcagcacccggctgaacaatgatgccaagaatgccatcgaggccctgggcagcaaggagatccggaacatgaagttccgcagctcctgggtgttcatcgccgccaagggcctggagctgcccagcgagatccagcgggagaagatcaaccacagtgatgccaagaacaaccgctacagcggctggccagctgagatccagatcgagggctgcatccccaaggagaggagctag

SEQ ID NO: 7319 - DNA, 759 bp, Artificial Sequence
  Description of Artificial Sequence: Synthetic coding sequence
atgaggggccagggcaggaaggagagcctgagtgacagccgggacctggatggcagctatgaccagctgaccggccaccccccaggccccaccaagaaggccctgaagcagcgcttcctgaagctgctgccctgctgcggcccccaggccctgcccagcgtgtctgagaacagcgtggatgatgaatttgagctgagcacagtgtgccacaggcctgagggcctggagcagctgcaggagcagaccaagttcaccaggaaggagctgcaggtgctgtaccggggcttcaagaatgaatgtcccagcggcatcgtgaatgaggagaacttcaagcagatctacagccagttcttcccccagggcgacagcagcacctacgccaccttcctgttcaatgcctttgacaccaaccatgatggctctgtgtcctttgaagattttgtggccggcctgagcgtcatcctgcggggcaccgtggatgaccggctgaactgggccttcaacctgtatgacctgaacaaggatggctgcatcaccaaggaggagatgctggacatcatgaagagcatctatgacatgatgggcaagtacacctacccagccctgcgggaggaggccccccgggagcacgtggagagcttcttccagaagatggacaggaacaaggatggagtggtgaccatcgaggagttcatcgagagctgccagaaggatgagaacatcatgaggtccatgcagctgtttgacaacgtcatctag

SEQ ID NO: 7320 - DNA, 312 bp, Artificial Sequence
  Description of Artificial Sequence: Synthetic coding sequence
atgagcggccggggcaagggcggcaagggcctgggcaaaggaggagccaagaggcacaggaaggtgctgcgggacaacatccagggcatcaccaagccagccatccggcggctggcccggcggggcggcgtgaagaggatcagcggcctcatctatgaggagacccggggcgtgctgaaggtgttcctggagaatgtcatcagagatgctgtgacctacacagagcacgccaagaggaagacagtgacagccatggatgtggtgtatgccctgaagaggcagggccgcaccctgtatggctttggaggatag

SEQ ID NO: 7321 - DNA, 3120 bp, Artificial Sequence
  Description of Artificial Sequence: Synthetic coding sequence
atggaggtgacagctgtggccacccagggcggctacggcagcagtgactgggtgaccagctacctgctgatgttcagtgatggcggcaggaactggaagcagtaccgccgggaggagagcatctggggcttccctggcaacaccaatgctgacagcgtggtgcactaccgcctgcagcccccatttgaggcccgcttcctgcgcttcctgcccctggcctggaacccccggggccgcatcggcatgagaattgaggtgtatggctgtgcctacaagtctgaggtggtgtactttgatggccagagcgccctgctgtaccgcctggacaagaagcccctgaagcccatcagagatgtgatcagcctgaagttcaaggccatgcagagcaatggcatcctgctgcaccgggagggccagcacggcaaccacatcaccctggagctgatcaagggcaagctggtgttcttcctgaacagcggaaatgccaagctgcccagcaccatcgcccctgtgaccctgaccctgggcagcctgctggatgaccagcactggcacagcgtgctgattgagctgctggacacccaggtgaacttcaccgtggacaagcacacccaccacttccaggccaagggggacagcagctacctggacctgaactttgagatcagctttggaggcatccccaccccaggccgcagccgggccttccggaggaagagcttccacggctgcctggagaacctgtactacaatggagtggatgtgacagagctggccaagaagcacaagccccagatcctgatgatgggaaatgtgtccttcagctgcccccagccccagacagtgcctgtgaccttcctgagcagccgcagctacctggccctgcccggcaacagcggggaggacaaggtgtctgtgaccttccagttccgcacctggaacagagctggccacctgctgtttggagagctgcggcggggcagcggcagctttgtgctcttcctgaaggatggcaagctgaagctgagcctcttccagcccggccagagccccagaaatgtgacagctggggccggcctgaatgatggccagtggcacagcgtgtccttcagcgccaagtggagccacatgaatgtggtggtggatgatgacacagctgtgcagcccctggtggccgtgctgattgattctggggacacctactactttggaggctgcctggacaacagcagcggcagcggctgcaagagccccctgggcggcttccagggctgcctgcggctcatcaccatcggggacaaggctgtggaccccatcctggtgcagcagggcgccctgggcagcttccgggacctgcagattgacagctgtggcatcacagaccgctgcctgcccagctactgtgagcacggcggagaatgttcccagagctgggacaccttcagctgtgactgcctgggcaccggctacacaggagagacctgccacagcagcctgtatgagcagagctgtgaggcccacaagcaccggggcaaccccagcggcctgtactacattgatgctgatggcagcggccccctgggccccttcctggtgtactgcaacatgacagcagatgctgcctggacagtggtgcagcacggcggcccagatgctgtgaccctgcggggggcccccagcggccaccccaggtctgctgtgtcctttgcctatgctgctggagctggccagctgcggtctgctgtgaacctggccgagcgctgtgagcagaggctggccctgcgctgtggcacagcccggcggccagacagcagagatggcacccccctgtcctggtgggtgggccgcaccaatgagacccacacctcctggggcggcagcctgcctgatgcccagaagtgcacctgtggcctggagggcaactgcatcgacagccagtactactgcaactgtgatgctggaagaaatgagtggaccagtgacaccatcgtgctgagccagaaggagcacctgcctgtgacccagatcgtgatgacagatgctggccggccccacagcgaggccgcctacaccctgggccccctgctgtgccgcggggaccagagcttctggaacagcgccagcttcaacacagagaccagctacctgcacttccctgccttccacggggagctgacagcagatgtgtgcttcttcttcaagaccaccgtgtcctctggagtcttcatggagaacctgggcatcacagacttcatccgcatcgagctgcgggcccccacagaggtgaccttctcctttgatgtgggcaatggcccctgtgaggtgacagtgcagagccccacccccttcaatgacaaccagtggcaccacgtgcgggcagagagaaatgtgaagggggccagcctgcaggtggaccagctgccccagaagatgcagcctgccccagcagatggccacgtgcggctgcagctgaacagccagctgttcatcggcggcacagccacccggcagaggggcttcctgggctgcatccgcagcctgcagctgaatggagtggccctggacctggaggagcgggccaccgtgaccccaggagtggagcccggctgtgccggccactgcagcacctacggccacctgtgcagaaatggaggccgctgccgggagaagagaagaggagtgacctgtgactgtgccttcagcgcctatgatggccccttctgcagcaatgagatcagcgcctactttgccaccggcagctccatgacctaccacttccaggagcactacaccctgtctgagaacagcagcagcctggtgagcagcctgcacagagatgtgaccctgacccgggagatgatcaccctgtccttccgcaccaccaggacccccagcctgctgctgtatgtgagcagcttctatgaggagtacctgagcgtcatcctggccaacaacggcagcctgcagatccgctacaagctggacagacaccagaacccagatgccttcacctttgacttcaagaacatggctgatggccagctgcaccaggtgaagatcaaccgggaggaggccgtggtgatggtggaggtgatcccccagatgcagaagagcaactag

SEQ ID NO: 7322 - DNA, 1257 bp, Artificial Sequence
  Description of Artificial Sequence: Synthetic coding sequence
atgaggagcctgctgctgctgagcgccttctgcctgctggaggccgccctggccgctgaggtgaagaagccagctgctgctgctgcccctggaacagctgagaagctgagccccaaggccgccaccctggccgagaggtctgctggcctggccttcagcctgtaccaggccatggccaaggaccaggccgtggagaacatcctggtgtcccctgtggtggtggccagcagcctgggcctggtgtccctgggcggcaaggccaccacagccagccaggccaaggctgtgctgtctgctgagcagctgagagatgaggaggtgcatgctggcctgggggagctgctgcggagcctgagcaacagcacagccagaaatgtgacctggaagctgggcagccggctgtatggccccagctctgtgtcctttgctgatgactttgtgcgcagcagcaagcagcactacaactgtgagcacagcaagatcaacttccgggacaagaggtctgccctgcagagcatcaatgagtgggccgcccagaccacagatggcaagctgcctgaggtgaccaaggatgtggagaggacagatggagccctgctggtgaatgccatgttcttcaagccccactgggatgagaagttccaccacaagatggtggacaacagaggcttcatggtgaccaggagctacacagtgggcgtgatgatgatgcacaggacaggcctgtacaactactatgatgatgagaaggagaagctgcagatcgtggagatgcccctggcccacaagctgagcagcctcatcatcctgatgccccaccacgtggagcccctggagcggctggagaagctgctgaccaaggagcagctgaagatctggatgggcaagatgcagaagaaggctgtggccatcagcctgcccaagggcgtggtggaggtgacccatgacctgcagaagcacctggccggcctgggcctgacagaggccatcgacaagaacaaggctgacctgagcaggatgtctgggaagaaggacctgtacctggccagcgtcttccacgccacagcctttgagctggacacagatggcaacccctttgaccaggacatctacggccgggaggagctgcggagccccaagctgttctacgccgaccaccccttcatcttcctggtgcgggacacccagagcggcagcctgctcttcatcggccgcctggtgcggcccaagggggacaagatgagagatgagctgtag

SEQ ID NO: 7323 - DNA, 378 bp, Artificial Sequence
  Description of Artificial Sequence: Synthetic coding sequence
atgcagctgctgaaggccctgtgggccctggccggggccgccctgtgctgcttcctggtgctggtgatccacgcccagttcctgaaggagggccagctggccgccggcacctgtgagatcgtgaccctggaccgggacagcagccagcccaggaggaccatcgcccggcagacagcccgctgtgcctgcaggaagggccagattgctggcaccacccgggcccggcctgcctgtgtggatgcccgcatcatcaagaccaagcagtggtgtgacatgctgccctgcctggagggggagggctgtgacctgctgatcaacagaagtggctggacctgcacccagcccggcggccgcatcaagaccaccaccgtgtcctag

SEQ ID NO: 7324 - DNA, 5859 bp, Artificial Sequence
  Description of Artificial Sequence: Synthetic coding sequence
atgcctgccctgggccctgccctgctgcaggccctgtgggccggctgggtgctgaccctgcagcccctgcccccaacagccttcaccccaaatggcacctacctgcagcacctggcccgggaccccaccagcggcaccctgtacctgggcgccaccaacttcctgttccagctgagccctggcctgcagctggaggccaccgtgtccacaggccctgtgctggacagccgggactgcctgccccctgtgatgccagatgaatgtccccaggcccagcccaccaacaaccccaaccagctgctgctggtgtcccctggggccctggtggtgtgtggctctgtgcaccagggcgtgtgtgagcagaggcggctgggccagctggagcagctgctgctgcggcctgagaggcctggggacacccagtatgtggccgccaatgaccctgctgtgtccacagtgggcctggtggcccagggcctggccggggagcccctgctgtttgtgggccggggctacaccagccggggcgtgggcggcggcatcccccccatcaccacccgggccctgtggcccccagacccccaggccgccttctcctatgaggagacagccaagctggccgtgggccgcctgtctgagtacagccaccactttgtgtctgcctttgcccggggggccagcgcctacttcctgttcctgcggcgggacctgcaggcccagagccgggccttccgggcctacgtgtcccgggtgtgcctgcgggaccagcactactacagctatgtggagctgcccctggcctgtgagggcggccgctatggcctcatccaggccgctgctgtggccaccagccgggaggtggcccatggagaggtgctgtttgctgccttcagcagcgctgccccacccaccgtgggccggccccccagcgctgctgctggggccagcggggccagcgccctgtgtgccttccccctggatgaggtggaccggctggccaacagaacaagagatgcctgctacacccgggagggccgggcagaagatggaacagaggtggcctacatcgagtatgatgtgaacagcgactgtgcccagctgcctgtggacaccctggatgcctacccctgtggcagtgaccacacccccagccccatggccagccgggtgcccctggaggccacccccatcctggagtggccaggcatccagctgacagctgtggccgtgaccatggaggatggccacaccatcgccttcctgggggacagccagggccagctgcaccgggtgtacctgggccctggcagtgatggccacccctacagcacccagagcatccagcagggcagcgctgtgtcccgggacctgacctttgatggcacctttgagcacctgtatgtgatgacccagagcaccctgctgaaggtgcctgtggccagctgtgcccagcacctggactgtgccagctgcctggcccaccgggacccctactgcggctggtgtgtgctgctgggccgctgcagccgccgctcagaatgttcccggggccagggccctgagcagtggctgtggagcttccagcctgagctgggctgcctgcaggtggccgccatgagccctgccaacatcagccgggaggagacccgggaggtgttcctgtctgtgcctgacctgccccccctgtggccaggagagagctacagctgccactttggagagcaccagagccctgccctgctgaccggcagcggcgtgatgtgccccagcccagaccccagcgaggcccctgtgctgcccagaggagctgactatgtgtctgtgtctgtggagctgcgctttggagctgtggtgattgccaagaccagcctgtccttctatgactgtgtggccgtgacagagctgcggcccagcgcccagtgccaggcctgtgtgagcagccgctggggctgcaactggtgtgtgtggcagcacctgtgcacccacaaggccagctgtgatgctggccccatggtggccagccaccagagccccctggtgtccccagaccccccagcccggggagatggagacagcgctgagctggagggccccccagcccccctcatcctgcccagcagcctggactaccagtatgacaccccaggcctgtgggagctggaggaggccaccctgggcgccagcagctgcccctgtgtggagagcgtgcagggcagcaccctgatgcctgtgcacgtggagcgggagatccggctgctgggcaggaacctgcacctgttccaggacggccctggggacaatgaatgtgtgatggagctggagggcctggaggtggtggtggaggcccgggtggagtgtgagcccccaccagacacccagtgccacgtgacctgccagcagcaccagctgtcctatgaggccctgcagcctgagctgcgggtgggcctcttcctgcggcgggccggccgcctgcgggtggacagcgctgagggcctgcacgtggtgctgtatgactgcagcgtgggccatggagactgcagccgctgccagacagccatgccccagtatggctgtgtgtggtgtgagggggagcggccccgctgtgtgacccgggaggcctgtggggaggccgaggccgtggccacccagtgcccagcccccctcatccacagcgtggagcccctgaccggccctgtggatggcggcaccagggtgaccatccggggcagcaacctgggccagcacgtgcaggatgtgctgggcatggtgacagtggccggcgtgccctgtgctgtggatgcccaggagtatgaggtgagcagcagcctggtgtgcatcactggagccagcggggaggaggtggccggggccacagctgtggaggtgcccggccggggccggggcgtgtctgaacatgactttgcctaccaggaccccaaggtgcacagcatcttccctgcccggggcccccgggccggcggcacccggctgaccctgaatggcagcaagctgctgaccggccgcctggaggacatccgggtggtggtgggggaccagccctgccacctgctgcctgagcagcagagcgagcagctgcgctgtgagaccagcccccggcccaccccagccaccctgcctgtggccgtgtggtttggagccacagagcggcggctgcagaggggccagttcaagtacaccctggaccccaacatcaccagcgctggccccaccaagagcttcctgagcggcggccgggagatctgtgtgcggggccagaacctggatgtggtgcagaccccccgcatccgggtgacagtggtgtccaggatgctgcagcccagccagggcctgggcagaagaagaagagtggtgcctgagacagcctgcagcctgggccccagctgcagcagccagcagtttgaggagccctgccacgtgaacagcagccagctgatcacctgcaggaccccagccctgcccggcctgcctgaggacccctgggtgcgggtggagttcatcctggacaacctggtgtttgattttgccaccctgaaccccacccccttctcctatgaagctgaccccaccctgcagcccctgaaccctgaggaccccaccatgcccttccgccacaagccaggctctgtgttttctgtggagggggagaacctggacctggccatgagcaaggaggaggtggtggccatgattggagatggcccctgtgtggtgaagaccctgaccaggcaccacctgtactgtgagccccctgtggagcagcccctgcccaggcaccacgccctgcgggaggccccagacagcctgcctgagttcaccgtgcagatgggcaacctgcgcttcagcctgggccacgtgcagtatgatggagagagccctggggccttccctgtggccgcccaggtgggcctgggcgtgggcaccagcctgctggccctgggcgtcatcatcatcgtgctgatgtacagaaggaagagcaagcaggccctgcgggactacaagaaggtgcagatccagctggagaacctggagagctctgtgcgggaccgctgcaagaaggagttcacagacctgatgacagagatgacagacctgaccagtgacctgctgggcagcggcatccccttcctggactacaaggtgtatgcagagcgcatcttcttccctggccaccgggagagccccctgcaccgggacctgggcgtgcctgagagccggcggcccaccgtggagcagggcctgggccagctgagcaacctgctgaacagcaagctgttcctgaccaagttcatccacaccctggagagccagaggaccttcagcgcccgggaccgggcctacgtggccagcctgctgactgtggccctgcacggcaagctggagtacttcacagacatcctgcggaccctgctgagtgacctggtggcccagtatgtggccaagaaccccaagctgatgctgcggaggacagagaccgtggtggagaagctgctgaccaactggatgagcatctgcctgtacacctttgtgcgggacagcgtgggggagcccctgtacatgctgttccggggcatcaagcaccaggtggacaagggccctgtggacagcgtgacaggcaaggccaagtacaccctgaatgacaaccggctgctgagagaagatgtggagtaccggcccctgaccctgaatgccctgctggccgtgggccctggggccggggaggcccagggcgtgcctgtgaaggtgctggactgtgacaccatcagccaggccaaggagaagatgctggaccagctgtacaagggcgtgcccctgacccagaggccagaccccaggaccctggatgtggagtggaggtctggagtggccggccacctgatcctgagtgatgaagatgtgaccagcgaggtgcagggcctgtggaggcggctgaacaccctgcagcactacaaggtgcctgatggagccaccgtggccctggtgccctgcctgaccaagcacgtgctgcgggagaaccaggactatgtgcctggagagaggacccccatgctggaggatgtggatgagggcggcatccggccctggcacctggtgaagcccagtgatgagcctgagcccccccggccccggcggggcagcctgcggggcggggagcgggagcgggccaaggccatccctgagatctacctgacccggctgctgtccatgaagggcaccctgcagaagtttgtggatgacctcttccaggtgatcctgagcaccagcaggcctgtgcccctggccgtgaagtacttctttgacctgctggatgagcaggcccagcagcacggcatcagtgaccaggacaccatccacatctggaagaccaacagcctgcccctgcgcttctggatcaacatcatcaagaacccccagtttgtgtttgatgtgcagaccagtgacaacatggatgctgtgctgctggtgattgcccagaccttcatggatgcctgcaccctggccgaccacaagctgggccgggacagccccatcaacaagctgctgtatgcccgggacatcccccgctacaagaggatggtggagcgctactatgctgacatccggcagacagtgcctgccagtgaccaggagatgaacagcgtgctggccgagctgtcctggaactacagcggggacctgggcgcccgggtggccctgcacgagctgtacaagtacatcaacaagtactatgaccagatcatcacagccctggaggaggatggaacagcccagaagatgcagctgggctaccgcctgcagcagattgctgctgctgtggagaacaaggtgacagacctgtag

SEQ ID NO: 7325 - DNA, 342 bp, Artificial Sequence
  Description of Artificial Sequence: Synthetic coding sequence
atgctggtgctcttcctgctgggcaccgtcttcctgctgtgcccctactggggcgagctgcatgaccccatcaaggccacagagatcatgtgctatgagtgcaagaagtaccacctgggcctgtgctatggagtgatgaccagctgcagcctgaagcacaagcagagctgtgctgtggagaacttctacatcctgaccaggaagggccagagcatgtaccactacagcaagctgagctgcatgaccagctgtgaggacatcaacttcctgggcttcaccaagagggtggagctgatctgctgtgaccacagcaactactgcaacctgcctgagggcgtgtag

SEQ ID NO: 7326 - DNA, 6408 bp, Artificial Sequence; identical to SEQ ID NO: 7028
  Description of Artificial Sequence: Synthetic coding sequence

SEQ ID NO: 7327 - DNA, 390 bp, Artificial Sequence
  Description of Artificial Sequence: Synthetic coding sequence
atgaggcccctgaagccaggggcccccctgcctgccctcttcctgctggccctggccctgagcccccatggagcccacggccggccccggggccggcggggggcccgggtgacagacaaggagcccaagcccctgctcttcctgcctgctgctggagctggccgcacccccagcggcagccgctctgctgagatcttcccccgggacagcaacctgaaggacaagttcatcaagcacttcaccggccctgtgaccttctccccagaatgttccaagcacttccaccggctgtactacaacaccagagaatgttccaccccagcctactacaagagatgtgcccggctgctgacccggctggccgtgagccccctgtgcagccagacctag

SEQ ID NO: 7328 - DNA, 252 bp, Artificial Sequence
  Description of Artificial Sequence: Synthetic coding sequence
atgaggctgtctgtgtgcctgctgatggtgtccctggccctgtgctgctaccaggcccacgccctggtgtgcccagctgtggccagcgagatcaccgtcttcctgttcctgagtgatgctgctgtgaacctgcaggtggccaagctgaaccccccacctgaggccctggccgccaagctggaggtgaagcactgcacagaccagatctccttcaagaagaggctgagcctgaagaagtcctggtggaagtag

SEQ ID NO: 7329 - DNA, 1455 bp, Artificial Sequence; identical to SEQ ID NO: 7137
  Description of Artificial Sequence: Synthetic coding sequence

SEQ ID NO: 7330 - DNA, 159 bp, Artificial Sequence
  Description of Artificial Sequence: Synthetic coding sequence
atgaagctgtgtgtgacagtgctgagcctgctggtgctggtggccgccttctgcagcctggccctgagcgcccccagcaacaagcccctggaggccagcaagagcgccctgacccctgtgtccccaggcagccgcagcacctgcatgacctggaactag

SEQ ID NO: 7331 - DNA, 675 bp, Artificial Sequence
  Description of Artificial Sequence: Synthetic coding sequence
atgagggtgtctggagtgctgcggctgctggccctgatctttgccatcgtgaccacctggatgttcatccgcagctacatgtccttctccatgaagaccatccggctgccccgctggctggccgccagccccaccaaggagatccaggtgaagaagtacaagtgtggcctcatcaagccctgcccagccaactactttgccttcaagatctgcagcggggccgccaacgtggtgggccccaccatgtgctttgaggacaggatgatcatgagccctgtgaagaacaacgtgggccggggcctgaacatcgccctggtgaatggcaccaccggggctgtgctgggccagaaggcctttgacatgtacagcggagatgtgatgcacctggtgaagttcctgaaggagatccctggaggagccctggtgctggtggccagctatgatgaccccggcaccaagatgaatgatgagagcaggaagctgttcagtgacctgggcagcagctatgccaagcagctgggcttccgggacagctgggtgttcatcggggccaaggacctgcggggcaagagcccctttgagcagttcctgaagaacagcccagacaccaacaagtatgagggctggccagagctgctggagatggagggctgcatgccacccaagcccttctag

SEQ ID NO: 7332 - DNA, 1404 bp, Artificial Sequence
  Description of Artificial Sequence: Synthetic coding sequence
atgctgatcttctggaccatcaccctcttcctgctgggcgccgccaagggcaaggaggtgtgctatgaggacctgggctgcttcagtgacacagagccctggggcggcacagccatccggcccctgaagatcctgccctggagccctgagaagattggcacccgcttcctgctgtacaccaatgaaaaccccaacaacttccagatcctgctgctgagtgaccccagcaccatcgaggccagcaacttccagatggacaggaagacccgcttcatcatccacggcttcatcgacaagggagatgagagctgggtgacagacatgtgcaagaagctgtttgaggtggaggaggtgaactgcatctgtgtggactggaagaagggcagccaggccacctacacccaggccgccaacaacgtgcgggtggtgggcgcccaggtggcccagatgctggacatcctgctgacagagtacagctacccacccagcaaggtgcacctgattggccacagcctgggcgcccacgtggccggggaggccggcagcaagaccccaggcctgagccgcatcaccggcctggaccctgtggaggccagctttgagagcaccccagaggaggtgcggctggaccccagtgatgctgactttgtggatgtgatccacacagatgctgcccccctcatccccttcctgggcttcggcaccaaccagcagatgggccacctggacttcttccccaatggaggagagagcatgcctggctgcaagaagaatgccctgagccagatcgtggacctggatggcatctgggccggcacccgggactttgtggcctgcaaccacctgcggagctacaagtactacctggagagcatcctgaacccagatggctttgctgcctacccctgcaccagctacaagagctttgaaagtgacaagtgcttcccctgcccagaccagggctgcccccagatgggccactatgctgacaagtttgctggccgcaccagcgaggagcagcagaagttcttcctgaacacaggagaggccagcaactttgcccgctggaggtatggagtgtccatcaccctgagcggccgcacagccaccggccagatcaaggtggccctgtttggaaataaaggaaacacccaccagtacagcatcttccggggcatcctgaagccaggcagcacccacagctatgaatttgatgccaagctggatgtgggcaccatcgagaaggtgaagttcctgtggaacaacaacgtcatcaaccccaccctgcccaaggtgggcgccaccaagatcaccgtgcagaagggggaggagaagacagtgtacaacttctgcagtgaagatactgtgcgggaggacaccctgctgaccctgaccccctgctag

SEQ ID NO: 7333 - DNA, 237 bp, Artificial Sequence
  Description of Artificial Sequence: Synthetic coding sequence
atgggcagcggcctgcccctggtgctgctgctgaccctgctgggcagcagccacggcaccggccctggcatgaccctgcagctgaagctgaaggagagcttcctgaccaacagcagctatgagagcagcttcctggagctgctggagaagctgtgcctgctgctgcacctgcccagcggcacctctgtgaccctgcaccacgcccggagccagcaccacgtggtgtgcaacacctag

SEQ ID NO: 7334 - DNA, 291 bp, Artificial Sequence
  Description of Artificial Sequence: Synthetic coding sequence
atggagcacaaggaggtggtgctgctgctgctgctcttcctgaagagcggccagggcgagcccctggatgattatgtgaacacccagggccccagcctcttctctgtgaccaagaagcagctgggcgccggcagccgggaggagtgtgccgccaagtgtgaggaggacaaggagttcacctgccgggccttccagtaccacagcaaggagcagcagtgtgtgatcatggccgagaacaggaagagcagcatcatcatccgcatgagagatgctgtgctgtttgagaagtag

SEQ ID NO: 7335 - DNA, 1083 bp, Artificial Sequence
  Description of Artificial Sequence: Synthetic coding sequence
atgggcctgctgctgctggtgcccctgctgctgctgcccggcagctatggcctgcccttctacaacggcttctactacagcaacagcgccaatgaccagaacctgggcaatggacatggcaaggacctgctgaatggagtgaagctggtggtggagaccccagaggagaccctcttcacctaccagggcgccagcgtcatcctgccctgccgctaccgctatgagcccgccctggtgagcccccggcgggtgcgggtgaagtggtggaagctgtctgaaaatggagcccctgagaaggatgtgctggtggccatcggcctgcggcacaggagctttggagactaccagggccgggtgcacctgcggcaggacaaggagcatgatgtgtccctggagatccaggacctgcggctggaggactatggccgctaccgctgtgaggtgattgatggcctggaggatgagagcggcctggtggagctggagctgcggggcgtggtgttcccctaccagagccccaacggccgctaccagttcaacttccacgagggccagcaggtgtgtgccgagcaggccgctgtggtggccagctttgagcagctgttccgggcctgggaggagggcctggactggtgcaatgccggctggctgcaggatgccaccgtgcagtaccccatcatgctgccccggcagccctgtggcggccctggcctggcccctggggtgcgctcctatggccccaggcaccggcggctgcacagatatgatgtgttctgctttgccacagccctgaagggccgggtgtactacctggagcaccctgagaagctgaccctgacagaggcccgggaggcctgccaggaggatgatgccaccatcgccaaggtgggccagctgtttgctgcctggaagttccacggcctggacagatgtgatgctggctggctggctgatggctctgtgcgctaccctgtggtgcacccccaccccaactgtggccccccagagcccggggtgcgcagctttggcttcccagacccccagagccggctgtatggagtgtactgctaccggcagcactag

SEQ ID NO: 7336 - DNA, 810 bp, Artificial Sequence
  Description of Artificial Sequence: Synthetic coding sequence
atgatccgcaccctgctgctgagcaccctggtggccggggccctgagctgtggggaccccacctacccaccctacgtgaccagggtggtgggcggggaggaggcccggcccaacagctggccctggcaggtgtccctgcagtacagcagcaatggcaagtggtaccacacctgtggcggcagcctgattgccaacagctgggtgctgacagctgcccactgcatcagcagcagcaggacctacagagtgggcctgggccgccacaacctgtatgtggccgagagcggcagcctggccgtgtctgtgtccaagatcgtggtgcacaaggactggaacagcaaccagatcagcaaaggaaatgacatcgccctgctgaagctggccaaccctgtgtccctgacagacaagatccagctggcctgcctgcccccagctggcaccatcctgcccaacaactacccctgctacgtgacaggctggggccgcctgcagaccaacggggctgtgcctgatgtgctgcagcagggccgcctgctggtggtggactatgccacctgcagcagcagcgcctggtggggcagctctgtgaagacctccatgatctgtgctggaggagatggagtcatcagcagctgcaatggagacagcggcggccccctgaactgccaggccagtgatggccgctggcaggtgcacggcatcgtgtcctttggcagccggctgggctgcaactactaccacaagcccagcgtcttcaccagggtgagcaactacatcgactggatcaacagcgtcatcgccaacaactag

SEQ ID NO: 7337 - DNA, 1122 bp, Artificial Sequence
  Description of Artificial Sequence: Synthetic coding sequence
atgctgccctggctgctggtgttttctgccctgggcatccaggcctggggagacagctcctggaacaagacccaggccaagcaggtgtctgagggcctgcagtacctgtttgagaacatcagccagctgacagagaagggcctgcccacagatgtgtccaccaccgtgtccaggaaggcctggggcgctgaggccgtgggctgcagcatccagctgaccacccctgtgaatgtgctggtgatccaccacgtgcccggcctggagtgccacgaccagacagtgtgcagccagaggctgcgggagctgcaggcccaccacgtgcacaacaacagcggctgtgatgtggcctacaacttcctggtgggagatgatggccgggtgtatgagggcgtgggctggaacatccagggcgtgcacacccagggctacaacaacatcagcctgggctttgccttcttcggcaccaagaagggccacagccccagccctgctgccctgagcgccatggagaacctgatcacctatgctgtgcagaagggccacctgagcagcagctatgtgcagcccctgctgggcaaaggagagaactgcctggccccccggcagaagaccagcctgaagaaggcctgccctggggtggtgcccaggtctgtgtggggcgcccgggagacccactgccccaggatgaccctgcctgccaagtatggcatcatcatccacacagctggccgcacctgcaacatcagtgatgaatgtcggctgctggtgcgggacatccagagcttctacatcgaccggctgaagagctgtgacatcggctacaacttcctggtgggccaggatggagccatctatgaaggagtgggctggaatgtgcagggcagcagcaccccaggctatgatgacatcgccctgggcatcaccttcatgggcaccttcaccggcatccccccaaatgctgctgccctggaggccgcccaggacctgatccagtgtgccatggtgaagggctacctgacccccaactacctgctggtgggccacagtgatgtggcccggaccctgagccctggccaggccctgtacaacatcatcagcacctggccccacttcaagcactag

SEQ ID NO: 7338 - DNA, 327 bp, Artificial Sequence
  Description of Artificial Sequence: Synthetic coding sequence
atgaggcagaggctgctgcccagcgtgaccagcctgctgctggtggccctgctcttccctggcagcagccaggcccggcacgtgaaccacagcgccacagaggccctgggggagctgcgggagcgggcccctggccagggcaccaacggcttccagctgctgcggcatgctgtgaagagggacctgctgccccccaggaccccaccctaccagggagatgtgcccccaggcatccggaacaccatctgccacatgcagcagggcatctgccgcctcttcttctgccacagcggcaccggccagcagcaccggcagagatgtggctag

SEQ ID NO: 7339 - DNA, 708 bp, Artificial Sequence
  Description of Artificial Sequence: Synthetic coding sequence
atgagcccccccctgctgaagctgggcgctgtgctgagcaccatggccatgatcagcaactggatgagccagaccctgcccagcctggtgggcctgaacaccacccggctgagcaccccagacaccctgacccagatcagccccaaggagggctggcaggtgtacagcagcgcccaggaccctgatggccgctgcatctgcaccgtggtggcccctgagcagaacctgtgcagcagagatgccaagagccggcagctgcggcagctgctggagaaggtgcagaacatgagccagagcattgaggtgctgaacctgcggacccagagggacttccagtatgtgctgaagatggagacccagatgaagggcctgaaggccaagttccggcagattgaagatgacaggaagaccctgatgaccaagcacttccaggagctgaaggagaagatggatgagctgctgcccctcatccctgtgctggagcagtacaagacagatgccaagctgatcacccagttcaaggaggagatccggaacctgtctgctgtgctgaccggcatccaggaggagattggagcctatgactatgaggagctgcaccagagggtgctgagcctggagacccggctgcgggactgcatgaagaagctgattgacctgaagaagaggaaggaggaggagaagaggcagcagaagggggaggcctag

SEQ ID NO: 7340 - DNA, 606 bp, Artificial Sequence
  Description of Artificial Sequence: Synthetic coding sequence
atgaacctgaactgccccccctgtgtgacaggcctgcgggtgtggagcagctgccgcagcaagcccaacagccgggcccggagctgccgcagctgcacaggagccagcaggaccctgcccagccaccacatgagccacgtggagtgccccagcggcatcgtgaatgaggagaacttcaagcagatctacagccagttcttcccccagggcgacagcagcacctacgccaccttcctgttcaatgcctttgacaccaaccatgatggctctgtgtcctttgaggactttgtggccggcctgagcgtcatcctgcggggcaccgtggatgaccggctgaactgggccttcaacctgtatgacctgaacaaggatggctgcatcaccaaggaggagatgctggacatcatgaagagcatctatgacatgatgggcaagtacacctacccagccctgcgggaggaggccccccgggagcacgtggagagcttcttccagaagatggacaggaacaaggatggagtggtgaccatcgaggagttcatcgagagctgccagaaggatgagaacatcatgaggtccatgcagctgtttgacaacgtcatctag

SEQ ID NO: 7341 - DNA, 693 bp, Artificial Sequence
  Description of Artificial Sequence: Synthetic coding sequence
atgaggctggccggccccctgagaattgtggtgctggtggtgtctgtgggcgtgacctggatcgtggtgtccatcctgctgggcggccctggcagcggcttcccccgcatccagcagctgttcaccagccctgagagctctgtgacagctgccccccgggccaggaagtacaagtgtggcctgccccagccctgcccagaggagcacctggccttccgggtggtgtctggggccgccaacgtcatcggccccaagatctgcctggaggacaagatgctgatgagctctgtgaaggacaacgtgggccggggcctgaacatcgccctggtgaatggagtgtctggagagctgattgaggcccgggcctttgacatgtgggccggagatgtgaatgacctgctgaagttcatccggcccctgcacgagggcaccctggtgtttgtggccagctatgatgatcctgccaccaagatgaatgaggagaccaggaagctgttcagcgagctgggcagcagaaatgccaaggagctggccttccgggacagctgggtgtttgtgggcgccaagggcgtgcagaacaagagcccctttgagcagcacgtgaagaacagcaagcacagcaacaagtatgagggctggccagaggccctggagatggagggctgcatccccaggaggagcacagccagctag

SEQ ID NO: 7342 - DNA, 684 bp, Artificial Sequence
  Description of Artificial Sequence: Synthetic coding sequence
atgagggtggccggggccgccaagctggtggtggccgtggccgtgttcctgctgaccttctacgtgatcagccaggtgtttgagatcaagatggatgccagcctgggcaacctgtttgcccggagcgccctggacacagctgcccggagcaccaagcccccacgctacaagtgtggcatcagcaaggcctgcccagagaagcactttgccttcaagatggccagcggggccgccaacgtggtgggccccaagatctgcctggaggacaacgtgctgatgtctggagtgaagaacaacgtgggccggggcatcaacgtggccctggccaacgggaagacaggagaggtgctggacaccaagtactttgacatgtggggcggagatgtggcccccttcatcgagttcctgaaggccatccaggacggcaccatcgtgctgatgggcacctatgatgatggagccaccaagctgaatgatgaggcccggcggctgattgctgacctgggcagcaccagcatcaccaacctgggcttccgggacaactgggtgttctgtggcggcaagggcatcaagaccaagagcccctttgagcagcacatcaagaacaacaaggacaccaacaagtatgagggctggccagaggtggtggagatggagggctgcatcccccagaagcaggactag

SEQ ID NO: 7343 - DNA, 1656 bp, Artificial Sequence
  Description of Artificial Sequence: Synthetic coding sequence
atggaggacagcgacagcgctgccaagcagctgggcctggccgaggccgctgctgctggaggagaggccgaggagcctgtgctgagcagagatgaggacagcgaggaggatgctgacagcgaggccgagcgggagaccccccgggtgacagctgtggccgtgatggctgctgagcccggccacatggacatgggcgctgaggccctgcccggcccagatgaagctgctgctgctgctgcctttgctgaggtgaccaccgtgacagtggccaacgtgggcgctgctgctgacaacgtgttcaccacctctgtggccaatgctgccagcatcagcggccacgtgctgagcggccgcacagccctgcagattggagacagcctgaacacagagaaggccaccctgattgtggtgcacacagatggcagcatcgtggagaccaccggcctgaagggccctgctgcccccctgaccccaggcccccagagcccccccacccccctggcccctggccaggagaagggcggcaccaagtacaactgggaccccagcgtgtatgattctgagctgcctgtgcgctgcaggaacatcagcggcaccctgtacaagaaccggctgggcagcggcggccggggccgctgcatcaagcagggcgagaactggtacagccccacagaatttgaggccatggccggccgggccagcagcaaggactggaagaggagcatccgctatgccggccggcccctgcagtgcctgatccaggacggcatcctgaacccccacgccgccagctgcacctgtgccgcctgctgtgatgacatgaccctgagcggccctgtgcggctgtttgtgccctacaagaggaggaagaaggaaaatgagctgcccaccacccctgtgaagaaggacagccccaagaacatcaccctgctgcctgccacagctgccaccaccttcaccgtgacccccagcggccagatcaccaccagcggggccctgacctttgaccgggccagcacagtggaggccacagctgtgatcagcgagagccctgcccagggagatgtgtttgctggggccaccgtgcaggaggcctctgtgcagcccccctgccgggccagccaccctgagccccactacccaggctaccaggacagctgccagatcgcccccttccctgaggccgccctgcccaccagccaccccaagatcgtgctgaccagcctgcctgccctggccgtgcccccacccacccccaccaaggccgcccccccagccctggtgaatggcctggagctgtctgagcccaggtcctggctgtacctggaggagatggtgaacagcctgctgaacacagcccagcagctgaagaccctgtttgagcaggccaagcacgccagcacctaccgggaggccgccaccaaccaggccaagatccatgctgatgctgagaggaaggagcagagctgtgtgaactgtggccgggaggccatgtctgagtgcaccggctgccacaaggtgaactactgcagcaccttctgccagaggaaggactggaaggaccaccagcacatctgtggccagagcgctgctgtgacagtgcaggctgatgaggtgcacgtggccgagagcgtgatggagaaggtgacagtgtag

SEQ ID NO: 7344 - DNA, 2022 bp, Artificial Sequence
  Description of Artificial Sequence: Synthetic coding sequence
atgaagccaggcggcttctggctgcacctgaccctgctgggcgccagcctgcctgctgccctgggctggatggaccccggcaccagccggggcccagatgtgggcgtgggggagagccaggccgaggagcccaggagctttgaggtgacccggcgggagggcctgagcagccacaatgagctgctggccagctgtgggaagaagttctgcagccggggcagccgctgtgtgctgagcctggccccagaagatagagtgtctgtgaccaccgtgacagtgggcctgagcacagtgctgacctgtgctgtgcacggggacctgcggccccccatcatctggaagagaaatggcctgaccctgaacttcctggacctggaggacatcaatgactttggagaagatgacagcctgtacatcaccaaggtgaccaccatccacatgggcaactacacctgccacgccagcggccacgagcagctgttccagacccacgtgctgcaggtgaatgtgccccctgtgatccgggtgtacccagagagccaggcccaggagcccggggtggccgccagcctgcgctgccacgccgagggcatccccatgccccgcatcacctggctgaagaatggagtggatgtgtccacccagatgagcaagcagctgagcctgctggccaatggaagtgagctgcacatcagctctgtgcgctatgaagatactggagcctacacctgcatcgccaagaatgaggtgggcgtggatgaggacatcagcagcctcttcatcgaggacagcgccaggaagaccctggccaacatcctgtggagggaggagggcctgtctgtgggcaacatgttctacgtgttcagtgatgatggcatcatcgtcatccaccctgtggactgtgagatccagaggcacctgaagcccacagagaagatcttcatgtcctatgaggagatctgcccccagcgggagaagaatgccacccagccctgccagtgggtgtctgctgtgaatgtgaggaaccgctacatctacgtggcccagcctgccctgagccgggtgctggtggtggacatccaggcccagaaggtgctgcagagcattggagtggaccccctgcctgccaagctgtcctatgacaagagccatgaccaggtgtgggtgctgtcctggggagatgtgcacaagagccggcccagcctgcaggtgatcacagaggccagcacaggccagagccagcacctgatccgcaccccatttgctggggtggatgacttcttcatcccccccaccaacctgatcatcaaccacatccgcttcggcttcatcttcaacaagagtgaccctgctgtgcacaaggtggacctggagaccatgatgcccctgaagaccatcggcctgcaccaccacggctgtgtgccccaggccatggcccacacccacctgggcggctacttcttcatccagtgccggcaggacagccctgccagcgctgcccggcagctgctggtggacagcgtgacagattctgtgctgggccccaatggagatgtgacaggcaccccccacaccagcccagatggccgcttcatcgtgtctgctgctgctgacagcccctggctgcacgtgcaggagatcaccgtgcggggggagatccagaccctgtatgacctgcagatcaacagcggcatcagtgacctggccttccagaggagcttcacagagagcaaccagtacaacatctatgctgccctgcacacagagccagacctgctcttcctggagctgagcacaggcaaggtgggcatgctgaagaacctgaaggagcccccagctggccctgcccagccctggggcggcacccaccgcatcatgagggacagcggcctgtttggccagtacctgctgaccccagcccgggagagcctcttcctgatcaatggccggcagaacaccctgcgctgtgaggtgtctggcatcaagggcggcaccaccgtggtgtgggtgggggaggtgtag

SEQ ID NO: 7345 - DNA, 2007 bp, Artificial Sequence
  Description of Artificial Sequence: Synthetic coding sequence
atggacctggtgctgaagcgctgcctgctgcacctggccgtgattggagccctgctggccgtgggcgccaccaaggtgcccaggaaccaggactggctgggcgtgtcccggcagctgcggaccaaggcctggaaccggcagctgtacccagagtggacagaggcccagaggctggactgctggaggggcggccaggtgtccctgaaggtgtccaatgatggccccaccctcatcggggccaatgccagcttcagcatcgccctgaacttccctggcagccagaaggtgctgcctgatggccaggtgatctgggtgaacaacaccatcatcaatggagaccaggtgtggggcggccagcctgtgtacccccaggagacagatgatgcctgcatcttcccagatggcggcccctgccccagcggctcctggagccagaagaggagctttgtgtatgtgtggaagacctggggccagtactggcaggtgctgggcggccctgtgtctggcctgagcatcggcaccggccgggccatgctgggcacccacaccatggaggtgacagtgtaccacagaagaggcagccgctcctatgtgcccctggcccacagcagcagcgccttcaccatcacagaccaggtgcccttctctgtgtctgtgtcccagctgcgggccctggatggcggcaacaagcacttcctgaggaaccagcccctgacctttgccctgcagctgcatgaccccagcggctacctggccgaggccgacctgagctacacctgggactttggagacagcagcggcaccctcatcagccgggccctggtggtgacccacacctacctggagcccggccctgtgacagcccaggtggtgctgcaggccgccatccccctgaccagctgtggcagcagccctgtgcccggcaccacagatggccaccggcccacagctgaggcccccaacaccacagctggccaggtgcccaccacagaggtggtgggcaccaccccaggccaggcccccacagctgagcccagcggcaccacctctgtgcaggtgcccaccacagaggtgatcagcacagcccctgtgcagatgcccacagctgagagcacaggcatgaccccagagaaggtgcctgtgtctgaggtgatgggcaccaccctggccgagatgagcaccccagaggccaccggcatgaccccagctgaggtgtccatcgtggtgctgagcggcaccacagctgcccaggtgaccaccacagagtgggtggagaccacagcccgggagctgcccatccctgagcctgagggcccagatgccagcagcatcatgagcacagagagcatcaccggcagcctgggccccctgctggatggaacagccaccctgcggctggtgaagaggcaggtgcccctggactgtgtgctgtaccgctatggcagcttctctgtgaccctggacatcgtgcagggcattgaatctgctgagatcctgcaggccgtgcccagcggggagggagatgcctttgagctgactgtgtcctgccagggcggcctgcccaaggaggcctgcatggagatcagcagccctggctgccagcccccagcccagaggctgtgccagcctgtgctgcccagccctgcctgccagctggtgctgcaccagatcctgaagggcggcagcggcacctactgcctgaatgtgtccctggccgacaccaacagcctggccgtggtgtccacccagctgatcatgcctgtgcccggcatcctgctgaccggccaggaggccggcctgggccaggtgcccctcatcgtgggcatcctgctggtgctgatggctgtggtgctggccagcctcatctacagaagaaggctgatgaagcaggacttctctgtgccccagctgccccacagcagcagccactggctgcggctgccccgcatcttctgcagctgccccatcggggagaacagccccctgctgagcggccagcaggtgtag

SEQ ID NO: 7346 - DNA, 1746 bp, Artificial Sequence
  Description of Artificial Sequence: Synthetic coding sequence
atgcagcaggacggcctgggcgtgggcaccagaaatggcagcggcaagggccgctctgtgcaccccagctggccctggtgtgccccccggcccctgcgctacttcggcagagatgcccgggcccggcgggcccagacagctgccatggccctgctggccggcggcctgagccggggcctgggcagccaccctgctgctgctggaagagatgctgtggtgtttgtgtggctgctgctgagcacctggtgcacagccccagcccgggccatccaggtgacagtgagcaacccctaccacgtggtgatcctcttccagcctgtgaccctgccctgcacctaccagatgaccagcacccccacccagcccatcgtcatctggaagtacaagagcttctgccgggacagaattgctgatgccttcagccctgcctctgtggacaaccagctgaatgcccagctggccgccggcaaccctggctacaacccctacgtggagtgccaggacagcgtgaggacagtgcgggtggtggccaccaagcagggcaatgctgtgaccctgggggactactaccagggccgccgcatcaccatcactggaaatgctgacctgacctttgaccagacagcctggggagacagcggcgtgtactactgcagcgtggtgtctgcccaggacctgcagggcaacaatgaggcctatgcagagctgattgtgctggtgtatgctgctgggaaggccgccaccagcggcgtgcccagcatctatgcccccagcacctacgcccacctgagccctgccaagaccccacctcctccagccatgatccccatgggccctgcctacaacggctacccaggcggctacccaggagatgtggacaggagcagcagcgctgggggccagggcagctatgtgcccctgctgcgggacacagacagctctgtggccagcgaggtgcgcagcggctaccgcatccaggccagccagcaggatgacagcatgagggtgctgtactacatggagaaggagctggccaactttgaccccagccggcccggcccccccagcggccgggtggagcgggccatgtctgaggtgaccagcctgcatgaagatgactggaggagccggcccagccggggccctgccctgacccccatcagagatgaggagtggggcggccacagccccaggagcccccggggctgggaccaggagcccgcccgggagcaggccggcggcggctggagggcccggcggccccgggcccggtctgtggatgccctggatgacctgaccccacccagcacagctgagagcggcagccgcagccccaccagcaatggaggccgcagccgggcctacatgccacccaggagccgcagcagagatgacctgtatgaccaggatgacagccgggacttccccaggagccgggacccccactatgatgacttccgcagccgggagcggcccccagctgaccccaggagccaccaccacaggacccgggacccccgggacaatggcagccgcagcggggacctgccctatgatggccgcctgctggaggaggccgtgaggaagaagggcagcgaggagcggcggcggccccacaaggaggaggaggaggaggcctactaccccccagcccccccaccctacagcgagacagacagccaggccagccgggagcggcggctgaagaagaacctggccctgagccgggagagcctggtggtgtag

SEQ ID NO: 7347 - DNA, 1959 bp, Artificial Sequence
  Description of Artificial Sequence: Synthetic coding sequence
atgcccccacccctgcccctgctgctgctgactgtgctggtggtggccgccgcccggcccggctgtgaatttgagaggaacccagctggggagtgccacaggcctcctgctgctgacagcgccacctgtgtggacctgcagctgcggacctgcagtgatgctgcctacaaccacaccaccttccccaacctgctgcagcaccgctcctgggaggtggtggaggccagcagcgagtacatcctgctgtctgtgctgcaccagctgctggagggccagtgcaacccagacctgcggctgctgggctgtgctgtgctggccccccgctgtgagggcggctgggtgagaagaccctgccgccacatctgtgagggcctgcgggaggtgtgccagcctgcctttgatgccatcgacatggcctggccctacttcctggactgccaccgctacttcaccagagaagatgagggctgctatgaccccctggagaagctgcggggcggcctggaggctgatgaggccctgcccagcggcctgccccccaccttcatccgcttcagccaccacagctatgcccagatggtgcgggtgctgcggaggacagccagccgctgtgcccacgtggcccggacctacagcatcggccgcagctttgatggccgggagctgctggtgattgagttcagcagcaggcctggccagcacgagctgatggagcctgaggtgaagctgattggcaacatccacggcaatgaggtggccggccgggagatgctgatctacctggcccagtacctgtgcagcgagtacctgctgggcaacccccgcatccagaggctgctgaacaccacccgcatccacctgctgcccagcatgaacccagatggctatgaggtggccgctgctgagggcgccggctacaacggctggaccagcggccggcagaatgcccagaacctggacctgaacagaaacttcccagacctgaccagcgagtactaccgcctggccgagaccaggggggcccggagtgaccacatccccatcccccagcactactggtggggcaaggtggcccctgagaccaaggccatcatgaagtggatgcagaccatcccctttgtgctgagcgccagcctgcacggcggggacctggtggtgtcctacccctttgacttcagcaagcacccccaggaggagaagatgttcagccccaccccagatgagaagatgttcaagctgctgagccgggcctatgcagatgtgcaccccatgatgatggacagaagtgagaacagatgtggcggcaacttcctgaagaggggcagcatcatcaatggagctgactggtacagcttcaccggcggcatgtctgacttcaactacctgcacaccaactgctttgagatcaccgtggagctgggctgtgtgaagtttcctcctgaggaggccctgtacatcctgtggcagcacaacaaggagagcctgctgaactttgtggagaccgtgcaccggggcatcaagggcgtggtgacagacaagtttgggaagcctgtgaagaatgcccgcatctctgtgaagggcatcagacatgacatcaccacagccccagatggagactactggaggctgctgcccccaggcatccacatcgtcatcgcccaggcccctggctacgccaaggtgatcaagaaggtgatcatcccagccaggatgaagagagctggccgggtggacttcatcctgcagcccctgggcatgggccccaagaacttcatccacggcctgcggaggacaggcccccatgaccccctgggcggggccagcagcctgggggaggccacagagccagaccccctgcgggcccggcggcagcccagcgcagatggcagcaagccctggtggtggagctacttcaccagcctgagcacccaccggccccgctggctgctgaagtactag

SEQ ID NO: 7348 - DNA, 279 bp, Artificial Sequence
  Description of Artificial Sequence: Synthetic coding sequence
atgaagctgtgtgtgacagtgctgagcctgctggtgctggtggccgccttctgcagcctggccctgagcgcccccatgggcagtgaccccccaacagcctgctgcttctcctacacagccaggaagctgcccaggaactttgtggtggactactatgagaccagcagcctgtgcagccagcctgctgtggtgggcttcctgggcaggaagggcaagcaggtgtgtgccgaccccagcgagagctgggtgcaggagtatgtgtatgacctggagctgtag

SEQ ID NO: 7349 - DNA, 249 bp, Artificial Sequence
  Description of Artificial Sequence: Synthetic coding sequence
atgaggcagaggctgctgcccagcgtgaccagcctgctgctggtggccctgctcttccctggcagcagccaggcccggcacgtgaaccacagcgccacagaggccctgggggagctgcgggagcgggcccctggccagggcaccaacggcttccagctgctgcggcatgctgtgaagagggacctgctgccccccaggaccccaccctaccagggcaccggccagcagcaccggcagagatgtggctag

SEQ ID NO: 7350 - DNA, 411 bp, Artificial Sequence
  Description of Artificial Sequence: Synthetic coding sequence
atggacaacgtgcagcccaagatcaagcaccggcccttctgcttctctgtgaagggccacgtgaagatgctgcggctggccctgactgtgacctccatgaccttcttcatcatcgcccaggcccctgagccctacatcgtcatcactggatttgaggtgaccgtcatcctcttcttcatcctgctgtatgtgctgcggctggaccggctgatgaagtggctgttctggcccctgctggacatcatcaacagcctggtgaccaccgtcttcatgctgattgtgtctgtgctggccctgatccctgagaccaccaccctgactgtgggcggcggcgtgtttgccctggtgacagctgtgtgctgcctggctgatggagccctgatctacaggaagctgctcttcctgaggtag

SEQ ID NO: 7351 - DNA, 1068 bp, Artificial Sequence
  Description of Artificial Sequence: Synthetic coding sequence
atgcagctgaccacctgcctgcgggagaccctcttcaccggggccagccagaagaccagcctgtggtggctgggcatcgccagctttggagtgcctgagaagctgggctgtgccaacctgcccctgaacagccggcagaaggagctgtgcaagaggaagccctacctgctgcccagcatccgggagggcgcccggctgggcatccaggagtgtggcagccagttcagacatgagcgctggaactgcatgatcacagctgctgccaccacagcccccatgggcgccagccccctgtttggctatgagctgagcagcggcaccaaggagacagccttcatctatgctgtgatggctgctggcctggtgcacagcgtgaccaggagctgcagcgctggcaacatgacagagtgcagctgtgacaccaccctgcagaatggaggcagcgccagcgagggctggcactggggcggctgcagtgatgatgtgcagtatggcatgtggttcagcaggaagttcctggacttccccatcggcaacaccaccgggaaggagaacaaggtgctgctggccatgaacctgcacaacaatgaggccggccggcaggccgtggccaagctgatgtctgtggactgccgctgccacggcgtgtctggcagctgtgctgtgaagacctgctggaagaccatgagcagctttgagaagattggccacctgctgaaggacaagtatgagaacagcatccagatcagtgacaagaccaagaggaagatgagaagaagagagaaggaccagaggaagatccccatccacaaggatgacctgctgtatgtgaacaagagccccaactactgtgtggaggacaagaagctgggcatccctggcacccagggccgggagtgcaacagaaccagcgagggcgcagatggctgcaacctgctgtgctgcggccggggctacaacacccacgtggtgcgccacgtggagcgctgtgagtgcaagttcatctggtgctgctacgtgcgctgcagaagatgtgagagcatgacagatgtgcacacctgcaagtag

SEQ ID NO: 7352 - DNA, 2916 bp, Artificial Sequence
  Description of Artificial Sequence: Synthetic coding sequence
atgctgcggcggcctgccccagccctggccccagctgcccggctgctgctggccggcctgctgtgtggcggcggcgtgtgggccgcccgggtgaacaagcacaagccctggctggagcccacctaccatggaattgtgacagaaaatgacaacacagtgctgctggaccccccactcatcgccctggacaaggatgcccccctgcgctttgctggggagatctgtggcttcaagatccacggccagaatgtgccctttgatgctgtggtggtggacaagagcactggagagggcgtcatccgcagcaaggagaagctggactgtgagctgcagaaggactacagcttcaccatccaggcctatgactgtgggaaaggaccagatggcaccaacgtgaagaagagccacaaggccaccgtgcacatccaggtgaatgatgtgaatgaatatgcccctgtgttcaaggagaagagctacaaggccaccgtcatcgagggcaagcagtatgacagcatcctgcgggtggaggccgtggatgctgactgcagcccccagttcagccagatctgcagctatgagatcatcaccccagatgtgcccttcaccgtggacaaggatggctacatcaagaacacagagaagctgaactacggcaaggagcaccagtacaagctgactgtgacagcctatgactgtgggaagaagagggccacagaagatgtgctggtgaagatcagcatcaagcccacctgcaccccaggctggcagggctggaacaaccgcatcgagtatgagcccggcaccggggccctggccgtgttccccaacatccacctggagacctgtgatgagcctgtggcctctgtgcaggccaccgtggagctggagaccagccacatcggcaagggctgtgaccgggacacctacagcgagaagagcctgcaccggctgtgtggggctgctgctggaacagctgagctgctgcccagccccagcggcagcctgaactggaccatgggcctgcccacagacaatggacatgacagcgaccaggtgtttgagttcaacggcacccaggccgtgcgcatcccagatggagtggtgtctgtgagccccaaggagcccttcaccatctctgtgtggatgagacatggcccctttggaaggaagaaggagaccatcctgtgcagcagtgacaagacagacatgaacagacaccactacagcctgtatgtgcacggctgccgcctcatcttcctgttccggcaggaccccagcgaggagaagaagtacagacctgctgagttccactggaagctgaaccaggtgtgtgatgaggagtggcaccactacgtgctgaatgtggagttccccagcgtgaccctgtatgtggatggcaccagccatgagcccttctctgtgacagaggactaccccctgcaccccagcaagattgagacccagctggtggtgggcgcctgctggcaggagttctctggagtggagaatgacaatgaaacagagcctgtgacagtggccagcgctggaggagacctgcacatgacccagttcttccggggcaacctggccggcctgaccctgcggagcggcaagctggccgacaagaaggtgattgactgcctgtacacctgcaaggagggcctggacctgcaggtgctggaggacagcggccggggcgtgcagatccaggcccaccccagccagctggtgctgaccctggagggggaggacctgggggagctggacaaggccatgcagcacatctcctacctgaacagccggcagttccccaccccaggcatccggcggctgaagatcaccagcaccatcaagtgcttcaatgaggccacctgcatctctgtgccccctgtggatggctacgtgatggtgctgcagcctgaggagcccaagatcagcctgagcggcgtgcaccactttgcccgggccgccagcgagtttgagagcagcgagggcgtcttcctgtttcctgagctgcgcatcatcagcaccatcacccgggaggtggagccagaaggagatggagctgaggaccccaccgtgcaggagagcctggtgtctgaggagatcgtgcatgacctggacacctgtgaggtgacagtggagggggaggagctgaaccacgagcaggagagcctggaggtggacatggcccggctgcagcagaagggcatcgaggtgagcagcagcgagctgggcatgaccttcaccggggtggacaccatggccagctatgaggaggtgctgcacctgctgcgctacagaaactggcacgcccggagcctgctggacaggaagttcaagctgatctgcagcgagctgaatggccgctacatcagcaatgagttcaaggtggaggtgaatgtcatccacacagccaaccccatggagcacgccaaccacatggccgcccagccccagtttgtgcaccctgagcacaggagctttgtggacctgagcggccacaacctggccaacccccacccctttgctgtggtgcccagcacagccaccgtggtgattgtggtgtgtgtgtccttcctggtgttcatgatcatcctgggcgtcttccgcatccgggccgcccacaggaggaccatgagggaccaggacaccgggaaggaaaatgagatggactgggatgacagcgccctgaccatcaccgtgaaccccatggagacctatgaggaccagcacagcagcgaggaggaggaggaggaggaggaggaggaggagagtgaagatggagaggaggaggatgacatcaccagcgctgagagcgagagcagcgaggaggaggagggggagcagggcgacccccagaatgccacccggcagcagcagctggagtgggatgacagcaccctgagctactag

SEQ ID NO: 7353 - DNA, 564 bp, Artificial Sequence
  Description of Artificial Sequence: Synthetic coding sequence
atggtggccgccaccgtggccgccgcctggctgctgctgtgggccgccgcctgtgcccagcaggagcaggacttctatgacttcaaggctgtgaacatccggggcaagctggtgtccctggagaagtaccggggctctgtgtccctggtggtgaatgtggcctctgaatgtggcttcacagaccagcactaccgggccctgcagcagctgcagagggacctgggcccccaccacttcaacgtgctggccttcccctgcaaccagtttggccagcaggagccagacagcaacaaggagattgagagctttgcccggaggacctacagcgtgtccttccccatgttcagcaagattgctgtgactggaactggagcccacccagccttcaagtacctggcccagaccagcggcaaggagcccacctggaacttctggaagtacctggtggccccagatggcaaggtggtgggcgcctgggaccccaccgtgtctgtggaggaggtgcggccccagatcacagccctggtgaggaagctgatcctgctgaagcgggaggacctgtag

SEQ ID NO: 7354 - DNA, 303 bp, Artificial Sequence
  Description of Artificial Sequence: Synthetic coding sequence
atgtggggcttcctggtgctgaaggcccgctggctggtgacccctgtgaggaccctggccacagaagctggccagaagcccagcctgcggggcctgctggatgtgggcaacatccagcaccgggccgcccgggcccggggcctgacccggggcgtcatccgggtgagcccccaggagaggagccagcagaaccagagcgcccccaagggccccacccccagcacccggcccaagcccaggaccctgggcccccaggcccacagcctggccctgcagagcgtggacctgctcttccggccctag

SEQ ID NO: 7355 - DNA, 2352 bp, Artificial Sequence
  Description of Artificial Sequence: Synthetic coding sequence
atgcgctggcagtgtggcacccgcttccggggcctgcggcctgctgtggccccctggacagccctgctggccctgggcctgcccggctgggtgctggccgtgtctgccacagctgctgctgtggtgcctgagcagcacgcctctgtggccggccagcaccccctggactggctgctgacagaccggggccccttccaccgggcccaggagtatgctgacttcatggagcgctaccggcagggcttcaccacccgctaccgcatctaccgggagtttgcccgctggaaggtgaacaacctggccctggagaggaaggacttcttcagcctgcccctgcccctggcccctgagttcatccggaacatccggctgctgggcagaagacccaacctgcagcaggtgacagagaacctgatcaagaagtatggcacccacttcctgctgagcgccaccctgggcggggaggagagcctgaccatctttgtggacaagcagaagctgggcaggaagacagagaccaccggcggggccagcatcatcggcggcagcggcaacagcacagctgtgtccctggagaccctgcaccagctggccgccagctacttcatcgaccgggagagcaccctgcggcggctgcaccacatccagatcgccactggagccatcaaggtgacagagaccaggacaggccccctgggctgcagcaactatgacaacctggacagcgtgtcctctgtgctggtgcagagccctgagaacaaggtgcagctgctgggcctgcaggtgctgctgcctgagtacctgcgggagagatttgtggccgccgccctgagctacatcacctgcagcagcgagggggagctggtgtgcaaggaaaatgactgctggtgcaagtgcagccccaccttccctgagtgcaactgcccagatgctgacatccaggccatggaggacagcctgctgcagatccaggacagctgggccacccacaaccggcagtttgaggagagcgaggagttccaggccctgctgaagaggctgcctgatgaccgcttcctgaacagcacagccatcagccagttctgggccatggacaccagcctgcagcaccgctaccagcagctgggcgccggcctgaaggtgctcttcaagaagacccaccgcatcctgcggcggctcttcaacctgtgcaagcgctgccaccggcagccccgcttccggctgcccaaggagaggagcctgagctactggtggaaccgcatccagagcctgctgtactgtggggagagcaccttccctggcaccttcctggagcagagccacagctgcacctgcccctatgaccagagcagctgccagggccccatcccctgtgccctgggggagggccctgcctgtgcccactgtgccccagacaacagcacccgctgtggcagctgcaaccctggctacgtgctggcccagggcctgtgcaggcctgaggtggccgagagcctggagaacttcctgggcctggagacagacctgcaggacctggagctgaagtacctgctgcagaagcaggacagcagaattgaggtgcacagcatcttcatcagcaatgacatgaggctgggctcctggtttgaccccagctggaggaagaggatgctgctgaccctgaagagcaacaagtacaagccaggcctggtgcacgtgatgctggccctgagcctgcagatctgcctgaccaagaacagcaccctggagcctgtgatggccatctacgtgaacccctttggaggcagccacagcgagagctggttcatgcctgtgaatgaaggcagcttcccagactgggagaggaccaacgtggatgctgctgcccagtgccagaactggaccatcaccctgggcaaccgctggaagaccttctttgaaacagtgcacgtgtacctgcggagccgcatcaagagcctggatgacagcagcaatgagaccatctactatgagcccctggagatgacagaccccagcaagaacctgggctacatgaagatcaacaccctgcaggtgtttggctacagcctgccctttgatcctgatgccatccgggacctgatcctgcagctggactacccctacacccagggcagccaggacagcgccctgctgcagctgattgagctgcgggacagagtgaaccagctgagccccccaggcaaggtgcggctggacctcttcagctgcctgctgcggcaccggctgaagctggccaacaatgaggtgggccgcatccagagcagcctgcgggccttcaacagcaagctgcccaaccctgtggagtatgagaccgggaagctgtgcagctag

SEQ ID NO: 7356 - DNA, 2016 bp, Artificial Sequence
  Description of Artificial Sequence: Synthetic coding sequence
atggcccagctgttcctgcccctgctggccgccctggtgctggcccaggccccagctgccctggctgatgtgctggagggggacagcagtgaagatcgggccttccgggtgagaattgctggagatgcccccctgcagggcgtgctgggcggggccctgaccatcccctgccacgtgcactacctgcggcccccacccagccggcgggctgtgctgggcagcccccgggtgaagtggaccttcctgagccggggccgggaggccgaggtgctggtggcccggggcgtgcgggtgaaggtgaatgaggcctaccgcttccgggtggccctgcctgcctacccagccagcctgacagatgtgtccctggccctgtctgagctgcggcccaatgacagcggcatctaccgctgtgaggtgcagcacggcattgatgacagcagtgatgctgtggaggtgaaggtgaagggcgtggtgttcctgtaccgggagggcagcgcccgctatgccttctccttcagcggggcccaggaggcctgtgcccgcatcggggcccacatcgccaccccagagcagctgtatgctgcctacctgggcggctatgagcagtgtgatgctggctggctgagtgaccagacagtgcgctaccccatccagaccccccgggaggcctgctatggagacatggatggcttccctggggtgagaaattatggagtggtggaccctgatgacctgtatgatgtgtactgctacgccgaggacctgaatggagagctgttcctgggggaccccccagagaagctgaccctggaggaggcccgggcctactgccaggagagaggagctgagatcgccaccaccggccagctgtatgctgcctgggatggcggcctggaccactgcagccctggctggctggctgatggctctgtgcgctaccccatcgtgacccccagccagagatgtggcggcggcctgcccggggtgaagaccctcttcctgttccccaaccagacaggcttccccaacaagcacagccgcttcaacgtgtactgcttccgggacagcgcccagcccagcgccatccctgaggccagcaacccagccagcaacccagccagtgatggcctggaggccatcgtgacagtgacagagaccctggaggagctgcagctgccccaggaggccacagaaagtgagagcagaggagccatctacagcatccccatcatggaggatggcggcggcggcagcagcaccccagaggaccctgctgaggcccccaggaccctgctggagtttgagacccagagcatggtgcccccaacaggcttcagcgaggaggagggcaaggccctggaggaggaggagaagtatgaagatgaggaggagaaggaggaggaggaggaggaggaggaggtggaggatgaggccctgtgggcctggcccagcgagctgagcagccctggccctgaggccagcctgcccacagagcctgctgcccaggaggagagcctgagccaggccccagcccgggctgtgctgcagcccggggccagccccctgcctgatggagagagcgaggccagccggcccccccgggtgcacggccccccaacagagaccctgcccaccccccgggagaggaacctggccagccccagccccagcaccctggtggaggcccgggaggtgggggaggccactggaggccctgagctgtctggagtgcccagaggagagagcgaggagaccggcagcagcgagggcgcccccagcctgctgcctgccacccgggcccctgagggcacccgggagctggaggcccccagcgaggacaacagcggccgcacagccccagctggcacctctgtgcaggcccagcctgtgctgcccacagattctgccagcagaggaggagtggccgtggtgcctgccagcggcaacagcgcccagggcagcacagccctgagcatcctgctgctcttcttccccctgcagctgtgggtgacctag

SEQ ID NO: 7357 - DNA, 375 bp, Artificial Sequence
  Description of Artificial Sequence: Synthetic coding sequence
atgtacaagctggccagctgctgcctgctcttcatcggcttcctgaaccccctgctgagcctgcccctgctggacagccgggagatctccttccagctgagcgcccctcatgaagatgcccggctgaccccagaggagctggagcgggccagcctgctgcagatcctgcctgagatgctgggcgctgagcggggggacatcctgaggaaggctgacagcagcaccaacatcttcaacccccggggcaacctgaggaagttccaggacttcagcggccaggaccccaacatcctgctgagccacctgctggcccgcatctggaagccctacaagaagcgggagaccccagactgcttctggaagtactgtgtgtag

SEQ ID NO: 7358 - DNA, 1326 bp, Artificial Sequence
  Description of Artificial Sequence: Synthetic coding sequence
atggagtttgaatttgaccggctgcgggccttccaggccatgcaggtgcactgcaacaacatgcacaccctgggcgcccggctgcctggaggagtggagtgccgcttcagaagaggccctgccatggcctgggagggggagcccatgaggcacaacctgggcggcaacctgggggacccccgggcccgggctgtgtctgtgcccctgggcggccgggtggcccgcttcctgcagtgccgcttcctgtttgctggcccctggctgctcttcagcgagatctccttcatcagtgatgtggtgaacaacagcagccctgccctgggcggcaccttccccccagccccctggtggcccccaggccccccacccaccaacttcagcagcctggagctggagccccggggccagcagcctgtggccaaggccgagggcagccccacagccatcctgattggctgcctggtggccatcatcctgctgctgctgctgatcatcgccctgatgctgtggaggctgcactggaggcggctgctgagcaaggtgctggagagccaccccaggaccaggagccctggcctggtgggcatccggcccacccccctgcctgtgagccccatggccctgcgctgctgcagccccatccagcccacagccagcttctggcccctgacccctgtgcccctggaggcccgggccccaccccaccccccaggccccaacccccccaccccccggggcgtgactggaggcaacacctatgctgtgcctgccctgcccccaggagctgtgggagatggccccccccgggtggacttccccaggagccggctgcgcttcaaggagaagctgggggagggccagtttggagaggtgcacctgtgtgaggtggacagcccccaggacctggtgtccctggacttccccctgaatgtgaggaagggccaccccctgctggtggccgtgaagatcctgcggccagatgccaccaagaatgccagaaatgacttcctgaaggaggtgaagatcatgagccggctgaaggaccccaacatcatccggctgctgggcgtgtgtgtgcaggatgaccccctgtgcatgatcacagactacatggagaatggagacctgaaccagttcctgagcgcccaccagctggaggacaaggctgctgagggcgcccctggagatggccaggccgcccagggccccaccatctcctaccccatgctgctgcacgtggccgcccagatcgccagcggcatgagatacctggccaccctgaactttgtgcacttctggggcgagcggcaccgcttcctgcactag

SEQ ID NO: 7359 - DNA, 1950 bp, Artificial Sequence
  Description of Artificial Sequence: Synthetic coding sequence
atgcagcaggacggcctgggcgtgggcaccagaaatggcagcggcaagggccgctctgtgcaccccagctggccctggtgtgccccccggcccctgcgctacttcggcagagatgcccgggcccggcgggcccagacagctgccatggccctgctggccggcggcctgagccggggcctgggcagccaccctgctgctgctggaagagatgctgtggtgtttgtgtggctgctgctgagcacctggtgcacagccccagcccgggccatccaggtgacagtgagcaacccctaccacgtggtgatcctcttccagcctgtgaccctgccctgcacctaccagatgaccagcacccccacccagcccatcgtcatctggaagtacaagagcttctgccgggacagaattgctgatgccttcagccctgcctctgtggacaaccagctgaatgcccagctggccgccggcaaccctggctacaacccctacgtggagtgccaggacagcgtgaggacagtgcgggtggtggccaccaagcagggcaatgctgtgaccctgggggactactaccagggccgccgcatcaccatcactggaaatgctgacctgacctttgaccagacagcctggggagacagcggcgtgtactactgcagcgtggtgtctgcccaggacctgcagggcaacaatgaggcctatgcagagctgattgtgctgggccgcaccagcggcgtggccgagctgctgcccggcttccaggccggccccatcgaggactggctgtttgtggtggtggtgtgcctggccgccttcctgatcttcctgctgctgggcatctgctggtgccagtgctgcccccacacctgctgctgctacgtgcgctgcccctgctgcccagacaagtgctgctgcccagaggccctgtatgctgctgggaaggccgccaccagcggcgtgcccagcatctatgcccccagcacctacgcccacctgagccctgccaagaccccacctcctccagccatgatccccatgggccctgcctacaacggctacccaggcggctacccaggagatgtggacaggagcagcagcgctgggggccagggcagctatgtgcccctgctgcgggacacagacagctctgtggccagcgaggtgcgcagcggctaccgcatccaggccagccagcaggatgacagcatgagggtgctgtactacatggagaaggagctggccaactttgaccccagccggcccggcccccccagcggccgggtggagcgggccatgtctgaggtgaccagcctgcatgaagatgactggaggagccggcccagccggggccctgccctgacccccatcagagatgaggagtggggcggccacagccccaggagcccccggggctgggaccaggagcccgcccgggagcaggccggcggcggctggagggcccggcggccccgggcccggtctgtggatgccctggatgacctgaccccacccagcacagctgagagcggcagccgcagccccaccagcaatggaggccgcagccgggcctacatgccacccaggagccgcagcagagatgacctgtatgaccaggatgacagccgggacttccccaggagccgggacccccactatgatgacttccgcagccgggagcggcccccagctgaccccaggagccaccaccacaggacccgggacccccgggacaatggcagccgcagcggggacctgccctatgatggccgcctgctggaggaggccgtgaggaagaagggcagcgaggagcggcggcggccccacaaggaggaggaggaggaggcctactaccccccagcccccccaccctacagcgagacagacagccaggccagccgggagcggcggctgaagaagaacctggccctgagccgggagagcctggtggtgtag

SEQ ID NO: 7360 - DNA, 402 bp, Artificial Sequence
  Description of Artificial Sequence: Synthetic coding sequence
atgtctgagcgggtggagaggaactggagcactggaggctggctgctggccctgtgcctggcctggctgtggacccacctgaccctggccgccctgcagcccccaacagccaccgtgctggtgcagcagggcacctgtgaggtgattgctgcccaccgctgctgcaacagaaaccgcatcgaggagaggagccagacagtgaagtgcagctgcttcagcggccaggtggccggcaccacccgggccaagcccagctgtgtggatgccagcatcgtgctgcagcgctggtggtgccagatggagccctgcctgcctggagaggagtgcaaggtgctgcctgacctgagcggctggagctgcagcagcggccacaaggtgaagaccaccaaggtgaccaggtag

SEQ ID NO: 7361 - DNA, 699 bp, Artificial Sequence
  Description of Artificial Sequence: Synthetic coding sequence
atggtggccgccaacacccgggcccctgaggacacccgggccccagctggccccaagcccagcagctgtgagtgggccgtgtgctgggccccagcccgctgccgcatcagcgccacagcctgtggcaacagctgggacaggcctgctggccgcacccagctgctgtggaccccagctgcccccacagccatggccgaggtgggccctggccacaccccagcccaccccagccagggcgctgtgccccccagcagagctgctgctgagccccacctgaagcccagccccagcgagctgcagacagctggccctgctgccaccatcccagcccggctgtgcaccaggaagccccggctggtgtacacccagtgctggtacgtgaaggagcccaagcaccctgagatcgtgaccccctggggcacagctgcccggcacagctggaggcagcaccagatgctgagcgccagcgagcggcgctgcctgcccagagatgtggagcagaagctgggccctgagcacacaggcccctgcctggatgagcagggccgggaggccgagctggcccggagcggccccagcgctgctggccctgtgcggctgaagccaggcctggtgcccggcctcttcctgctgagctgcaccaccagccccagcacctgcctgcctgtgggccaggagggggagcggggcatgctgtag

SEQ ID NO: 7362 - DNA, 711 bp, Artificial Sequence
  Description of Artificial Sequence: Synthetic coding sequence
atgtgtgtgacctaccacaatggaacaggctactgcaagtgcccagagggcttcctgggggagtactgccagcaccgggacccctgtgagaagaaccgctgccagaatggaggcacctgtgtggcccaggccatgctgggcaaggccacctgccgctgtgccagcggcttcaccggggaggactgccagtacagcaccagccacccctgctttgtgtcccggccctgcctgaatggaggcacctgccacatgctgagccgggacacctatgaatgtacctgccaggtgggcttcaccgggaaggagtgccagtggacagatgcctgcctgagccacccctgtgccaacggcagcacctgcaccaccgtggccaaccagttcagctgcaagtgcctgaccggcttcaccggccagaagtgtgaaacagatgtgaatgaatgtgacatccctggccactgccagcacggcggcacctgcctgaacctgcccggcagctaccagtgccagtgcctgcagggcttcaccggccagtactgtgacagcctgtatgtgccctgtgcccccagcccctgtgtgaatggaggcacctgccggcagacaggagacttcacctttgagtgcaactgcctgcctgagaccgtgagaagaggaacagagctgtgggagcgggaccgggaggtgtggaatggcaaggagcatgatgaaaattag

SEQ ID NO: 7363 - DNA, 204 bp, Artificial Sequence
  Description of Artificial Sequence: Synthetic coding sequence
atggacaacgtgcagcccaagatcaagcaccggcccttctgcttctctgtgaagggccacgtgaagatgctgcggctggtgtttgccctggtgacagctgtgtgctgcctggctgatggagccctgatctacaggaagctgctcttcaaccccagcggcccctaccagaagaagcctgtgcatgagaagaaggaggtgctgtag

SEQ ID NO: 7364 - DNA, 75 bp, Artificial Sequence
  Description of Artificial Sequence: Synthetic coding sequence
atgctggtggatggccccagcgagaggcctgccctgtgcttcctgctgctggccgtggccatgtccttcttctag

SEQ ID NO: 7365 - DNA, 3345 bp, Artificial Sequence
  Description of Artificial Sequence: Synthetic coding sequence
atgctggccagcagcagccgcatccgggccgcctggacccgggccctgctgctgcccctgctgctggccggccctgtgggctgcctgagccggcaggagctgttcccctttggacctggccagggcgacctggagctggaggatggagatgactttgtgtccccagccctggagctgagcggggccctgcgcttctatgacagaagtgacattgatgctgtgtatgtgaccaccaacggcatcatcgccaccagcgagcccccagccaaggagagccaccctggcctcttcccccccacctttggagctgtggcccccttcctggccgacctggacaccacagatggcctgggcaaggtgtactaccgggaggacctgagccccagcatcacccagagagctgctgaatgtgtgcaccggggcttccctgagatctccttccagcccagcagcgctgtggtggtgacctgggagagcgtggccccctaccagggccccagccgggaccctgaccagaagggcaagaggaacaccttccaggccgtgctggccagcagtgacagcagcagctatgccatcttcctgtacccagaagatggcctgcagttccacaccaccttcagcaagaaggagaacaaccaggtgcctgctgtggtggccttcagccagggctctgtgggcttcctgtggaagagcaatggagcctacaacatctttgccaatgaccgggagagcgtggagaacctggccaagagcagcaacagcggccagcagggcgtgtgggtgtttgaaattggcagccctgccaccaccaacggggtggtgcctgcagatgtgatcctgggcacagaagatggagcagaatatgatgatgaagatgaggactatgacctggccaccacccggctgggcctggaggatgtgggcaccacccccttctcctacaaggccctgcggcggggcggcgctgacacctacagcgtgcccagcgtgctgagccccaggagagctgccacagagcggcccctgggccccccaacagagaggaccaggagcttccagctggccgtggagaccttccaccagcagcacccccaggtgattgatgtggatgaggtggaggagaccggggtggtgttctcctacaacacagacagccggcagacctgtgccaacaacagacaccagtgcagcgtgcatgctgagtgccgggactatgccaccggcttctgctgcagctgtgtggccggctacacaggaaatggccggcagtgtgtggccgagggcagcccccagagggtgaatggcaaggtgaagggccgcatctttgtgggcagcagccaggtgcccatcgtgtttgagaacacagacctgcacagctatgtggtgatgaaccacggccgcagctacacagccatcagcaccatccctgagaccgtgggctacagcctgctgcccctggcccctgtgggcggcatcatcggctggatgtttgctgtggagcaggacggcttcaagaatggcttcagcatcaccggcggggagttcacccggcaggccgaggtgacctttgtgggccaccctggcaacctggtgatcaagcagcgcttcagcggcattgatgaacatggccacctgaccatcgacacagagctggagggccgggtgccccagatccccttcggcagctctgtgcacatcgagccctacacagagctgtaccactacagcaccagcgtcatcaccagcagcagcacccgggagtacacagtgacagagcctgagagagatggagccagccccagccgcatctacacctaccagtggaggcagaccatcaccttccaggagtgtgtgcatgatgacagcaggcctgccctgcccagcacccagcagctgtctgtggacagcgtgtttgtgctgtacaaccaggaggagaagatcctgcgctatgccctgagcaacagcatcggccctgtgcgggagggcagcccagatgccctgcagaacccctgctacatcggcacccacggctgtgacaccaatgctgcctgcaggcctggccccaggacccagttcacctgtgagtgcagcatcggcttcagaggagatggccgcacctgctatgaggtggagaagacccgctgccagcacgagcgggagcacatcctgggcgctgctggggccacagacccccagaggcccatccccccaggcctgtttgtgcctgaatgtgatgcccacggccactacgcccccacccagtgccacggcagcacaggctactgctggtgtgtggacagagatggccgggaggtggagggcaccaggacccggcccggcatgaccccaccctgcctgagcacagtggccccacccatccaccagggccctgctgtgcccacagctgtgatccccctgcccccaggcacccacctgctgtttgcccagacaggcaagattgagcggctgcccctggagggcaacaccatgaggaagacagaggccaaggccttcctgcacgtgcctgccaaggtgatcatcggcctggcctttgactgtgtggacaagatggtgtactggacagacatcacagagcccagcatcggccgggccagcctgcatggaggagagcccaccaccatcatccggcaggacctgggcagccctgagggcattgctgtggaccacctgggcaggaacatcttctggacagacagcaacctggaccgcatcgaggtggccaagctggatggcacccagaggagagtgctgtttgaaacagacctggtgaacccccggggcatcgtgacagacagcgtgcggggcaacctgtactggacagactggaacagagacaaccccaagattgagaccagctacatggatggcaccaacagacgcatcctggtgcaggatgacctgggcctgcccaacggcctgacctttgatgccttcagcagccagctgtgctgggtggatgctggcaccaacagagcagaatgtctgaaccccagccagcccagcaggaggaaggccctggagggcctgcagtacccctttgctgtgaccagctatggcaagaacctgtacttcacagactggaagatgaacagcgtggtggccctggacctggccatcagcaaggagacagatgccttccagccccacaagcagacccggctgtatggcatcaccacagccctgagccagtgcccccagggccacaactactgcagcgtgaacaatggaggctgcacccacctgtgcctggccaccccaggcagcaggacctgccgctgcccagacaacaccctgggcgtggactgcatcgagcagaagtag

SEQ ID NO: 7366 - DNA, 2172 bp, Artificial Sequence
  Description of Artificial Sequence: Synthetic coding sequence
atgggcagccgctgtgccctggccctggccgtgctgagcgccctgctgtgccaggtgtggagcagcggcgtgtttgagctgaagctgcaggagtttgtgaacaagaagggcctgctgggcaacagaaactgctgccggggcggggccggccccccaccctgtgcctgcaggaccttcttccgggtgtgcctgaagcactaccaggcctctgtgtccccagagcccccctgcacctacggcagcgctgtgacccctgtgctgggcgtggacagcttcagcctgcctgatggcggcggcgctgacagcgccttcagcaaccccatccgcttccccttcggcttcacctggccaggcaccttcagcctcatcatcgaggccctgcacacagacagcccagatgacctggccacagagaaccctgagcggctcatcagccggctggccacccagaggcacctgactgtgggggaggagtggagccaggacctgcacagcagcggccgcacagacctgaagtacagctacagatttgtgtgtgatgagcactactacggggagggctgcagcgtcttctgccggcccagagatgatgccttcggccacttcacctgtggggagcggggggagaaggtgtgcaaccctggctggaagggcccctactgcacagagcccatctgcctgcccggctgtgatgagcagcacggcttctgtgacaagccaggagagtgcaagtgccgggtgggctggcagggccgctactgtgatgagtgcatccgctacccaggctgcctgcacggcacctgccagcagccctggcagtgcaactgccaggagggctggggcggcctcttctgcaaccaggacctgaactactgcacccaccacaagccctgcaagaatggagccacctgcaccaacacaggccagggcagctacacctgcagctgccggcccggctacacaggagccacctgtgagctgggcattgatgaatgtgaccccagcccctgcaagaatggaggcagctgcacagacctggagaacagctacagctgcacctgccccccaggcttctacggcaagatctgtgagctgagcgccatgacctgtgctgatggcccctgcttcaatggaggccgctgcagcgacagcccagatggcggctacagctgccgctgccctgtgggctacagcggcttcaactgtgagaagaagattgactactgcagcagcagcccctgcagcaatggagccaagtgtgtggacctgggagatgcctacctgtgccgctgccaggccggcttcagcggccgccactgtgatgacaacgtggatgactgtgccagcagcccctgtgccaacggcggcacctgcagagatggagtgaatgacttcagctgcacctgccccccaggctacacaggcaggaactgcagcgcccctgtgagccgctgtgaacatgccccctgccacaacggggccacctgccacgagcggggccacagatatgtgtgtgaatgtgcccggggctatggaggccccaactgccagttcctgctgcctgagctgcccccaggccctgctgtggtggacctgacagagaagctggagggccagggcggccccttcccctgggtggccgtgtgtgccggggtcatcctggtgctgatgctgctgctgggctgtgccgctgtggtggtgtgtgtgcggctgcggctgcagaagcaccggcccccagctgacccctgccgcggggagacagagaccatgaacaacctggccaactgccagcgggagaaggacatctctgtgtccatcattggagccacccagatcaagaacaccaacaagaaggctgacttccacggggaccacagcgctgacaagaatggcttcaaggcccgctacccagctgtggactacaacctggtgcaggacctgaagggagatgacacagctgtgagagatgcccacagcaagagggacaccaagtgccagccccagggcagcagtggagaggagaagggcacccccaccaccctgcggggcggggaggccagcgagaggaagaggccagacagcggctgcagcaccagcaaggacaccaagtaccagagcgtgtatgtgatcagcgaggagaaggatgaatgtgtgattgccacagaggtgtag

SEQ ID NO: 7367 - DNA, 981 bp, Artificial Sequence
  Description of Artificial Sequence: Synthetic coding sequence
atggccgccccagcctctgtgatgggccccctgggccccagcgccctgggcctgctgctgctgctgctggtggtggccccaccccgggtggccgccctggtgcaccggcagcctgagaaccagggcatcagcctgaccggctctgtggcctgtggccggcccagcatggagggcaagatcctgggcggcgtgcctgcccctgagaggaagtggccctggcaggtgtctgtgcactacgccggcctgcacgtgtgtggcggcagcatcctgaatgagtactgggtgctgtctgctgcccactgcttccaccgggacaagaacatcaagatctatgacatgtatgtgggcctggtgaacctgcgggtggccggcaaccacacccagtggtatgaggtgaacagagtcatcctgcaccccacctatgagatgtaccaccccatcggaggagatgtggccctggtgcagctgaagacccgcatcgtgttttctgagagcgtgctgcctgtgtgcctggccaccccagaggtgaacctgaccagcgccaactgctgggccaccggctggggcctggtgtccaagcagggcgagaccagtgatgagctgcaggagatgcagctgcccctcatcctggagccctggtgccacctgctgtatggccacatgagctacatcatgccagacatgctgtgtgccggggacatcctgaatgccaagacagtgtgtgagggggacagcggcggccccctggtgtgtgagttcaacagatcctggctgcagatcggcatcgtgtcctggggccggggctgcagcaaccccctgtacccaggagtgtatgcctctgtgtcctacttcagcaagtggatctgtgacaacatcgagatcacccccaccccagcccagcctgccccagccctgagccctgccctgggccccaccctgtctgtgctgatggccatgctggccggctggagcgtgctgtag

SEQ ID NO: 7368 - DNA, 1596 bp, Artificial Sequence
  Description of Artificial Sequence: Synthetic coding sequence
atgagcctggccgcctactgtgtgatctgctgccgccgcatcggcaccagcaccagcccccccaagagcggcacccactggagggacatccggaacatcatcaagttcaccggcagcctcatcctgggcggcagcctcttcctgacctatgaggtgctggccctgaagaaggctgtgaccctggacacccaggtggtggagcgggagaagatgaagagctacatctacgtgcacacagtgtccctggacaagggggagaaccacggcatcgcctggcaggccaggaaggagctgcacaaggctgtgaggaaggtgctggccaccagcgccaagatcctgaggaacccctttgctgaccccttcagcacagtggacattgaagatcatgaatgtgctgtgtggctgctgctgaggaagagcaagagtgatgacaagaccacccggctggaggccgtgcgggagatgtctgagacccaccactggcatgactaccagtaccgcatcatcgcccaggcctgtgaccccaagaccctgattggcctggcccggtctgaggagagtgacctgcgcttcttcctgctgcccccacccctgcccagcctgaaggaggacagcagcacagaggaggagctgcggcagctgctggccagcctgccccagacagagctggatgagtgcatccagtacttcaccagcctggccctgtctgagagcagccagagcctggccgcccagaagggcggcctgtggtgcttcggcggcaatggcctgccctatgcagagagctttggagaggtgcccagcgccaccgtggagatgttctgcctggaggccatcgtgaagcacagcgagatcagcacccactgtgacaagattgaggccaatggaggcctgcagctgctgcagaggctgtaccgcctgcacaaggactgccccaaggtgcagaggaacatcatgagggtcatcggcaacatggccctgaatgagcacctgcacagcagcatcgtgcgcagcggctgggtgtccatcatggccgaggccatgaagagcccccacatcatggagagcagccatgctgcccgcatcctggccaacctggaccgggagaccgtgcaggagaagtaccaggatggagtgtatgtgctgcacccccagtaccgcaccagccagcccatcaaggcagatgtgctcttcatccacggcctgatgggcgccgccttcaagacctggaggcagcaggacagcgagcaggccgtcatcgagaagcccatggaggatgaagatcgctacaccacctgctggcccaagacctggctggccaaggactgcccagccctgcgcatcatctctgtggagtatgacaccagcctgagtgactggagggcccgctgccccatggagcggcgcagcctgctgagcatcagcagcggcatcgtggagggcctggagagccccctgcacagcgaggccaccaacttcctgggcagcagcgagctgctggtgctgggcatcggccagtggtttggctaccacatcgcctgggaggtgttcctgagcaagcgctgctgctggaagcccctgcggagccagaagtag

SEQ ID NO: 7369 - DNA, 1596 bp, Artificial Sequence; identical to SEQ ID NO: 7368
  Description of Artificial Sequence: Synthetic coding sequence

SEQ ID NO: 7370 - DNA, 1965 bp, Artificial Sequence
  Description of Artificial Sequence: Synthetic coding sequence
atgagcctggccgcctactgtgtgatctgctgccgccgcatcggcaccagcaccagcccccccaagagcggcacccactggagggacatccggaacatcatcaagttcaccggcagcctcatcctgggcggcagcctcttcctgacctatgaggtgctggccctgaagaaggctgtgaccctggacacccaggtggtggagcgggagaagatgaagagctacatctacgtgcacacagtgtccctggacaagggggagaaccacggcatcgcctggcaggccaggaaggagctgcacaaggctgtgaggaaggtgctggccaccagcgccaagatcctgaggaacccctttgctgaccccttcagcacagtggacattgaagatcatgaatgtgctgtgtggctgctgctgaggaagagcaagagtgatgacaagaccacccggctggaggccgtgcgggagatgtctgagacccaccactggcatgactaccagtaccgcatcatcgcccaggcctgtgaccccaagaccctgattggcctggcccggtctgaggagagtgacctgcgcttcttcctgctgcccccacccctgcccagcctgaaggaggacagcagcacagaggaggagctgcggcagctgctggccagcctgccccagacagagctggatgagtgcatccagtacttcaccagcctggccctgtctgagagcagccagagcctggccgcccagaagggcggcctgtggtgcttcggcggcaatggcctgccctatgcagagagctttggagaggtgcccagcgccaccgtggagatgttctgcctggaggccatcgtgaagcacagcgagatcagcacccactgtgacaagattgaggccaatggaggcctgcagctgctgcagaggctgtaccgcctgcacaaggactgccccaaggtgcagaggaacatcatgagggtcatcggcaacatggccctgaatgagcacctgcacagcagcatcgtgcgcagcggctgggtgtccatcatggccgaggccatgaagagcccccacatcatggagagcagccatgctgcccgcatcctggccaacctggaccgggagaccgtgcaggagaagtaccaggatggagtgtatgtgctgcacccccagtaccgcaccagccagcccatcaaggcagatgtgctcttcatccacggcctgatgggcgccgccttcaagacctggaggcagcaggacagcgagcaggccgtcatcgagaagcccatggaggatgaagatcgctacaccacctgctggcccaagacctggctggccaaggactgcccagccctgcgcatcatctctgtggagtatgacaccagcctgagtgactggagggcccgctgccccatggagaggaagagcatcgccttccgcagcaatgagctgctgaggaagctgcgggctgctggggtgggggacaggcctgtggtgtggatcagccacagcatgggcggcctgctggtgaagaagatgctgctggaggccagcaccaagccagagatgagcaccgtcatcaacaacacccggggcatcatcttctacagcgtgccccaccacggcagccggctggccgagtacagcgtgaacatccgctacctgctcttccccagcctggaggtgaaggagctgagcaaggacagccctgccctgaagaccctgcaggatgacttcctggagtttgccaaggacaagaacttccaggtgctgaactttgtggagaccctgcccacctacatcggctccatgatcaagctgcacgtggtgcctgtggagagcgctgacctgggcattggagacctgatccctgtggatgtgaaccacctgaacatctgcaagcccaagaagaaggatgccttcctgtaccagaggaccctgcagttcatccgggaggccctggccaaggacctggagaactag

SEQ ID NO: 7371 - DNA, 1509 bp, Artificial Sequence
  Description of Artificial Sequence: Synthetic coding sequence
atggcccagagatgtgtgtgtgtgctggccctggtggccatgctgctgctggtgttccccaccgtgagccgctccatgggccccaggtctggagagcaccagagggccagccgcatccccagccagttcagcaaggaggagcgggtggccatgaaggaggccctgaagggggccatccagatccccaccgtgaccttcagcagcgagaagagcaacaccacagccctggccgagtttgggaagtacatccacaaggtgttccccaccgtggtgtccaccagcttcatccagcacgaggtggtggaggagtacagccacctgttcaccatccagggcagtgaccccagcctgcagccctacctgctgatggcccactttgatgtggtgcctgcccctgaggagggctgggaggtgccccccttcagcggcctggagagagatggcatcatctacggccggggcaccctggatgacaagaacagcgtgatggccctgctgcaggccctggagctgctgctgatcaggaagtacatcccccggcgctccttcttcatcagcctgggccatgatgaggagagcagcggcaccggggcccagaggatcagcgccctgctgcagagcagaggagtgcagctggccttcatcgtggatgaaggaggcttcatcctggatgacttcatccccaacttcaagaagcccatcgccctgattgctgtgtctgagaagggctccatgaacctgatgctgcaggtgaacatgaccagcggccacagcagcgccccacccaaggagaccagcatcggcatcctggccgctgctgtgtcccggctggagcagacccccatgcccatcatcttcggcagcggcaccgtggtgacagtgctgcagcagctggccaatgagttccccttccctgtgaacatcatcctgagcaacccctggctgtttgagcccctcatcagccgcttcatggagaggaaccccctgaccaatgccatcatccgcaccaccacagccctgaccatcttcaaggccggcgtgaagttcaacgtcatcccccctgtggcccaggccaccgtgaacttccgcatccaccctggccagacagtgcaggaggtgctggagctgaccaagaacatcgtggccgacaacagagtgcagttccacgtgctgagcgcctttgaccccctgcctgtgagccccagtgatgacaaggccctgggctaccagctgctgcggcagacagtgcagagcgtcttccctgaggtgaacatcacagcccctgtgaccagcatcggcaacacagacagccgcttcttcaccaacctgaccaccggcatctaccgcttctaccccatctacatccagcctgaggacttcaagaggatccacggcgtgaatgagaagatctctgtgcaggcctatgagacccaggtgaagttcatctttgagctgatccagaatgctgacacagaccaggagcctgtgagccacctgcacaagctgtag

SEQ ID NO: 7372 - DNA, 999 bp, Artificial Sequence
  Description of Artificial Sequence: Synthetic coding sequence
atgaggctgctggccttcctgagcctgctggccctggtgctgcaggagactggaacagccagcctgcccaggaaggagaggaagagaagagaggagcagatgccccgggagggggacagctttgaggtgctgcccctgagaaatgatgtgctgaacccagacaactacggggaggtgattgacctgagcaactatgaggagctgacagattatggagaccagctgcctgaggtgaaggtgaccagcctggccccagccaccagcatcagccctgccaagagcaccacagcccctggcacccccagcagcaaccccaccatgacccggcccaccacagctggcctgctgctgagcagccagcccaaccacggcctgcccacctgcctggtgtgtgtgtgcctgggcagctctgtgtactgtgatgacatcgacctggaggacatcccccccctgcccaggagaacagcctacctgtatgcccgcttcaaccgcatcagccgcatccgggcagaggacttcaagggcctgaccaagctgaagagaattgacctgagcaacaacctgatcagcagcattgacaatgatgccttccggctgctgcacgccctgcaggacctgatcctgcctgagaaccagctggaggccctgcctgtgctgcccagcggcatcgagttcctggatgtgcggctgaaccggctgcagagcagcggcatccagcctgctgccttccgggccatggagaagctgcagttcctgtacctgagtgacaacctgctggacagcatccctggccccctgcccctgagcctgcggtctgtgcacctgcagaacaacctgattgagaccatgcagagagatgtgttctgtgaccctgaggagcacaagcacacccggcggcagctggaggacatccggctggatggcaaccccatcaacctgagcctcttccccagcgcctacttctgcctgccccggctgcccatcggccgcttcacctag

SEQ ID NO: 7373 - DNA, 1401 bp, Artificial Sequence
  Description of Artificial Sequence: Synthetic coding sequence
atggtgcgctctgtggcctgggccggcttcatggtgctgctgatgatcccctggggcagcgctgccaagctggtgtgctacttcaccaactgggcccagtaccggcagggcgaggcccgcttcctgcccaaggacctggaccccagcctgtgcacccacctgatctatgcctttgctggcatgaccaaccaccagctgagcaccacagagtggaatgatgagaccctgtaccaggagttcaacggcctgaagaagatgaaccccaagctgaagaccctgctggccatcggcggctggaactttggcacccagaagttcacagacatggtggccacagccaacaaccggcagacctttgtgaacagcgccatccgcttcctgaggaagtacagctttgatggcctggacctggactgggagtacccaggcagccagggcagccctgctgtggacaaggagcgcttcaccaccctggtgcaggacctggccaatgccttccagcaggaggcccagaccagcggcaaggagcggctgctgctgtctgctgctgtgcctgctggccagacctacgtggatgctggctatgaggtggacaagatcgcccagaacctggactttgtgaacctgatggcctatgacttccacggctcctgggagaaggtgacaggccacaacagccccctgtacaagaggcaggaggagagcggggccgccgccagcctgaatgtggatgctgctgtgcagcagtggctgcagaagggcaccccagccagcaagctgatcctgggcatgcccacctacggccgctccttcaccctggccagcagcagtgacaccagggtgggcgccccagccaccggcagcggcaccccaggccccttcaccaaggagggcggcatgctggcctactatgaggtgtgctcctggaagggggccaccaagcagaggatccaggaccagaaggtgccctacatcttccgggacaaccagtgggtgggctttgatgatgtggagagcttcaagaccaaggtgtcctacctgaagcagaagggcctgggcggggccatggtgtgggccctggacctggatgactttgctggcttcagctgcaaccagggccgctaccccctcatccagaccctgcggcaggagctgagcctgccctacctgcccagcggcaccccagagctggaggtgcccaagccaggccagcccagcgagcctgagcacggccccagccctggccaggacaccttctgccagggcaaggcagatggcctgtaccccaacccccgggagaggagcagcttctacagctgtgccgccggccgcctcttccagcagagctgccccaccggcctggtgttcagcaacagctgcaagtgctgcacctggaactag

SEQ ID NO: 7374 - DNA, 1596 bp, Artificial Sequence
  Description of Artificial Sequence: Synthetic coding sequence
atgaggctgtgcctgggccggccccacccccggggccacagccgggtgggcaagtctgagcggggccgcggggcccggggcctggcccggcagaggaccctggaggatgaggaggagcaggagcgggagaggagaagaagacacaggaacctgagcagcaccacagatgatgaggccccccggctgagccagaatggagaccggcaggccagcgccagcgagcggctgcccagcgtggaggaggccgaggtgcccaagcccctgcccccagccagcaaggatgaagatgaggacatccagagcatcctgcggacccggcaggagcggcggcagaggcggcaggtggtggaggccgcccaggcccccatccaggagcggctggaggccgaggagggcaggaacagcctgagccctgtgcaggccacccagaagcccctggtgtccaagaaggagctggagatccccccaagaagaaggctgagccgggagcagaggggcccctgggccctggaggaggagagcctggtgggccgggagcctgaggagaggaagaagggcgtgcctgagaagagccctgtgctggagaagagctccatgcccaagaagacagcccctgagaagagcctggtgtctgacaagaccagcatcagcgagaaggtgctggccagcgagaagaccagcctgtctgagaagattgctgtgtctgagaagaggaacagcagcgagaagaagtctgtgctggagaagacctctgtgtctgagaagagcctggcccctggcatggccctgggcagcggccgccgcctggtgtctgagaaggccagcatctttgagaaggccctggccagcgagaagagccccacagcagatgccaagccagcccccaagagggccacagccagcgagcagcccctggcccaggagcccccagccagcggcggcagccctgccaccaccaaggagcagaggggccgggccctgcccgggaagaacctgcccagcctggccaagcagggcgccagtgaccccccaacagtggccagccggctgccccctgtgaccctgcaggtgaagatccccagcaaggaggaggaggccgacatgagcagccccacccagaggacctacagcagcagcctgaagaggagcagccccaggaccatctccttcaggatgaagcccaagaaggaaaattctgagaccaccctgaccaggtctgcctccatgaagctgcctgacaacacagtgaagctgggggagaagctggagcgctaccacacagccatccgccgctctgagagcgtgaagagccggggcctgccctgcacagagctgtttgtggcccctgtgggcgtggccagcaagaggcacctgtttgagaaggagctggccggccagagcagagctgagcccgccagcagcaggaaagaaaacctgcggctgagcggcgtggtgaccagccggctgaacctgtggatcagcaggacccaggagagcggggaccaggacccccaggaggcccagaaggccagcagcgccacagagaggacccagtggggccagaagagtgacagcagcctggatgctgaggtgtag

SEQ ID NO: 7375 - DNA, 1782 bp, Artificial Sequence
  Description of Artificial Sequence: Synthetic coding sequence
atgaaggctgacctgaagcagcaccaccaccactggagcatcttctcctacatccggctgcggctgcccagcatgctgctgctcttcagcgtcatcctgatctcctgggtgtccacagtgggcggggagggcaccctgtgtgacttccccaagatccaccacggcttcctgtatgatgaggaggactacaaccccttcagccaggtgcccactggagaggtgttctactacagctgtgagtacaactttgtgagccccagcaagagcttctggacccgcatcacctgcacagaggagggctggagccccacccccaagtgcctgaggatgtgcagcttcccctttgtgaagaatggccacagcgagagcagcggcctcatccacctggagggggacacagtgcagatcatctgcaacacaggctacagcctgcagaacaatgagaagaacatcagctgtgtggagcggggctggagcaccccacccatctgcagcttcaccaagggggagtgccacgtgcccatcctggaggccaacgtggatgcccagcccaagaaggagagctacaaggtgggagatgtgctgaagttcagctgcaggaagaacctgatccgggtgggcagtgacagcgtgcagtgctaccagtttggctggagccccaacttccccacctgcaagggccaggtgcgcagctgtggccccccaccccagctgagcaatggagaggtgaaggagatcaggaaggaggagtatggccacaatgaggtggtggagtatgactgcaaccccaacttcatcatcaatggccccaagaagatccagtgtgtggatggagagtggaccaccctgcccacctgtgtggagcaggtgaagacctgtggctacatccctgagctggagtatggctacgtgcagcccagcgtgcccccctaccagcacggcgtgtctgtggaggtgaactgcagaaatgaatatgccatgattggcaacaacatgatcacctgcatcaatggcatctggacagagctgcccatgtgtgtggccacccaccagctgaagcgctgcaagattgctggggtgaacatcaagaccctgctgaagctgagcggcaaggagttcaaccacaacagccgcatccgctaccgctgcagcgacatcttccgctaccgccacagcgtgtgcatcaacgggaagtggaaccctgaggtggactgcacagagaagcgggagcagttctgccccccaccaccccagatccccaatgcccagaacatgaccaccaccgtgaactaccaggatggagagaaggtggccgtgctgtgcaaggagaactacctgctgcctgaggccaaggagatcgtgtgcaaggatggccgctggcagagcctgccccgctgtgtggagagcacagcctactgcggccccccacccagcatcaacaatggagacaccaccagcttccccctgtctgtgtacccacctggcagcacagtgacctaccgctgccagagcttctacaagctgcagggctctgtgacagtgacctgcaggaacaagcagtggagcgagcccccacgctgcctggacccctgtgtggtgtctgaggagaacatgaacaagaacaacatccagctgaagtggagaaatgatggcaagctgtatgccaagacaggagatgctgtggagttccagtgcaagttcccccacaaggccatgatcagcagcccccccttccgggccatctgccaggagggcaagtttgagtaccccatctgtgagtag

SEQ ID NO: 7376 - DNA, 2301 bp, Artificial Sequence
  Description of Artificial Sequence: Synthetic coding sequence
atgatctggaggagcagagctggagctgagctgttcagcctgatggccctgtgggagtggatcgccctgagcctgcactgctgggtgctggccgtggccgctgtgtctgaccagcacgccaccagcccctttgactggctgctgagtgacaagggccccttccacaggagccaggagtacacagactttgtggacaggagccggcagggcttcagcacccgctacaagatctaccgggagtttggccgctggaaggtgaacaacctggccgtggagaggaggaacttcctgggcagccccctgcccctggcccctgagttcttcaggaacatccggctgctgggccggcggcccaccctgcagcagatcacagaaaatctcatcaagaagtatggcacccacttcctgctgagcgccaccctgggcggggaggagagcctgaccatctttgtggacaagaggaagctgagcaagagagctgagggcagtgacagcaccaccaacagcagctctgtgaccctggagaccctgcaccagctggccgccagctacttcatcgaccgggacagcaccctgcggcggctgcaccacatccagatcgccagcacagccatcaaggtgacagagaccaggacaggccccctgggctgcagcaactatgacaacctggacagcgtgtcctctgtgctggtgcagagccctgagaacaagatccagctgcagggcctgcaggtgctgctgcctgactacctgcaggagagatttgtgcaggccgccctgagctacatcgcctgcaacagcgagggggagttcatctgcaaggaaaatgactgctggtgccactgcggccccaagtttcctgagtgcaactgccccagcatggacatccaggccatggaggagaacctgctgcgcatcacagagacctggaaggcctacaacagcgactttgaggagagtgatgagttcaagctgttcatgaagaggctgcccatgaactacttcctgaacaccagcaccatcatgcacctgtggaccatggacagcaacttccagaggagatatgagcagctggagaacagcatgaagcagctgttcctgaaggcccagaagatcgtgcacaagctgttcagcctgagcaagcgctgccacaagcagcccctcatcagcctgccccggcagaggaccagcacctactggctgacccgcatccagagcttcctgtactgcaatgaaaatggcctgctgggcagcttcagcgaggagacccacagctgcacctgccccaatgaccaggtggtgtgcacagccttcctgccctgcaccgtgggagatgccagcgcctgcctgacctgtgccccagacaacagaacccgctgtggcacctgcaacacaggctacatgctgagccagggcctgtgcaagccagaggtggccgagagcacagaccactacatcggctttgaaacagacctgcaggacctggagatgaagtacctgctgcagaagacagaccggcgcatcgaggtgcacgccatcttcatcagcaatgacatgaggctgaacagctggtttgaccccagctggaggaagaggatgctgctgaccctgaagagcaacaagtacaagagcagcctggtgcacatgatcctgggcctgagcctgcagatctgcctgaccaagaacagcaccctggagcctgtgctggccgtgtatgtgaacccctttggaggcagccacagcgagagctggttcatgcctgtgaatgaaaacagcttcccagactgggagaggaccaagctggacctgcccctgcagtgctacaactggaccctgaccctgggcaacaagtggaagaccttctttgagaccgtgcacatctacctgcggagccgcatcaagagcaatggccccaatggaaatgaaagcatctactatgagcccctggagttcatcgaccccagcaggaacctgggctacatgaagatcaacaacatccaggtgtttggctacagcatgcactttgatcctgaggccatccgggacctgatcctgcagctggactacccctacacccagggcagccaggacagcgccctgctgcagctgctggagatccgggacagagtgaacaagctgagccccccaggccagaggcggctggacctcttcagctgcctgctgcggcaccggctgaagctgagcaccagcgaggtggtgcgcatccagagcgccctgcaggccttcaatgccaagctgcccaacaccatggactatgacaccaccaagctgtgcagctag

SEQ ID NO: 7377 - DNA, 1815 bp, Artificial Sequence
  Description of Artificial Sequence: Synthetic coding sequence
atgaggcgctgcaacagcggcagcggccccccacccagcctgctgctgctgctgctgtggctgctggccgtgcctggggccaatgctgcccccaggtctgccctgtacagccccagcgaccccctgaccctgctgcaggccgacacagtgagaggagctgtgctgggcagccgcagcgcctgggccgtggagttctttgcctcctggtgtggccactgcatcgcctttgcccccacctggaaggccctggctgaagatgtgaaggcctggaggcctgccctgtacctggccgccctggactgtgccgaggagaccaacagcgctgtgtgccgggacttcaacatccctggcttccccaccgtgcgcttcttcaaggccttcaccaagaatggcagcggggctgtgtttcctgtggccggggctgatgtgcagaccctgcgggagcggctgattgatgccctggagagccaccacgacacctggcccccagcctgcccccccctggagcccgccaagctggaggagattgatggcttctttgccaggaacaatgaggagtacctggccctgatctttgagaagggcggcagctacctgggccgggaggtggccctggacctgagccagcacaagggcgtggccgtgcggcgggtgctgaacacagaggccaacgtggtgaggaagtttggagtgacagacttccccagctgctacctgctcttcagaaatggatctgtgtcccgggtgcctgtgctgatggagagccgctccttctacacagcctacctgcagaggctgagcggcctgacccgggaggccgcccagaccaccgtggcccccaccacagccaacaagatcgcccccaccgtgtggaagctggccgacaggagcaagatctacatggctgacctggagagcgccctgcactacatcctgcgcatcgaggtgggccgcttccctgtgctggagggccagaggctggtggccctgaagaagtttgtggccgtgctggccaagtacttccctggccggcccctggtgcagaacttcctgcacagcgtgaatgagtggctgaagaggcagaagaggaacaagatcccctacagcttcttcaagacagccctggatgacaggaaggagggcgctgtgctggccaagaaggtgaactggattggctgccagggcagcgagccccacttccggggcttcccctgcagcctgtgggtgctcttccacttcctgactgtgcaggccgcccggcagaatgtggaccacagccaggaggccgccaaggccaaggaggtgctgcctgccatccggggctacgtgcactacttcttcggctgccgggactgtgccagccactttgagcagatggctgctgcctccatgcaccgggtgggcagccccaatgctgctgtgctgtggctgtggagcagccacaacagagtgaatgcccggctggccggggcccccagcgaggacccccagttccccaaggtgcagtggccaccccgggagctgtgcagcgcctgccacaatgaaaggctggatgtgcctgtgtgggatgtggaggccaccctgaacttcctgaaggcccacttcagccccagcaacatcatcctggacttccctgctgctggcagcgctgccaggagagatgtgcagaatgtggccgccgcccctgagctggccatgggcgccctggagctggagagcaggaacagcaccctggaccccgggaagccagagatgatgaagagccccaccaacaccacccctcatgtgcctgctgagggccctgagctgatctag

SEQ ID NO: 7378 - DNA, 2244 bp, Artificial Sequence
  Description of Artificial Sequence: Synthetic coding sequence
atgaggcgctgcaacagcggcagcggccccccacccagcctgctgctgctgctgctgtggctgctggccgtgcctggggccaatgctgcccccaggtctgccctgtacagccccagcgaccccctgaccctgctgcaggccgacacagtgagaggagctgtgctgggcagccgcagcgcctgggccgtggagttctttgcctcctggtgtggccactgcatcgcctttgcccccacctggaaggccctggctgaagatgtgaaggcctggaggcctgccctgtacctggccgccctggactgtgccgaggagaccaacagcgctgtgtgccgggacttcaacatccctggcttccccaccgtgcgcttcttcaaggccttcaccaagaatggcagcggggctgtgtttcctgtggccggggctgatgtgcagaccctgcgggagcggctgattgatgccctggagagccaccacgacacctggcccccagcctgcccccccctggagcccgccaagctggaggagattgatggcttctttgccaggaacaatgaggagtacctggccctgatctttgagaagggcggcagctacctgggccgggaggtggccctggacctgagccagcacaagggcgtggccgtgcggcgggtgctgaacacagaggccaacgtggtgaggaagtttggagtgacagacttccccagctgctacctgctcttcagaaatggatctgtgtcccgggtgcctgtgctgatggagagccgctccttctacacagcctacctgcagaggctgagcggcctgacccgggaggccgcccagaccaccgtggcccccaccacagccaacaagatcgcccccaccgtgtggaagctggccgacaggagcaagatctacatggctgacctggagagcgccctgcactacatcctgcgcatcgaggtgggccgcttccctgtgctggagggccagaggctggtggccctgaagaagtttgtggccgtgctggccaagtacttccctggccggcccctggtgcagaacttcctgcacagcgtgaatgagtggctgaagaggcagaagaggaacaagatcccctacagcttcttcaagacagccctggatgacaggaaggagggcgctgtgctggccaagaaggtgaactggattggctgccagggcagcgagccccacttccggggcttcccctgcagcctgtgggtgctcttccacttcctgactgtgcaggccgcccggcagaatgtggaccacagccaggaggccgccaaggccaaggaggtgctgcctgccatccggggctacgtgcactacttcttcggctgccgggactgtgccagccactttgagcagatggctgctgcctccatgcaccgggtgggcagccccaatgctgctgtgctgtggctgtggagcagccacaacagagtgaatgcccggctggccggggcccccagcgaggacccccagttccccaaggtgcagtggccaccccgggagctgtgcagcgcctgccacaatgaaaggctggatgtgcctgtgtgggatgtggaggccaccctgaacttcctgaaggcccacttcagccccagcaacatcatcctggacttccctgctgctggcagcgctgccaggagagatgtgcagaatgtggccgccgcccctgagctggccatgggcgccctggagctggagagcaggaacagcaccctggaccccgggaagccagagatgatgaagagccccaccaacaccacccctcatgtgcctgctgagggccctgaggccagccggccccccaagctgcaccctggcctgcgggccgcccctggccaggagcccccagagcacatggccgagctgcagagaaatgagcaggagcagcccctgggccagtggcacctgagcaagagggacacaggagctgccctgctggccgagagcagagctgagaagaaccggctgtggggccccctggaggtgagaagagtgggccgcagcagcaagcagctggtggacatccctgagggccagctggaggcccgggccggccggggccggggccagtggctgcaggtgctgggcggcggcttctcctacctggacatcagcctgtgtgtgggcctgtacagcctgtccttcatgggcctgctggccatgtacacctacttccaggccaagatccgggccctgaagggccacgccggccaccctgctgcctag

SEQ ID NO: 7379 - DNA, 1476 bp, Artificial Sequence
  Description of Artificial Sequence: Synthetic coding sequence
atgaagaccttcacctggaccctgggcgtgctcttcttcctgctggtggacaccggccactgccggggcggccagttcaagatcaagaagatcaaccagaggcgctacccccgggccacagatggcaaggaggaggccaagaagtgtgcctacaccttcctggtgcctgagcagaggatcaccggccccatctgtgtgaacaccaagggccaggatgccagcaccatcaaggacatgatcaccaggatggacctggagaacctgaaggatgtgctgagccggcagaagcgggagattgatgtgctgcagctggtggtggatgtggatggcaacatcgtgaatgaggtgaagctgctgaggaaggagagcaggaacatgaacagccgggtgacccagctgtacatgcagctgctgcacgagatcatcaggaagagggacaacagcctggagctgagccagctggagaacaagatcctgaatgtgaccacagagatgctgaagatggccacccgctaccgggagctggaggtgaagtatgccagcctgacagacctggtgaacaaccagagcgtgatgatcaccctgctggaggagcagtgcctgcgcatcttcagccggcaggacacccacgtgtccccacccctggtgcaggtggtgccccagcacatccccaacagccagcagtacaccccaggcctgctgggcggcaatgagatccagagggaccccggctacccccgggacctgatgcctcctccagacctggccaccagccccaccaagagccccttcaagatcccccctgtgaccttcatcaatgaaggccccttcaaggactgccagcaggccaaggaggccggccacagcgtgtctggcatctacatgatcaagccagagaacagcaatggccccatgcagctgtggtgtgagaacagcctggaccccggcggctggacagtcatccagaagaggacagatggctctgtgaacttcttcaggaactgggagaactacaagaagggcttcggcaacattgatggagagtactggctgggcctggagaacatctacatgctgagcaaccaggacaactacaagctgctgattgagctggaggactggagcgacaagaaggtgtatgcagagtacagcagcttccggctggagcctgagagcgagttctaccgcctgcggctgggcacctaccagggcaatgctggggacagcatgatgtggcacaacgggaagcagttcaccaccctggaccgggacaaggacatgtatgccggcaactgtgcccacttccacaagggcggctggtggtacaatgcctgtgcccacagcaacctgaatggagtgtggtacagaggaggccactaccgcagcaagcaccaggacggcatcttctgggccgagtacagaggaggcagctacagcctgcgggctgtgcagatgatgatcaagcccatcgactag

SEQ ID NO: 7380 - DNA, 2484 bp, Artificial Sequence
  Description of Artificial Sequence: Synthetic coding sequence
atgatgtgcctgaagatcctgcgcatcagcctggccatcctggccggctgggccctgtgcagcgccaacagcgagctgggctggaccaggaagaagagcctggtggagcgggagcacctgaaccaggtgctgctggagggggagcgctgctggctgggcgccaaggtgagaagaccccgggccagcccccagcaccacctgtttggagtgtaccccagcagagctggcaactacctgcggccctaccctgtgggggagcaggagatccaccacacaggccgcagcaagccagacacagagggcaatgctgtgtccctggtgcccccagacctgacagaaaatcctgctggcctgcggggagctgtggaggagcctgctgccccctgggtgggggacagccccatcggccagagcgagctgctgggagatgatgatgcctacctgggcaaccagaggagcaaggagagcctgggggaggccggcatccagaagggcagcgccatggccgccaccaccaccacagccatcttcaccaccctgaatgagcccaagccagagacccagaggcggggctgggccaagagccggcagaggcggcaggtgtggaagagaagagcagaagatggccagggcgacagcggcatcagcagccacttccagccctggcccaagcacagcctgaagcaccgggtgaagaagagccccccagaggagagcaaccagaatggaggagagggcagctaccgggaggccgagaccttcaacagccaggtgggcctgcccatcctgtacttcagcggccggcgggagcggctgctgctgcggcctgaggtgctggccgagatcccccgggaggccttcaccgtggaggcctgggtgaagccagagggcggccagaacaacccagccatcatcgccggcgtgtttgacaactgcagccacacagtgtctgacaagggctgggccctgggcatccgcagcggcaaggacaagggcaagagagatgcccgcttcttcttcagcctgtgcacagacagagtgaagaaggccaccatcctgatcagccacagccgctaccagcccggcacctggacccacgtggccgccacctatgatggccgccacatggccctgtatgtggatggcacccaggtggccagcagcctggaccagagcggccccctgaacagccccttcatggccagctgccgcagcctgctgctgggcggggacagcagtgaagatggccactacttccggggccacctgggcaccctggtgttctggagcacagccctgccccagagccacttccagcacagcagccagcacagcagcggggaggaggaggccacagacctggtgctgacagccagctttgagcctgtgaacacagagtgggtgcccttcagagatgagaagtacccccggctggaggtgctgcagggctttgagcctgagcctgagatcctgagccccctgcagccccccctgtgtggccagacagtgtgtgacaacgtggagctgatcagccagtacaacggctactggcccctgcggggggagaaggtgatccgctaccaggtggtgaacatctgtgatgatgagggcctgaaccccatcgtgtctgaggagcagatccggctgcagcacgaggccctgaatgaggccttcagccgctacaacatctcctggcagctgtctgtgcaccaggtgcacaacagcaccctgcggcaccgggtggtgctggtgaactgtgagcccagcaagattggaaatgaccactgtgaccctgaatgtgagcaccccctgaccggctatgatggaggagactgccgcctgcagggccgctgctacagctggaacagaagagatggcctgtgccacgtggagtgcaacaacatgctgaatgactttgatgatggagactgctgtgacccccaggtggctgatgtgaggaagacctgctttgatcctgacagccccaagagggcctacatgtctgtgaaggagctgaaggaggccctgcagctgaacagcacccacttcctgaacatctactttgccagctctgtgcgggaggacctggccggggccgccacctggccctgggacaaggatgctgtgacccacctgggcggcatcgtgctgagccctgcctactacggcatgcctggccacacagacaccatgattcatgaggtgggccacgtgctgggcctgtaccacgtgttcaagggcgtgtctgagcgggagagctgcaatgacccctgcaaggagaccgtgcccagcatggagactggagacctgtgtgccgacacagcccccacccccaagtctgagctgtgccgggagcctgagcccaccagtgacacctgtggcttcacccgcttccctggggcccccttcaccaactacatgagctacacaggcatcaccaccgtgctcttctgcttcctgctgcgcatccacggcggcctgtag

SEQ ID NO: 7381 - DNA, 5376 bp, Artificial Sequence
  Description of Artificial Sequence: Synthetic coding sequence
atgatgtgcctgaagatcctgcgcatcagcctggccatcctggccggctgggccctgtgcagcgccaacagcgagctgggctggaccaggaagaagagcctggtggagcgggagcacctgaaccaggtgctgctggagggggagcgctgctggctgggcgccaaggtgagaagaccccgggccagcccccagcaccacctgtttggagtgtaccccagcagagctggcaactacctgcggccctaccctgtgggggagcaggagatccaccacacaggccgcagcaagccagacacagagggcaatgctgtgtccctggtgcccccagacctgacagaaaatcctgctggcctgcggggagctgtggaggagcctgctgccccctgggtgggggacagccccatcggccagagcgagctgctgggagatgatgatgcctacctgggcaaccagaggagcaaggagagcctgggggaggccggcatccagaagggcagcgccatggccgccaccaccaccacagccatcttcaccaccctgaatgagcccaagccagagacccagaggcggggctgggccaagagccggcagaggcggcaggtgtggaagagaagagcagaagatggccagggcgacagcggcatcagcagccacttccagccctggcccaagcacagcctgaagcaccgggtgaagaagagccccccagaggagagcaaccagaatggaggagagggcagctaccgggaggccgagaccttcaacagccaggtgggcctgcccatcctgtacttcagcggccggcgggagcggctgctgctgcggcctgaggtgctggccgagatcccccgggaggccttcaccgtggaggcctgggtgaagccagagggcggccagaacaacccagccatcatcgccggcgtgtttgacaactgcagccacacagtgtctgacaagggctgggccctgggcatccgcagcggcaaggacaagggcaagagagatgcccgcttcttcttcagcctgtgcacagacagagtgaagaaggccaccatcctgatcagccacagccgctaccagcccggcacctggacccacgtggccgccacctatgatggccgccacatggccctgtatgtggatggcacccaggtggccagcagcctggaccagagcggccccctgaacagccccttcatggccagctgccgcagcctgctgctgggcggggacagcagtgaagatggccactacttccggggccacctgggcaccctggtgttctggagcacagccctgccccagagccacttccagcacagcagccagcacagcagcggggaggaggaggccacagacctggtgctgacagccagctttgagcctgtgaacacagagtgggtgcccttcagagatgagaagtacccccggctggaggtgctgcagggctttgagcctgagcctgagatcctgagccccctgcagccccccctgtgtggccagacagtgtgtgacaacgtggagctgatcagccagtacaacggctactggcccctgcggggggagaaggtgatccgctaccaggtggtgaacatctgtgatgatgagggcctgaaccccatcgtgtctgaggagcagatccggctgcagcacgaggccctgaatgaggccttcagccgctacaacatctcctggcagctgtctgtgcaccaggtgcacaacagcaccctgcggcaccgggtggtgctggtgaactgtgagcccagcaagattggaaatgaccactgtgaccctgaatgtgagcaccccctgaccggctatgatggaggagactgccgcctgcagggccgctgctacagctggaacagaagagatggcctgtgccacgtggagtgcaacaacatgctgaatgactttgatgatggagactgctgtgacccccaggtggctgatgtgaggaagacctgctttgatcctgacagccccaagagggcctacatgtctgtgaaggagctgaaggaggccctgcagctgaacagcacccacttcctgaacatctactttgccagctctgtgcgggaggacctggccggggccgccacctggccctgggacaaggatgctgtgacccacctgggcggcatcgtgctgagccctgcctactacggcatgcctggccacacagacaccatgattcatgaggtgggccacgtgctgggcctgtaccacgtgttcaagggcgtgtctgagcgggagagctgcaatgacccctgcaaggagaccgtgcccagcatggagactggagacctgtgtgccgacacagcccccacccccaagtctgagctgtgccgggagcctgagcccaccagtgacacctgtggcttcacccgcttccctggggcccccttcaccaactacatgagctacacagatgacaactgcacagacaacttcacccccaaccaggtggccaggatgcactgctacctggacctggtgtaccagcagtggacagagagcaggaagcccacccccatccccatcccccccatggtgattggccagaccaacaagagcctgaccatccactggctgccccccatctctggagtggtgtatgaccgggccagcggcagcctgtgtggggcctgcacagaagatggcaccttccggcagtatgtgcacacagccagcagccggcgggtgtgtgacagcagcggctactggaccccagaggaggccgtgggccccccagatgtggaccagccctgtgagcccagcctgcaggcctggagccctgaggtgcacctgtaccacatgaacatgacagtgccctgccccacagagggctgcagcctggagctgctcttccagcaccctgtgcaggccgacaccctgaccctgtgggtgaccagcttcttcatggagagcagccaggtgctgtttgacacagagatcctgctggagaacaaggagagcgtgcacctgggccccctggacaccttctgtgacatccccctgaccatcaagctgcacgtggatggcaaggtgtctggagtgaaggtgtacacctttgatgaaagaattgaaattgatgctgccctgctgaccagccagccccacagccccctgtgcagcggctgcaggcctgtgcgctaccaggtgctgcgggaccccccatttgccagcggcctgcctgtggtggtgacccacagccacaggaagttcacagatgtggaggtgaccccaggccagatgtaccagtaccaggtgctggccgaggccggcggggagctgggggaggccagcccccccctgaaccacatccacggggccccctactgtggagatggcaaggtgtctgagcggctgggggaggagtgtgatgatggagacctggtgtctggagatggctgcagcaaggtgtgtgagctggaggagggcttcaactgtgtgggggagcccagcctgtgctacatgtatgaaggagatggcatctgtgagccctttgagaggaagaccagcatcgtggactgtggcatctacacccccaagggctacctggaccagtgggccacccgggcctacagcagccatgaggacaagaagaagtgccctgtgtccctggtgactggagagccccacagcctcatctgcaccagctaccacccagacctgcccaaccaccggcccctgaccggctggttcccctgtgtggcctctgaaaatgagacccaggatgacagaagtgagcagcctgagggcagcctgaagaaggaggatgaggtgtggctgaaggtgtgcttcaacagacctggagaggcccgggccatcttcatcttcctgaccacagatggcctggtgcctggagagcaccagcagcccaccgtgaccctgtacctgacagatgtgcggggcagcaaccacagcctgggcacctacggcctgagctgccagcacaaccccctcatcatcaacgtgacccaccaccagaatgtgctcttccaccacaccacctctgtgctgctgaacttcagcagcccccgggtgggcatctctgctgtggccctgcggaccagcagcagaattggcctgagcgcccccagcaactgcatcagtgaagatgagggccagaaccaccagggccagagctgcatccaccggccctgtgggaagcaggacagctgccccagcctgctgctggaccacgcagatgtggtgaactgcaccagcatcggccctggcctgatgaagtgtgccatcacctgccagaggggctttgccctgcaggccagcagcggccagtacatccggcccatgcagaaggagatcctgctgacctgcagcagcggccactgggaccagaatgtgtcctgcctgcctgtggactgtggggtgcctgaccccagcctggtgaactatgccaacttcagctgcagcgagggcaccaagttcctgaagcgctgcagcatcagctgtgtgcccccagccaagctgcagggcctgagcccctggctgacctgcctggaggatggcctgtggagcctgcctgaggtgtactgcaagctggagtgtgatgccccacccatcatcctgaatgccaacctgctgctgccccactgcctgcaggacaaccatgatgtgggcaccatctgcaagtatgagtgcaagccaggctactacgtggccgagagcgctgagggcaaggtgaggaacaagctgctgaagatccagtgcctggagggcggcatctgggagcagggcagctgcatccctgtggtgtgtgagcccccacctcctgtgtttgagggcatgtatgaatgtaccaacggcttcagcctggacagccagtgtgtgctgaactgcaaccaggagcgggagaagctgcccatcctgtgcaccaaggagggcctgtggacccaggagttcaagctgtgtgagaacctgcagggcgagtgccccccaccacccagcgagctgaacagcgtggagtacaagtgtgagcagggctatggaattggagctgtgtgcagccccctgtgtgtgatcccccccagcgaccctgtgatgctgcctgagaacatcacagctgacaccctggagcactggatggagcctgtgaaggtgcagagcatcgtgtgcacaggaagacggcagtggcacccagaccctgtgctggtgcactgcatccagagctgtgagcccttccaggctgatggctggtgtgacaccatcaacaacagagcctactgccactatgatggaggagactgctgcagcagcaccctgagcagcaagaaggtgatcccctttgctgctgactgtgacctggatgaatgtacctgccgggaccccaaggccgaggagaaccagtag

SEQ ID NO: 7382 - DNA, 702 bp, Artificial Sequence
  Description of Artificial Sequence: Synthetic coding sequence
atgaaggaccccctggccaaggatgagcgcatctacgtgaccaactactactacggcaacaccctggtggagttcaggaacctggagaacttcaagcagggccgctggagcaacagctacaagctgccctacagctggattggaactggacatgtggtgtacaatggagccttctactacaacagagccttcaccaggaacatcatcaagtatgacctgaagcagagatatgtggccgcctgggccatgctgcatgatgtggcctatgaggaggccaccccctggcgctggcagggccacagtgatgtggactttgctgtggatgaaaatggcctgtggctgatctacccagccctggatgatgagggcttcagccaggaggtgattgtgctgagcaagctgaatgctgctgacctgagcacccagaaggagaccacctggaggacaggcctgcggaggaacttctacggcaactgcttcgtcatctgtggggtgctgtatgctgtggacagctacaaccagagaaatgccaacatctcctatgcctttgacacccacaccaacacccagatcgtgccccggctgctgtttgaaaatgagtacagctacaccacccagattgactacaaccccaaggaccggctgctgtatgcctgggacaatggccaccaggtgacctaccacgtgatctttgcctactag

SEQ ID NO: 7383 - DNA, 579 bp, Artificial Sequence
  Description of Artificial Sequence: Synthetic coding sequence
atgctgaagaagatctctgtgggcgtggccggggacctgaacacagtgaccatgaagctgggctgtgtgctgatggcctgggccctgtacctgagcctgggcgtgctgtgggtggcccagatgctgctggccgccagctttgagaccctgcagtgtgagggccctgtgtgcacagaggagagcagctgccacacagaagatgacctgacagatgcccgggaggccggcttccaggtgaaggcctacaccttcagcgagcccttccacctgattgtgtcctatggagccagcagcagcgctgccccacccaccctgaacccagccccccagaagtctgctgcccctggaacagcccctgaggaggcccctggccccctgcccccaccacccacccccagcagtgaagatcctggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 7384 - DNA, 459 bp, Artificial Sequence
  Description of Artificial Sequence: Synthetic coding sequence
atgctgctggccgccagctttgagaccctgcagtgtgagggccctgtgtgcacagaggagagcagctgccacacagaagatgacctgacagatgcccgggaggccggcttccaggtgaaggcctacaccttcagcgagcccttccacctgattgtgtcctatggagccagcagcagcgctgccccacccaccctgaacccagccccccagaagtctgctgcccctggaacagcccctgaggaggcccctggccccctgcccccaccacccacccccagcagtgaagatcctggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 7385 - DNA, 1098 bp, Artificial Sequence
  Description of Artificial Sequence: Synthetic coding sequence
atgaagctgggctgtgtgctgatggcctgggccctgtacctgagcctgggcgtgctgtgggtggcccagatgctgctggccgccggctgccacgccgccgccagctttgagaccctgcagtgtgagggccctgtgtgcacagaggagagcagctgccacacagaagatgacctgacagatgcccgggaggccggcttccaggtgaaggcctacaccttcagcgagcccttccacctgattgtgtcctatgactggctgatcctgcagggccctgccaagcctgtgtttgaaggagacctgctggtgctgcgctgccaggcctggcaggactggcccctgacccaggtgaccttctacagagatggcagcgccctgggccccccaggccccaaccgggagttcagcatcaccgtggtgcagaaggctgacagcggccactaccactgcagcggcatcttccagagccctggccctggcatccctgagacagcctctgtggtggccatcaccgtgcaggagctgtttcctgcccccatcctgcgggctgtgcccagcgctgagccccaggccggcagccccatgaccctgagctgccagaccaagctgcccctgcagaggtctgctgcccggctgctcttctccttctacaaggatggaagaattgtgcagagccggggcctgagcagcgagttccagatccccacagccagcgaggaccacagcggcagctactggtgtgaggccgccacagaggacaaccaggtgtggaagcagagcccccagctggagatccgggtgcagggcgccagcagcagcgctgccccacccaccctgaacccagccccccagaagtctgctgcccctggaacagcccctgaggaggcccctggccccctgcccccaccacccacccccagcagcgaggaccccggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 7386 - DNA, 711 bp, Artificial Sequence
  Description of Artificial Sequence: Synthetic coding sequence
atgctgaagaagatctctgtgggcgtggccggggacctgaacacagtgaccatgaagctgggctgtgtgctgatggcctgggccctgtacctgagcctgggcgtgctgtgggtggcccagatgctgctggagctgtttcctgcccccatcctgcgggctgtgcccagcgctgagccccaggccggcagccccatgaccctgagctgccagaccaagctgcccctgcagaggtctgctgcccggctgctcttctccttctacaaggatggccgcatcgtgcagagccggggcctgagcagcgagttccagatccccacagccagcgaggaccacagcggcagctactggtgtgaggccgccacagaggacaaccaggtgtggaagcagagcccccagctggagatccgggtgcagggcgccagcagcagcgctgccccacccaccctgaacccagccccccagaagtctgctgcccctggaacagcccctgaggaggcccctggccccctgcccccaccacccacccccagcagtgaagatcctggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 7387 - DNA, 1149 bp, Artificial Sequence
  Description of Artificial Sequence: Synthetic coding sequence
atgctgaagaagatctctgtgggcgtggccggggacctgaacacagtgaccatgaagctgggctgtgtgctgatggcctgggccctgtacctgagcctgggcgtgctgtgggtggcccagatgctgctggccgccggctgccacgccgccgccagctttgagaccctgcagtgtgagggccctgtgtgcacagaggagagcagctgccacacagaagatgacctgacagatgcccgggaggccggcttccaggtgaaggcctacaccttcagcgagcccttccacctgattgtgtcctatgactggctgatcctgcagggccctgccaagcctgtgtttgaaggagacctgctggtgctgcgctgccaggcctggcaggactggcccctgacccaggtgaccttctacagagatggcagcgccctgggccccccaggccccaaccgggagttcagcatcaccgtggtgcagaaggctgacagcggccactaccactgcagcggcatcttccagagccctggccctggcatccctgagacagcctctgtggtggccatcaccgtgcaggagctgtttcctgcccccatcctgcgggctgtgcccagcgctgagccccaggccggcagccccatgaccctgagctgccagaccaagctgcccctgcagaggtctgctgcccggctgctcttctccttctacaaggatggccgcatcgtgcagagccggggcctgagcagcgagttccagatccccacagccagcgaggaccacagcggcagctactggtgtgaggccgccacagaggacaaccaggtgtggaagcagagcccccagctggagatccgggtgcagggcgccagcagcagcgctgccccacccaccctgaacccagccccccagaagtctgctgcccctggaacagcccctgaggaggcccctggccccctgcccccaccacccacccccagcagtgaagatcctggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 7388 - DNA, 738 bp, Artificial Sequence
  Description of Artificial Sequence: Synthetic coding sequence
atgagccggctgcgggccctgctgggcctgggcctgctggtggccggcagccgggtgccccgcatcaagagccagaccatcgcctgccgcagcggccccacctggtggggcccccagaggctgaacagcggcggccgctgggacagcgaggtgatggccagcacagtggtgaagtacctgagccaggaggaggcccaggccgtggaccaggagctgttcaatgagtaccagttctctgtggaccagctgatggagctggccggcctgagctgtgccacagccatcgccaaggcctacccacccacctccatgagccgcagcccccccaccgtgctggtgatctgtggccctggcaacaatggaggagatggcctggtgtgtgcccggcacctgaagctgtttggctatgagcccaccatctactaccccaagaggcccaacaagcccctcttcaccgccctggtgacccagtgccagaagatggacatccccttcctgggggagatgcctgctgagcccatgaccattgatgagctgtatgagctggtggtggatgccatcttcggcttctccttcaagggagatgtgcgggagcccttccacagcatcctgtctgtgctgaagggcctgactgtgcccatcgccagcattgacatccccagcggggccggcatccagaaggtgggctggggccgcctgggcccctaccccccagacagctgcccccaccaggtgtag

SEQ ID NO: 7389 - DNA, 783 bp, Artificial Sequence
  Description of Artificial Sequence: Synthetic coding sequence
atgagccggctgcgggccctgctgggcctgggcctgctggtggccggcagccgggtgccccgcatcaagagccagaccatcgcctgccgcagcggccccacctggtggggcccccagaggctgaacagcggcggccgctgggacagcgaggtgatggccagcacagtggtgaagtacctgagccaggaggaggcccaggccgtggaccaggagctgttcaatgagtaccagttctctgtggaccagctgatggagctggccggcctgagctgtgccacagccatcgccaaggcctacccacccacctccatgagccgcagcccccccaccgtgctggtgatctgtggccctggcaacaatggaggagatggcctggtgtgtgcccggcacctgaagctgtttggctatgagcccaccatctactaccccaagaggcccaacaagcccctcttcaccgccctggtgacccagtgccagaagatggacatccccttcctgggggagatgcctgctgagctgcagggccgctgcagcggcaccgtgccccagcaccctgagtgcccagagggcacccactgtgcccactgccagcaccgccacagcctgaggatgggccgcggggagggcaagtgctggagggaccctgcccggctggcccacatcccccacagcccccagaagatctgcaaccctgtgtaccgcagcctgcccctgcccggcggcagcttctgtgccacctgcagcggggaggaggtgcctgctgagcccgccaccctgccctag

SEQ ID NO: 7390 - DNA, 867 bp, Artificial Sequence
  Description of Artificial Sequence: Synthetic coding sequence
atgagccggctgcgggccctgctgggcctgggcctgctggtggccggcagccgggtgccccgcatcaagagccagaccatcgcctgccgcagcggccccacctggtggggcccccagaggctgaacagcggcggccgctgggacagcgaggtgatggccagcacagtggtgaagtacctgagccaggaggaggcccaggccgtggaccaggagctgttcaatgagtaccagttctctgtggaccagctgatggagctggccggcctgagctgtgccacagccatcgccaaggcctacccacccacctccatgagccgcagcccccccaccgtgctggtgatctgtggccctggcaacaatggaggagatggcctggtgtgtgcccggcacctgaagctgtttggctatgagcccaccatctactaccccaagaggcccaacaagcccctcttcaccgccctggtgacccagtgccagaagatggacatccccttcctgggggagatgcctgctgagcccatgaccattgatgagctgtatgagctggtggtggatgccatcttcggcttctccttcaagggagatgtgcgggagcccttccacagcatcctgtctgtgctgaagggcctgactgtgcccatcgccagcattgacatccccagcggctgggatgtggagaagggaaatgctgggggcatccagcctgacctgctgatcagcctgacagcccccaagaagagcgccacccagttcaccggccgctaccactacctgggcggccgctttgtgcccccagccctggagaagaagtaccagctgaacctgcccccctacccagacacagaatgtgtgtaccgcctgcagtag

SEQ ID NO: 7391 - DNA, 879 bp, Artificial Sequence
  Description of Artificial Sequence: Synthetic coding sequence
atgcacctgcggctcatctcctggctgttcatcatcctgaacttcatggagtacatcggcagccagaatgccagccggggccggcggcagaggaggatgcaccccaacgtgtcccagggctgccagggcggctgtgccacctgcagcgactacaacggctgcctgagctgcaagcccaggctcttctttgccctggagcgcatcggcatgaagcagattggagtgtgcctgagcagctgccccagcggctactacggcacccgctacccagacatcaacaagtgcaccaagtgcaaggctgactgtgacacctgcttcaacaagaacttctgcaccaagtgcaagagcggcttctacctgcacctgggcaagtgcctggacaactgcccagagggcctggaggccaacaaccacaccatggagtgtgtgtccatcgtgcactgtgaggtgtctgagtggaacccctggagcccctgcaccaagaagggcaagacctgtggcttcaagaggggcacagagaccagggtgcgggagatcatccagcaccccagcgccaagggcaacctgtgcccccccaccaatgagaccaggaagtgcaccgtgcagaggaagaagtgccagaagggggagcggggcaagaagggccgggagaggaagaggaagaagcccaacaagggggagagcaaggaggccatcccagacagcaagagcctggagagcagcaaggagatccctgagcagcgggagaacaagcagcagcagaagaagaggaaggtgcaggacaagcagaagtctggaattgaggtgaccctggccgagggcctgacctctgtgtcccagaggacccagcccaccccctgcagaagacgctacctgtag

SEQ ID NO: 7392 - DNA, 2871 bp, Artificial Sequence
  Description of Artificial Sequence: Synthetic coding sequence
atggagacccaggagctgcggggggccctggccctgctgctgctgtgcttcttcaccagcgccagccaggacctgcaggtgattgacctgctgactgtgggggagagccggcagatggtggccgtggccgagaagatcagaacagccctgctgacagctggggacatctacctgctgagcaccttccggctgccccccaagcagggcggcgtgctgtttggcctgtacagccggcaggacaacacccgctggctggaggcctctgtggtgggcaagatcaacaaggtgctggtgcgctaccagagagaagatggcaaggtgcatgctgtgaacctgcagcaggccggcctggctgatggccgcacccacacagtgctgctgcggctgcggggccccagccggcccagccctgccctgcacctgtatgtggactgcaagctgggggaccagcacgccggcctgcctgccctggcccccatccccccagctgaggtggatggcctggagatcagaacaggccagaaggcctacctgaggatgcagggctttgtggagagcatgaagatcatcctgggcggctccatggcccgggtgggcgccctgtctgaatgtcccttccagggagatgagagcatccacagcgctgtgaccaatgccctgcacagcatcctgggggagcagaccaaggccctggtgacccagctgaccctcttcaaccagatcctggtggagctgagagatgacatccgggaccaggtgaaggagatgagcctcatccggaacaccatcatggagtgccaggtgtgtggcttccacgagcagaggagccactgcagccccaacccctgcttccggggcgtggactgcatggaggtgtatgagtacccaggctaccgctgtggcccctgccccccaggcctgcagggcaatggcacccactgcagcgacatcaatgaatgtgcccatgctgacccctgcttccctggcagcagctgcatcaacaccatgcctggcttccactgtgaggcctgcccccggggctacaagggcacccaggtgtctggagtgggcatcgactatgcccgggccagcaagcaggtgtgcaatgacattgatgaatgtaatgatggcaacaatggaggctgtgaccccaacagcatctgcaccaacacagtgggcagcttcaagtgtggcccctgccgcctgggcttcctgggcaaccagagccagggctgcctgcctgcccggacctgccacagccctgcccacagcccctgccacatccacgcccactgcctgtttgaaagaaatggagctgtgtcctgccagtgcaatgtgggctgggccggaaatggaaatgtgtgtggcacagacacagacattgatggctacccagaccaggccctgccctgcatggacaacaacaagcactgcaagcaggacaactgcctgctgacccccaacagcggccaggaggatgctgacaatgatggagtgggggaccagtgtgatgatgatgctgatggagatggcatcaagaatgtggaggacaactgccgcctcttccccaacaaggaccagcagaacagcgacacagacagctttggagatgcctgtgacaactgccccaacgtgcccaacaatgaccagaaggacacagatggaaatggagaaggagatgcctgtgacaatgatgtggatggagatggcatccccaacggcctggacaactgccccaaggtgcccaaccccctgcagacagacagagatgaagatggagtgggagatgcctgtgacagctgcccagagatgagcaaccccacccagacagatgctgacagcgacctggtgggagatgtgtgtgacaccaatgaagattctgatggagatggccaccaggacaccaaggacaactgcccccagctgcccaacagcagccagctggacagcgacaatgatggcctgggagatgaatgtgatggagatgatgacaatgatggcatcccagactatgtgcccccaggccctgacaactgccgcctggtgcccaaccccaaccagaaggacagtgatggaaatggagtgggagatgtgtgtgaagatgactttgacaatgatgctgtggtggaccccctggatgtgtgcccagagagcgctgaggtgaccctgacagacttccgggcctaccagacagtggtgctggaccctgaaggagatgcccagattgaccccaactgggtggtgctgaaccagggcatggagatcgtgcagaccatgaacagcgaccccggcctggccgtgggctacacagccttcaatggagtggactttgagggcaccttccacgtgaacacagtgacagatgatgattatgccggcttcctgttctcctaccaggacagcggccgcttctacgtggtgatgtggaagcagacagagcagacctactggcaggccacccccttccgggctgtggcccagcccggcctgcagctgaaggctgtgacctctgtgtctggccctggagagcacctgagaaatgccctgtggcacacaggccacaccccagaccaggtgcggctgctgtggacagaccccagaaatgtgggctggagggacaagaccagctaccgctggcagctgctgcaccggccccaggtgggctacatccgggtgaagctgtatgagggcccccagctggtggccgacagcggggtcatcatcgacacctccatgaggggcggccgcctgggcgtcttctgcttcagccaggagaacatcatctggagcaacctgcagtaccgctgcaatgacacagtgcctgaggactttgagcccttccggcggcagctgctgcagggccgggtgtag

SEQ ID NO: 7393 - DNA, 1110 bp, Artificial Sequence
  Description of Artificial Sequence: Synthetic coding sequence
atgctgccctggctgctggtgttttctgccctgggcatccaggcctggggagacagctcctggaacaagacccaggccaagcaggtgtctgagggcctgcagtacctgtttgagaacatcagccagctgacagagaaggatgtgtccaccaccgtgtccaggaaggcctggggcgctgaggccgtgggctgcagcatccagctgaccacccctgtgaatgtgctggtgatccaccacgtgcccggcctggagtgccacgaccagacagtgtgcagccagaggctgcgggagctgcaggcccaccacgtgcacaacaacagcggctgtgatgtggcctacaacttcctggtgggagatgatggccgggtgtatgagggcgtgggctggaacatccagggcgtgcacacccagggctacaacaacatcagcctgggctttgccttcttcggcaccaagaagggccacagccccagccctgctgccctgagcgccatggagaacctgatcacctatgctgtgcagaagggccacctgagcagcagctatgtgcagcccctgctgggcaaaggagagaactgcctggccccccggcagaagaccagcctgaagaaggcctgccctggggtggtgcccaggtctgtgtggggcgcccgggagacccactgccccaggatgaccctgcctgccaagtatggcatcatcatccacacagctggccgcacctgcaacatcagtgatgaatgtcggctgctggtgcgggacatccagagcttctacatcgaccggctgaagagctgtgacatcggctacaacttcctggtgggccaggatggagccatctatgaaggagtgggctggaatgtgcagggcagcagcaccccaggctatgatgacatcgccctgggcatcaccttcatgggcaccttcaccggcatccccccaaatgctgctgccctggaggccgcccaggacctgatccagtgtgccatggtgaagggctacctgacccccaactacctgctggtgggccacagtgatgtggcccggaccctgagccctggccaggccctgtacaacatcatcagcacctggccccacttcaagcactag

SEQ ID NO: 7394 - DNA, 675 bp, Artificial Sequence
  Description of Artificial Sequence: Synthetic coding sequence
atggagaagatcccctttgtgctgggcggcaacctgcagggcggggagctggtggtggcctacccctatgacctggtgcgcagcccctggaagacccaggagcacacccccaccccagatgaccacgtgttccgctggctggcctacagctatgccagcacccaccggctgatgacagatgccaggagaagagtgtgccacacagaggacttccagaaggaggagggcaccgtgaatggagcctcctggcacacagtggccggcagcctgaatgacttctcctacctgcacaccaactgctttgagctgagcatctacgtgggctgtgacaagtacccccatgagagccagctgcctgaggagtgggagaacaaccgggagagcctcatcgtgttcatggagcaggtgcaccggggcatcaagggcctggtgcgggacagccacggcaagggcatccccaatgccatcatctctgtggagggcatcaaccacgacatcagaacaggccgggtgtccctgcagaagctgagcctggcctgcagaagagtgcgctgtgcctttgccctgagcagcagcagcaccatgattgtgcggcccccccagccctatggaacagtgccccacagcagcccagaccctgtgaccaccaagatcagccccctgaggaacttctag

SEQ ID NO: 7395 - DNA, 285 bp, Artificial Sequence
  Description of Artificial Sequence: Synthetic coding sequence
atgcctgtgattgctgggggcatcctggccgccctgctgctgctgattgtggtggtgctgtgcctgtacttcaagatccacaatgccctgaaggccgccaaggagcctgaggccgtggccgtgaagaaccacaacccagacaaggtgtggtgggccaagaacagccaggccaagaccatcgccacagagagctgcccagccctgcagtgctgtgagggctacaggatgtgtgccagctttgacagcctgcccccctgctgctgtgacatcaatgaaggcctgtag

SEQ ID NO: 7396 - DNA, 285 bp, Artificial Sequence; identical to SEQ ID NO: 7395
  Description of Artificial Sequence: Synthetic coding sequence

SEQ ID NO: 7397 - DNA, 1026 bp, Artificial Sequence
  Description of Artificial Sequence: Synthetic coding sequence
atggtgcctgctgctggggccctgctgtgggtgctgctgctgaacctgggccccagggctgctggggcccagggcctgacccagacccccacagagatgcagagggtgtccctgcgctttggaggccccatgaccaggagctaccgcagcacagccaggacaggcctgcccaggaagacccgcatcatcctggaggatgaaaatgatgccatggctgatgctgaccggctggccggccctgctgctgctgagctgctggccgccaccgtgtccacaggcttcagccgcagcagcgccatcaatgaagaagatggcagcagcgaggagggcgtggtgatcaatgccggcaaggacagcaccagccgggagctgcccagcgccacccccaacacagctggcagcagcagcacccgcttcatcgccaacagccaggagcctgagatccggctgaccagcagcctgcccaggagccctggccgcagcacagaggacctgcccggcagccaggccaccctgagccagtggagcaccccaggcagcacccccagccgctggcccagccccagccccacagccatgcccagccctgaggacctgcggctggtgctgatgccctggggcccctggcactgccactgcaagagcggcaccatgagccgcagccgcagcggcaagctgcacggcctgagcggccgcctgcgggtgggcgccctgagccagctgaggacagagcacaagccctgcacctaccagcagtgcccctgcaaccggctgcgggaggagtgccccctggacaccagcctgtgcacagacaccaactgtgccagccagagcaccaccagcaccaggaccaccaccacccccttccccaccatccacctgcggagcagccccagcctgcccccagccagcccctgcccagccctggccttctggaagagggtgagaattggcctggaggacatctggaacagcctgagcagcgtcttcacagagatgcagcccatcgacaggaaccagaggtag

SEQ ID NO: 7398 - DNA, 366 bp, Artificial Sequence
  Description of Artificial Sequence: Synthetic coding sequence
atggatgtgctgtttgtggccatctttgctgtgcccctcatcctgggccaggagtatgaagatgaggagcggctgggagaagatgagtactaccaggtggtgtactactacacagtgacccccagctatgatgacttctctgctgacttcaccatcgactacagcatctttgaaagtgaggaccggctgaaccggctggacaaggacatcacagaggccatcgagaccaccatcagcctggagacagcccgggctgaccaccccaagcctgtgacagtgaagcctgtgaccacagagcctgtggaggagggctgctatgacagcctggatggcagcctggcccggggcaactggaagatcaagtag

SEQ ID NO: 7399 - DNA, 396 bp, Artificial Sequence
  Description of Artificial Sequence: Synthetic coding sequence
atggatgtgctgtttgtggccatctttgctgtgcccctcatcctgggccaggagtatgaagatgaggagcggctgggagaagatgagtactaccaggtggtgtactactacacagtgacccccagctatgatgacttctctgctgacttcaccatcgactacagcatctttgaaagtgaggaccggctgaaccggctggacaaggacatcacagaggccatcgagaccaccatcagcctggagacagcccgggctgaccaccccaagcctgtgacagtgaagcctgtgaccacagagcccagcccagacctgaatgatgctgtgagcagcctgcggagccccatccccctgctgctgagctgtgcctttgtgcaggtgggcatgtacttcatgtag

SEQ ID NO: 7400 - DNA, 396 bp, Artificial Sequence; identical to SEQ ID NO: 7399
  Description of Artificial Sequence: Synthetic coding sequence

SEQ ID NO: 7401 - DNA, 312 bp, Artificial Sequence; identical to SEQ ID NO: 7320
  Description of Artificial Sequence: Synthetic coding sequence

SEQ ID NO: 7402 - DNA, 312 bp, Artificial Sequence; identical to SEQ ID NO: 7320
  Description of Artificial Sequence: Synthetic coding sequence

SEQ ID NO: 7403 - DNA, 1404 bp, Artificial Sequence
  Description of Artificial Sequence: Synthetic coding sequence
atgctgggcatctggatcgtggccttcctgttcttcggcaccagccggggcaaggaggtgtgctatgaaaggctgggctgcttcaaggatggcctgccctggaccaggaccttcagcacagagctggtgggcctgccctggagccctgagaagatcaacacccgcttcctgctgtacaccatccacaaccccaatgcctaccaggagatctctgctgtgaacagcagcaccatccaggccagctactttggaacagacaagatcacccgcatcaacattgctggctggaagacagatggcaagtggcagagggacatgtgcaatgtgctgctgcagctggaggacatcaactgcatcaacctggactggatcaatggcagccgggagtacatccatgctgtgaacaacctgcgggtggtgggcgctgaggtggcctacttcattgatgtgctgatgaagaagtttgagtacagccccagcaaggtgcacctgattggccacagcctgggcgcccacctggccggggaggccggcagccgcatccctggcctgggccgcatcaccggcctggaccctgctggccccttcttccacaacacccccaaggaggtgcggctggaccccagtgatgccaactttgtggatgtgatccacaccaatgctgcccgcatcctgtttgagctgggcgtgggcaccattgatgcctgtggccacctggacttctaccccaacggcggcaagcacatgcctggctgtgaagatctcatcacccccctgctgaagttcaacttcaatgcctacaagaaggagatggccagcttctttgactgcaaccacgcccggagctaccagttctatgcagagagcatcctgaacccagatgccttcatcgcctacccctgccgcagctacaccagcttcaaggccggcaactgcttcttctgcagcaaggagggctgccccaccatgggccactttgctgaccgcttccacttcaagaacatgaagaccaacggcagccactacttcctgaacacaggcagcctgagcccctttgcccgctggaggcacaagctgtctgtgaagctgagcggcagcgaggtgacccagggcaccgtcttcctgcgggtgggcggcgctgtgaggaagacaggagaatttgccatcgtgtctgggaagctggagcccggcatgacctacaccaagctgattgatgctgatgtgaatgtgggcaacatcacctctgtgcagttcatctggaagaagcacctgtttgaggacagccagaacaagctgggcgctgagatggtgatcaacaccagcggcaagtatggctacaagagcaccttctgcagccaggacatcatgggccccaacatcctgcagaacctgaagccctgctag

SEQ ID NO: 7404 - DNA, 1287 bp, Artificial Sequence
  Description of Artificial Sequence: Synthetic coding sequence
atgatcactggagtcttctccatgaggctgtggacccctgtgggcgtgctgaccagcctggcctactgcctgcaccagaggagagtggccctggccgagctgcaggaggctgatggccagtgccctgtggacaggagcctgctgaagctgaagatggtgcaggtggtgttcagacatggagcccggagccccctgaagcccctgcccctggaggagcaggtggagtggaacccccagctgctggaggtgcccccccagacccagtttgactacacagtgaccaacctggccggcggccccaagccctacagcccctatgacagccagtaccacgagaccaccctgaagggcggcatgtttgctggccagctgaccaaggtgggcatgcagcagatgtttgccctgggggagcggctgaggaagaactacgtggaggacatccccttcctgagccccaccttcaacccccaggaggtgttcatccgcagcaccaacatcttcaggaacctggagagcacccgctgcctgctggccggcctcttccagtgccagaaggagggccccatcatcatccacacagatgaggccgacagcgaggtgctgtaccccaactaccagagctgctggagcctgcggcagaggacccggggccggcggcagacagccagcctgcagcccggcatcagcgaggacctgaagaaggtgaaggacaggatgggcatcgacagcagtgacaaggtggacttcttcatcctgctggacaacgtggccgctgagcaggcccacaacctgcccagctgccccatgctgaagagatttgccaggatgattgagcagagagctgtggacaccagcctgtacatcctgcccaaggaggaccgggagagcctgcagatggctgtgggccccttcctgcacatcctggagagcaacctgctgaaggctgtggacagcgccacagccccagacaagatcaggaagctgtacctgtatgctgcccatgatgtgaccttcatccccctgctgatgaccctgggcatctttgaccacaagtggcccccatttgctgtggacctgaccatggagctgtaccagcacctggagagcaaggagtggtttgtgcagctgtactaccacggcaaggagcaggtgccccggggctgcccagatggcctgtgccccctggacatgttcctgaatgccatgtctgtgtacaccctgagccctgagaagtaccacgccctgtgcagccagacccaggtgatggaggtgggcaatgaggagtag

SEQ ID NO: 7405 - DNA, 711 bp, Artificial Sequence; identical to SEQ ID NO: 7362
  Description of Artificial Sequence: Synthetic coding sequence

SEQ ID NO: 7406 - DNA, 990 bp, Artificial Sequence
  Description of Artificial Sequence: Synthetic coding sequence
atggtgaccaaggcctttgtgctgctggccatctttgctgaggccagcgccaagagctgtgcccccaacaaggcagatgtgatcctggtgttctgctaccccaagaccatcatcaccaagatcccagaatgtccctacggctgggaggtgcaccagctggccctgggcggcctgtgctacaatggagtgcatgagggcggctactaccagtttgtgatcccagacctgagccccaagaacaagagctactgcggcacccagagcgagtacaagccacccatctaccacttctacagccacatcgtgtccaatgacaccaccgtgattgtgaagaaccagcctgtgaactacagcttcagctgcacctaccacagcacctacctggtgaaccaggccgcctttgaccagagggtggccaccgtgcacgtgaagaatggctccatgggcacctttgagagccagctgagcctgaacttctacaccaatgccaagttcagcatcaagaaggaggccccctttgtgctggaggccagcgagatcggcagtgacctgtttgctggggtggaggccaagggcctgagcatccgcttcaaggtggtgctgaacagctgctgggccaccccatctgctgacttcatgtaccccctgcagtggcagctgatcaacaagggctgccccacagatgagaccgtgctggtgcatgaaaatggccgggaccaccgggccaccttccagttcaatgccttccgcttccagaacatccccaagctgagcaaggtgtggctgcactgtgagaccttcatctgtgacagcgagaagctgagctgccctgtgacctgtgacaagaggaagaggctgctgcgggaccagacaggaggagtgctggtggtggagctgagcctgcggagccggggcttcagcagcctgtacagcttcagtgatgtgctgcaccacctgatcatgatgctgggcatctgtgctgtgctgtag

SEQ ID NO: 7407 - DNA, 1161 bp, Artificial Sequence
  Description of Artificial Sequence: Synthetic coding sequence
atggcccagtggcactgcagccagaggacccaggccggcggccatggagtgggggagcggctggcccagtgccaggaccagagcagcagacatgctgctgagctgcgggacttcaagaacaagatgctgcccctgctggaggtggccgagaaggagcgggaggccctgaggacagaggccgacaccatcagcggccgggtggaccggctggagcgggaggtggactacctggagacccagaacccagccctgccctgtgtggagtttgatgagaaggtgactggaggccctggcaccaagggcaagggcagaagaaatgagaagtatgacatggtgacagactgtggctacaccatcagccaggtgcgctccatgaagatcctgaagagatttggaggccctgctggcctgtggaccaaggaccccctgggccagacagagaagatctacgtgctggatggcacccagaatgacacagcctttgtgttcccccggctgcgggacttcaccctggccatggccgccaggaaggccagccgggtgcgggtgcccttcccctgggtgggcaccggccagctggtgtatggaggcttcctgtactttgcccggcggcccccaggccggcctgggggcggcggggagatggagaacaccctgcagctgatcaagttccacctggccaacagaacagtggtggacagctctgtgtttcctgctgagggcctcatccccccctacggcctgacagctgacacctacatcgacctggccgcagatgaggagggcctgtgggccgtgtatgccaccagagaagatgacagacacctgtgcctggccaagctggacccccagaccctggacacagagcagcagtgggacaccccctgccccagagaaaatgctgaggccgcctttgtgatctgtggcaccctgtatgtggtgtacaacaccaggcctgccagccgggcccgcatccagtgcagctttgatgccagcggcaccctgaccccagagcgggccgccctgccctacttccccaggagatatggagcccacgccagcctgcgctacaacccccgggagcggcagctgtatgcctgggatgatggctaccagatcgtgtacaagctggagatgaggaagaaggaggaggaggtgtag

SEQ ID NO: 7408 - DNA, 510 bp, Artificial Sequence
  Description of Artificial Sequence: Synthetic coding sequence
atgtctgagcgggtggagaggaactggagcactggaggctggctgctggccctgtgcctggcctggctgtggacccacctgaccctggccgccctgcagcccccaacagccaccgtgctggtgcagcagggcacctgtgaggtgattgctgcccaccgctgctgcaacagaaaccgcatcgaggagaggagccagacagtgaagtgcagctgcttcagcggccaggtggccggcaccacccgggccaagcccagctgtgtggatgacctgctgctggccgcccactgtgcccggcgggaccccagggctgccctgcggctgctgctgccccagccccccagcagctgcagagatggcggcgtgcgctggagccctgcctgccggggccgctctgtgcgctgcagcaggacctgcagagatggagctgctgctgtggacaccaagagcaagcccccaagaagccatgacagctcctggggcagcaggcctggccaggagcggctggactag

SEQ ID NO: 7409 - DNA, 693 bp, Artificial Sequence; identical to SEQ ID NO: 7341
  Description of Artificial Sequence: Synthetic coding sequence

SEQ ID NO: 7410 - DNA, 1176 bp, Artificial Sequence
  Description of Artificial Sequence: Synthetic coding sequence
atgctgcggcctgggggcgctgaggaggccgcccagctgcccctgcggcgggccagcgcccctgtgcctgtgcccagccctgctgccccagatggcagccgggccagcgcccggctgggcctggcctgcctgctgctgctgctgctgctgaccctgcctgcccgggtggacacctcctggtggtacatcggggccctgggcgcccgggtcatctgtgacaacatccctggcctggtgtcccggcagaggcagctgtgccagcgctacccagacatcatgaggtctgtgggggagggcgcccgggagtggatccgggagtgccagcaccagttccgccaccaccgctggaactgcaccaccctggaccgggaccacacagtgtttggccgggtgatgctgcggagcagccgggaggccgcctttgtgtatgccatcagcagcgctggggtggtgcacgccatcacccgggcctgcagccagggcgagctgtctgtgtgcagctgtgacccctacacccggggccgccaccacgaccagagaggagactttgactggggcggctgcagcgacaacatccactacggcgtgcgctttgccaaggcctttgtggatgccaaggagaagaggctgaaggatgcccgggccctgatgaacctgcacaacaacagatgtggccgcacagctgtgcggcgcttcctgaagctggagtgcaagtgccacggcgtgtctggcagctgcaccctgcggacctgctggagggccctgagtgacttcagaagaactggagactacctgcggaggagatatgatggagctgtgcaggtgatggccacccaggatggagccaacttcaccgctgcccggcagggctaccgccgggccaccaggacagacctggtgtactttgacaacagcccagactactgtgtgctggacaaggctgctggcagcctgggcacagctggccgggtgtgcagcaagaccagcaagggcacagatggctgtgagatcatgtgctgcggccggggctatgacaccaccagggtgaccagggtgacccagtgtgagtgcaagttccactggtgctgtgctgtgcgctgcaaggaatgtagaaacacagtggatgtgcacacctgcaaggcccccaagaaggccgagtggctggaccagacctag

SEQ ID NO: 7411 - DNA, 1119 bp, Artificial Sequence
  Description of Artificial Sequence: Synthetic coding sequence
atgctggatggcctgggcgtggtggccatcagcatcttcggcatccagctgaagacagagggcagcctgaggacagctgtgcccggcatccccacccagagcgccttcaacaagtgcctgcagcgctacatcggggccctgggcgcccgggtcatctgtgacaacatccctggcctggtgtcccggcagaggcagctgtgccagcgctacccagacatcatgaggtctgtgggggagggcgcccgggagtggatccgggagtgccagcaccagttccgccaccaccgctggaactgcaccaccctggaccgggaccacacagtgtttggccgggtgatgctgcggagcagccgggaggccgcctttgtgtatgccatcagcagcgctggggtggtgcacgccatcacccgggcctgcagccagggcgagctgtctgtgtgcagctgtgacccctacacccggggccgccaccacgaccagagaggagactttgactggggcggctgcagcgacaacatccactatggagtgcgctttgccaaggcctttgtggatgccaaggagaagaggctgaaggatgcccgggccctgatgaacctgcacaacaacagatgtggccgcacagctgtgcggcgcttcctgaagctggagtgcaagtgccacggcgtgtctggcagctgcaccctgcggacctgctggagggccctgagtgacttccggaggactggagactacctgcggcggcgctatgatggagctgtgcaggtgatggccacccaggatggagccaacttcaccgctgcccggcagggctacagaagagccaccaggacagacctggtgtactttgacaacagcccagactactgtgtgctggacaaggccgccggcagcctgggcacagctggccgggtgtgcagcaagaccagcaaaggaacagatggctgtgagatcatgtgctgcggccggggctatgacaccaccagggtgaccagggtgacccagtgtgagtgcaagttccactggtgctgtgctgtgcgctgcaaggagtgcaggaacacagtggatgtgcacacctgcaaggcccccaagaaggccgagtggctggaccagacctag

SEQ ID NO: 7412 - DNA, 1242 bp, Artificial Sequence
  Description of Artificial Sequence: Synthetic coding sequence
atggagaacatgctgctgtggctgatcttcttcaccccaggctggaccctgattgatggcagcgagatggagtgggacttcatgtggcacctgaggaaggtgcccagaattgtgtctgagaggaccttccacctgaccagccctgcctttgaagcagatgccaagatgatggtgaacacagtgtgtggcatcgagtgccagaaggagctgcccacccccagcctgtctgagctggaggactacctgtcctatgagaccgtgtttgaaaatggcaccaggaccctgaccagggtgaaggtgcaggacctggtgctggagcccacccagaacatcaccaccaagggcgtgtctgtgcggaggaagaggcaggtgtatggaacagacagccgcttcagcatcctggacaagcgcttcctgaccaacttccccttcagcacagctgtgaagctgagcacaggctgcagcggcatcctgatcagcccccagcacgtgctgacagctgcccactgtgtgcatgatggcaaggactatgtgaagggcagcaagaagctgcgggtgggcctgctgaagatgaggaacaagagcggcggcaagaagaggcggggcagcaagaggagcagaagagaggccagcggcggggaccagcgggagggcacccgggagcacctgcgggagcgggccaagggcggcagaagaaggaagaagagcggccggggccagagaattgctgagggccggcccagcttccagtggaccagggtgaagaacacccacatccccaagggctgggcccggggcggcatgggagatgccaccctggactatgactatgccctgctggagctgaagagggcccacaagaagaagtacatggagctgggcatcagccccaccatcaagaagatgcctgggggcatgatccacttcagcggctttgacaatgacagagctgaccagctggtgtaccgcttctgcagcgtgtctgatgagagcaatgacctgctgtaccagtactgtgatgctgagagcggcagcacaggcagcggcgtgtacctgcggctgaaggaccctgacaagaagaactggaagaggaagatcatcgctgtgtacagcggccaccagtgggtggatgtgcatggagtgcagaaggactacaacgtggccgtgcgcatcacccccctgaagtatgcccagatctgcctgtggatccacggcaatgatgccaactgtgcctacggctag

SEQ ID NO: 7413 - DNA, 1143 bp, Artificial Sequence
  Description of Artificial Sequence: Synthetic coding sequence
atgggcgccaccaccatggaccagaagagcctgtgggccggcagcgcctacaagctggtgtgctacttcaccaactggagccaggaccggcaggagcccgggaagttcaccccagaaaatattgaccccttcctgtgcagccacctgatctacagctttgccagcattgagaacaacaaggtgatcatcaaggacaagtctgaggtgatgctgtaccagaccatcaacagcctgaagaccaagaaccccaagctgaagatcctgctgagcattggaggctacctgtttggcagcaagggcttccaccccatggtggacagcagcaccagccggctggagttcatcaacagcatcatcctcttcctgaggaaccacaactttgatggcctggatgtgtcctggatctacccagaccagaaggagaacacccacttcaccgtgctgatccacgagctggccgaggccttccagaaggacttcaccaagagcaccaaggagcggctgctgctgacagctggggtgtctgctggccggcagatgattgacaacagctaccaggtggagaagctggccaaggacctggacttcatcaacctgctgagctttgacttccacggctcctgggagaagcccctcatcaccggccacaacagccccctgagcaagggctggcaggaccggggccccagcagctactacaacgtggagtatgctgtgggctactggatccacaagggcatgcccagcgagaaggtggtgatgggcatccccacctacggccacagcttcaccctggccagcgctgagaccaccgtgggcgccccagccagcggccctggagctgctggccccatcacagagagcagcggcttcctggcctactatgagatctgccagttcctgaagggggccaagatcacccggctgcaggaccagcaggtgccctatgctgtgaagggcaaccagtgggtgggctatgatgatgtgaagtccatggagaccaaggtgcagttcctgaagaacctgaacctgggcggggccatgatctggagcattgacatggatgacttcaccgggaagagctgcaaccagggcccctaccccctggtgcaggccgtgaagaggagcctgggcagcctgtag

SEQ ID NO: 7414 - DNA, 1173 bp, Artificial Sequence
  Description of Artificial Sequence: Synthetic coding sequence
atgggcgccaccaccatggaccagaagagcctgtgggccggcgtggtggtgctgctgctgctgcagggcggcagcgcctacaagctggtgtgctacttcaccaactggagccaggaccggcaggagcccgggaagttcaccccagaaaatattgaccccttcctgtgcagccacctgatctacagctttgccagcattgagaacaacaaggtgatcatcaaggacaagtctgaggtgatgctgtaccagaccatcaacagcctgaagaccaagaaccccaagctgaagatcctgctgagcattggaggctacctgtttggcagcaagggcttccaccccatggtggacagcagcaccagccggctggagttcatcaacagcatcatcctcttcctgaggaaccacaactttgatggcctggatgtgtcctggatctacccagaccagaaggagaacacccacttcaccgtgctgatccacgagctggccgaggccttccagaaggacttcaccaagagcaccaaggagcggctgctgctgacagctggggtgtctgctggccggcagatgattgacaacagctaccaggtggagaagctggccaaggacctggacttcatcaacctgctgagctttgacttccacggctcctgggagaagcccctcatcaccggccacaacagccccctgagcaagggctggcaggaccggggccccagcagctactacaacgtggagtatgctgtgggctactggatccacaagggcatgcccagcgagaaggtggtgatgggcatccccacctacggccacagcttcaccctggccagcgctgagaccaccgtgggcgccccagccagcggccctggagctgctggccccatcacagagagcagcggcttcctggcctactatgagatctgccagttcctgaagggggccaagatcacccggctgcaggaccagcaggtgccctatgctgtgaagggcaaccagtgggtgggctatgatgatgtgaagtccatggagaccaaggtgcagttcctgaagaacctgaacctgggcggggccatgatctggagcattgacatggatgacttcaccgggaagagctgcaaccagggcccctaccccctggtgcaggccgtgaagaggagcctgggcagcctgtag

SEQ ID NO: 7415 - DNA, 2202 bp, Artificial Sequence
  Description of Artificial Sequence: Synthetic coding sequence
atggccggcggccgggagacctgcctgcccctcatcggcttcatcctgatctgcctgaagatggtggccagcgccaagagcgcccctgagatccccaccatcgaccaggcctacagcaagctgagcaacagcatcaccgtggagtgggccaccgtgcctggggccaccagctacctgctgacagcagaagatggagacacagtgattgagaccaccgtggccaacagccctggcaccgtgacaggcctgaaggccgccacctggtatgagatcaccatccgcagcatctctgctgctggccgcagccaggccagcccccccaagcaggccaagacagtgctggccgcccccatcctggaggtgagcagccccagcagtgacagcatcctggtgcagtgggaggccgtgtacatggccatcgccttctctgtgtccatcatgagggccaacggcctgggcagcatctggaaggagaacaccaccaacaccagcctgaccttcaccagcctggaggccggcaccctgtacaccatcaaggcctatgcctggaatgccaaccgcatccctggagatgacagcacctgcaaccagaggaccagcccccgggccccagccaacatccaggtgtcctttgattctggggccctgaaggccagcttctcctgggcccgggcagagggcgccttcaactacacagtgatggccctgagtgacagcagcgagctgacctgcagcaccaccttcagcagctgcaccatcagcagcctgcagtgtggcacagagtacctgatctctgtgctggccagcaatgatgctggcagcagcaagagcagcagcgccatgaccctgaagacagtggcctgtgcccctggccgggtgaccatccaggaggaccccccaggccacctgtctgtggcctggagctctgtggacctgggggactactacgtggtgtttgtgaagagtgatgatggcctggaggtgcactgcaacaccagcctgacccagtgcaacttcctgtctgaatgtggcttcacctacttcatctctgtgtttgtgtacaacaaggccggccagagccccctgggggacatcttcaactacaccacagccccctgctgccccagcgacatcaaccctgtgctggtgtccagtgacagagtggagatcgtgtggagccctgtgagaggagctgagctgtatgagaccaaggctgtggatggctacaacatggtggagtgcaatgacaccaccccagcctgcaccctgagcgccctggagtgtgacaccaagtacaacatcaccgtgtacagcttcaatgaggtgcggggcagcaacatgagctgcaccccccagttcatcaccacagccccctgcagccctgagatcaagaatgtgtccagagatgccttctccatgatcaacgtgcactggaggagcaccaatgatgatgccacctacacagtgacagcccagggcgagaagggcctgtaccagtgcagcagcactggagagagctgcaccatgaggggcctgccctgtggcagcgtcttctctgtgacagctgtggccgagacccaggccggccgcagcctgcccagctacagcgtgcccctggagaccgtgccctgctgccccaccggcctgactgtgacccagatcacccagagcgtcatcaacgtgtcctggaccatcggccgggtggcccagacccacgtggccgtgctggagagccacacaggccagagcaagtgccacacccaccagaaccactgcctgctgggctgcatcacctgtggcatcaactacacagtgaccctgaaggccatcagcgccaccggcctgacagctgactgcagctaccagagctacttcagcggggcctgctgccccctgggcgtgaagctgtaccgcctgggccccaacggcatccgcatctactggcaggccagccggggcagcgccaactacagcacagacctgtatggcagcaagggcatcttcacctgcaccccatctgctggcctgtccttctgtgatgtgacagagatcccctgtggagatgtgtacacagtgatggtgtcccctgtggccaagacaggcctgaagctgaccttctgccccaagaagatctacagcgtgacctgcagcggcagcaccctgggcatggtgatctaccggggcaagagaaatgaggagtag

SEQ ID NO: 7416 - DNA, 555 bp, Artificial Sequence
  Description of Artificial Sequence: Synthetic coding sequence
atgaggggccagggcaggaaggagagcctgagtgacagccgggacctggatggcagctatgaccagctgacagacagcgtggatgatgaatttgagctgagcacagtgtgccacaggcctgagggcctggagcagctgcaggagcagaccaagttcaccaggaaggagctgcaggtgctgtaccggggcttcaagaatgaatgtcccagcggcatcgtgaatgaggagaacttcaagcagatctacagccagttcttcccccagggcgacagcagcacctacgccaccttcctgttcaatgcctttgacaccaaccatgatggctctgtgtcctttgaggagatgctggacatcatgaagagcatctatgacatgatgggcaagtacacctacccagccctgcgggaggaggccccccgggagcacgtggagagcttcttccagaagatggacaggaacaaggatggagtggtgaccatcgaggagttcatcgagagctgccagaaggatgagaacatcatgaggtccatgcagctgtttgacaacgtcatctag

SEQ ID NO: 7417 - DNA, 759 bp, Artificial Sequence
  Description of Artificial Sequence: Synthetic coding sequence
atgaggggccagggcaggaaggagagcctgagtgacagccgggacctggatggcagctatgaccagctgaccggccaccccccaggccccaccaagaaggccctgaagcagcgcttcctgaagctgctgccctgctgcggcccccaggccctgcccagcgtgtctgagagcaatgtggatgatgaatttgagctgagcacagtgtgccacaggcctgagggcctggagcagctgcaggagcagaccaagttcaccaggaaggagctgcaggtgctgtaccggggcttcaagaatgaatgtcccagcggcatcgtgaatgaggagaacttcaagcagatctacagccagttcttcccccagggcgacagcagcacctacgccaccttcctgttcaatgcctttgacaccaaccatgatggctctgtgtcctttgaagattttgtggccggcctgagcgtcatcctgcggggcaccgtggatgaccggctgaactgggccttcaacctgtatgacctgaacaaggatggctgcatcaccaaggaggagatgctggacatcatgaagagcatctatgacatgatgggcaagtacacctacccagccctgcgggaggaggccccccgggagcacgtggagagcttcttccagaagatggacaggaacaaggatggagtggtgaccatcgaggagttcatcgagagctgccagaaggatgagaacatcatgaggtccatgcagctgtttgacaacgtcatctag

SEQ ID NO: 7418 - DNA, 1377 bp, Artificial Sequence
  Description of Artificial Sequence: Synthetic coding sequence
atgcaggccaccagcaacctgctgaacctgctgctgctgagcctgtttgctggcctggaccccagcaagacccagatcagccccaaggagggctggcaggtgtacagcagcgcccaggaccctgatggccgctgcatctgcaccgtggtggcccctgagcagaacctgtgcagcagagatgccaagagccggcagctgcggcagctgctggagaaggtgcagaacatgagccagagcattgaggtgctgaacctgcggacccagagggacttccagtatgtgctgaagatggagacccagatgaagggcctgaaggccaagttccggcagattgaagatgacaggaagaccctgatgaccaagcacttccaggagctgaaggagaagatggatgagctgctgcccctcatccctgtgctggagcagtacaagacagatgccaagctgatcacccagttcaaggaggagatccggaacctgtctgctgtgctgaccggcatccaggaggagattggagcctatgactatgaggagctgcaccagagggtgctgagcctggagacccggctgcgggactgcatgaagaagctgacctgtgggaagctgatgaagatcaccggccctgtgacagtgaagaccagcggcaccaggtttggagcctggatgacagaccccctggccagcgagaagaacaacagagtgtggtacatggacagctacaccaacaacaagatcgtgcgggagtacaagagcattgctgactttgtgtctggagctgagagcaggacctacaacctgcccttcaagtgggccggcaccaaccacgtggtgtacaacggcagcctgtacttcaacaagtaccagagcaacatcatcatcaagtacagctttgacatgggccgggtgctggcccagaggagcctggagtatgccggcttccacaacgtgtacccctacacctggggcggcttcagtgacatcgacctgatggctgatgagatcggcctgtgggccgtgtatgccaccaaccagaatgccggcaacatcgtcatcagccagctgaaccaggacaccctggaggtgatgaagtcctggagcacaggctaccccaagaggtctgctggggagagcttcatgatctgtggcaccctgtatgtgaccaacagccacctgaccggggccaaggtgtactacagctacagcaccaagaccagcacctatgagtacacagacatccccttccacaaccagtacttccacatctccatgctggactacaatgcccgggaccgggccctgtatgcctggaacaacggccaccaggtgctcttcaacgtgaccctcttccacatcatcaagacagaagatgacacctag

SEQ ID NO: 7419 - DNA, 915 bp, Artificial Sequence
  Description of Artificial Sequence: Synthetic coding sequence
atgctgcccccacccaggcctgctgctgccctggccctgcctgtgctgctgctgctgctggtggtgctgaccccaccacccaccggggcccggcccagccctggccctgactacctgcggcggggctggatgaggctgctggccgagggggagggctgtgccccctgcaggcctgaggagtgtgccgccccccggggctgcctggccggccgggtgagagatgcctgtggctgctgctgggagtgtgccaacctggagggccagctgtgtgacctggaccccagcgcccacttctacggccactgtggggagcagctggagtgccgcctggacaccggcggggacctgagcagaggagaggtgcctgagcccctgtgtgcctgccgcagccagagccccctgtgtggcagtgatggccacacctacagccagatctgccgcctgcaggaggccgcccgggcccggccagatgccaacctgactgtggcccaccctggcccctgtgagagcggcccccagatcgtgagccacccctatgacacctggaatgtgacaggccaggacgtcatcttcggctgtgaggtgtttgcctaccccatggccagcattgagtggaggaaggatggcctggacatccagctgcctggagatgacccccacatctctgtgcagttccggggcggcccccagagatttgaggtgacaggctggctgcagatccaggccgtgcggcccagtgatgagggcacctaccgctgcctgggcagaaatgccctgggccaggtggaggccccagccagcctgactgtgctgaccccagaccagctgaacagcacaggcatcccccagctgcggagcctgaacctggtgcctgaggaggaggccgagagtgaagaaaatgatgactactactag

SEQ ID NO: 7420 - DNA, 327 bp, Artificial Sequence
  Description of Artificial Sequence: Synthetic coding sequence
atgacccccagccggctgccctggctgctgtcctgggtgtctgccacagcctggagggctgcccggagccccctgctgtgccacagcctgaggaagaccagcagcagccagggcggcaagtctgagctggtgaagcagagcctgaagaagcccaagctgcctgagggccgctttgatgcccctgaggacagccacctggagaaggagcccctggagaagttcccagatgatgtgaaccctgtgaccaaggagaagggcggcccccggggccctgagcccacccgctacggggactgggagaggaagggccgctgcatcgacttctag

SEQ ID NO: 7421 - DNA, 663 bp, Artificial Sequence
  Description of Artificial Sequence: Synthetic coding sequence
atggccggcctgagccggggcagcgcccgggccctgctggccgccctgctggccagcaccctgctggccctgctggtgtccccagcccggggccggggcggccgggaccatggagactgggatgaggccagccggctgccccccctgcccccaagagaagatgctgcccgggtggccaggtttgtgacccacgtgtctgactggggcgccctggccaccatcagcaccctggaggccgtgcggggccggccctttgctgatgtgctgagcctgagtgatggccccccaggggccggcagcggcgtgccctacttctacctgagccccctgcagctgtctgtgagcaacctgcaggagaacccctatgccaccctgaccatgaccctggcccagaccaacttctgcaagaagcacggctttgacccccagagccccctgtgtgtgcacatcatgctgtctggaacagtgaccaaggtgaatgaaacagagatggacatcgccaagcacagcctcttcatccgccaccctgagatgaagacctggcccagcagccacaactggttctttgccaagctgaacatcaccaacatctgggtgctggactactttggaggccccaagatcgtgaccccagaggagtactacaacgtgacagtgcagtag

SEQ ID NO: 7422 - DNA, 2760 bp, Artificial Sequence
  Description of Artificial Sequence: Synthetic coding sequence
atgggcctcttccggggctttgtgttcctgctggtgctgtgcctgctgcaccagagcaacaccagcttcatcaagctgaacaacaatggatttgaggacatcgtcatcgtcatcgaccccagcgtgcctgaagatgagaagatcatcgagcagatcgaggacatggtgaccacagccagcacctacctgtttgaggccacagagaagcgcttcttcttcaagaatgtgtccatcctgatccctgagaactggaaggagaacccccagtacaagaggcccaagcatgagaaccacaagcatgctgatgtgattgtggccccacccaccctgcccggcagagatgagccctacaccaagcagttcacagaatgtggggagaagggggagtacatccacttcaccccagacctgctgctgggcaagaagcagaatgaatatggccccccaggcaagctgtttgtgcatgagtgggcccacctgcgctggggcgtgtttgatgagtacaatgaagaccagcccttctaccgggccaagagcaagaagattgaggccacccgctgcagcgctggcatcagcggcaggaacagagtgtacaagtgccagggcggcagctgcctgagccgggcctgcagaattgacagcaccaccaagctgtatggcaaggactgccagttcttcccagacaaggtgcagacagagaaggccagcatcatgttcatgcagagcattgattctgtggtggagttctgcaatgagaagacccacaaccaggaggcccccagcctgcagaacatcaagtgcaacttccgcagcacctgggaggtgatcagcaacagcgaggacttcaagaacaccatccccatggtgaccccacctcctcctcctgtgttcagcctgctgaagatcagccagagaattgtgtgcctggtgctggacaagagcggctccatgggcggcaaggaccggctgaacaggatgaaccaggccgccaagcacttcctgctgcagacagtggagaatggctcctgggtgggcatggtgcactttgacagcacagccaccatcgtgaacaagctgatccagatcaagagcagtgatgagaggaacaccctgatggccggcctgcccacctaccccctgggcggcaccagcatctgcagcggcatcaagtatgccttccaggtgattggagagctgcacagccagctggatggcagcgaggtgctgctgctgacagatggagaggacaacacagccagcagctgcattgatgaggtgaagcagagcggggccatcgtgcacttcatcgccctgggccgggcagcagatgaagctgtgattgagatgagcaagatcactggaggcagccacttctacgtgtctgatgaggcccagaacaacggcctgattgatgcctttggagccctgaccagcggcaacacagacctgagccagaagagcctgcagctggagagcaagggcctgaccctgaacagcaatgcctggatgaatgacaccgtcatcatcgacagcacagtgggcaaggacaccttcttcctgatcacctggaacagcctgcccccatccatcagcctgtgggaccccagcggcaccatcatggagaacttcaccgtggatgccaccagcaagatggcctacctgagcatccctggaacagccaaggtgggcacctgggcctacaacctgcaggccaaggccaaccctgagaccctgaccatcaccgtgaccagccgggccgccaacagctctgtgccccccatcaccgtgaatgccaagatgaacaaggatgtgaacagcttccccagccccatgattgtgtatgcagagatcctgcagggctacgtgcctgtgctgggcgccaacgtgacagccttcatcgagagccagaatggccacacagaggtgctggagctgctggacaacggggccggggctgacagcttcaagaatgatggagtgtacagccgctacttcaccgcctacacagaaaatggccgctacagcctgaaggtgcgggcccatggaggagccaacacagcccggctgaagctgcggccccccctgaacagagctgcctacatccctggctgggtggtgaatggagaaattgaggccaacccccccaggcctgagattgatgaggacacccagaccaccctggaggacttcagcaggacagccagcggcggggcctttgtggtgtcccaggtgcccagcctgcccctgcctgaccagtacccacccagccagatcacagacctggatgccaccgtgcatgaggacaagatcatcctgacctggacagcccctggggacaactttgatgtgggcaaggtgcagcgctacatcatccgcatcagcgccagcatcctggacctgcgggacagctttgatgatgccctgcaggtgaacaccacagacctgagccccaaggaggccaacagcaaggagagctttgccttcaagccagagaacatcagcgaggagaatgccacccacatcttcatcgccatcaagagcattgacaagagcaacctgaccagcaaggtgagcaacatcgcccaggtgaccctcttcatcccccaggccaacccagatgacatcgaccccacccccacccccacccccacccccaccccagacaagagccacaacagcggcgtgaacatcagcaccctggtgctgtctgtgattggctctgtggtgattgtgaacttcatcctgagcaccaccatctag

SEQ ID NO: 7423 - DNA, 1938 bp, Artificial Sequence
  Description of Artificial Sequence: Synthetic coding sequence
atggcccccagcgctgaccccggcatgagcaggatgctgcccttcctgctgctgctgtggttcctgcccatcacagagggcagccagagagctgagcccatgttcaccgctgtgaccaacagcgtgctgcccccagactatgacagcaaccccacccagctgaactacggcgtggccgtgacagatgtggaccatgatggagactttgaaattgtggtggccggctacaacggccccaacctggtgctgaagtatgaccgggcccagaagaggctggtgaacattgctgtggatgagaggagcagcccctactatgccctgcgggaccggcagggcaatgccatcggcgtgacagcctgtgacattgatggagatggccgggaggagatctacttcctgaacaccaacaatgccttcagcggcgtggccacctacacagacaagctgttcaagttcaggaacaaccgctgggaggacatcctgagtgatgaggtgaatgtggcccggggcgtggccagcctgtttgctggccgctctgtggcctgtgtggacaggaagggcagcggccgctacagcatctacatcgccaactatgcctatggaaatgtgggcccagatgccctgattgagatggaccctgaggccagtgacctgagccggggcatcctggccctgagagatgtggccgctgaggccggcgtgtccaagtacacaggaggccggggcgtgtctgtgggccccatcctgagcagcagcgccagtgacatcttctgtgacaatgaaaatggccccaacttcctgttccacaacagaggagatggcacctttgtggatgctgctgccagcgctggggtggatgacccccaccagcacggccggggcgtggccctggccgacttcaacagagatggcaaggtggacatcgtgtatggcaactggaatggcccccaccggctgtacctgcagatgagcacccacggcaaggtgcgcttccgggacatcgccagccccaagttctccatgcccagccctgtgaggacagtcatcacagctgactttgacaatgaccaggagctggagatcttcttcaacaacatcgcctaccgcagcagcagcgccaacagactcttccgggtcatcagaagagagcacggggaccccctgattgaggagctgaaccctggagatgccctggagcctgagggccggggcactggaggagtggtgacagactttgatggagatggcatgctggacctgatcctgagccacggggagagcatggcccagcccctgtctgtgttccggggcaaccagggcttcaacaacaactggctgcgggtggtgcccaggaccaggtttggagcctttgcccggggggccaaggtggtgctgtacaccaagaagagcggggcccacctgcgcatcattgatggcggcagcggctacctgtgtgagatggagcctgtggcccacttcggcctgggcaaggatgaggccagctctgtggaggtgacctggccagatggcaagatggtgtccagaaatgtggccagcggggagatgaacagcgtgctggagatcctgtaccccagagatgaggacaccctgcaggaccctgcccccctggagtgtggccagggcttcagccagcaggagaatggccactgcatggacaccaatgaatgcatccagttcccctttgtgtgcccccgggacaagcctgtgtgtgtgaacacctacggcagctaccgctgcaggaccaacaagaagtgcagccggggctatgagcccaatgaagatggaacagcctgtgtggcccaggtggccttcctgggcggctacagcagcgctgccagccgcatcagcgagcccctgagccgggccagctacctgagcctgggcctgggcctgtgcctgcagctgtatgccctgtag

SEQ ID NO: 7424 - DNA, 1986 bp, Artificial Sequence
  Description of Artificial Sequence: Synthetic coding sequence
atggcccccagcgctgaccccggcatgagcaggatgctgcccttcctgctgctgctgtggttcctgcccatcacagagggcagccagagagctgagcccatgttcaccgctgtgaccaacagcgtgctgcccccagactatgacagcaaccccacccagctgaactacggcgtggccgtgacagatgtggaccatgatggagactttgaaattgtggtggccggctacaacggccccaacctggtgctgaagtatgaccgggcccagaagaggctggtgaacattgctgtggatgagaggagcagcccctactatgccctgcgggaccggcagggcaatgccatcggcgtgacagcctgtgacattgatggagatggccgggaggagatctacttcctgaacaccaacaatgccttcagcggcgtggccacctacacagacaagctgttcaagttcaggaacaaccgctgggaggacatcctgagtgatgaggtgaatgtggcccggggcgtggccagcctgtttgctggccgctctgtggcctgtgtggacaggaagggcagcggccgctacagcatctacatcgccaactatgcctatggaaatgtgggcccagatgccctgattgagatggaccctgaggccagtgacctgagccggggcatcctggccctgagagatgtggccgctgaggccggcgtgtccaagtacacaggaggccggggcgtgtctgtgggccccatcctgagcagcagcgccagtgacatcttctgtgacaatgaaaatggccccaacttcctgttccacaacagaggagatggcacctttgtggatgctgctgccagcgctggggtggatgacccccaccagcacggccggggcgtggccctggccgacttcaacagagatggcaaggtggacatcgtgtatggcaactggaatggcccccaccggctgtacctgcagatgagcacccacggcaaggtgcgcttccgggacatcgccagccccaagttctccatgcccagccctgtgaggacagtcatcacagctgactttgacaatgaccaggagctggagatcttcttcaacaacatcgcctaccgcagcagcagcgccaacagactcttccgggtcatcagaagagagcacggggaccccctgattgaggagctgaaccctggagatgccctggagcctgagggccggggcactggaggagtggtgacagactttgatggagatggcatgctggacctgatcctgagccacggggagagcatggcccagcccctgtctgtgttccggggcaaccagggcttcaacaacaactggctgcgggtggtgcccaggaccaggtttggagcctttgcccggggggccaaggtggtgctgtacaccaagaagagcggggcccacctgcgcatcattgatggcggcagcggctacctgtgtgagatggagcctgtggcccacttcggcctgggcaaggatgaggccagctctgtggaggtgacctggccagatggcaagatggtgtccagaaatgtggccagcggggagatgaacagcgtgctggagatcctgtaccccagagatgaggacaccctgcaggaccctgcccccctggagtgtggccagggcttcagccagcaggagaatggccactgcatggacaccaatgaatgcatccagttcccctttgtgtgcccccgggacaagcctgtgtgtgtgaacacctacggcagctaccgctgcaggaccaacaagaagtgcagccggggctatgagcccaatgaagatggaacagcctgtgtgggcaccctgggccagagccctggcccccggcccaccacccccacagctgctgctgccacagctgctgctgctgctgctgctggagctgccacagctgcccctgtgctggtggatggagacctgaacctgggctctgtggtgaaggagagctgtgagcccagctgctag

SEQ ID NO: 7425 - DNA, 1230 bp, Artificial Sequence
  Description of Artificial Sequence: Synthetic coding sequence
atggccctgaccccaggctggggcagcagcgctggccctgtgcggcctgagctgtggctgctgctgtgggccgccgcctggaggctgggcgccagcgcctgcccagccctgtgcacctgcaccggcaccaccgtggactgccacggcaccggcctgcaggccatccccaagaacatccccaggaacacagagcggctggagctgaatggaaacaacatcacccgcatccacaagaatgactttgctggcctgaagcagctgcgggtgctgcagctgatggagaaccagattggagctgtggagcggggggcctttgatgacatgaaggagctggagcggctgcggctgaacagaaaccagctgcacatgctgcctgagctgctcttccagaacaaccaggccctgagccggctggacctgtctgaaaatgccatccaggccatccccaggaaggccttccggggggccacagacctgaagaacctgcagctggacaagaaccagatcagctgcatcgaggagggcgccttccgggccctgcggggcctggaggtgctgaccctgaacaacaacaacatcaccaccatccctgtgagcagcttcaaccacatgcccaagctgcggaccttccggctgcacagcaaccacctgttctgtgactgccacctggcctggctgagccagtggctgcggcagaggcccaccatcggcctcttcacccagtgcagcggccctgccagcctgcggggcctgaatgtggccgaggtgcagaagtctgagttcagctgcagcggccagggcgaggccggccgggtgcccacctgcaccctgagcagcggcagctgcccagccatgtgcacctgcagcaatggcatcgtggactgccggggcaagggcctgacagccatcccagccaacctgcctgagaccatgacagagatccggctggagctgaatggcatcaagagcatccccccaggggccttcagcccctacaggaagctgcggagaattgacctgagcaacaaccagattgctgagatcgccccagatgccttccagggcctgcggagcctgaacagcctgcacacaggccctgtgacctgcccccacaccaccggcacccacagcagccactgccgggcctttgctgtggccgtgccccacagcagaaatgacctggaggccatgtttgaggaggaggtgccccgcatcttctacagcgcctag

SEQ ID NO: 7426 - DNA, 1143 bp, Artificial Sequence
  Description of Artificial Sequence: Synthetic coding sequence
atggccctgaccccaggctggggcagcagcgctggccctgtgcggcctgagctgtggctgctgctgtgggccgccgcctggaggctgggcgccagcgcctgcccagccctgtgcacctgcaccggcaccaccgtggactgccacggcaccggcctgcaggccatccccaagaacatccccaggaacacagagcggctggagctgaatggaaacaacatcacccgcatccacaagaatgactttgctggcctgaagcagctgcgggtgctgcagctgatggagaaccagattggagctgtggagcggggggcctttgatgacatgaaggagctggagcggctggacctgtctgaaaatgccatccaggccatccccaggaaggccttccggggggccacagacctgaagaacctgcagctggacaagaaccagatcagctgcatcgaggagggcgccttccgggccctgcggggcctggaggtgctgaccctgaacaacaacaacatcaccaccatccctgtgagcagcttcaaccacatgcccaagctgcggaccttccggctgcacagcaaccacctgttctgtgactgccacctggcctggctgagccagtggctgcggcagaggcccaccatcggcctcttcacccagtgcagcggccctgccagcctgcggggcctgaatgtggccgaggtgcagaagtctgagttcagctgcagcggccagggcgaggccggccgggtgcccacctgcaccctgagcagcggcagctgcccagccatgtgcacctgcagcaatggcatcgtggactgccggggcaagggcctgacagccatcccagccaacctgcctgagaccatgacagagatccggctggagctgaatggcatcaagagcatccccccaggggccttcagcccctacaggaagctgcggagaattgacctgagcaacaaccagattgctgagatcgccccagatgccttccagggcctgcggagcctgaacagcctggtgctgtatggcaacaagatcacagacctgccccggggcgtgtttggaggcctgtacaccctgcagctgctgctgctgaatgccaacaagatcaactgcatccggccagatgccttccaggacctgtag

SEQ ID NO: 7427 - DNA, 2448 bp, Artificial Sequence
  Description of Artificial Sequence: Synthetic coding sequence
atggccctgaccccaggctggggcagcagcgctggccctgtgcggcctgagctgtggctgctgctgtgggccgccgcctggaggctgggcgccagcgcctgcccagccctgtgcacctgcaccggcaccaccgtggactgccacggcaccggcctgcaggccatccccaagaacatccccaggaacacagagcggctggagctgaatggaaacaacatcacccgcatccacaagaatgactttgctggcctgaagcagctgcgggtgctgcagctgatggagaaccagattggagctgtggagcggggggcctttgatgacatgaaggagctggagcggctgcggctgaacagaaaccagctgcacatgctgcctgagctgctcttccagaacaaccaggccctgagccggctggacctgtctgaaaatgccatccaggccatccccaggaaggccttccggggggccacagacctgaagaacctgcagctggacaagaaccagatcagctgcatcgaggagggcgccttccgggccctgcggggcctggaggtgctgaccctgaacaacaacaacatcaccaccatccctgtgagcagcttcaaccacatgcccaagctgcggaccttccggctgcacagcaaccacctgttctgtgactgccacctggcctggctgagccagtggctgcggcagaggcccaccatcggcctcttcacccagtgcagcggccctgccagcctgcggggcctgaatgtggccgaggtgcagaagtctgagttcagctgcagcggccagggcgaggccggccgggtgcccacctgcaccctgagcagcggcagctgcccagccatgtgcacctgcagcaatggcatcgtggactgccggggcaagggcctgacagccatcccagccaacctgcctgagaccatgacagagatccggctggagctgaatggcatcaagagcatccccccaggggccttcagcccctacaggaagctgcggcgcatctgccccctgtccttctgcagcccctgccgggacctgagcaacaaccagattgctgagatcgccccagatgccttccagggcctgcggagcctgaacagcctggtgctgtatggcaacaagatcacagacctgccccggggcgtgtttggaggcctgtacaccctgcagctgctgctgctgaatgccaacaagatcaactgcatccggccagatgccttccaggacctgcagaacctgagcctgctgagcctgtatgacaacaagatccagagcctggccaagggcaccttcaccagcctgcgggccatccagaccctgcacctggcccagaaccccttcatctgtgactgcaacctgaagtggctggccgacttcctgcggaccaaccccatcgagaccagcggggcccgctgtgccagcccccggcggctggccaacaagagaattggccagatcaagagcaagaagttccgctgcagcgccaaggagcagtacttcatccctggaacagaggactaccagctgaacagcgagtgcaacagtgatgtggtgtgcccccacaagtgccgctgtgaggccaacgtggtggagtgcagcagcctgaagctgaccaagatccctgagcgcatcccccagagcacagctgagctgcggctgaacaacaatgagatcagcatcctggaggccaccggcatgttcaagaagctgacccacctgaagaagatcaacctgagcaacaacaaggtgtctgaaattgaagatggagcctttgaaggagctgcctctgtgtctgagctgcacctgacagccaaccagctggagagcatccgcagcggcatgttccggggcctggatggcctgcggaccctgatgctgaggaacaaccgcatcagctgcatccacaatgacagcttcaccggcctgagaaatgtgcggctgctgagcctgtatgacaaccagatcaccaccgtgtcccctggggcctttgacaccctgcagagcctgagcaccctgaacctgctggccaaccccttcaactgcaactgccagctggcctggctgggcggctggctgaggaagaggaagatcgtgactggaaacccccgctgccagaacccagacttcctgcggcagatccccctgcaggatgtggccttcccagacttccgctgtgaggagggccaggaggagggcggctgcctgccccggccccagtgcccccaggagtgtgcctgcctggacacagtggtgcgctgcagcaacaagcacctgcgggccctgcccaagggcatccccaagaatgtgacagagctgtacctggatggcaaccagttcaccctggtgcccggccagctgagcaccttcaagtacctgcagctggtgatcctgagctacaatgccctgcagtgcatcccccccctggccttccagtag

SEQ ID NO: 7428 - DNA, 4386 bp, Artificial Sequence
  Description of Artificial Sequence: Synthetic coding sequence
atggccctgaccccaggctggggcagcagcgctggccctgtgcggcctgagctgtggctgctgctgtgggccgccgcctggaggctgggcgccagcgcctgcccagccctgtgcacctgcaccggcaccaccgtggactgccacggcaccggcctgcaggccatccccaagaacatccccaggaacacagagcggctggagctgaatggaaacaacatcacccgcatccacaagaatgactttgctggcctgaagcagctgcgggtgctgcagctgatggagaaccagattggagctgtggagcggggggcctttgatgacatgaaggagctggagcggctgcggctgaacagaaaccagctgcacatgctgcctgagctgctcttccagaacaaccaggccctgagccggctggacctgtctgaaaatgccatccaggccatccccaggaaggccttccggggggccacagacctgaagaacctgcagctggacaagaaccagatcagctgcatcgaggagggcgccttccgggccctgcggggcctggaggtgctgaccctgaacaacaacaacatcaccaccatccctgtgagcagcttcaaccacatgcccaagctgcggaccttccggctgcacagcaaccacctgttctgtgactgccacctggcctggctgagccagtggctgcggcagaggcccaccatcggcctcttcacccagtgcagcggccctgccagcctgcggggcctgaatgtggccgaggtgcagaagtctgagttcagctgcagcggccagggcgaggccggccgggtgcccacctgcaccctgagcagcggcagctgcccagccatgtgcacctgcagcaatggcatcgtggactgccggggcaagggcctgacagccatcccagccaacctgcctgagaccatgacagagatccggctggagctgaatggcatcaagagcatccccccaggggccttcagcccctacaggaagctgcggagaattgacctgagcaacaaccagattgctgagatcgccccagatgccttccagggcctgcggagcctgaacagcctggtgctgtatggcaacaagatcacagacctgccccggggcgtgtttggaggcctgtacaccctgcagctgctgctgctgaatgccaacaagatcaactgcatccggccagatgccttccaggacctgcagaacctgagcctgctgagcctgtatgacaacaagatccagagcctggccaagggcaccttcaccagcctgcgggccatccagaccctgcacctggcccagaaccccttcatctgtgactgcaacctgaagtggctggccgacttcctgcggaccaaccccatcgagaccagcggggcccgctgtgccagcccccggcggctggccaacaagagaattggccagatcaagagcaagaagttccgctgcagcgccaaggagcagtacttcatccctggaacagaggactaccagctgaacagcgagtgcaacagtgatgtggtgtgcccccacaagtgccgctgtgaggccaacgtggtggagtgcagcagcctgaagctgaccaagatccctgagcgcatcccccagagcacagctgagctgcggctgaacaacaatgagatcagcatcctggaggccaccggcatgttcaagaagctgacccacctgaagaagatcaacctgagcaacaacaaggtgtctgaaattgaagatggagcctttgaaggagctgcctctgtgtctgagctgcacctgacagccaaccagctggagagcatccgcagcggcatgttccggggcctggatggcctgcggaccctgatgctgaggaacaaccgcatcagctgcatccacaatgacagcttcaccggcctgagaaatgtgcggctgctgagcctgtatgacaaccagatcaccaccgtgtcccctggggcctttgacaccctgcagagcctgagcaccctgaacctgctggccaaccccttcaactgcaactgccagctggcctggctgggcggctggctgaggaagaggaagatcgtgactggaaacccccgctgccagaacccagacttcctgcggcagatccccctgcaggatgtggccttcccagacttccgctgtgaggagggccaggaggagggcggctgcctgccccggccccagtgcccccaggagtgtgcctgcctggacacagtggtgcgctgcagcaacaagcacctgcgggccctgcccaagggcatccccaagaatgtgacagagctgtacctggatggcaaccagttcaccctggtgcccggccagctgagcaccttcaagtacctgcagctggtggacctgagcaacaacaagatcagcagcctgagcaacagcagcttcaccaacatgagccagctgaccaccctcatcctgagctacaatgccctgcagtgcatcccccccctggccttccagggcctgcggagcctgcggctgctgagcctgcacggcaatgacatcagcaccctgcaggagggcatctttgctgatgtgaccagcctgagccacctggccatcggggccaaccccctgtactgtgactgccacctgcgctggctgagctcctgggtgaagacaggctacaaggagcccggcatcgcccgctgtgccggcccccaggacatggagggcaagctgctgctgaccaccccagccaagaagtttgagtgccagggcccccccaccctggccgtgcaggccaagtgtgacctgtgcctgagcagcccctgccagaaccagggcacctgccacaatgaccccctggaggtgtaccgctgtgcctgccccagcggctacaagggccgggactgtgaggtgtccctggacagctgcagcagcggcccctgtgaaaatggaggcacctgccacgcccaggagggagaagatgcccccttcacctgcagctgccccactggatttgagggccccacctgtggggtgaacacagatgactgtgtggaccacgcctgtgccaacggcggcgtgtgtgtggatggagtgggcaactacacctgccagtgccccctgcagtatgagggcaaggcctgtgagcagctggtggacctgtgcagcccagacctgaacccctgccagcacgaggcccagtgtgtgggcaccccagatggcccccgctgtgagtgcatgcctggctacgccggggacaactgcagcgagaaccaggatgactgccgggaccaccgctgccagaatggagcccagtgcatggatgaggtgaacagctacagctgcctgtgtgccgagggctacagcggccagctgtgtgagatccccccccacctgcctgcccccaagagcccctgtgagggcacagagtgccagaatggagccaactgtgtggaccagggcaacagacctgtgtgccagtgcctgcccggctttggaggcccagaatgtgagaagctgctgtctgtgaactttgtggaccgggacacctacctgcagttcacagacctgcagaactggccccgggccaacatcaccctgcaggtgtccacagctgaggacaatggcatcctgctgtacaacggggacaatgaccacatcgctgtggagctgtaccagggccacgtgcgggtgtcctatgaccccggcagctaccccagcagcgccatctacagcgctgagaccatcaatgatggccagttccacacagtggagctggtggcctttgaccagatggtgaacctgagcattgatggcggcagccccatgaccatggacaactttgggaagcactacaccctgaacagcgaggcccccctgtatgtgggcggcatgcctgtggatgtgaacagcgctgccttccggctgtggcagatcctgaatggcaccggcttccacggctgcatccggaacctgtacatcaacaatgagctgcaggacttcaccaagacccagatgaagccaggagtggtgcccggctgtgagccctgcaggaagctgtactgcctgcacggcatctgccagcccaatgccaccccaggccccatgtgccactgtgaggccggctgggtgggcctgcactgtgaccagcctgcagatggcccctgccacggccacaagtgtgtgcacggccagtgtgtgcccctggatgccctgagctacagctgccagtgccaggacggctacagcggggccctgtgcaaccagagccccagcgctgggggcaccctgagcggcaccttcaccaggagcagaggagccatgcccagcgcccggccccgggccccctgccacggctggagcgctggggcccgggcccaggcccgggccgccgcccgggccttcggctag

SEQ ID NO: 7429 - DNA, 570 bp, Artificial Sequence
  Description of Artificial Sequence: Synthetic coding sequence
atggaggccaccggcacagatgaggtggacaagctgaagaccaagttcatcagcgcctggaacaacatgaagtacagctgggtgctgaagaccaagacctacttcagcaggaacagccctgtgctgctgctgggcaagtgctaccacttcaagtatgaagatgaggacaagaccctgcctgctgagagcggctgcaccatcgaggaccacgtgattgctggaaatgtggaggagttcaggaaggacttcatcagccgcatctggctgacctaccgggaggagttcccccagatcgagggcagcgccctgaccacagactgtggctggggctgcaccctgaggacaggccagatgctgctggcccagggcctcatcctgcacttcctgggccgggcctggacctggccagatgccctgaacatcgagaacagcgacagcgagagctggaccagccacacagtgaagaagttcaccgccagctttgaggccagcctgagcggggagcgggagttcaagacccccaccatcagcctgaaggagaccatcggcaagtacagtgatgaccactag

SEQ ID NO: 7430 - DNA, 1377 bp, Artificial Sequence; identical to SEQ ID NO: 7113
  Description of Artificial Sequence: Synthetic coding sequence

SEQ ID NO: 7431 - DNA, 8178 bp, Artificial Sequence
  Description of Artificial Sequence: Synthetic coding sequence
atggagcagacagactgcaagccctaccagcccctgcccaaggtgaagcatgagatggacctggcctacaccagcagcagtgatgaaagtgaagatggcaggaagccccggcagagctacaacagccgggagaccctgcacgagtacaaccaggagctgaggatgaactacaacagccagagcaggaagaggaaggaggtggagaagagcacccaggagatggagttctgtgagaccagccacaccctgtgcagcggctaccagacagacatgcacagcgtgtccagacatggctaccagctggagatgggcagtgatgtggacacagaaacagaaggagctgccagcccagaccacgccctgaggatgtggatccggggcatgaagtctgagcacagcagctgcctgagcagccgggccaacagcgccctgagcctgacagacacagaccacgagaggaagagtgatggagaaaatggcttcaagttcagccctgtgtgctgtgacatggaggcccaggccggcagcacccaggatgtgcagagcagcccccacaaccagttcaccttccggcccctgcccccacctcctcctcctcctcatgcctgcacctgtgccaggaagcccccacctgctgctgacagcctgcagaggaggtccatgaccaccaggagccagcccagccctgctgccccagccccacccaccagcacccaggacagcgtgcacctgcacaacagctgggtgctgaacagcaacatccccctggagaccaggcacttcctgttcaagcacggcagcggcagcagcgccatcttctctgctgccagccagaactaccccctgaccagcaacacagtgtacagccccccaccccggcccctgcccaggagcaccttcagcaggcctgccttcaccttcaacaagccctaccgctgctgcaactggaagtgcacagccctgagcgccacagccatcaccgtgaccctggccctgctgctggcctacgtgattgctgtgcacctgtttggcctgacctggcagctgcagcctgtggagggggagctgtatgccaatggagtgtccaaaggaaacagaggaacagagagcatggacaccacctacagccccatcggcggcaaggtgtctgacaagtctgagaagaaggtgttccagaagggccgggccatcgacacaggagaggtggacatcggggcccaggtgatgcagaccatccccccaggcctcttctggaggttccagatcaccatccaccaccccatctacctgaagttcaacatcagcctggccaaggacagcctgctgggcatctatggaagaagaaacatcccccccacccacacccagtttgattttgtgaagctgatggatggcaagcagctggtgaagcaggacagcaagggcagtgatgacacccagcacagccccaggaacctgatcctgaccagcctgcaggagaccggcttcatcgagtacatggaccagggcccctggtacctggccttctacaatgatggcaagaagatggagcaggtgtttgtgctgaccacagccatcgagatcatggatgactgcagcaccaactgcaatggaaatggagagtgcatcagcggccactgccactgcttccctggcttcctgggccctgactgtgcccgggacagctgccctgtgctgtgtggcggcaatggagaatatgagaagggccactgtgtgtgccgccacggctggaagggcccagaatgtgatgtgcctgaggagcagtgcatcgaccccacctgcttcggccacggcacctgcatcatgggcgtgtgcatctgtgtgcccggctacaagggggagatctgtgaggaggaggactgcctggaccccatgtgcagcaaccacggcatctgtgtgaagggggagtgccactgcagcacaggctggggcggcgtgaactgtgagacccccctgcctgtgtgccaggagcagtgcagcggccacggcaccttcctgctggatgctggggtgtgcagctgtgaccccaagtggacaggcagtgactgcagcacagagctgtgcaccatggagtgtggcagccacggcgtgtgcagccggggcatctgccagtgtgaggagggctgggtgggccccacctgtgaggagaggagctgccacagccactgcacagaacatggccagtgcaaggatggaaaatgtgagtgcagccctggctgggagggggaccactgcaccatcgcccactacctggatgctgtgagagatggctgccccggcctgtgctttggaaatggccgctgcaccctggaccagaatggctggcactgtgtgtgccaggtgggctggagcggcaccggctgcaatgtggtgatggagatgctgtgtggggacaacctggacaatgatggagatggcctgacagactgtgtggaccctgactgctgccagcagagcaactgctacatcagccccctgtgccagggcagcccagaccccctggacctgatccagcagagccagaccctcttcagccagcacaccagccgcctcttctatgaccgcatcaagttcctgattggcaaggacagcacccacgtgatccccccagaggtgtcctttgacagccggcgggcctgtgtgatccggggccaggtggtggccattgatggcacccccctggtgggcgtgaatgtgtccttcctgcaccacagcgactatggcttcaccatcagccggcaggacggcagctttgacctggtggccatcggcggcatcagcgtcatcctgatctttgacaggagccccttcctgcctgagaagaggaccctgtggctgccctggaaccagttcatcgtggtggagaaggtgaccatgcagagggtggtgtctgacccccccagctgtgacatcagcaacttcatcagccccaaccccatcgtgctgcccagccccctgaccagctttggaggcagctgcccagagcggggcaccatcgtgcctgagctgcaggtggtgcaggaggagatccccatccccagcagctttgtgcggctgagctacctgagcagcaggaccccaggctacaagaccctgctgcgcatcctgctgacccacagcaccatccctgtgggcatgatcaaggtgcacctgactgtggccgtggagggccgcctgacccagaagtggttccctgctgccatcaacctggtgtacacctttgcctggaacaagacagacatctacggccagaaggtgtggggcctggccgaggccctggtgtctgtgggctatgaatatgagacctgcccagacttcatcctgtgggagcagaggacagtggtgctgcagggctttgagatggatgccagcaacctgggcggctggagcctgaacaagcaccacatcctgaacccccagagcggcatcatccacaagggaaatggagagaacatgttcatcagccagcagccccctgtgatcagcaccatcatgggaaatggccaccagaggtctgtggcctgcaccaactgcaatggacctgcccacaacaacaagctgtttgcccctgtggccctggccagcggcccagatggctctgtgtatgtgggggacttcaactttgtgcggcgcatcttccccagcggcaacagcgtgtccatcctggagctgagcaccagccctgcccacaagtactacctggccatggaccctgtgtctgagagcctgtacctgagtgacaccaacaccaggaaggtgtacaagctgaagagcctggtggagaccaaggacctgagcaagaactttgaggtggtggccggcaccggggaccagtgcctgccctttgaccagagccactgtggagatggcggccgggccagcgaggccagcctgaacagcccccggggcatcaccgtggacagacatggcttcatctactttgtggatggcaccatgatcaggaagattgatgaaaatgctgtgatcaccaccgtcatcggcagcaatggcctgaccagcacccagcccctgagctgtgacagcggcatggacatcacccaggtgcggctggagtggcccacagacctggccgtgaaccccatggacaacagcctgtatgtgctggacaacaacatcgtgctgcagatcagcgagaacagaagagtgcgcatcatcgccggccggcccatccactgccaggtgcccggcatcgaccacttcctggtgtccaaggtggccatccacagcaccctggagagcgcccgggccatctctgtgagccacagcggcctgctcttcatcgccgagacagatgagaggaaggtgaaccgcatccagcaggtgaccaccaacggggagatctacatcatcgccggggcccccacagactgtgactgcaagattgaccccaactgtgactgcttctctggagatggcggctacgccaaggatgccaagatgaaggcccccagcagcctggccgtgtccccagatggcaccctgtatgtggccgacctgggcaatgtgcgcatccgcaccatcagcaggaaccaggcccacctgaatgacatgaacatctatgagatcgccagccctgctgaccaggagctgtaccagttcaccgtgaatggcacccacctgcacaccctgaacctgatcacccgggactatgtgtacaacttcacctacaacagcgagggggacctgggcgccatcaccagcagcaatggaaacagcgtgcacatcagaagagatgctgggggcatgcccctgtggctggtggtgcctgggggccaggtgtactggctgaccatcagcagcaatggagtgctgaagagggtgtctgcccagggctacaacctggccctgatgacctacccaggcaacacaggcctgctggccaccaagagcaatgaaaatggctggaccaccgtgtatgaatatgaccctgagggccacctgaccaatgccaccttccccaccggggaggtgtcctccttccacagcgacctggagaagctgaccaaggtggagctggacaccagcaaccgggagaatgtgctgatgagcaccaacctgacagccaccagcaccatctacatcctgaagcaggagaacacccagagcacctacagagtgaacccagatggcagcctgcgggtgacctttgccagcggcatggagatcggcctgagcagcgagccccacatcctggccggggctgtgaaccccaccctgggcaagtgcaacatcagcctgcctggagagcacaatgccaacctgattgagtggaggcagaggaaggagcagaacaagggaaatgtgtctgcctttgaaagaaggctgcgggcccacaacagaaacctgctgagcattgactttgaccacatcaccaggacaggcaagatctatgatgaccacaggaagttcaccctgcgcatcctgtatgaccagacaggccggcccatcctgtggagccctgtgagccgctacaatgaggtgaacatcacctacagccccagcggcctggtgaccttcatccagaggggcacctggaatgagaagatggagtatgaccagagcggcaagatcatcagcaggacctgggcagatggcaagatctggagctacacctacctggagaagtctgtgatgctgctgctgcacagccagaggcgctacatctttgaatatgaccagcctgactgcctgctgtctgtgaccatgcccagcatggtgcgccacagcctgcagaccatgctgtctgtgggctactacagaaacatctacaccccaccagacagcagcaccagcttcatccaggactacagcagagatggccgcctgctgcagaccctgcacctgggcaccggccggcgggtgctgtacaagtacaccaagcaggcccggctgtctgaggtgctgtatgacaccacccaggtgaccctgacctatgaggagagcagcggggtcatcaagaccatccacctgatgcatgatggcttcatctgcaccatccgctaccggcagacaggccccctcatcggccggcagatcttccgcttcagcgaggagggcctggtgaatgccaggtttgactacagctacaacaacttccgggtgacctccatgcaggccgtcatcaatgagacccccctgcccatcgacctgtaccgctacgtggatgtgtctggccgcacagagcagtttgggaagttcagcgtcatcaactatgacctgaaccaggtgatcaccaccaccgtgatgaagcacaccaagatcttcagcgccaacggccaggtgattgaggtgcagtatgagatcctgaaggccatcgcctactggatgaccatccagtatgacaacgtgggccgcatggtgatctgtgacatccgggtgggcgtggatgccaacatcacccgctacttctatgaatatgatgctgatggccagctgcagacagtgtctgtgaatgacaagacccagtggagatacagctatgacctgaatggaaacatcaacctgctgagccacggcaagagcgcccggctgacccccctgcgctatgacctgcgggaccgcatcacccggctgggggagatccagtacaagatggatgaagatggcttcctgcggcagagaggaaatgacatctttgagtacaacagcaatggcctgctgcagaaggcctacaacaaggccagcggctggacagtgcagtactactatgatggcctgggcagaagagtggccagcaagagcagcctgggccagcacctgcagttcttctacgccgacctgaccaaccccatccgggtgacccacctgtacaaccacaccagcagcgagatcaccagcctgtactatgacctgcagggccacctgattgccatggagctgagcagtggagaggagtactacgtggcctgtgacaacacaggcacccccctggccgtgttcagcagccggggccaggtgatcaaggagatcctgtacaccccctacggggacatctaccatgacacctacccagacttccaggtgatcatcggcttccacggcggcctgtatgacttcctgaccaagctggtgcacctgggccagagggactatgatgtggtggccggccgctggaccacccccaaccaccacatctggaagcagctgaacctgctgcccaagcccttcaacctgtacagctttgagaacaactaccctgtgggcaagatccaggatgtggccaagtacaccacagacatccgctcctggctggagctgtttggcttccagctgcacaacgtgctgcccggcttccccaagccagagctggagaacctggagctgacctatgagctgctgcggctgcagaccaagacccaggagtgggaccccgggaagaccatcctgggcatccagtgtgagctgcagaagcagctgaggaacttcatcagcctggaccagctgcccatgaccccccgctacaatgatggccgctgcctggagggcggcaagcagcccaggtttgctgctgtgcccagcgtgtttgggaagggcatcaagtttgccatcaaggatggcatcgtgacagctgacatcatcggcgtggccaatgaagacagccggcggctggccgccatcctgaacaatgcccactacctggagaacctgcacttcaccatcgagggccgggacacccactacttcatcaagctgggcagcctggaggaggacctggtgctgattggcaacacaggaggccgccgcatcctggagaatggagtgaatgtgacagtgtcccagatgacctctgtgctgaatggaagaacaagaagatttgctgacatccagctgcagcacggggccctgtgcttcaacatccgctatggcaccaccgtggaggaggagaagaaccacgtgctggagatcgcccggcagagagctgtggcccaggcctggaccaaggagcagaggcggctgcaggagggggaggagggcatccgggcctggacagaaggagagaagcagcagctgctgagcacaggccgggtgcagggctatgatggctactttgtgctgtctgtggagcagtacctggagctgagtgacagcgccaacaacatccacttcatgaggcagagcgagatcggcagaagatag

SEQ ID NO: 7432 - DNA, 204 bp, Artificial Sequence
  Description of Artificial Sequence: Synthetic coding sequence
atgaagatccagctgttcttcttcatcctgcacttctgggtgaccatcctgcctgccaagaagaagtacccagaatatggcagcctggacctgcggcgggagtgcagaattggaaatggccagtgcaagaaccagtgccatgaaaatgagatcagaattgcctactgcatccggcccggcacccactgctgcctgcagcagtag

SEQ ID NO: 7433 - DNA, 831 bp, Artificial Sequence
  Description of Artificial Sequence: Synthetic coding sequence
atgaagcagatcctgcacccagccctggagaccacagcctgcaccaaccacttcaatgctgacccctgcagcactggatttgtgtttcctgccatgaccctcttccctgtgctgctcttcctggtggccggcctgctgcccagcttccctgccaatgaagacaaggaccctgccttcaccgccctgctgaccacccagacccaggtgcagcgggagatcgtgaacaagcacaatgagctgcggcgggctgtgagccccccagccaggaacatgctgaagatggagtggaacaaggaggccgccgccaatgcccagaagtgggccaaccagtgcaactaccgccacagcaaccccaaggacaggatgaccagcctgaagtgtggagaaaatctctacatgagcagcgccagcagctcctggagccaggccatccagagctggtttgatgagtacaatgactttgattttggagtgggccccaagaccccaaatgctgtggtgggccactacacccaggtggtgtggtacagcagctacctggtgggctgtggaaatgcctactgccccaaccagaaggtgctgaagtactactacgtgtgccagtactgcccagctggcaactgggccaaccggctgtatgtgccctatgagcagggcgccccctgtgccagctgcccagacaactgtgatgatggcctgtgcaccaacggctgcaagtatgaagatctctacagcaactgcaagagcctgaagctgaccctgacctgcaagcaccagctggtgcgggacagctgcaaggccagctgcaactgcagcaacagcatctactag

SEQ ID NO: 7434 - DNA, 1350 bp, Artificial Sequence
  Description of Artificial Sequence: Synthetic coding sequence
atgctggccgagtggggcgcctgcctgctgctggccgtggccctgctgggccctggcctgcaggcccaggccatggagggcgtgaagtgtggcggcgtgctgagcgcccccagcggcaacttcagcagccccaacttcccccggctgtacccctacaacacagaatgttcctggctgattgtggtggccgagggcagctctgtgctgctgaccttccacgcctttgacctggagtaccatgacacctgcagctttgacttcctggagatctacaacggggccagcccagacaagggcaacctgctgggccgcttctgtgggaaggtgcccccaccacccttcaccagctcctggcacgtgatgtctgtcatcttccacagcgacaagcacgtggccagccacggcttctctgctggctaccagaaggatgtgtgtggcggcgtgctgaccggcctgtctggagtgctgaccagccctgagtaccccaacaactaccccaacagcatggagtgccactgggtgatccgggccgccggccctgcccacgtgaagctggtgtttgtggacttccaggtggagggcaatgaagaatgtacctatgactatgtggccgtgctgggcggccctggccccacccggggccaccactactgcggcagcaccaggcctcccaccctggtgtccctgggccacgagctgcaggtggtgttcaagagtgacttcaacattggaggccggggcttcaaggcctactacttcagcggggagtgccaggaggtgtacatggccatgaggggcaacttcagcagcccccagtaccccagcagctaccccaacaacatccgctgccactggaccatccggctgcccccaggctaccaggtgaaggtgttcttcctggacctggacctggaggagcccaacagcctgaccaagacctgtgactttgaccacctggccgcctttgatggagccagcgaggaggcccccctgctgggcaactggtgtggccaccacctgcccccacctgtgaccagcagccacaaccagctgctgctgctgctgcacacagacaggagcaccacccggcggggcttctctgtggcctacatcggcggccagctgggctgcggcagcggcagcacagaaggagagggggaggccctgcagccccagagcctgcagagccccagcagcatcccccctgtgtgcccagccccacccatgaatggcctgctgcagctgctgctgcactggctgcacccctgccccctgagcggccccctgcggctggatggaacagccccagcctgcttccactactgccgggccagcttccccagcttctag

SEQ ID NO: 7435 - DNA, 1434 bp, Artificial Sequence; identical to SEQ ID NO: 6874
  Description of Artificial Sequence: Synthetic coding sequence

SEQ ID NO: 7436 - DNA, 1479 bp, Artificial Sequence
  Description of Artificial Sequence: Synthetic coding sequence
atgggcagcgccccctgggcccctgtgctgctgctggccctgggcctgcggggcctgcaggccggggcccggcgggccccagaccccggcttccaggagcgcttcttccagcagaggctggaccacttcaactttgagcgcttcggcaacaagaccttcccccagcgcttcctggtgtctgaccgcttctgggtgcggggggagggccccatcttcttctacacaggaaatgaaggagatgtgtgggcctttgccaacaacagcgcctttgtggccgagctggccgctgagcggggggccctgctggtgtttgctgagcaccgctactacggcaagagcctgccctttggagcccagagcacccagaggggccacacagagctgctgactgtggagcaggccctggccgactttgctgagctgctgcgggccctgcggcgggacctgggcgcccaggatgccccagccatcgcctttggaggcagctatggaggcatgctgagcgcctacctgaggatgaagtacccccacctggtggccggggccctggccgccagcgcccctgtgctggccgtggccggcctgggggacagcaaccagttcttcagagatgtgacagctgactttgagggccagagccccaagtgcacccagggcgtgcgggaggccttccggcagatcaaggacctcttcctgcagggcgcctatgacacagtgcgctgggagtttggcacctgccagcccctgagtgatgagaaggacctgacccagctgttcatgtttgccagaaatgccttcaccgtgctggccatgatggactacccctaccccacagacttcctgggccccctgcctgccaaccctgtgaaggtgggctgtgaccggctgctgtctgaggcccagaggatcaccggcctgcgggccctggccggcctggtgtacaatgccagcggcagcgagcactgctatgacatctaccgcctgtaccacagctgtgccgaccccaccggctgcggcaccggcccagatgcccgggcctgggactaccaggcctgcacagagatcaacctgacctttgccagcaacaacgtgacagacatgtttcctgacctgcccttcacagatgagctgcggcagcgctactgcctggacacctggggcgtgtggcccaggccagactggctgctgaccagcttctggggcggggacctgcgggccgccagcaacatcatcttcagcaatggaaacctggacccctgggccggcggcggcatcagaagaaacctgagcgcctctgtgattgctgtgaccatccagggcggggcccaccacctggacctgcgggccagccacccagaagatcctgcctctgtggtggaggccaggaagctggaggccaccatcattggagagtgggtgaaggccgcccggcgggagcagcagcctgccctgcggggcggcccccggctgagcctgtag

SEQ ID NO: 7437 - DNA, 2850 bp, Artificial Sequence
  Description of Artificial Sequence: Synthetic coding sequence
atgatcctgagcctgctcttcagcctgggcggccccctgggctggggcctgctgggcgcctgggcccaggccagcagcaccagcctgagtgacctgcagagcagcaggaccccaggagtgtggaaggccgaggccgaggacaccgggaaggaccctgtgggcaggaactggtgcccctaccccatgagcaagctggtgaccctgctggccctgtgcaagacagagaagttcctgatccacagccagcagccctgcccccagggcgccccagactgccagaaggtgaaggtgatgtacaggatggcccacaagcctgtgtaccaggtgaagcagaaggtgctgaccagcctggcctggcgctgctgccccggctacacaggccccaactgtgagcaccacgacagcatggccatccctgagcctgctgaccccggggacagccaccaggagccccaggacggccctgtgtccttcaagccaggccacctggccgctgtgatcaatgaggtggaggtgcagcaggagcagcaggagcacctgctgggggacctgcagaatgatgtgcaccgggtggccgacagcctgcccggcctgtggaaggccctgcccggcaacctgacagctgctgtgatggaggccaaccagacaggccacgagttcccagacaggagcctggagcaggtgctgctgccccacgtggacaccttcctgcaggtgcacttcagccccatctggaggagcttcaaccagagcctgcacagcctgacccaggccatccggaacctgagcctggatgtggaggccaaccggcaggccatcagccgggtgcaggacagcgctgtggcccgggctgacttccaggagctgggcgccaagtttgaggccaaggtgcaggagaacacccagagggtgggccagctgcggcaggatgtggaggaccggctgcacgcccagcacttcaccctgcacaggagcatcagcgagctgcaggctgatgtggacaccaagctgaagaggctgcacaaggcccaggaggcccctggcaccaacggcagcctggtgctggccacccctggggccggggcccggcctgagccagacagcctgcaggcccggctgggccagctgcagaggaacctgtctgagctgcacatgaccacagcccggcgggaggaggagctgcagtacaccctggaggacatgagggccaccctgaccaggcatgtggatgagatcaaggagctgtacagcgagagtgatgagacctttgaccagatcagcaaggtggagcggcaggtggaggagctgcaggtgaaccacacagccctgcgggagctgcgggtcatcctgatggagaagagcctcatcatggaggagaacaaggaggaggtggagcggcagctgctggagctgaacctgaccctgcagcacctgcagggcggccatgctgacctgatcaagtatgtgaaggactgcaactgccagaagctgtacctggacctggatgtgatccgggagggccagagagatgccacccgggccctggaggagacccaggtgtccctggatgaaagacggcagctggatggcagcagcctgcaggccctgcagaatgctgtggatgctgtgtccctggccgtggatgcccacaaggccgagggggagcgggcccgggccgccaccagccggctgcggagccaggtgcaggccctggatgatgaggtgggcgccctgaaggctgctgctgctgaggcccggcatgaggtgcggcagctgcacagcgcctttgctgccctgctggaggatgccctgcggcatgaggccgtgctggccgccctgtttggagaggaggtgctggaggagatgtctgagcagaccccaggccccctgcccctgtcctatgagcagatccgggtggccctgcaggatgctgccagcggcctgcaggagcaggccctgggctgggatgagctggccgcccgggtgacagccctggagcaggccagcgagccccccaggcctgctgagcacctggagcccagccatgatgctggccgggaggaggccgccaccacagccctggccggcctggcccgggagctgcagagcctgagcaatgatgtgaagaatgtgggccgctgctgtgaggccgaggccggggccggggccgccagcctgaatgccagcctgcacggcctgcacaatgccctgtttgccacccagaggagcctggagcagcaccagaggctcttccacagcctgtttggaaacttccagggcctgatggaggccaacgtgtccctggacctgggcaagctgcagaccatgctgagcaggaagggcaagaagcagcagaaggacctggaggcccccaggaagagggacaagaaggaggccgagcccctggtggacatccgggtgacaggccctgtgcctggggccctgggcgccgccctgtgggaggccggcagccctgtggccttctacgccagcttcagcgagggcacagctgccctgcagacagtgaagttcaacaccacctacatcaacatcggcagcagctacttccctgagcacggctacttccgggcccctgagcggggcgtgtacctgtttgctgtgtctgtggagtttggacctggccctggcaccggccagctggtgtttggaggccaccacaggacccctgtgtgcaccaccggccagggcagcggcagcacagccaccgtgtttgccatggccgagctgcagaagggggagcgggtgtggtttgagctgacccagggcagcatcaccaagaggagcctgtctggaacagcctttggaggcttcctgatgttcaagacctag

SEQ ID NO: 7438 - DNA, 246 bp, Artificial Sequence
  Description of Artificial Sequence: Synthetic coding sequence
atgaggctgctggtgctgagcagcctgctgtgcatcctgctgctgtgcttcagcatcttcagcacagagggcaagaggaggcctgccaaggcctggagcggccgccgcacccggctgtgctgccaccgggtgcccagccccaacagcaccaacctgaagggccaccacgtgcggctgtgcaagccctgcaagctggagcctgagccccggctgtgggtggtgcctggggccctgccccaggtgtag

SEQ ID NO: 7439 - DNA, 690 bp, Artificial Sequence
  Description of Artificial Sequence: Synthetic coding sequence
atgtccttcctgcaggaccccagcttcttcaccatgggcatgtggagcattggagctggggccctgggcgctgctgccctggccctgctgctggccaacacagatgtgttcctgagcaagccccagaaggccgccctggagtacctggaggacatcgacctgaagaccctggagaaggagcccaggaccttcaaggccaaggagctgtgggagaagaatggagctgtgatcatggctgtgagaagacctggctgcttcctgtgccgggaggaggccgctgacctgagcagcctgaagtccatgctggaccagctgggcgtgcccctgtatgctgtggtgaaggagcacatcagaacagaggtgaaggacttccagccctacttcaagggggagatcttcctggatgagaagaagaagttctacggcccccagaggaggaagatgatgttcatgggcttcatccggctgggcgtgtggtacaacttcttccgggcctggaatggaggcttcagcggcaacctggagggggagggcttcatcctgggcggcgtgtttgtggtgggcagcggcaagcagggcatcctgctggagcaccgggagaaggagtttggagacaaggtgaacctgctgtctgtgctggaggccgccaagatgatcaagccccagaccctggccagcgagaagaagtag

SEQ ID NO: 7440 - DNA, 657 bp, Artificial Sequence
  Description of Artificial Sequence: Synthetic coding sequence
atgggcatgtggagcatcggggccggggccctgggcgccgccgccctggccctgctgctggccaacacagatgtgttcctgagcaagccccagaaggccgccctggagtacctggaggacatcgacctgaagaccctggagaaggagcccaggaccttcaaggccaaggagctgtgggagaagaatggagctgtgatcatggctgtgcggcggcccggctgcttcctgtgccgggaggaggccgctgacctgagcagcctgaagtccatgctggaccagctgggcgtgcccctgtatgctgtggtgaaggagcacatcagaacagaggtgaaggacttccagccctacttcaagggggagatcttcctggatgagaagaagaagttctacggcccccagaggaggaagatgatgttcatgggcttcatccggctgggcgtgtggtacaacttcttccgggcctggaatggaggcttcagcggcaacctggagggggagggcttcatcctgggcggcgtgtttgtggtgggcagcggcaagcagggcatcctgctggagcaccgggagaaggagtttggagacaaggtgaacctgctgtctgtgctggaggccgccaagatgatcaagccccagaccctggccagcgagaagaagtag

SEQ ID NO: 7441 - DNA, 690 bp, Artificial Sequence; identical to SEQ ID NO: 7439
  Description of Artificial Sequence: Synthetic coding sequence

SEQ ID NO: 7442 - DNA, 690 bp, Artificial Sequence; identical to SEQ ID NO: 7439
  Description of Artificial Sequence: Synthetic coding sequence

SEQ ID NO: 7443 - DNA, 1248 bp, Artificial Sequence; identical to SEQ ID NO: 7151
  Description of Artificial Sequence: Synthetic coding sequence

SEQ ID NO: 7444 - DNA, 240 bp, Artificial Sequence
  Description of Artificial Sequence: Synthetic coding sequence
atggccccccagaccctgctgcctgtgctggtgctgtgtgtgctgctgctgcaggcccagggcggctacagagacaagaagaggatgcagaagacccagctgagccctgagatcaaggtgtgccagcagcagcccaagctgtacctgtgcaagcacctgtgtgagagccaccgggactgccaggccaacaacatctgctgcagcacctactgtggaaatgtgtgcatgagcatcctgtag

SEQ ID NO: 7445 - DNA, 486 bp, Artificial Sequence
  Description of Artificial Sequence: Synthetic coding sequence
atgggcctgagcggcctgctgcccatcctggtgcccttcatcctgctgggggacatccaggagcccggccatgctgagggcatcctgggcaagccctgccccaagatcaaggtggagtgtgaggtggaggagattgaccagtgcaccaagccccgggactgcccagagaacatgaagtgctgccccttcagccggggcaagaagtgcctggacttcaggaagatctatgctgtgtgccaccggcggctggccccagcctggccaccctaccacactggaggcaccatcaagaagaccaagatctgcagcgagttcatctatggaggcagccagggcaacaacaacaacttccagacagaggccatctgcctggtgacctgcaagaagtaccacaagagcgccctgctgtacaccatccgccgcagcctgaacaacctgcaggacctggcccacaaccctggcctgagcccccgggtgcctgactag

SEQ ID NO: 7446 - DNA, 261 bp, Artificial Sequence
  Description of Artificial Sequence: Synthetic coding sequence
atgggcctgagcggcctgctgcccatcctggtgcccttcatcctgctgggggacatccaggagcccggccatgctgagggcatcctgggcaagccctgccccaagatcaaggtggagtgtgaggtggaggagattgaccagtgcaccaagccccgggactgcccagagaacatgaagtgctgccccttcagccggggcaagaagtgcctggacttcaggaaggtgtccctgaccctgtaccacaaggaggagctggagtag

SEQ ID NO: 7447 - DNA, 375 bp, Artificial Sequence
  Description of Artificial Sequence: Synthetic coding sequence
atgcctgcctgccgcctgggccccctggccgccgccctgctgctgagcctgctgctgtttggcttcaccctggtgtctggcaccggggctgagaagacaggagtgtgcccagagctgcaggccgaccagaactgcacccaggagtgtgtgtctgattctgaatgtgccgacaacctgaagtgctgcagcgctggctgtgccaccttctgcagcctgcccaatgacaaggagggcagctgcccccaggtgaacatcaacttcccccagctgggcctgtgccgggaccagtgccaggtggacagccagtgccccggccagatgaagtgctgcagaaatggctgtgggaaggtgtcctgtgtgacccccaacttctag

SEQ ID NO: 7448 - DNA, 1428 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaggccggggccgccccctacgtgcaggcctttgacagcctgctggccggccctgtggccgagtacctgaagatcagcaaggagattggaggagatgtgcagaagcatgctgagatggtgcacacaggcctgaagctggagcgggccctgctggtgacagccagccagtgccagcagcctgctgagaacaagctgagtgacctgctggcccccatcagcgagcagatcaaggaggtgatcaccttccgggagaagaacagaggcagcaagctgttcaaccacctgtctgctgtgtctgagagcatccaggccctgggctgggtggccatggcccccaagccaggcccctacgtgaaggagatgaatgatgctgccatgttctacaccaacagagtgctgaaggagtacaaggatgtggacaagaagcacgtggactgggtgaaggcctacctgagcatctggacagagctgcaggcctacatcaaggagttccacaccaccggcctggcctggagcaagacaggccctgtggccaaggagctgagcggcctgcccagcggccccagcgctggcagctgccccccacctcctccaccctgccccccacctcctcctgtgtccaccatcagctgcagctatgaaagtgccagccgcagcagcctgtttgcccagatcaaccagggcgagagcatcacccacgccctgaagcacgtgtctgatgacatgaagacccacaagaacccagccctgaaggcccagagcggccctgtgcgcagcggccccaagcccttcagcgcccccaagccccagaccagccccagccccaagagggccaccaagaaggagcctgctgtgctggagctggagggcaagaagtggagggtggagaaccaggagaatgtgagcaacctggtgattgaggacacagagctgaagcaggtggcctacatctacaagtgtgtgaacaccaccctgcagatcaagggcaagatcaacagcatcaccgtggacaactgcaagaagctgggcctggtgtttgatgatgtggtgggcatcgtggagatcatcaacagcaaggatgtgaaggtgcaggtgatgggcaaggtgcccaccatcagcatcaacaagacagatggctgccacgcctacctgagcaagaacagcctggactgtgaaattgtgtctgccaagagcagcgagatgaatgtgctgatccccacagaaggaggagacttcaatgagttccctgtgcctgagcagttcaagaccctgtggaatggccagaagctggtgaccaccgtgacagaaattgctggatag

SEQ ID NO: 7449 - DNA, 438 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaggccggggccgccccctacgtgcaggcctacatcaaggagttccacaccaccggcctggcctggagcaagacaggccctgtggccaaggagctgagcggcctgcccagcggccccagcgctggcagctgccccccacctcctccaccctgccccccacctcctcctgtgtccaccatcagctgcagctatgagagcgccagccgcagcagcctgtttgcccagatcaaccagggcgagagcatcacccacgccctgaagcacgtgtctgatgacatgaagacccacaagaacccagccctgaaggcccagagcggccctgtgaggtag

SEQ ID NO: 7450 - DNA, 1428 bp, Artificial Sequence; identical to SEQ ID NO: 7448
  Description of Artificial Sequence: Synthetic coding sequence

SEQ ID NO: 7451 - DNA, 1425 bp, Artificial Sequence; identical to SEQ ID NO: 7240
  Description of Artificial Sequence: Synthetic coding sequence

SEQ ID NO: 7452 - DNA, 1425 bp, Artificial Sequence; identical to SEQ ID NO: 7240
  Description of Artificial Sequence: Synthetic coding sequence

SEQ ID NO: 7453 - DNA, 1428 bp, Artificial Sequence; identical to SEQ ID NO: 7448
  Description of Artificial Sequence: Synthetic coding sequence

SEQ ID NO: 7454 - DNA, 1209 bp, Artificial Sequence
  Description of Artificial Sequence: Synthetic coding sequence
atgacagccctgcccggccccctgtggctgctgggcctggccctgtgtgccctgggcggcggcggccctggcctgcggcccccacctggctgcccccagaggcggctgggcgcccgggagaggagagatgtgcagcgggagatcctggccgtgctgggcctgcccggccggccccggccccgggcccctcctgctgccagccggctgcctgccagcgcccccctcttcatgctggacctgtaccacgccatggctggagatgatgatgaagatggagccccagctgagcggcggctgggccgggctgacctggtgatgagctttgtgaacatggtggagcgggaccgggccctgggccaccaggagccccactggaaggagttccgctttgacctgacccagatcccagctggggaggccgtgacagctgctgagttccgcatctacaaggtgcccagcatccacctgctgaacagaaccctgcacgtgtccatgttccaggtggtgcaggagcagagcaaccgggagagtgacctcttcttcctggacctgcagaccctgcgggctggagatgagggctggctggtgctggatgtgacagctgccagtgactgctggctgctgaagaggcacaaggacctgggcctgcggctgtatgtggagacagaagatggccacagcgtggaccccggcctggccggcctgctgggccagagggcccccaggagccagcagccctttgtggtgaccttcttccgggccagccccagccccatccgcacccccagggctgtgcggcccctgcggcggcggcagcccaagaagagcaatgagctgccccaggccaaccggctgcccggcatctttgatgatgtgcacggcagccacggccggcaggtgtgcagaagacatgagctgtatgtgtccttccaggacctgggctggctggactgggtgattgccccccagggctacagcgcctactactgtgaaggagaatgttccttccccctggacagctgcatgaatgccaccaaccacgccatcctgcagagcctggtgcacctgatgatgccagatgctgtgcccaaggcctgctgtgcccccaccaagctgagcgccacctctgtgctgtactatgacagcagcaacaacgtcatcctgaggaagcacaggaacatggtggtgaaggcctgtggctgccactag

SEQ ID NO: 7455 - DNA, 804 bp, Artificial Sequence
  Description of Artificial Sequence: Synthetic coding sequence
atggccgccatccgcatgggcaagctgaccaccatgcctgctggcctcatctatgcctctgtgtctgtgcatgctgccaagcaggaggagagcaagaagcagctggtgaagccagagcagctgcccatctacacagccccacccctgcagagcaaatatgtggaggagcagcccggccacctgcagatgggctttgccagcatcagaacagccaccggctgctacatcggctggtgcaagggcgtgtatgtgtttgtgaagaatggcatcatggacacagtgcagtttgggaaggatgcctacgtgtacctgaagaaccccccccgggacttcctgcccaagatgggcgtcatcaccgtgtctggcctggccggcctggtgtctgccaggaagggcagcaagttcaagaagatcacctaccccctgggcctggccaccctgggcgccaccgtgtgctaccctgtgcagagcgtcatcatcgccaaggtgacagccaagcgctacatgctgcaggccagcaagttcctggagcagctgaaccactgcggccagaaggccgccaagaagagccacagcctgaacctgaagaagaccaagctgggcagcagcagcgagattgaggtgcctgccaagaccacccacgtgctgaagcacagcgtgcccctgcccacagagctgagcagcgaggccaagaccaagtctgagagcaccagcggggccacccagttcatgccagaccccaagctgatggaccacggccagagccaccctgaggacatcgacatgtacagcaccaggagctag

SEQ ID NO: 7456 - DNA, 807 bp, Artificial Sequence
  Description of Artificial Sequence: Synthetic coding sequence
atggccgccatccgcatgggcaagctgaccaccatgcctgctggcctcatctatgcctctgtgtctgtgcatgctgccaagcaggaggagagcaagaagcagctggtgaagccagagcagctgcccatctacacagccccacccctgcagagcaaatatgtggaggagcagcccggccacctgcagatgggctttgccagcatcagaacagccaccggctgctacatcggctggtgcaagggcgtgtatgtgtttgtgaagaatggcatcatggacacagtgcagtttgggaaggatgcctacgtgtacctgaagaaccccccccgggacttcctgcccaagatgggcgtcatcaccgtgtctggcctggccggcctggtgtctgccaggaagggcagcaagttcaagaagatcacctaccccctgggcctggccaccctgggcgccaccgtgtgctaccctgtgcagagcgtcatcatcgccaaggtgacagccaagaaggtgtatgccaccagccagcagatctttggagctgtgaagagcctgtggaccaagagcagcaaggaggagagcctgcccaagcccaaggagaagaccaagctgggcagcagcagcgagattgaggtgcctgccaagaccacccacgtgctgaagcacagcgtgcccctgcccacagagctgagcagcgaggccaagaccaagtctgagagcaccagcggggccacccagttcatgccagaccccaagctgatggaccacggccagagccacccagaagatattgacatgtacagcaccaggagctag

SEQ ID NO: 7457 - DNA, 3672 bp, Artificial Sequence
  Description of Artificial Sequence: Synthetic coding sequence
atggcccccctgcgggccctgctgagctacctgctgcccctgcactgtgccctgtgtgccgccgccggcagcaggaccccagagctgcacctgagcggcaagctgagtgactatggagtgacagtgccctgcagcacagacttccggggccgcttcctgagccacgtggtgtctggccctgctgctgccagcgctggctccatggtggtggacaccccacccaccctgcccaggcacagcagccacctgcgggtggcccggagccccctgcaccctgggggcaccctgtggccaggccgggtgggccgccacagcctgtacttcaacgtgacagtgtttgggaaggagctgcacctgcggctgcggcccaacagaaggctggtggtgcccggcagctctgtggagtggcaggaggacttccgggagctgttccggcagcccctgcggcaggagtgtgtgtacacaggaggagtgacaggcatgcctggagctgctgtggccatcagcaactgtgatggcctggccggcctcatcagaacagacagcacagacttcttcatcgagcccctggagcggggccagcaggagaaggaggccagcggccgcacccacgtggtgtaccgccgggaggccgtgcagcaggagtgggccgagccagatggagacctgcacaatgaggccttcggcctgggggacctgcccaacctgctgggcctggtgggggaccagctgggggacacagagaggaagagaagacatgccaagccaggcagctacagcattgaggtgctgctggtggtggatgacagcgtggtgcgcttccacggcaaggagcacgtgcagaactacgtgctgaccctgatgaacatcgtggatgagatctaccatgatgagagcctgggcgtgcacatcaacatcgccctggtgcggctcatcatggtgggctaccggcagagcctgagcctgattgagcggggcaaccccagccgcagcctggagcaggtgtgccgctgggcccacagccagcagaggcaggaccccagccacgccgagcaccacgaccacgtggtgttcctgacccggcaggactttggccccagcggctacgcccctgtgacaggcatgtgccaccccctgcggagctgtgccctgaaccatgaagatggcttcagcagcgccttcgtcatcgcccacgagaccggccacgtgctgggcatggagcatgatggccagggcaatggctgtgctgatgagaccagcctgggctctgtgatggcccccctggtgcaggccgccttccaccgcttccactggagccgctgcagcaagctggagctgagccgctacctgcccagctatgactgcctgctggatgacccctttgatcctgcctggccccagcccccagagctgcccggcatcaactacagcatggatgagcagtgccgctttgattttggcagcggctaccagacctgcctggccttccgcacctttgagccctgcaagcagctgtggtgcagccacccagacaacccctacttctgcaagaccaagaagggcccccccctggatggaacagaatgtgcccctgggaagtggtgcttcaagggccactgcatctggaagagccctgagcagacctacggccaggacggcggctggagctcctggaccaagtttggcagctgcagccgcagctgtggcggcggcgtgcgcagccgcagccgcagctgcaacaaccccagccctgcctacggcggccgcctgtgcctgggccccatgtttgagtaccaggtgtgcaacagtgaagaatgtcctggcacctatgaggacttccgggcccagcagtgtgccaagagaaattcctactacgtgcaccagaatgccaagcacagctgggtgccctatgagccagatgatgatgcccagaagtgtgagctgatctgccagagcgctgacacaggagatgtggtgttcatgaaccaggtggtgcatgatggcacccgctgcagctacagagacccctacagcgtgtgtgcccggggggagtgtgtgcctgtgggctgtgacaaggaggtgggctccatgaaggcagatgacaagtgtggggtgtgtggcggggacaacagccactgcaggacagtgaagggcaccctgggcaaggccagcaagcaggccggggccctgaagctggtgcagatcccagctggggcccggcacatccagatcgaggccctggagaagagcccccaccgcatcgtggtgaagaaccaggtgacaggcagcttcatcctgaaccccaagggcaaggaggccaccagcaggaccttcaccgccatgggcctggagtgggaggatgctgtggaggatgccaaggagagcctgaagaccagcggccccctgcctgaggccatcgccatcctggccctgcccccaacagagggcggccccaggagcagcctggcctacaagtatgtgattcatgaggacctgctgcccctcatcggcagcaacaacgtgctgctggaggagatggacacctatgagtgggccctgaagtcctgggccccctgcagcaaggcctgtggcggcggcatccagttcaccaagtatggctgcagaagaagaagagaccaccacatggtgcagaggcacctgtgtgaccacaagaagaggcccaagcccatcagaagacgctgcaaccagcacccctgcagccagcctgtgtgggtgacagaggagtggggcgcctgcagccgcagctgtgggaagctgggcgtgcagacccggggcatccagtgcctgctgcccctgagcaatggcacccacaaggtgatgcctgccaaggcctgtgccggggacaggcctgaggcccggcggccctgcctgcgggtgccctgcccagcccagtggaggctgggcgcctggagccagtgcagcgccacctgtggggagggcatccagcagaggcaggtggtgtgcaggaccaatgccaacagcctgggccactgtgagggggacagaccagacacagtgcaggtgtgcagcctgcctgcctgtggcggcaaccaccagaacagcacagtgcgggcagatgtgtgggagctgggcaccccagagggccagtgggtgccccagagcgagcccctgcaccccatcaacaagatcagcagcacagagccctgcaccggggacaggagcgtcttctgccagatggaggtgctggaccgctactgcagcatccctggctaccaccggctgtgctgcgtgtcctgcatcaagaaggccagcggccccaaccctggccctgaccccggccccaccagcctgccccccttcagcaccccaggcagccccctgcccggcccccaggaccctgcagatgctgctgagcccccaggcaagcccaccggcagcgaggaccaccagcacggccgggccacccagctgcccggggccctggacaccagcagccctggcacccagcacccctttgcccctgagacccccatccctggggcctcctggagcatcagccccaccacccctgggggcctgccctggggctggacccagacccccacccctgtgcctgaggacaagggccagcctggagaggacctgcggcaccctggcaccagcctgcctgctgccagccctgtgacctag

SEQ ID NO: 7458 - DNA, 3681 bp, Artificial Sequence
  Description of Artificial Sequence: Synthetic coding sequence
atggcccccctgcgggccctgctgagctacctgctgcccctgcactgtgccctgtgtgccgccgccggcagcaggaccccagagctgcacctgagcggcaagctgagtgactatggagtgacagtgccctgcagcacagacttccggggccgcttcctgagccacgtggtgtctggccctgctgctgccagcgctggctccatggtggtggacaccccacccaccctgcccaggcacagcagccacctgcgggtggcccggagccccctgcaccctgggggcaccctgtggccaggccgggtgggccgccacagcctgtacttcaacgtgacagtgtttgggaaggagctgcacctgcggctgcggcccaacagaaggctggtggtgcccggcagctctgtggagtggcaggaggacttccgggagctgttccggcagcccctgcggcaggagtgtgtgtacacaggaggagtgacaggcatgcctggagctgctgtggccatcagcaactgtgatggcctggccggcctcatcagaacagacagcacagacttcttcatcgagcccctggagcggggccagcaggagaaggaggccagcggccgcacccacgtggtgtaccgccgggaggccgtgcagcaggagtgggccgagccagatggagacctgcacaatgaggccttcggcctgggggacctgcccaacctgctgggcctggtgggggaccagctgggggacacagagaggaagagaagacatgccaagccaggcagctacagcattgaggtgctgctggtggtggatgacagcgtggtgcgcttccacggcaaggagcacgtgcagaactacgtgctgaccctgatgaacatcgtggatgagatctaccatgatgagagcctgggcgtgcacatcaacatcgccctggtgcggctcatcatggtgggctaccggcagagcctgagcctgattgagcggggcaaccccagccgcagcctggagcaggtgtgccgctgggcccacagccagcagaggcaggaccccagccacgccgagcaccacgaccacgtggtgttcctgacccggcaggactttggccccagcggcatgcagggctacgcccctgtgacaggcatgtgccaccccctgcggagctgtgccctgaaccatgaagatggcttcagcagcgcctttgtgattgcccatgaaacaggccacgtgctgggcatggagcatgatggccagggcaatggctgtgctgatgagaccagcctgggctctgtgatggcccccctggtgcaggccgccttccaccgcttccactggagccgctgcagcaagctggagctgagccgctacctgcccagctatgactgcctgctggatgacccctttgatcctgcctggccccagcccccagagctgcccggcatcaactacagcatggatgagcagtgccgctttgattttggaagtggctaccagacctgcctggccttccgcacctttgagccctgcaagcagctgtggtgcagccacccagacaacccctacttctgcaagaccaagaagggcccccccctggatggaacagaatgtgcccctgggaagtggtgcttcaagggccactgcatctggaagagccctgagcagacctacggccaggacggcggctggagctcctggaccaagtttggcagctgcagccgcagctgtggcggcggcgtgcgcagccgcagccgcagctgcaacaaccccagccctgcctatggaggccgcctgtgcctgggccccatgtttgagtaccaggtgtgcaacagcgaggagtgccccggcacctatgaggacttccgggcccagcagtgtgccaagaggaacagctactacgtgcaccagaatgccaagcacagctgggtgccctatgagccagatgatgatgcccagaagtgtgagctgatctgccagagcgctgacacaggagatgtggtgttcatgaaccaggtggtgcatgatggcacccgctgcagctacagagacccctacagcgtgtgtgcccggggagaatgtgtgcctgtgggctgtgacaaggaggtgggctccatgaaggcagatgacaagtgtggggtgtgtggcggggacaacagccactgcaggacagtgaagggcaccctgggcaaggccagcaagcaggccggggccctgaagctggtgcagatcccagctggggcccggcacatccagatcgaggccctggagaagagcccccacagaattgtggtgaagaaccaggtgacaggcagcttcatcctgaaccccaagggcaaggaggccaccagcaggaccttcaccgccatgggcctggagtgggaggatgctgtggaggatgccaaggagagcctgaagaccagcggccccctgcctgaggccatcgccatcctggccctgcccccaacagaaggaggccccaggagcagcctggcctacaagtatgtgattcatgaggacctgctgcccctgattggcagcaacaacgtgctgctggaggagatggacacctatgagtgggccctgaagtcctgggccccctgcagcaaggcctgtggcggcggcatccagttcaccaagtatggctgcagaagaagaagagaccaccacatggtgcagaggcacctgtgtgaccacaagaagaggcccaagcccatcagaagacgctgcaaccagcacccctgcagccagcctgtgtgggtgacagaggagtggggcgcctgcagccgcagctgtgggaagctgggcgtgcagacccggggcatccagtgcctgctgcccctgagcaatggcacccacaaggtgatgcctgccaaggcctgtgccggggacaggcctgaggcccggcggccctgcctgcgggtgccctgcccagcccagtggaggctgggcgcctggagccagtgcagcgccacctgtggggagggcatccagcagaggcaggtggtgtgcaggaccaatgccaacagcctgggccactgtgagggggacagaccagacacagtgcaggtgtgcagcctgcctgcctgtggcggcaaccaccagaacagcacagtgcgggcagatgtgtgggagctgggcaccccagagggccagtgggtgccccagagcgagcccctgcaccccatcaacaagatcagcagcacagagccctgcacaggagacagatctgtgttctgccagatggaggtgctggaccgctactgcagcatccctggctaccaccggctgtgctgcgtgtcctgcatcaagaaggccagcggccccaaccctggccctgaccccggccccaccagcctgccccccttcagcaccccaggcagccccctgcccggcccccaggaccctgcagatgctgctgagcccccaggcaagcccactggaagtgaggaccaccagcacggccgggccacccagctgcccggggccctggacaccagcagccctggcacccagcacccctttgcccctgagacccccatccctggggcctcctggagcatcagccccaccaccccaggcggcctgccctggggctggacccagacccccacccctgtgcctgaagataaaggccagcccggggaggacctgcggcaccctggcaccagcctgcctgctgccagccctgtgacctag

SEQ ID NO: 7459 - DNA, 762 bp, Artificial Sequence
  Description of Artificial Sequence: Synthetic coding sequence
atggctgctgccacccggggctgccggccctggggcagcctgctgggcctgctgggcctggtgtctgctgctgctgctgcctgggacctggccagcctgcgctgcaccctgggcgccttctgtgaatgtgacttccggccagacctgcccggcctggagtgtgacctggcccagcacctggccggccagcacctggccaaggccctggtggtgaaggccctgaaggcctttgtgcgggaccctgcccccaccaagcccctggtgctgagcctgcacggctggacaggaacaggcaagagctatgtgagcagcctgctggcccactacctgttccagggcggcctgcggagcccccgggtgcaccacttcagccctgtgctgcacttcccccaccccagccacatcgagcgctacaagaaggacctgaagtcctgggtgcagggcaacctgacagcctgtggccgcagcctcttcctgtttgatgagatggacaagatgcctcctggcctgatggaggtgctgcggcccttcctgggcagctcctgggtggtgtatggcaccaactacaggaaggccatcttcatcttcatccgctggggccctgccctgcagtgggcccagtggggcggccacttcagcgaggtgcagctgtacagcctgagcctgtgcagccagcagaaccctgtgccccacggcctgtcctgggccttccctgtgcccagcgccaccctgagagatgacatcgtcatccccccaggatag

SEQ ID NO: 7460 - DNA, 966 bp, Artificial Sequence
  Description of Artificial Sequence: Synthetic coding sequence
atggctgctgccacccggggctgccggccctggggcagcctgctgggcctgctgggcctggtgtctgctgctgctgctgcctgggacctggccagcctgcgctgcaccctgggcgccttctgtgaatgtgacttccggccagacctgcccggcctggagtgtgacctggcccagcacctggccggccagcacctggccaaggccctggtggtgaaggccctgaaggcctttgtgcgggaccctgcccccaccaagcccctggtgctgagcctgcacggctggacaggaacaggcaagagctatgtgagcagcctgctggcccactacctgttccagggcggcctgcggagcccccgggtgcaccacttcagccctgtgctgcacttcccccaccccagccacatcgagcgctacaagaaggacctgaagtcctgggtgcagggcaacctgacagcctgtggccgcagcctcttcctgtttgatgagatggacaagatgcctcctggcctgatggaggtgctgcggcccttcctgggcagctcctgggtggtgtatggcaccaactacaggaaggccatcttcatcttcatcagcaacacaggaggcaagcagatcaaccaggtggccctggaggcctggaggagccggcgggaccgggaggagatcctgctgcaggagctggagcctgtgatcagcagagctgtgctggacaacccccaccacggcttcagcaacagcggcatcatggaggagcggctgctggatgctgtggtgcccttcctgcccctgcagaggcaccacgtgcgccactgtgtgctgaatgagctggcccagctgggcctggagcccagagatgaggtggtgcaggccgtgctggacagcaccaccttcttcccagaagatgagcagctgttcagcagcaatggctgcaagacagtggccagcagaattgccttcttcctgtag

SEQ ID NO: 7461 - DNA, 576 bp, Artificial Sequence
  Description of Artificial Sequence: Synthetic coding sequence
atgcaggtgtggtgtgaccagagacatgaccccggcggctggacagtcatccagaggcggctggatggctctgtgaacttcttcaggaactgggagacctacaagcagggcttcggcaacattgatggagagtactggctgggcctggagaacatctactggctgaccaaccagggcaactacaagctgctggtgaccatggaggactggagcggcaggaaggtgtttgctgaatatgccagcttccggctggagcctgagagcgagtactacaagctgcggctgggccgctaccatggaaatgctggggacagcttcacctggcacaacgggaagcagttcaccaccctggaccgggaccatgatgtgtacacaggcaactgtgcccactaccagaagggcggctggtggtacaatgcctgtgcccacagcaacctgaatggagtgtggtacagaggaggccactaccgcagccgctaccaggatggagtgtactgggccgagttccggggcggcagctacagcctgaagaaggtggtgatgatgatccggcccaaccccaacaccttccactag

SEQ ID NO: 7462 - DNA, 1482 bp, Artificial Sequence
  Description of Artificial Sequence: Synthetic coding sequence
atgaggcccctgtgtgtgacctgctggtggctgggcctgctggccgccatgggcgctgtggccggccaggaggatggctttgagggcacagaggagggcagcccccgggagttcatctacctgaaccgctacaagagagctggggagagccaggacaagtgcacctacaccttcatcgtgccccagcagagggtgactggagccatctgtgtgaacagcaaggagcctgaggtgctgctggagaacagagtgcacaagcaggagctggagctgctgaacaatgagctgctgaagcagaagaggcagatcgagaccctgcagcagctggtggaggtggatggcggcatcgtgtctgaggtgaagctgctgaggaaggagagcaggaacatgaacagccgggtgacccagctgtacatgcagctgctgcacgagatcatcaggaagagggacaatgccctggagctgagccagctggagaaccgcatcctgaaccagacagctgacatgctgcagctggccagcaagtacaaggacctggagcacaagtaccagcacctggccaccctggcccacaaccagagcgagatcatcgcccagctggaggagcactgccagagggtgcccagcgcccggcctgtgccccagcccccacctgctgccccaccccgggtgtaccagccccccacctacaaccgcatcatcaaccagatcagcaccaatgagatccagagcgaccagaacctgaaggtgctgcccccacccctgcccaccatgcccaccctgaccagcctgcccagcagcacagacaagcccagcggcccctggagggactgcctgcaggccctggaggatggccatgacaccagcagcatctacctggtgaagccagagaacaccaaccggctgatgcaggtgtggtgtgaccagagacatgaccccggcggctggacagtcatccagaggcggctggatggctctgtgaacttcttcaggaactgggagacctacaagcagggcttcggcaacattgatggagagtactggctgggcctggagaacatctactggctgaccaaccagggcaactacaagctgctggtgaccatggaggactggagcggcaggaaggtgtttgctgaatatgccagcttccggctggagcctgagagcgagtactacaagctgcggctgggccgctaccatggaaatgctggggacagcttcacctggcacaacgggaagcagttcaccaccctggaccgggaccatgatgtgtacacaggcaactgtgcccactaccagaagggcggctggtggtacaatgcctgtgcccacagcaacctgaatggagtgtggtacagaggaggccactaccgcagccgctaccaggatggagtgtactgggccgagttccggggcggcagctacagcctgaagaaggtggtgatgatgatccggcccaaccccaacaccttccactag

SEQ ID NO: 7463 - DNA, 1959 bp, Artificial Sequence
  Description of Artificial Sequence: Synthetic coding sequence
atggctgctgctgccctgcccccccggcccctgctgctgctgcccctggtgctgctgctgagcggccggcccaccagggctgacagcaaggtgtttggagacctggaccaggtgaggatgaccagcgagggcagtgactgccgctgcaagtgcatcatgaggcccctgagcaaggatgcctgcagccgggtgcgcagcggccgggcccgggtggaggacttctacacagtggagaccgtgagcagcggcacagactgccgctgcagctgcacagccccacccagcagcctgaacccctgtgaaaatgagtggaagatggagaagctgaagaagcaggcccctgagctgctgaagctgcagagcatggtggacctgctggagggcaccctgtacagcatggacctgatgaaggtgcacgcctacgtgcacaaggtggccagccagatgaacaccctggaggagagcatcaaggccaacctgagcagagaaaatgaggtggtgaaggacagcgtgcgccacctgtctgagcagctgcggcactatgagaaccacagcgccatcatgctgggcatcaagaaggagctgagccggctgggcctgcagctgctgcagaaggatgctgctgctgccccagccaccccagccaccggcaccggcagcaaggcccaggacacagcccggggcaagggcaaggacatcagcaaatatggctctgtgcagaagagctttgctgaccggggcctgcccaagccacccaaggagaagctgctgcaggtggagaagctgaggaaggagagcggcaagggcagcttcctgcagcccacagccaagccccgggccctggcccagcagcaggccgtcatccggggcttcacctactacaaggccggcaagcaggaggtgacagaggccgtggccgacaacaccctgcagggcacctcctggctggagcagctgccccccaaggtggagggccgcagcaacagcgctgagcccaacagcgctgagcaggatgaggccgagcccaggagcagcgagcgggtggacctggccagcggcacccccaccagcatcccagccaccaccaccacagccaccaccacccccacccccaccaccagcctgctgcccacagagccccccagcggccctgaggtgagcagccagggccgggaggccagctgtgagggcaccctgcgggctgtggacccccctgtgcgccaccacagctatggaagacatgagggcgcctggatgaaggaccctgctgccagagatgaccgcatctacgtgaccaactactactacggcaacagcctggtggagttcaggaacctggagaacttcaagcagggccgctggagcaacatgtacaagctgccctacaactggattggaactggacatgtggtgtaccagggcgccttctactacaacagagccttcaccaagaacatcatcaagtatgacctgcggcagagatttgtggcctcctgggccctgctgcctgatgtggtgtatgaggacaccaccccctggaagtggaggggccacagcgacatcgactttgctgtggatgagagcggcctgtgggtgatctacccagctgtggatgacagagatgaggcccagcctgaggtgattgtgctgagccggctggaccccggggacctgtctgtgcaccgggagaccacctggaagacccggctgcggaggaacagctatggcaactgcttcctggtgtgtggcatcctgtatgctgtggacacctacaaccagcaggagggccaggtggcctatgcctttgacacccacactggaacagatgcccggccccagctgcccttcctgaatgagcacgcctacaccacccagattgactacaaccccaaggagcgggtgctgtatgcctgggacaatggccaccagctgacctacaccctgcactttgtggtgtag

SEQ ID NO: 7464 - DNA, 1641 bp, Artificial Sequence
  Description of Artificial Sequence: Synthetic coding sequence
atgaagaaccaggacaagaagaatggagctgccaagcagagcaaccccaagagcagccctggccagcctgaggccggccctgagggcgcccaggagcggcccagccaggccgccccagctgtggaggccgagggccctggcagcagccaggcccccaggaagccagagggcgcccaggccaggacagcccagagcggggccctgagagatgtgtctgaggagctgagccggcagctggaggacatcctgagcacctactgtgtggacaacaaccagggcggccctggagaagatggagcccagggcgagcctgctgagccagaagatgctgagaagagcaggacctacgtggccagaaatggagagcctgagcccacccctgtggtgaatggagagaaggagcccagcaaaggagaccccaacacagaggagatccggcagagtgatgaggtgggggaccgggaccacagaagaccccaggagaagaagaaggccaagggcctgggcaaggagatcaccctgctgatgcagaccctgaacaccctgagcaccccagaggagaagctggccgccctgtgcaagaagtatgcagagctgctggaggagcacaggaacagccagaagcagatgaagctgctgcagaagaagcagagccagctggtgcaggagaaggaccacctgcggggggagcacagcaaggctgtgctggcccggagcaagctggagagcctgtgccgggagctgcagaggcacaacagaagcctgaaggaggagggcgtgcagagggcccgggaggaggaggagaagaggaaggaggtgaccagccacttccaggtgaccctgaatgacatccagctgcagatggagcagcacaatgaaagaaacagcaagctgcggcaggagaacatggagctggccgagcggctgaagaagctgattgagcagtatgagctgcgggaggagcacatcgacaaggtgttcaagcacaaggacctgcagcagcagctggtggatgccaagctgcagcaggcccaggagatgctgaaggaggccgaggagcggcaccagcgggagaaggacttcctgctgaaggaggccgtggagagccagaggatgtgtgagctgatgaagcagcaggagacccacctgaagcagcagctggccctgtacacagagaagtttgaggagttccagaacaccctgagcaagagcagcgaggtgttcaccaccttcaagcaggagatggagaagatgaccaagaagatcaagaagctggagaaggagaccaccatgtaccgcagccgctgggagagcagcaacaaggccctgctggagatggccgaggagaagacagtgcgggacaaggagctggagggcctgcaggtgaagatccagaggctggagaagctgtgccgggccctgcagacagaaagaaatgacctgaacaagagggtgcaggacctgtctgctgggggccagggcagcctgacagattctggccctgagaggaggcctgagggccctggggcccaggcccccagcagcccccgggtgacagaggccccctgctacccaggggcccccagcacagaggccagcggccagacaggcccccaggagcccaccagcgcccgggcctag

SEQ ID NO: 7465 - DNA, 1641 bp, Artificial Sequence; identical to SEQ ID NO: 7464
  Description of Artificial Sequence: Synthetic coding sequence

SEQ ID NO: 7466 - DNA, 1392 bp, Artificial Sequence
  Description of Artificial Sequence: Synthetic coding sequence
atgcacggcagctgcagcttcctgatgctgctgctgcccctgctgctgctgctggtggccaccaccggccctgtgggcgccctgacagatgaggagaagaggctgatggtggagctgcacaacctgtaccgggcccaggtgagccccacagccagtgacatgctgcacatgcgctgggatgaggagctggccgcctttgccaaggcctatgcccggcagtgtgtgtggggccacaacaaggagcggggcagaagaggagagaacctgtttgccatcacagatgagggcatggatgtgcccctggccatggaggagtggcaccacgagcgggagcactacaacctgtctgctgccacctgcagccctggccagatgtgtggccactacacccaggtggtgtgggccaagacagagcgcatcggctgcggcagccacttctgtgagaagctgcagggcgtggaggagaccaacatcgagctgctggtgtgcaactatgagcccccaggaaatgtgaagggcaagaggccctaccaggagggcaccccctgcagccagtgccccagcggctaccactgcaagaacagcctgtgtgagcccatcggcagcccagaagatgcccaggacctgccctacctggtgacagaggcccccagcttccgggccacagaggccagtgacagcaggaagatgggcacccccagcagcctggccaccggcatcccagccttcctggtgacagaggtgtctggcagcctggccaccaaggccctgcctgctgtggagacccaggcccccaccagcctggccaccaaggaccccccatccatggccacagaggccccaccctgtgtgaccacagaggtgcccagcatcctggccgcccacagcctgcccagcctggatgaggagcctgtgaccttccccaagagcacccacgtgcccatccccaagtctgctgacaaggtgacagacaagaccaaggtgcccagccgcagccctgagaacagcctggaccccaagatgagcctgaccggggcccgggagctgctgccccacgcccaggaggaggccgaggccgaggccgagctgccccccagcagcgaggtgctggccagcgtcttccctgcccaggacaagccaggagagctgcaggccaccctggaccacacaggccacaccagcagcaagagcctgcccaacttccccaacaccagcgccacagccaatgccactggaggccgggccctggccctgcagagcagcctgcctggagctgagggccctgacaagcccagcgtggtgtctggcctgaacagcggccctggccacgtgtggggccccctgctgggcctgctgctgctgccccccctggtgctggccggcatcttctag

SEQ ID NO: 7467 - DNA, 459 bp, Artificial Sequence
  Description of Artificial Sequence: Synthetic coding sequence
atgatgctgccccagtggctgctgctgctcttcctgctcttcttcttcctgttcctgctgacccggggcagcctgagccccaccaagtacaacctgctggagctgaaggagagctgcatccggaaccaggactgtgaaacaggctgctgccagagggccccagacaactgtgagagccactgtgccgagaagggcagcgagggcagcctgtgccagacccaggtgttcttcggccagtaccgggcctgcccctgcctgaggaacctgacctgcatctacagcaagaatgagaagtggctgagcatcgcctacggccgctgccagaagattggccggcagaagctggccaagaagatgttcctggtgctgccccccagctgctgcctgctgctgctgcacctgctgagcagcctgccccgggccctgtgcagcccctgcagccctgagcccccaccctag

SEQ ID NO: 7468 - DNA, 366 bp, Artificial Sequence
  Description of Artificial Sequence: Synthetic coding sequence
atgatgctgccccagtggctgctgctgctcttcctgctcttcttcttcctgttcctgctgacccggggcagcctgagccccaccaagtacaacctgctggagctgaaggagagctgcatccggaaccaggactgtgaaacaggctgctgccagagggccccagacaactgtgagagccactgtgccgagaagggcagcgagggcagcctgtgccagacccaggtgttcttcggccagtaccgggcctgcccctgcctgaggaacctgacctgcatctacagcaagaatgagaagtggctgagcatcgcctacggccgctgccagaagattggccggcagaagctggccaagaagatgttcttctag

SEQ ID NO: 7469 - DNA, 1122 bp, Artificial Sequence
  Description of Artificial Sequence: Synthetic coding sequence
atgaggctgctggcctggctgatcttcctggccaactggggcggggcccgggcagagcccgggaagttctggcacatcgctgacctgcacctggaccctgactacaaggtgtccaaggaccccttccaggtgtgccccagcgctggcagccagcctgtgcctgatgctggcccctggggagactacctgtgtgacagcccctgggccctgatcaacagcagcatctatgccatgaaggagattgagcctgagccagacttcatcctgtggacaggagatgacacccctcatgtgcctgatgagaagctgggggaggccgctgtgctggagatcgtggagcggctgaccaagctgatccgggaggtgtttcctgacaccaaggtgtatgctgccctgggcaaccacgacttccaccccaagaaccagtttcctgctggcagcaacaacatctacaaccagattgctgagctgtggaagccctggctgagcaatgaaagcatcgccctcttcaagaagggggccttctactgtgagaagctgcccggccccagcggggccggcagaattgtggtgctgaacaccaacctgtactacaccagcaatgccctgacagctgacatggctgaccccggccagcagttccagtggctggaggatgtgctgacagatgccagcaaggccggggacatggtgtacatcgtgggccacgtgcccccaggcttctttgagaagacccagaacaaggcctggttccgggagggcttcaatgagaagtacctgaaggtggtgaggaagcaccaccgggtgattgctggccagttcttcggccaccaccacacagacagcttcaggatgctgtatgatgatgctggggtgcccatcagcgccatgttcatcaccccaggagtgaccccctggaagaccaccctgcccggggtggtgaatggagccaacaacccagccatccgggtgtttgaatatgaccgggccaccctgagcctgaaggtgcgcagccctgctgaggcccggggcggcggctgggagggcctgaagtgcatcaccaccttcccccacagccagctgatccacctgcccctgaccacagagccccaggagggctag

SEQ ID NO: 7470 - DNA, 810 bp, Artificial Sequence
  Description of Artificial Sequence: Synthetic coding sequence
atgaggctgctggcctggctgatcttcctggccaactggggcggggcccgggcagagcctgaggaggcccagggcccctgtgcccaggagaagggcaaaggacctccacccaccagcatcctggccagcctggcccctggcctggaggccggcaagttctggcacatcgctgacctgcacctggaccctgactacaaggtgtccaaggaccccttccaggtgtgccccagcgctggcagccagcctgtgcctgatgctggcccctggggagactacctgtgtgacagcccctgggccctgatcaacagcagcatctatgccatgaaggagattgagcctgagccagacttcatcctgtggacaggagatgacacccctcatgtgcctgatgagaagctgggggaggccgctgtgctggagatcgtggagcggctgaccaagctgatccgggaggtgtttcctgacaccaaggtgtatgctgccctgggcaaccacgacttccaccccaagaaccagtttcctgctggcagcaacaacatctacaaccagattgctgagctgtggaagccctggctgagcaatgaaagcatcgccctcttcaagaagggggccttctactgtgagaagctgcccggccccagcggggccggcagaattgtggtgctgaacaccaacctgtactacaccagcaatgccctgacagctgacatggctgaccccggccagcagttccagtggctggaggatgtgctgacagatgccagcaaggccggggacatggtgtacatcgtgggccacgtgcccccatag

SEQ ID NO: 7471 - DNA, 1368 bp, Artificial Sequence
  Description of Artificial Sequence: Synthetic coding sequence
atgaggctgctggcctggctgatcttcctggccaactggggcggggcccgggcagagcccgggaagttctggcacatcgctgacctgcacctggaccctgactacaaggtgtccaaggaccccttccaggtgtgccccagcgctggcagccagcctgtgcctgatgctggcccctggggagactacctgtgtgacagcccctgggccctgatcaacagcagcatctatgccatgaaggagattgagcctgagccagacttcatcctgtggacaggagatgacacccctcatgtgcctgatgagaagctgggggaggccgctgtgctggagatcgtggagcggctgaccaagctgatccgggaggtgtttcctgacaccaaggtgtatgctgccctgggcaaccacgacttccaccccaagaaccagtttcctgctggcagcaacaacatctacaaccagattgctgagctgtggaagccctggctgagcaatgaaagcatcgccctcttcaagaagggggccttctactgtgagaagctgcccggccccagcggggccggcagaattgtggtgctgaacaccaacctgtactacaccagcaatgccctgacagctgacatggctgaccccggccagcagttccagtggctggaggatgtgctgacagatgccagcaaggccggggacatggtgtacatcgtgggccacgtgcccccaggcttctttgagaagacccagaacaaggcctggttccgggagggcttcaatgagaagtacctgaaggtggtgaggaagcaccaccgggtgattgctggccagttcttcggccaccaccacacagacagcttcaggatgctgtatgatgatgctggggtgcccatcagcgccatgttcatcaccccaggagtgaccccctggaagaccaccctgcccggggtggtgaatggagccaacaacccagccatccgggtgtttgaatatgaccgggccaccctgagcctgaaggacatggtgacctacttcatgaacctgagccaggccaatgcccagggcaccccccgctgggagctggagtaccagctgacagaggcctatggagtgcctgatgccagcgcccacagcatgcacacagtgctggacagaattgctggggaccagagcaccctgcagcgctactacgtgtacaacagcgtgtcctacagcgctggggtgtgtgatgaggcctgcagcatgcagcacgtgtgtgccatgaggcaggtggacattgatgcctacaccacctgcctgtatgccagcggcaccacccctgtgccccagctgcccctgctgctgatggccctgctgggcctgtgcaccctggtgctgtag

SEQ ID NO: 7472 - DNA, 867 bp, Artificial Sequence
  Description of Artificial Sequence: Synthetic coding sequence
atggccctggcccccccaccccggggcctgtggcaggccaaggacatcagccccatcgtgaaggccgccaggagagatggagagctgctgctgagcgcccagctggacagcgaggagcgggaccccggggtgccccggcccagcccctatgccccctacatcctggtgtatgccaatgacctggccatcagcgagcccaacagcgtggccgtgaccctgcagagatatgaccccttccctgctggggaccctgagccccgggccgcccccaacaacagcgctgacccccgggtgagaagagctgcccaggccaccggccccctgcaggacaatgagctgcccggcctggatgagcggcccccccgggcccacgcccagcacttccacaagcaccagctgtggcccagccccttccgggccctgaagcccaggcctggcaggaaggacaggaggaagaagggccaggaggtgttcatggccgccagccaggtgctggactttgatgagaagaccatgcagaaggcccggaggaagcagtgggatgagccccgggtgtgcagccgccgctacctgaaggtggactttgctgacatcggctggaatgagtggatcatcagccccaagagctttgatgcctactactgtgccggggcctgtgagttccccatgcccaagatcgtgcggcccagcaaccacgccaccatccagagcatcgtgcgggctgtgggcatcatccctggcatccctgagccctgctgcgtgcctgacaagatgaacagcctgggcgtgctcttcctggatgagaacagaaatgtggtgctgaaggtgtaccccaacatgtctgtggacacctgtgcctgcaggtag

SEQ ID NO: 7473 - DNA, 1626 bp, Artificial Sequence
  Description of Artificial Sequence: Synthetic coding sequence
atgcccttccggctgctgatccccctgggcctgctgtgtgccctgctgccccagcaccacggggcccctggcccagatggcagcgccccagaccctgcccactacagcttcagcctgaccctgattgatgccctggacaccctgctgatcctgggcaatgtgtctgagttccagagggtggtggaggtgctgcaggacagcgtggactttgatattgatgtgaatgcctctgtgtttgagaccaacatccgggtggtgggcggcctgctgagcgcccacctgctgagcaagaaggccggcgtggaggtggaggccggctggccctgcagcggccccctgctgaggatggccgaggaggccgccaggaagctgctgcctgccttccagacccccaccggcatgccctacggcaccgtgaacctgctgcatggagtgaaccctggagagacccctgtgacctgcacagctggcatcggcaccttcatcgtggagtttgccaccctgagcagcctgaccggggaccctgtgtttgaagatgtggcccgggtggccctgatgaggctgtgggagagcagaagtgacatcggcctggtgggcaaccacattgatgtgctgaccgggaagtgggtggcccaggatgctggcatcggggccggcgtggacagctactttgagtacctggtgaagggggccatcctgctgcaggacaagaagctgatggccatgttcctggagtacaacaaggccatccggaactacaccaggtttgatgactggtacctgtgggtgcagatgtacaagggcaccgtgtccatgcctgtgttccagagcctggaggcctactggccaggcctgcagagcctgattggagacatcgacaatgccatgaggaccttcctgaactactacacagtgtggaagcagtttggaggcctgcctgagttctacaacatcccccagggctacacagtggagaagcgggagggctaccccctgcggcctgagctgattgaaagtgccatgtacctgtaccgggccactggagaccccaccctgctggagctgggcagagatgctgtggagagcattgagaagatcagcaaggtggagtgtggctttgccaccatcaaggacctgcgggaccacaagctggacaacaggatggagagcttcttcctggccgagaccgtgaagtacctgtacctgctgtttgaccccaccaacttcatccacaacaacggcagcacctttgatgctgtgatcaccccctacggggagtgcatcctgggcgccggcggctacatcttcaacacagaggcccaccccattgatcctgctgccctgcactgctgccagaggctgaaggaggagcagtgggaggtggaggacctgatgagggagttctacagcctgaagaggagccgcagcaagttccagaagaacacagtgagcagcggcccctgggagcccccagcccggcccggcaccctcttctccccagaaaatcatgaccaggcccgggagaggaagccagccaagcagaaggtgcccctgctgagctgccccagccagcccttcaccagcaagctggccctgctgggccaggtgttcctggacagcagctag

SEQ ID NO: 7474 - DNA, 1737 bp, Artificial Sequence
  Description of Artificial Sequence: Synthetic coding sequence
atgcccttccggctgctgatccccctgggcctgctgtgtgccctgctgccccagcaccacggggcccctggcccagatggcagcgccccagaccctgcccactaccgggagcgggtgaaggccatgttctaccacgcctatgacagctacctggagaatgccttcccctttgatgagctgcggcccctgacctgtgatggccatgacacctggggcagcttcagcctgaccctgattgatgccctggacaccctgctgatcctgggcaatgtgtctgagttccagagggtggtggaggtgctgcaggacagcgtggactttgatattgatgtgaatgcctctgtgtttgagaccaacatccgggtggtgggcggcctgctgagcgcccacctgctgagcaagaaggccggcgtggaggtggaggccggctggccctgcagcggccccctgctgaggatggccgaggaggccgccaggaagctgctgcctgccttccagacccccaccggcatgccctatggaacagtgaacctgctgcacggcgtgaaccctggagagacccctgtgacctgcacagctggcatcggcaccttcatcgtggagtttgccaccctgagcagcctgactggagaccctgtgtttgaagatgtggcccgggtggccctgatgaggctgtgggagagcagaagtgacatcggcctggtgggcaaccacattgatgtgctgaccgggaagtgggtggcccaggatgctggcattggagctggggtggacagctactttgagtacctggtgaagggggccatcctgctgcaggacaagaagctgatggccatgttcctggagtacaacaaggccatccggaactacaccaggtttgatgactggtacctgtgggtgcagatgtacaagggcaccgtgtccatgcctgtgttccagagcctggaggcctactggccaggcctgcagagcctcatcggggacatcgacaatgccatgaggaccttcctgaactactacacagtgtggaagcagtttggaggcctgcctgagttctacaacatcccccagggctacacagtggagaagcgggagggctaccccctgcggcctgagctgattgagagcgccatgtacctgtaccgggccaccggggaccccaccctgctggagctgggcagagatgctgtggagagcattgagaagatcagcaaggtggagtgtggctttgccaccatcaaggacctgcgggaccacaagctggacaacaggatggagagcttcttcctggccgagaccgtgaagtacctgtacctgctgtttgaccccaccaacttcatccacaacaacggcagcacctttgatgctgtgatcaccccctatggagagtgcatcctgggcgctgggggctacatcttcaacacagaggcccaccccatcgaccctgctgccctgcactgctgccagaggctgaaggaggagcagtgggaggtggaggacctgatgagggagttctacagcctgaagaggagccgcagcaagttccagaagaacacagtgagcagcggcccctgggagcccccagcccggcccggcaccctcttcagccctgagaaccacgaccaggcccgggagaggaagccagccaagcagaaggtgcccctgctgagctgccccagccagcccttcaccagcaagctggccctgctgggccaggtgttcctggacagcagctag

SEQ ID NO: 7475 - DNA, 495 bp, Artificial Sequence
  Description of Artificial Sequence: Synthetic coding sequence
atgaggagctgctacgtggcccaggccggcctgaagctgcccggcagcagtgaccccccagccagcgccagccagagcacccgcatcacagccagcggctacggcccccccagcagccggcccagcagccgggtggtgaatggagaagatgctgtgccctacagctggccctggcaggtgtccctgcagtatgagaagagcggcagcttctaccacacctgtggcggcagcctgattgccccagactgggtggtgacagctggccactgcatcagcagcagcaggacctaccaggtggtgctgggggagtatgacagagctgtgaaggagggccctgagcaggtgatccccatcaacagcggggacctgtttgtgcaccccctgtggaacagaagctgtgtggcctgtggaaatgacatcgccctgatcaagctgagccgcagcgcccagctgggagatgctgtgcagctggccagcctgcccccagctggatag

SEQ ID NO: 7476 - DNA, 3663 bp, Artificial Sequence
  Description of Artificial Sequence: Synthetic coding sequence
atgcctggcctgctgaactggatcactggagctgccctgcccctgacagccagtgatgtgaccagctgtgtgtctggctacgccctgggcctgacagccagcctgacctacggcaacctggaggcccagcccttccagggcctgtttgtgtaccccctggatgaatgtaccaccgtcatcggctttgaggccgtgattgctgacagagtggtgacagtgcagatcaaggacaaggccaagctggagagcggccactttgatgccagccacgtgcgcagccccaccgtgactggaaacatcctgcaggatggagtgtccatcgccccccacagctgcacccctgggaaggtgaccctggatgaggacctggagcgcatcctgtttgtggccaacctgggcaccatcgcccccatggagaatgtgaccatcttcatcagcaccagcagcgagctgcccaccctgcccagcggggctgtgcgggtgctgctgcctgctgtgtgtgcccccaccgtgccccagttctgcaccaagagcacaggcaccagcaaccagcaggcccagggcaaggacagacactgcttcggggcctgggcccctggctcctggaacaagctgtgcctggccaccctgctgaacacagaggtgagcaaccccatggagtatgagttcaacttccagctggagatccggggcccctgcctgctggccggcgtggagagccccacccatgagatccgggcagatgctgcccccagcgcccggagcgccaagagcatcatcatcaccctggccaacaagcacacctttgacaggcctgtggagatcctgatccaccccagcgagccccacatgccccacgtgctgattgaaaaaggagacatgaccctgggggagtttgaccagcacctgaagggccgcacagacttcatcaagggcatgaagaagaagagcagagctgagaggaagacagagatcatcaggaagaggctgcacaaggacatcccccaccacagcgtcatcatgctgaacttctgcccagacctgcagagcgtgcagccctgcctgaggaaggcccatggagagttcatcttcctgattgacaggagcagctccatgagcggcatctccatgcaccgggtgaaggatgccatgctggtggccctgaagagcctgatgcctgcctgcctcttcaacatcatcggcttcggcagcaccttcaagagcctcttccccagcagccagacctacagcgaggacagcctggccatggcctgtgatgacatccagaggatgaaggctgacatgggcggcaccaacatcctgagccccctgaagtgggtgatccggcagcctgtgcaccggggccacccccggctgctgtttgtgatcacagatggagctgtgaacaacacaggcaaggtgctggagctggtgagaaatcatgccttcagcacccgctgctacagctttggcatcggccccaacgtgtgccaccggctggtgaagggcctggcctctgtgtctgagggcagcgctgagctgctgatggagggggagcggctgcagcccaagatggtgaagagcctgaagaaggccatggcccctgtgctgagtgatgtgacagtggagtggatcttccctgagaccacagaggtgctggtgtcccctgtgtctgccagcagcctcttccctggagagcggctggtgggctatggaattgtgtgtgatgccagcctgcacatcagcaaccccaggagtgacaagagaagacgctacagcatgctgcacagccaggagagcggcagctctgtgttctaccacagccaggatgatggccctggcctggagggcggggactgtgccaagaacagcggggcccccttcatcctgggccaggccaagaatgcccggctggccagcggggacagcaccaccaagcatgacctgaacctgagccagaggagaagagcctacagcaccaaccagatcaccaaccacaagcccctgccccgggccaccatggccagtgaccccatgcctgctgccaagcgctaccccctgaggaaggcccggctgcaggacctgaccaaccagaccagcctggatgtgcagcgctggcagattgacctgcagcccctgctgaacagcggccaggacctgaaccagggccccaagctgcggggccctggggcccggcggcccagcctgctgccccagggctgccagcccttcctgccctggggccaggagacccaggcctggagccctgtgcgggagaggaccagtgacagccgcagccctggggacctggagcccagccaccaccccagcgcctttgaaacagagaccagcagtgactgggaccccccagctgagagccaggagcgggccagccccagcaggcctgccaccccagcccctgtgctgggcaaggccctggtgaagggcctgcatgacagccagaggctgcagtgggaggtgtcctttgagctgggcaccccaggccctgagcggggcggggcccaggatgctgacctgtggagcgagaccttccaccacctggccgcccgggccatcatccgggactttgagcagctggccgagcgggagggggagattgagcagggcagcaacagacgctaccaggtgtctgccctgcacaccagcaaggcctgcaacatcatcagcaagtacacagcctttgtgcctgtggatgtgtccaagagccgctacctgcccaccgtggtggagtaccccaacagcgctgccctgaggatgctgggcagccgggccctggcccagcagtggaggggcaccagcagcggcttcggccggccccagaccatgctgggggaggacagcgcccctggaaatggcaagttccaggccctgaacatggaggccagccccacagccctcttcagcgaggcccggagccctggccgggagaagcatggagccagcgagggcccccagaggagcctggccaccaacaccctgagctccatgaaggccagcgagaacctgtttggctcctggctgaacctgaacaagagccggctgctgaccagggctgccaagggcttcctgagcaagcccctcatcaaggctgtggagagcaccagcggcaaccagagctttgactacatccccctggtgtccctgcagctggccagcggggccttcctgctgaatgaggccttctgtgaggccacccacatccccatggagaagctgaagtggaccagccccttcacctgccaccgggtgtccctgaccacccggcccagcgagagcaagacccccagcccccagctgtgcaccagcagccccccaagacaccccagctgtgacagcttcagcctggagcccctggccaagggcaagctgggcctggagcccagggctgtggtggagcacacaggcaagctgtgggccaccgtggtgggcctggcctggctggagcacagcagcgccagctacttcacagagtgggagctggtggccgccaaggccaacagctggctggagcagcaggaggtgcctgagggccgcacccagggcaccctgaaggctgctgcccggcagctgtttgtgctgctgcggcactgggatgagaacctggagttcaacatgctgtgctacaaccccaactacgtgtag

SEQ ID NO: 7477 - DNA, 3051 bp, Artificial Sequence
  Description of Artificial Sequence: Synthetic coding sequence
atgcctggcctgctgaactggatcactggagctgccctgcccctgacagccagtgatgtgaccagctgtgtgtctggctacgccctgggcctgacagccagcctgacctacggcaacctggaggcccagcccttccagggcctgtttgtgtaccccctggatgaatgtaccaccgtcatcggctttgaggccgtgattgctgacagagtggtgacagtgcagatcaaggacaaggccaagctggagagcggccactttgatgccagccacgtgcgcagccccaccgtgactggaaacatcctgcaggatggagtgtccatcgccccccacagctgcacccctgggaaggtgaccctggatgaggacctggagcgcatcctgtttgtggccaacctgggcaccatcgcccccatggagaatgtgaccatcttcatcagcaccagcagcgagctgcccaccctgcccagcggggctgtgcgggtgctgctgcctgctgtgtgtgcccccaccgtgccccagttctgcaccaagagcacaggcaccagcaaccagcaggcccagggcaaggacagacactgcttcggggcctgggcccctggctcctggaacaagctgtgcctggccaccctgctgaacacagaggtgagcaaccccatggagtatgagttcaacttccagctggagatccggggcccctgcctgctggccggcgtggagagccccacccatgagatccgggcagatgctgcccccagcgcccggagcgccaagagcatcatcatcaccctggccaacaagcacacctttgacaggcctgtggagatcctgatccaccccagcgagccccacatgccccacgtgctgattgaaaaaggagacatgaccctgggggagtttgaccagcacctgaagggccgcacagacttcatcaagggcatgaagaagaagagcagagctgagaggaagacagagatcatcaggaagaggctgcacaaggacatcccccaccacagcgtcatcatgctgaacttctgcccagacctgcagagcgtgcagccctgcctgaggaaggcccatggagagttcatcttcctgattgacaggagcagctccatgagcggcatctccatgcaccgggtgaaggatgccatgctggtggccctgaagagcctgatgcctgcctgcctcttcaacatcatcggcttcggcagcaccttcaagagcctcttccccagcagccagacctacagcgaggacagcctggccatggcctgtgatgacatccagaggatgaaggctgacatgggcggcaccaacatcctgagccccctgaagtgggtgatccggcagcctgtgcaccggggccacccccggctgctgtttgtgatcacagatggagctgtgaacaacacaggcaaggtgctggagctggtgagaaatcatgccttcagcacccgctgctacagctttggcatcggccccaacgtgtgccaccggctggtgaagggcctggcctctgtgtctgagggcagcgctgagctgctgatggagggggagcggctgcagcccaagatggtgaagagcctgaagaaggccatggcccctgtgctgagtgatgtgacagtggagtggatcttccctgagaccacagaggtgctggtgtcccctgtgtctgccagcagcctcttccctggagagcggctggtgggctatggaattgtgtgtgatgccagcctgcacatcagcaaccccaggagtgacaagagaagacgctacagcatgctgcacagccaggagagcggcagctctgtgttctaccacagccaggatgatggccctggcctggagggcggggactgtgccaagaacagcggggcccccttcatcctgggccaggccaagaatgcccggctggccagcggggacagcaccaccaagcatgacctgaacctgagccagaggagaagagcctacagcaccaaccagatcaccaaccacaagcccctgccccgggccaccatggccagtgaccccatgcctgctgccaagcgctaccccctgaggaaggcccggctgcaggacctgaccaaccagaccagcctggatgtgcagcgctggcagattgacctgcagcccctgctgaacagcggccaggacctgaaccagggccccaagctgcggggccctggggcccggcggcccagcctgctgccccagggctgccagcccttcctgccctggggccaggagacccaggcctggagccctgtgcgggagaggaccagtgacagccgcagccctggggacctggagcccagccaccaccccagcgcctttgaaacagagaccagcagtgactgggaccccccagctgagagccaggagcgggccagccccagcaggcctgccaccccagcccctgtgctgggcaaggccctggtgaagggcctgcatgacagccagaggctgcagtgggaggtgtcctttgagctgggcaccccaggccctgagcggggcggggcccaggatgctgacctgtggagcgagaccttccaccacctggccgcccgggccatcatccgggactttgagcagctggccgagcgggagggggagattgagcagggcagcaacagacgctaccaggtgtctgccctgcacaccagcaaggcctgcaacatcatcagcaagtacacagcctttgtgcctgtggatgtgtccaagagccgctacctgcccaccgtggtggagtaccccaacagcgctgccctgaggatgctgggcagccgggccctggcccagcagtggaggggcaccagcagcggcttcggccggccccagaccatgctgggggaggacagcgcccctggaaatggccccaggaagtgcagccagaccctgatgggcttcaagaccaagacagaaacagagcacagcgtgcggggctggaagcccaggggggccctgcagaaccagagcgtgctgagcacctcctggagccactggccacccaagcccaggaggaccagcagcaccccagagcccagctag

SEQ ID NO: 7478 - DNA, 3663 bp, Artificial Sequence; identical to SEQ ID NO: 7476
  Description of Artificial Sequence: Synthetic coding sequence

SEQ ID NO: 7479 - DNA, 5235 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagtacccaggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccggggcagcagcacctggctgacagcctttgtgctgaaggtgctgagcctggcccaggagcaggtgggcggcagccctgagaagctgcaggagaccagcaactggctgctgagccagcagcaggctgatggcagcttccaggacctgagccctgtgatccaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccagcagcttcctgggggagaaggccagcgctggcctgctgggcgcccacgccgccgccatcacagcctatgccctgaccctgaccaaggccccagctgacctgcggggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaaggtggtggaggagcaggagagccgggtgcactacacagtgtgcatctggagaaatggcaaggtgggcctgagcggcatggccatcgcagatgtgaccctgctgagcggcttccacgccctgcgggctgacctggagaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 7480 - DNA, 1242 bp, Artificial Sequence
  Description of Artificial Sequence: Synthetic coding sequence
atgaagggggccctgggcagccctgtggccgccgccggggccgccatgcaggagagctttggctgtgtggtggccaaccgcttccaccagctgctggatgatgaaagtgacccctttgacatcctgcgggaggccgagcggcggcggcagcagcagctgcagaggaagagaagagatgaagctgctgctgctgctggagctggcccccggggcggccgcagccctgctggggccagcggccacagagctggagctgggggccggcgggagagccagaaggagaggaagagcctgcctgcccctgtggcccagaggccagacagccctgggggcggcctgcaggcccctggccagaagaggaccccaagaagaggagagcagcagggctggaatgacagccggggccctgagggcatgctggagagagctgagaggaggagctaccgggagtaccggccctatgaaacagagcggcaggccgacttcaccgctgagaagttcccagatgagaagccaggggacagatttgaccgggaccggcccctgcggggccggggcggcccccggggcggcatgaggggccggggccggggcggccctggcaacagagtgtttgatgcctttgaccagaggggcaagcgggagtttgaaagatatggaggaaatgacaagattgctgtgaggacagaggacaacatgggcggctgcggcgtgaggacctggggcagcggcaaggacaccagtgatgtggagcccacagcccccatggaggagcccaccgtggtggaggagagccagggcaccccagaggaggagagccctgccaaggtgcctgagctggaggtggaggaggagacccaggtgcaggagatgaccctggatgagtggaagaacctgcaggagcagacccggcccaagccagagttcaacatcaggaagccagagagcacagtgcccagcaaggctgtggtgatccacaagagcaagtacagagatgacatggtgaaggatgattatgaagatgacagccacgtgttcaggaagccagccaatgacatcaccagccagctggagatcaactttggaaacctgcccaggcctggccgcggggcccggggcggcacccggggcggccggggccgcatcagaagagctgagaactacggccccagggctgaggtggtgatgcaggatgtggcccccaacccagatgatcctgaggacttccctgccctgtcctag

SEQ ID NO: 7481 - DNA, 927 bp, Artificial Sequence
  Description of Artificial Sequence: Synthetic coding sequence
atgaagggggccctgggcagccctgtggccgccgccggggccgccatgcaggagagctttggctgtgtggtggccaaccgcttccaccagctgctggatgatgaaagtgacccctttgacatcctgcgggaggccgagcggcggcggcagcagcagctgcagaggaagagaagagatgaagctgctgctgctgctggagctggcccccggggcggccgcagccctgctggggccagcggccacagagctggagctgggggccggcgggagagccagaaggagaggaagagcctgcctgcccctgtggcccagaggccagacagccctgggggcggcctgcaggcccctggccagaagaggaccccaagaagaggagagcagcagggctggaatgacagccggggccctgagggcatgctggagagagctgagaggaggagctaccgggagtaccggccctatgaaacagagcggcaggccgacttcaccgctgagaagttcccagatgagaaggtgcctgagctggaggtggaggaggagacccaggtgcaggagatgaccctggatgagtggaagaacctgcaggagcagacccggcccaagccagagttcaacatcaggaagccagagagcacagtgcccagcaaggctgtggtgatccacaagagcaagtacagagatgacatggtgaaggatgattatgaagatgacagccacgtgttcaggaagccagccaatgacatcaccagccagctggagatcaactttggaaacctgccccggcccggccgcggggcccggggcggcacccggggcggccggggccgcatccggcgggcagaaaattatggccccagggctgaggtggtgatgcaggatgtggcccccaacccagatgatcctgaggacttccctgccctgtcctag

SEQ ID NO: 7482 - DNA, 1437 bp, Artificial Sequence
  Description of Artificial Sequence: Synthetic coding sequence
atgccccggcggggctacagcaagccaggctcctggggcagcttctgggccatgctgaccctggtgggcctggtgacccacgccgcccagagagcagatgtgggcggggaggccgccggcaccagcatcaaccacagccaggccgtgctgcagaggctgcaggagctgctgcggcagggcaatgccagtgatgtggtgctgcgggtgcaggccgccggcacagatgaggtgcgggtcttccacgcccaccggctgctgctgggcctgcacagcgagctgttcctggagctgctgagcaaccagagcgaggccgtgctgcaggagccccaggactgtgccgctgtgtttgacaagttcatccgctacctgtactgtggggagctgactgtgctgctgacccaggccatccccctgcaccggctggccaccaagtatggagtgagcagcctgcagaggggcgtggccgactacatgagggcccacctggccggcggggccggccctgctgtgggctggtaccactatgctgtgggcactggagatgaggccctgcgggagagctgcctgcagttcctggcctggaacctgtctgctgtggccgccagcacagagtggggcgctgtgtccccagagctgctgtggcagctgctgcagaggagtgacctggtgctgcaggatgagctggagctgttccacgccctggaggcctggctgggccgggcccggcccccacctgctgtggccgagcgggccctgcgggccatccgctaccccatgatccccccagcccagctgttccagctgcaggcccggtctgctgccctggcccggcacggccctgctgtggccgacctgctgctgcaggcctaccagttccacgccgccagccccctgcactacgccaagttctttgatgtgaatggaagtgccttcctgcccaggaactacctggccccagcctggggcgccccctgggtgatcaacaacccagccagagatgacaggagcaccagcttccagacccagctgggccccagcggccatgatgctggccggcgggtgacctggaatgtgctcttcagcccccgctggctgcctgtgtccctgcggcctgtgtatgcagatgctgctggaacagccctgcctgctgcccggccagaagatggccggccccggctggtggtgaccccagccagcagtggaggagatgctgctggggtgtccttccagaagacagtgctggtgggcgcccggcagcagggccgcctgctggtgagacatgcctacagcttccaccagagcagcgaggaggccggggacttcctggcccatgctgacctgcagaggaggaacagcgagtacctggtggagaatgccctgcacctgcacctgattgtgaagcctgtgtaccacaccctcatccgcacccccaagtag

SEQ ID NO: 7483 - DNA, 477 bp, Artificial Sequence
  Description of Artificial Sequence: Synthetic coding sequence
atgtgctgccctgggggccactacaccctcatcctgcggcggggcaaccgcttcagaagagagaagaggcctgccaaggtgactggagcccagacagaggtgcagctggccccacccctgccccggggccgggcccggcgcagcccctggagcgtgcccatcagcctgagcattgaccggctggagtttgacctgctgtacccagccatcaagggggacaccatccagctgtacctgggcgccaagctgctggacagccagggcaaggtgaccaagtggttcaacaacagcgctgccagcctgaccatgcccaccctggacaacatccccttcagcctcatcgtgtcccaggatgtggtgaaggctgctgtggccgctgtgctgagccctgaggagttcatggtgctgctggacagcgtgctgcctgagagcgcccaccggctgaagagcagcatcggcctcatcaatgagaagtag

SEQ ID NO: 7484 - DNA, 771 bp, Artificial Sequence; identical to SEQ ID NO: 7291
  Description of Artificial Sequence: Synthetic coding sequence

SEQ ID NO: 7485 - DNA, 771 bp, Artificial Sequence; identical to SEQ ID NO: 7291
  Description of Artificial Sequence: Synthetic coding sequence

SEQ ID NO: 7486 - DNA, 657 bp, Artificial Sequence
  Description of Artificial Sequence: Synthetic coding sequence
atgatgtgccccctgtggaggctgctgatcttcctgggcctgctggccctgcccctggccccccacaagcagccctggccaggcctggcccaggcccaccgggacaacaagagcaccctggcccgcatcatcgcccagggcctcatcaagcacaatgctgagagccgcatccagaacatccactttggagaccggctgaatgccagcgcccaggtggcccctggcctggtgggctggctgatcagcggcaggaagcaccagcagcagcaggagagccgcagctttgacaacaacatcgtgaagatgtgtgcccacatgagcatcgtggtggagttctggctggagaaggatgaatttggaagaagagacctggtgattggaaaatgtgatgctgagcccagctctgtgcacgtggccatcctgacagaggccatcccccccaagatgaaccagttcctgtacaacctgaaggagaacctgcagaaggtgctgccccacatggtggagagccaggtgtgccccctcatcggggagatcctgggccagctggatgtgaagctgctgaagagcctcatcgagcaggaggccgcccacgagcccacccaccacgagaccagccagcccagcgcctgccaggccggggagagccccagctag

SEQ ID NO: 7487 - DNA, 765 bp, Artificial Sequence
  Description of Artificial Sequence: Synthetic coding sequence
atgatgtgccccctgtggaggctgctgatcttcctgggcctgctggccctgcccctggccccccacaagcagccctggccaggcctggcccaggcccaccgggacaacaagagcaccctggcccgcatcatcgcccagggcctcatcaagcacaatgctgagagccgcatccagaacatccactttggagaccggctgaatgccagcgcccaggtggcccctggcctggtgggctggctgatcagcggcaggaagcaccagcagcagcaggagagcagcatcaacatcaccaacatccagctggactgtggcggcatccagatctccttccacaaggagtggttcagcgccaacatcagcctggagtttgacctggagctgcggcccagctttgacaacaacatcgtgaagatgtgtgcccacatgagcatcgtggtggagttctggctggagaaggatgaatttggaagaagagacctggtgattggaaaatgtgatgctgagcccagctctgtgcacgtggccatcctgacagaggccatcccccccaagatgaaccagttcctgtacaacctgaaggagaacctgcagaaggtgctgccccacatggtggagagccaggtgtgccccctcatcggggagatcctgggccagctggatgtgaagctgctgaagagcctcatcgagcaggaggccgcccacgagcccacccaccacgagaccagccagcccagcgcctgccaggccggggagagccccagctag

SEQ ID NO: 7488 - DNA, 1635 bp, Artificial Sequence
  Description of Artificial Sequence: Synthetic coding sequence
atgaagatctccatgatcaactacaagagcctgctggccctgctcttcatcctggcctcctggatcatcttcaccgtcttccagaacagcaccaaggtgtggagcgccctgaacctgagcatcagcctgcactactggaacaacagcaccaagagcctcttccccaagacccccctcatcagcctgaagcccctgacagaaacagagctgcgcatcaaggagatcatcgagaagctggaccagcagatccccccccggcccttcacccacgtgaacaccaccaccagcgccacccacagcacagccaccatcctgaacccccgggacacctactgccgcggggaccagctgcacatcctgctggaggtgcgggaccacctgggccgcaggaagcagtatggaggagacttcctgcgggccaggatgagcagccctgccctgatggccggggccagcggcaaggtgacagacttcaacaacggcacctacctggtgtccttcaccctcttctgggagggccaggtgtccctgagcctgctgctgatccaccccagcgagggcgtgtctgccctgtggagcgccaggaaccagggctatgacagagtcatcttcaccggccagtttgtgaatggcaccagccaggtgcacagtgaatgtggcctcatcctgaacaccaatgctgagctgtgccagtacctggacaacagagaccaggagggcttctactgtgtgcggccccagcacatgccctgtgccgccctgacccacatgtacagcaagaacaagaaggtgtcctacctgagcaagcaggagaagagcctgtttgagaggagcaatgtgggcgtggagatcatggagaagttcaacaccatctctgtgtccaagtgcaacaaggagaccgtggccatgaaggagaagtgcaagtttggcatgaccagcaccatccccagcggccacgtgtggaggaacacctggaaccctgtgtcctgcagcctggccaccgtgaagatgaaggaatgtctgcggggcaagctgatctacctgatgggagacagcaccatccggcagtggatggagtacttcaaggccagcatcaacaccctgaagtctgtggacctgcacgagagcggcaagctgcagcaccagctggccgtggacctggacaggaacatcaacatccagtggcagaagtactgctaccccctgattggctccatgacctacagcgtgaaggagatggagtacctgacccgggccatcgacagaactggaggagagaagaacacagtgattgtcatcagcctgggccagcacttccggcccttccccattgatgtgttcatcagaagagccctgaatgtgcacaaggccatccagcacctgctgctgcggagcccagacaccatggtgatcatcaagacagagaacatccgggagatgtacaatgatgctgagcgcttcagtgacttccacggctacatccagtacctgatcatcaaggacatcttccaggacctgtctgtgtccatcattgatgcctgggacatcaccatcgcctacggcaccaacaacgtgcaccccccccagcacgtggtgggcaaccagatcaacatcctgctgaactacatctgctag

SEQ ID NO: 7489 - DNA, 1845 bp, Artificial Sequence
  Description of Artificial Sequence: Synthetic coding sequence
atgtggatggcctggtgtgtggccgccctgtctgtggtggccgtgtgtggcaccagccatgagaccaacacagtgctgcgggtgaccaaggatgtgctgagcaatgccatcagcggcatgctgcagcagagtgatgccctgcacagcgccctgcgggaggtgcccctgggcgtgggggacatcccctacaatgacttccacgtgcggggccccccacctgtgtacaccaacgggaagaagctggatggcatctaccagtatggccacatcgagaccaatgacaacacagcccagctgggcggcaagtaccgctatggagagatcctggagagcgagggcagcatccgggacctgagaaattctggctacagatctgcagaaaatgcctacggcggccaccggggcctgggccgctacagagctgcccctgtgggccgcctgcacagaagagagctgcagcccggggagatccccccaggagtggccactggagctgtgggccctgggggcctgctgggcaccggcggcatgctggccgcagatggcatcctggccggccagggcggcctgctgggcggcggcggcctgctgggagatggcggcctgctgggcggcggcggcgtgctgggcgtgctgggggagggcggcatcctgagcacagtgcagggcatcaccggcctgagaattgtggagctgaccctgccccgggtgtctgtgcggctgctgcccggggtgggcgtgtacctgagcctgtacaccagggtggccatcaacgggaagagcctgattggcttcctggacattgctgtggaggtgaacatcacagccaaggtgcggctgaccatggacagaacaggctacccccggctggtgattgaaagatgtgacaccctgctgggcggcatcaaggtgaagctgctgcggggcctgctgcccaacctggtggacaacctggtgaacagagtgctggctgatgtgctgcctgacctgctgtgccccatcgtggatgtggtgctgggcctggtgaatgaccagctgggcctggtggacagcctcatccccctgggcatcctgggctctgtgcagtacaccttcagcagcctgcccctggtgactggagagttcctggagctggacctgaacaccctggtgggggaggccggcggcggcctgattgactaccccctgggctggccagctgtgagccccaagcccatgcctgagctgccccccatgggagacaacaccaagagccagctggccatgtctgccaacttcctgggctctgtgctgaccctgctgcagaagcagcacgccctggacctggacatcaccaacggcatgtttgaggagctgccccccctgaccacagccaccctgggcgccctgatccccaaggtgttccagcagtacccagagagctgccccctcatcatccgcatccaggtgctgaacccccccagcgtgatgctgcagaaggacaaggccctggtgaaggtgctggccacagctgaggtgatggtgtcccagcccaaggacctggagaccaccatctgcctgattgatgtggacacagagttcctggccagcttcagcacagaaggagacaagctgatgattgatgccaagctggagaagaccagcctgaacctgcggaccagcaatgtgggcaactttgatattggcctgatggaggtgctggtggagaagatctttgacctggccttcatgcctgccatgaatgctgtgctgggcagcggcgtgcccctgcccaagatcctgaacatcgacttcagcaatgctgacattgatgtgctggaggacctgctggtgctgagcgcctag

SEQ ID NO: 7490 - DNA, 1431 bp, Artificial Sequence
  Description of Artificial Sequence: Synthetic coding sequence
atgcagcctgtgatgctggccctgtggagcctgctgctgctgtggggcctggccaccccctgccaggagctgctggagaccgtgggcaccctggccagaattgacaaggatgagctgggcaaggccatccagaacagcctggtgggggagcccatcctgcagaatgtgctgggctctgtgacagctgtgaacagaggcctgctgggcagcggcggcctgctgggcggcggcggcctgctgggccacggcggcgtgtttggagtggtggaggagctgagcggcctgaagattgaggagctgaccctgcccaaggtgctgctgaagctgctgcccggctttggagtgcagctgagcctgcacaccaaggtgggcatgcactgcagcggccccctgggcggcctgctgcagctggccgctgaggtgaatgtgaccagccgggtggccctggccgtgagcagccggggcacccccatcctgatcctgaagcgctgcagcaccctgctgggccacatcagcctcttcagcggcctgctgcccacccccctgtttggagtggtggagcagatgctgttcaaggtgctgcccggcctgctgtgccctgtggtggacagcgtgctgggcgtggtgaatgagctgctgggcgctgtgctgggcctggtgtccctgggcgccctgggctctgtggagttcagcctggccaccctgcccctcatcagcaaccagtacatcgagctggacatcaaccccatcgtgaagtctgtggccggggacatcatcgacttccccaagagccgggccccagccaaggtgccccccaagaaggaccacaccagccaggtgatggtgcccctgtacctgttcaacaccaccttcggcctgctgcagaccaatggagccctggacatggacatcaccccagagctggtgcccagtgatgtgcccctgaccaccacagacctggccgccctgctgcctgaggccctgggcaagctgcccctgcaccagcagctgctgctcttcctgcgggtgcgggaggcccccaccgtgaccctgcacaacaagaaggccctggtgtccctgcctgccaacatccacgtgctcttctacgtgcccaagggcaccccagagagcctgtttgagctgaacagcgtgatgacagtgcgggcccagctggcccccagcgccaccaagctgcacatcagcctgagcctggagcggctgtctgtgaaggtggccagcagcttcacccacgcctttgatggcagccggctggaggagtggctgagccacgtggtgggcgctgtgtatgcccccaagctgaatgtggccctggatgtgggcatccccctgcccaaggtgctgaacatcaacttcagcaacagcgtgctggagatcgtggagaatgctgtggtgctgactgtggccagctag

SEQ ID NO: 7491 - DNA, 585 bp, Artificial Sequence
  Description of Artificial Sequence: Synthetic coding sequence
atgcaggatgcccccctgagctgcctgagccccaccaagtggagctctgtgtcctctgctgacagcacagagaagagcgccagcggggccggcaccaggaacctgcccttccagttctgcctgcggcaggccctgaggatgaaggccgccggcatcctgaccctcatcggctgcctggtgactggagctgagagcaagatctacacccgctgcaagctggccaagatcttcagccgggccggcctggacaactactggggcttcagcctgggcaactggatctgcatggcctactatgaaagtggctacaacaccacagcccagacagtgctggatgatggcagcattgattatggcatcttccagatcaacagctttgcctggtgccggcggggcaagctgaaggagaacaaccactgccacgtggcctgcagcgccctgatcacagatgacctgacagatgccatcatctgtgccaggaagatcgtgaaggagacccagggcatgaactactggcagggctggaagaagcactgtgagggccgggacctgtctgagtggaagaagggctgtgaggtgtcctag

SEQ ID NO: 7492 - DNA, 1266 bp, Artificial Sequence
  Description of Artificial Sequence: Synthetic coding sequence
atgggcttcctgagccccatctacgtgatcttcttcttcttcggcgtgaaggtgcactgccagtatgagacctaccagtgggatgaagattatgaccaggagccagatgatgactaccagacaggcttccccttccggcagaatgtggactatggagtgcccttccaccagtacaccctgggctgtgtgtctgagtgcttctgccccaccaacttccccagctccatgtactgtgacaacaggaagctgaagaccatccccaacatccccatgcacatccagcagctgtacctgcagttcaatgaaattgaagctgtgacagccaacagcttcatcaatgccacccacctgaaggagatcaacctgagccacaacaagatcaagagccagaagattgattatggagtgtttgccaagctgcccaacctgctgcagctgcacctggagcacaacaacctggaggagttccccttccccctgcccaagagcctggagcggctgctgctgggctacaatgagatcagcaagctgcagaccaatgccatggatggcctggtgaacctgaccatgctggacctgtgctacaactacctgcatgacagcctgctgaaggacaagatctttgccaagatggagaagctgatgcagctgaacctgtgcagcaaccggctggagagcatgcctcctggcctgcccagcagcctgatgtacctgagcctggagaacaacagcatcagcagcatccctgagaagtactttgacaagctgcccaagctgcacaccctgaggatgagccacaacaagctgcaggacatcccctacaacatcttcaacctgcccaacatcgtggagctgtctgtgggccacaacaagctgaagcaggccttctacatccccaggaacctggagcacctgtacctgcagaacaatgaaattgagaagatgaacctgactgtgatgtgccccagcattgaccccctgcactaccaccacctgacctacatccgggtggaccagaacaagctgaaggagcccatcagcagctacatcttcttctgcttcccccacatccacaccatctactacggggagcagaggagcaccaacggccagaccatccagctgaagacccaggtgttccgccgcttcccagatgatgatgatgaaagtgaagatcatgatgatcctgacaatgcccacgagagccctgagcaggagggcgctgagggccactttgacctgcactactatgagaaccaggagtag

SEQ ID NO: 7493 - DNA, 252 bp, Artificial Sequence
  Description of Artificial Sequence: Synthetic coding sequence
atgctgtgctgctgccccctggctgatgccctgctgatcttcctggagaccggcagctgcttccagcccggccagcagagcgagaccctgagccagaagcagaacaagaccaacaacaagaagtgggccggcggggccggctgccggcccttccggctgtggtgggtgggccgcagcagaggagctggggtgcagctgtacagcaccaagaagggctggatcctgcggggcaagggcggcacagaggcctag

SEQ ID NO: 7494 - DNA, 2559 bp, Artificial Sequence
  Description of Artificial Sequence: Synthetic coding sequence
atgctgcccacagaggtgccccagagccaccctggccccagcgccctgctgctgctgcagctgctgctgccccccaccagcgccttcttccccaacatctggagcctgctggccgcccctggcagcatcacccaccaggacctgacagaggaggccgccctgaatgtgaccctgcagctgttcctggagcagcccccacctggccggccccccctgcggctggaggacttcctgggccgcaccctgctggctgatgacctgtttgctgcctacttcggccctggcagcagccgccgcttccgggccgccctgggggaggtgtcccgggccaatgctgcccaggacttcctgcccaccagcagaaatgaccctgacctgcactttgatgctgagcggctgggccagggccgggcccggctggtgggcgccctgcgggagaccgtggtggccgcccgggccctggaccacaccctggcccggcagaggctgggcgccgccctgcacgccctgcaggacttctacagccacagcaactgggtggagctgggggagcagcagccccacccccacctgctgtggccccggcaggagctgcagaacctggcccaggtggccgaccccacctgcagcgactgtgaggagctgagctgccccaggaactggctgggcttcaccctgctgaccagcggctacttcggcacccacccccccaagcccccaggcaagtgcagccatggaggccactttgacaggagcagcagccagcccccccggggcggcatcaacaaggacagcaccagccctggcttcagcccccaccacatgctgcacctgcaggccgccaagctggccctgctggccagcatccaggccttcagcctgctgcggagccggctgggggaccgggacttcagccggctgctggacatcaccccagccagcagcctgagctttgtgctggacaccaccggctccatgggagaggagatcaatgctgccaagatccaggcccggcacctggtggagcagaggcggggcagccccatggagcctgtgcactacgtgctggtgcccttccatgaccccggcttcggccctgtgttcaccaccagtgaccctgacagcttctggcagcagctgaatgagatccacgccctgggcggcggagatgagcctgagatgtgcctgagcgccctgcagctggccctgctgcacaccccacccctgagtgacatctttgtgttcacagatgccagccccaaggatgccttcctgaccaaccaggtggagagcctgacccaggagcggcgctgccgggtgaccttcctggtgacagaggacaccagccgggtgcagggccgggcccggcgggagatcctgagccccctgcgctttgagccctacaaggctgtggccctggccagcggcggggaggtgatcttcaccaaggaccagcacatcagagatgtggccgccatcgtgggggagagcatggccgccctggtgaccctgcccctggacccccctgtggtggtgcccggccagcccctggtgttttctgtggatggcctgctgcagaagatcaccgtgcgcatccatggagacatcagcagcttctggatcaagaacccagctggggtgtcccagggccaggaggagggcggcggccccctgggccacacccggcgcttcggccagttctggatggtgaccatggatgatcctccccagacaggcacctgggagatccaggtgacagctgaggacaccccaggagtgcgggtgcaggcccagaccagcctggacttcctgttccacttcggcatccccatggaggatggcccccaccctggcctgtaccccctgacccagcctgtggccggcctgcagacccagctgctggtggaggtgacaggcctgggcagccgggccaaccctggggacccccagccccacttcagccacgtgatcctgcggggcgtgcctgagggcgctgagctgggccaggtgcccctggagcctgtgggccccccagagcggggcctgctggccgccagcctgagccccaccctgctgagcaccccccggcccttcagcctggagctgattggccaggatgctgctggccggcggctgcacagagctgccccccagcccagcacagtggtgcctgtgctgctggagctgagcggccccagcggcttcctggcccctggcagcaaggtgcccctgagcctgcgcatcgccagcttcagcggcccccaggacctggacctgcggacctttgtgaaccccagcttcagcctgaccagcaacctgagccgggcccacctggagctgaatgaaagtgcctggggccgcctgtggctggaggtgcctgattctgctgccccagacagcgtggtgatggtgacagtgacagctgggggccgggaggccaaccctgtgccccccacccacgccttcctgcggctgctggtgtctgccccagccccccaggtgaggaaccactacttccccagccagggccctgcccaccacccctaccgcctcatctag

SEQ ID NO: 7495 - DNA, 2676 bp, Artificial Sequence
  Description of Artificial Sequence: Synthetic coding sequence
atgctgcccacagaggtgccccagagccaccctggccccagcgccctgctgctgctgcagctgctgctgccccccaccagcgccttcttccccaacatctggagcctgctggccgcccctggcagcatcacccaccaggacctgacagaggaggccgccctgaatgtgaccctgcagctgttcctggagcagcccccacctggccggccccccctgcggctggaggacttcctgggccgcaccctgctggctgatgacctgtttgctgcctacttcggccctggcagcagccgccgcttccgggccgccctgggggaggtgtcccgggccaatgctgcccaggacttcctgcccaccagcagaaatgaccctgacctgcactttgatgctgagcggctgggccagggccgggcccggctggtgggcgccctgcgggagaccgtggtggccgcccgggccctggaccacaccctggcccggcagaggctgggcgccgccctgcacgccctgcaggacttctacagccacagcaactgggtggagctgggggagcagcagccccacccccacctgctgtggccccggcaggagctgcagaacctggcccaggtggccgaccccacctgcagcgactgtgaggagctgagctgccccaggaactggctgggcttcaccctgctgaccagcggctacttcggcacccacccccccaagcccccaggcaagtgcagccatggaggccactttgacaggagcagcagccagcccccccggggcggcatcaacaaggacagcaccagccctggcttcagcccccaccacatgctgcacctgcaggccgccaagctggccctgctggccagcatccaggccttcagcctgctgcggagccggctgggggaccgggacttcagccggctgctggacatcaccccagccagcagcctgagctttgtgctggacaccaccggctccatgggagaggagatcaatgctgccaagatccaggcccggcacctggtggagcagaggcggggcagccccatggagcctgtgcactacgtgctggtgcccttccatgaccccggcttcggccctgtgttcaccaccagtgaccctgacagcttctggcagcagctgaatgagatccacgccctgggcggcggagatgagcctgagatgtgcctgagcgccctgcagctggccctgctgcacaccccacccctgagtgacatctttgtgttcacagatgccagccccaaggatgccttcctgaccaaccaggtggagagcctgacccaggagcggcgctgccgggtgaccttcctggtgacagaggacaccagccgggtgcagggccgggcccggcgggagatcctgagccccctgcgctttgagccctacaaggctgtggccctggccagcggcggggaggtgatcttcaccaaggaccagcacatcagagatgtggccgccatcgtgggggagagcatggccgccctggtgaccctgcccctggacccccctgtggtggtgcccggccagcccctggtgttttctgtggatggcctgctgcagaagatcaccgtgcgcatccatggagacatcagcagcttctggatcaagaacccagctggggtgtcccagggccaggaggagggcggcggccccctgggccacacccggcgcttcggccagttctggatggtgaccatggatgatcctccccagacaggcacctgggagatccaggtgacagctgaggacaccccaggagtgcgggtgcaggcccagaccagcctggacttcctgttccacttcggcatccccatggaggatggcccccaccctggcctgtaccccctgacccagcctgtggccggcctgcagacccagctgctggtggaggtgacaggcctgggcagccgggccaaccctggggacccccagccccacttcagccacgtgatcctgcggggcgtgcctgagggcgctgagctgggccaggtgcccctggagcctgtgggccccccagagcggggcctgctggccgccagcctgagccccaccctgctgagcaccccccggcccttcagcctggagctgattggccaggatgctgctggccggcggctgcacagagctgccccccagcccagcacagtggtgcctgtgctgctggagctgagcggccccagcggcttcctggcccctggcagcaaggtgcccctgagcctgcgcatcgccagcttcagcggcccccaggacctggacctgcggacctttgtgaaccccagcttcagcctgaccagcaacctgagccgggcccacctggagctgaatgaaagtgcctggggccgcctgtggctggaggtgcctgattctgctgccccagacagcgtggtgatggtgacagtgacagctgggggccgggaggccaaccctgtgccccccacccacgccttcctgcggctgctggtgtctgccccagccccccaggacagacacaccacccccaccggcagcagtgaccccatcctgaccacagccaccccagccttcagccccttcaccctggtgacccagggccgggccggggccggcctggccgccggcagcccctggtggggcaccgtgggcggcgtgctgctgctgctgggcctggcctcctggtag

SEQ ID NO: 7496 - DNA, 552 bp, Artificial Sequence
  Description of Artificial Sequence: Synthetic coding sequence
atggtgcgcatctggaccaccatcatgattgtgctgatcctgctgctgcgcatcggccccaacaagcccagcctgagcggccggcaggccccagcccaggcccagaccagtgacctggtgcccagcctcttccccctgggcctgtgggcccctggcttctgcacctggagcagcccagatgaggacaagaggcccaggaagcctgtgcccggcaccggcaacagagattctggcacccggcggcggctgcaggatgccacagagcaggaccccaggcctggaaatgatgtggccagcgctgagacagctggcccccccagccccagcggcatccgggcccaggaccgggcccccaggcacagaagagcccccccagccaggatgcctgtggccccagcccccagcgcagatggagagcccctgcaggagcagggcggcggcctcttccacaggaccaggtctgtgtacaacggcctggagctgaacacctggatgaaggtggagcggctgtttgtggagaagttccaccagagcttcagcctggacaactag

SEQ ID NO: 7497 - DNA, 444 bp, Artificial Sequence
  Description of Artificial Sequence: Synthetic coding sequence
atggccggccctgctggcagccagagcctgggccccctgtgcttccacagcagcccccaggccctgtacacagtgctgctgattgtgctggtgatgatgagcctggtgtttgggaagtttgtgcctgtgaactgggagcccccccagcccctgcccttccccaagtacctgcgctgctaccgctgcctgctggagaccaaggagctgggctgcctgctgggcagtgacatctgcctgaccccagctggcagcagctgcatcaccctgcacaagaagaacagcagcggcagtgatgtgatggtgtctgactgccgcagcaaggagcagatgtctgactgcagcaacaccaggaccagccctgtgtctggcttctggatcttcagccagtactgcttcctggacttctgcaatgacccccagaacagaggcctgtacaccccctag

SEQ ID NO: 7498 - DNA, 447 bp, Artificial Sequence
  Description of Artificial Sequence: Synthetic coding sequence
atgcagaccttccctgtggccggggccctggaccctgccatcctggacaccagcagcccccaggccctgtacacagtgctgctgattgtgctggtgatgatgagcctggtgtttgggaagtttgtgcctgtgaactgggagcccccccagcccctgcccttccccaagtacctgcgctgctaccgctgcctgctggagaccaaggagctgggctgcctgctgggcagtgacatctgcctgaccccagctggcagcagctgcatcaccctgcacaagaagaacagcagcggcagtgatgtgatggtgtctgactgccgcagcaaggagcagatgtctgactgcagcaacaccaggaccagccctgtgtctggcttctggatcttcagccagtactgcttcctggacttctgcaatgacccccagaacagaggcctgtacaccccctag

SEQ ID NO: 7499 - DNA, 606 bp, Artificial Sequence
  Description of Artificial Sequence: Synthetic coding sequence
atgaaggtgcacatgctggtgggcgtgctggtgatggtgggcttcaccgtgggcaaggtgcctgtgcctgacatccgcacctgccacttctgcctggtggaggaccccagcgtgggctgcatcagcggcagcgagaagtgcaccatcagcagcagcagcctgtgcatggtgatcaccatctactatgatgtgaaggtgcgcttcatcgtgcggggctgcggccagtacatctcctaccgctgccaggagaagaggaacacctactttgctgagtactggtaccaggcccagtgctgccagtatgactactgcaacagctggagcagcccccagctgcagagcagcctgcctgagccccatgaccggcccctggccctgcccctgagtgacagccagatccagtggttctaccaggccctgaacctgagcctgcccctgcccaacttccacgccggcacagagccagatggcctggaccccatggtgaccctgagcctgaacctgggcctgagctttgctgagctgcggaggatgtacctgttcctgaacagcagcggcctgctggtgctgccccaggccggcctgctgaccccccaccccagctag

SEQ ID NO: 7500 - DNA, 345 bp, Artificial Sequence
  Description of Artificial Sequence: Synthetic coding sequence
atgctgggcggggaggaggcccggcccaacagctggccctggcaggtgtccctgcagtacagcagcaatggccagtggtaccacacctgtggcggcagcctgattgccaacagctgggtgctgacagctgcccactgcatccggcagatcatcaaggcccacaaggtgctgcagcgctgcagcctcatcctcttctttgtgcgggacctgtgcagcagccagctggagctgactggagtgtctgctggcagcagcggcatctacagagtgatgctgggccagcacaacctgtatgtggccgagagcggcagcctggccgtgtctgtgtccaagatcgtggtgtag

SEQ ID NO: 7501 - DNA, 810 bp, Artificial Sequence
  Description of Artificial Sequence: Synthetic coding sequence
atgatccgcaccctgctgctgagcaccctggtggccggggccctgagctgtggggtgtccacctacgccccagacatgagcaggatgctgggcggggaggaggcccggcccaacagctggccctggcaggtgtccctgcagtacagcagcaatggccagtggtaccacacctgtggcggcagcctgattgccaacagctgggtgctgacagctgcccactgcatcagcagcagcggcatctacagagtgatgctgggccagcacaacctgtatgtggccgagagcggcagcctggccgtgtctgtgtccaagatcgtggtgcacaaggactggaacagcgaccaggtgtccaaaggaaatgacatcgccctgctgaagctggccaaccctgtgtccctgacagacaagatccagctggcctgcctgcccccagctggcaccatcctgcccaacaactacccctgctacgtgacaggctggggccgcctgcagaccaacggggccctgcctgatgacctgaagcagggccagctgctggtggtggactatgccacctgcagcagcagcggctggtggggcagcacagtgaagaccaacatgatctgtgctggaggagatggagtcatctgcacctgcaatggagacagcggcggccccctgaactgccaggccagtgatggccgctgggaggtgcacggcatcggcagcctgacctctgtgctgggctgcaactactactacaagcccagcatcttcaccagggtgagcaactacaatgactggatcaacagcgtcatcgccaacaactag

SEQ ID NO: 7502 - DNA, 567 bp, Artificial Sequence
  Description of Artificial Sequence: Synthetic coding sequence
atgttccaccagatctgggccgccctgctgtacttctacggcatcatcctgaacagcatctaccagtgcccagagcacagccagctgaccaccctgggcgtggatggcaaggagttccctgaggtgcacctgggccagtggtacttcatcgccggggccgcccccaccaaggaggagctggccacctttgatcctgtggacaacatcgtgttcaacatggctgctggcagcgcccccatgcagctgcacctgcgggccaccatccgcatgaaggatggcctgtgtgtgcccaggaagtggatctaccacctgacagagggcagcacagacctgaggacagagggccgcccagacatgaagacagagctgttcagcagcagctgccctgggggcatcatgctgaatgaaacaggccagggctaccagcgcttcctgctgtacaacagaagcccccaccccccagagaagtgtgtggaggagttcaagagcctgaccagctgcctggacagcaaggccttcctgctgacccccaggaaccaggaggcctgtgagctgagcaacaactag

SEQ ID NO: 7503 - DNA, 390 bp, Artificial Sequence
  Description of Artificial Sequence: Synthetic coding sequence
atggctgctggcagcgcccccatgcagctgcacctgcgggccaccatccgcatgaaggatggcctgtgtgtgcccaggaagtggatctaccacctgacagagggcagcacagacctgaggacagagggccgcccagacatgaagacagagctgttcagcagcagctgccctgggggcatcatgctgaatgaaacaggccagggctaccagcgcttcctgctgtacaacagaagcccccaccccccagagaagtgtgtggaggagttcaagagcctgaccagctgcctggacagcaaggccttcctgctgacccccaggaaccagggcaagggcctgaagagccacaagacaggcctgggcctgaccaagagcagtggagtgactggatag

SEQ ID NO: 7504 - DNA, 351 bp, Artificial Sequence
  Description of Artificial Sequence: Synthetic coding sequence
atggctgctggcagcgcccccatgcagctgcacctgcgggccaccatccgcatgaaggatggcctgtgtgtgcccaggaagtggatctaccacctgacagagggcagcacagacctgaggacagagggccgcccagacatgaagacagagctgttcagcagcagctgccctgggggcatcatgctgaatgaaacaggccagggctaccagcgcttcctgctgtacaacagaagcccccaccccccagagaagtgtgtggaggagttcaagagcctgaccagctgcctggacagcaaggccttcctgctgacccccaggaaccaggaggcctgtgagctgagcaacaactag

SEQ ID NO: 7505 - DNA, 435 bp, Artificial Sequence
  Description of Artificial Sequence: Synthetic coding sequence
atgatccgcaccctgctgctgagcaccctggtggccggggccctgagctgtggggaccccacctacccaccctacgtgaccagggtggtgggcggggaggaggcccggcccaacagctggccctggcaggtgtccctgcagtacagcagcaatggcaagtggtaccacacctgtggcggcagcctgattgccaacagctgggtgctgacagctgcccactgcatcagccagagcatggtgcagtgtgcccacaaggtgctgcagcgctgcagcctcatcctcttctttgtgcgggacctgtgcagcagccagctggagctgactggagtgtctgctggcagcagcaggacctacagagtgggcctgggccgccacaacctgtatgtggccgagagcggcagcctggccgtgtctgtgtccaagatcgtggtgtag

SEQ ID NO: 7506 - DNA, 204 bp, Artificial Sequence
  Description of Artificial Sequence: Synthetic coding sequence
atgaagctgctgctgctgaccctgactgtgctgctgctgctgagccagctgaccccaggcggcacccagcgctgctggaacctgtatggaaaatgtcgctaccgctgcagcaagaaggagcgggtgtatgtgtactgcatcaacaacaagatgtgctgcgtgaagcccaagtaccagcccaaggagcgctggtggcccttctag

SEQ ID NO: 7507 - DNA, 231 bp, Artificial Sequence
  Description of Artificial Sequence: Synthetic coding sequence
atgaagctgctgctgctgctgctgactgtgaccctgctgctggcccaggtgacccctgtgatgaagtgctggggcaagagcggccgctgcaggaccacctgcaaggagagcgaggtgtactacatcctgtgcaagacagaggccaagtgctgcgtggaccccaagtatgtgcctgtgaagcccaagctgacagacaccaacaccagcctggagagcaccagcgctgtgtag

SEQ ID NO: 7508 - DNA, 267 bp, Artificial Sequence
  Description of Artificial Sequence: Synthetic coding sequence
atgaagctgctgtacctgttcctggccatcctgctggccatcgaggagcctgtgatctctgtggagtgctggatggatggccactgccgcctgctgtgcaaggatggagaagattccatcatccgctgcaggaacaggaagcgctgctgcgtgcccagccgctacctgaccatccagcctgtgaccatccacggcatcctgggctggaccaccccccagatgagcaccacagcccccaagatgaagaccaacatcaccaacagatag

SEQ ID NO: 7509 - DNA, 255 bp, Artificial Sequence
  Description of Artificial Sequence: Synthetic coding sequence
atgaagctgctgtacctgttcctggccatcctgctggccatcgaggagcctgtgatcagcggcaagaggcacatcctgcgctgcatgggcaacagcggcatctgccgggccagctgcaagaagaatgagcagccctacctgtactgcaggaactgccagagctgctgcctgcagagctacatgaggatcagcatcagcggcaaggaggagaacacagactggagctatgagaagcagtggccccggctgccctag

SEQ ID NO: 7510 - DNA, 2631 bp, Artificial Sequence; identical to SEQ ID NO: 6925
  Description of Artificial Sequence: Synthetic coding sequence

SEQ ID NO: 7511 - DNA, 2742 bp, Artificial Sequence; identical to SEQ ID NO: 7141
  Description of Artificial Sequence: Synthetic coding sequence

SEQ ID NO: 7512 - DNA, 2631 bp, Artificial Sequence; identical to SEQ ID NO: 6925
  Description of Artificial Sequence: Synthetic coding sequence

SEQ ID NO: 7513 - DNA, 2631 bp, Artificial Sequence; identical to SEQ ID NO: 6925
  Description of Artificial Sequence: Synthetic coding sequence

SEQ ID NO: 7514 - DNA, 2760 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagagatggcctgctgagctacacagcccctgtgggccagaccatgtacctgtctgaggccgtgtacctgaatgacagcacctatgatggccacacagtgggcggcctgcagtatggaggcctgggccagctggctgatggagtggtgggcctggatgacttcaggaagagccaggagctgcgggtgtggccaggctatgactatgtgggctggagcaaccacagcttcagcagcggctacgtggagatggagtttgaatttgaccggctgcgggccttccaggccatgcaggtgcactgcaacaacatgcacaccctgggcgcccggctgcccggcggcgtggagtgccgcttccggcggggccctgccatggcctgggagggggagcccatgaggcacaacctgggcggcaacctgggggacccccgggcccgggctgtgtctgtgcccctgggcggccgggtggcccgcttcctgcagtgccgcttcctgtttgctggcccctggctgctcttcagcgagatctccttcatcagtgatgtggtgaacaacagcagccctgccctgggcggcaccttccccccagccccctggtggcccccaggccccccacccaccaacttcagcagcctggagctggagccccggggccagcagcctgtggccaaggccgagggcagccccacagccatcctgattggctgcctggtggccatcatcctgctgctgctgctgatcatcgccctgatgctgtggaggctgcactggaggcggctgctgagcaaggccgagcggcgggtgctggaggaggagctgactgtgcacctgtctgtgcctggggacaccatcctgatcaacaaccggcccggcccccgggagcccccaccctaccaggagccccggccccggggcaaccccccccacagcgccccctgtgtgcccaacggcagcgccctgctgctgagcaacccagcctaccgcctgctgctggccacctacgcccggcccccccggggccctggcccccccaccccagcctgggccaagcccaccaacacccaggcctacagcggggactacatggagcctgagaagccaggggcccccctgctgcccccaccaccccagaacagcgtgccccactacgccgaggccgacatcgtgaccctgcagggcgtgactggaggcaacacctatgctgtgcctgccctgcccccaggagctgtgggagatggccccccccgggtggacttccccaggagccggctgcgcttcaaggagaagctgggggagggccagtttggagaggtgcacctgtgtgaggtggacagcccccaggacctggtgtccctggacttccccctgaatgtgaggaagggccaccccctgctggtggccgtgaagatcctgcggccagatgccaccaagaatgccagcttcagcctcttcagcagaaatgacttcctgaaggaggtgaagatcatgagccggctgaaggaccccaacatcatccggctgctgggcgtgtgtgtgcaggatgaccccctgtgcatgatcacagactacatggagaatggagacctgaaccagttcctgagcgcccaccagctggaggacaaggctgctgagggcgcccctggagatggccaggccgcccagggccccaccatctcctaccccatgctgctgcacgtggccgcccagatcgccagcggcatgagatacctggccaccctgaactttgtgcaccgggacctggccaccaggaactgcctggtgggggagaacttcaccatcaagattgctgactttggcatgagcaggaacctgtatgctggggactactacagagtgcagggccgggctgtgctgcccatccgctggatggcctgggagtgcatcctgatgggcaagttcaccacagccagtgatgtgtgggcctttggagtgaccctgtgggaggtgctgatgctgtgccgggcccagcccttcggccagctgacagatgagcaggtgattgaaaatgctggggagttcttccgggaccagggccggcaggtgtacctgagccggcccccagcctgcccccagggcctgtatgagctgatgctgcgctgctggagccgggagagcgagcagaggcctcccttcagccagctgcaccgcttcctggctgaagatgccctgaacacagtgtag

SEQ ID NO: 7515 - DNA, 1041 bp, Artificial Sequence
  Description of Artificial Sequence: Synthetic coding sequence
atgctgaagaagcccctgtctgctgtgacctggctgtgcatcttcatcgtggcctttgtgagccacccagcctggctgcagaagctgagcaagcacaagaccccagcccagccccagctgaaggccgccaactgctgtgaggaggtgaaggagctgaaggcccaggtggccaacctgagcagcctgctgtctgagctgaacaagaagcaggagcgggactgggtgtctgtggtgatgcaggtgatggagctggagagcaacagcaagaggatggagagccggctgacagatgctgagagcaagtacagcgagatgaacaaccagattgacatcatgcagctgcaggccgcccagacagtgacccagaccagcgcagatgccatctatgactgcagcagcctgtaccagaagaactaccgcatcagcggcgtgtacaagctgcccccagatgacttcctgggcagccctgagctggaggtgttctgtgacatggagaccagcggcggcggctggaccatcatccagaggaggaagagcggcctggtgtccttctacagagactggaagcagtacaagcagggcttcggcagcatccggggggacttctggctgggcaatgagcacatccaccggctgagccggcagcccacccggctgcgggtggagatggaggactgggagggcaacctgcgctatgcagagtacagccactttgtgctgggcaatgagctgaacagctaccgcctcttcctgggcaactacacaggaaatgtgggcaatgatgccctgcagtaccacaacaacacagccttcagcaccaaggacaaggacaatgacaactgcctggacaagtgtgcccagctgaggaagggcggctactggtacaactgctgcacagacagcaacctgaatggagtgtactaccgcctgggggagcacaacaagcacctggatggcatcacctggtacggctggcacggcagcacctacagcctgaagagggtggagatgaagatccggcctgaggacttcaagccctag

SEQ ID NO: 7516 - DNA, 1056 bp, Artificial Sequence
  Description of Artificial Sequence: Synthetic coding sequence
atgaagggccgggctgtgtcctttgaccccctggcctgccagggcctgaatgccagccctggcagcctgaccagccccctgcggcgcatccgcagcctgaccggccgggaggtgctgacccccttccctggcctgggcacagctgctgccccagcccagggcggggcccacctgaagccccacagcctggtgctgcccatcacagccctgcccccaccacccctggccctgcggggccggcaggccaccagcaagctgccccccttcctgagcagccccttcccccccagcctgtgcccctgggtgcctgaccccggcttcaaggagacagccttcctgtatgctgtgagcagcgctgccctgacccacaccctggcccgggcctgcagcgctggccgcatggagcgctgcacctgtgatgacagccctggcctggagagccggcaggcctggcagtggggcgtgtgtggggacaacctgaagtacagcaccaagttcctgagcaacttcctgggcagcaagaggggcaacaaggacctgcgggcccgggcagatgcccacaacacccacgtgggcatcaaggctgtgaagagcggcctgcggaccacctgcaagtgccacggcgtgtctggcagctgtgctgtgaggacctgctggaagcagctgagccccttccgggagaccggccaggtgctgaagctgcgctatgacagcgctgtgaaggtgagcagcgccaccaatgaggccctgggccgcctggagctgtgggccccagcccggcagggcagcctgaccaagggcctggcccccaggtctggggacctggtgtacatggaggacagccccagcttctgccggcccagcaagtacagccctggaacagctggccgggtgtgcagccgggaggccagctgcagcagcctgtgctgcggccggggctatgacacccagagccggctggtggccttcagctgccactgccaggtgcagtggtgctgctacgtggagtgccagcagtgtgtgcaggaggagctggtgtacacctgcaagcactag

SEQ ID NO: 7517 - DNA, 462 bp, Artificial Sequence
  Description of Artificial Sequence: Synthetic coding sequence
atgaagcacctgcggccccagttccccctcatcctggccatctactgcttctgcatgctgcagatccccagcagcggcttcccccagcccctggccgaccccagtgatggcctggacatcgtgcagctggagcagctggcctactgcctgagccagtgggcccccctgagccggcagcccaaggacaaccaggacatctacaagcgcttcctgttccactacagcaggacccaggaggccacccaccctgtgaagacaggcttcccccctgtgcaccccctgatgcacctggccgccaagctggccaacagaaggatgaagaggatcctgcagaggggcagcggcacagctgctgtggacttcaccaagaaggaccacacagccacctggggccggcccttcttcctgttccggcccagaaatggaagaaatattgaagatgaggcccagatccagtggtag

SEQ ID NO: 7518 - DNA, 765 bp, Artificial Sequence
  Description of Artificial Sequence: Synthetic coding sequence
atggctgctgccagcgctggggccacccggctgctgctgctgctgctgatggctgtggccgcccccagccgggcccggggcagcggctgccgggccggcaccggggcccggggagctggagctgagggccgggagggggaggcctgtggcaccgtgggcctgctgctggagcacagctttgaaattgatgattctgccaacttcaggaagaggggcagcctgctgtggaaccagcaggacggcaccctgagcctgagccagaggcagctgtctgaggaggagcggggccgcctgagagatgtggccgccctgaatggcctgtacagagtgcgcatcccccggcggcctggggccctggatggcctggaggccggcggctacgtgagcagctttgtgcctgcctgcagcctggtggagagccacctgagtgaccagctgaccctgcacgtggatgtggccggaaatgtggtgggcgtgtctgtggtgacccaccctgggggctgccggggccacgaggtggaggatgtggacctggagctgttcaacacctctgtgcagctgcagccccccaccacagcccctggccctgagacagctgccttcatcgagcggctggagatggagcaggcccagaaggccaagaacccccaggagcagaagagcttctttgccaagtactggcacatcatcctgggcggcgctgtgctgctgacagccctgcggcctgctgcccctggccctgcccccccaccccaggaggcctag

SEQ ID NO: 7519 - DNA, 810 bp, Artificial Sequence
  Description of Artificial Sequence: Synthetic coding sequence
atggctgctgccagcgctggggccacccggctgctgctgctgctgctgatggctgtggccgcccccagccgggcccggggcagcggctgccgggccggcaccggggcccggggagctggagctgagggccgggagggggaggcctgtggcaccgtgggcctgctgctggagcacagctttgaaattgatgattctgccaacttcaggaagaggggcagcctgctgtggaaccagcaggacggcaccctgagcctgagccagaggcagctgtctgaggaggagcggggccgcctgagagatgtggccgccctgaatggcctgtacagagtgcgcatcccccggcggcctggggccctggatggcctggaggccggcggctacgtgagcagctttgtgcctgcctgcagcctggtggagagccacctgagtgaccagctgaccctgcacgtggatgtggccggaaatgtggtgggcgtgtctgtggtgacccaccctgggggctgccggggccacgaggtggaggatgtggacctggagctgttcaacacctctgtgcagctgcagccccccaccacagcccctggccctgagacagctgccttcatcgagcggctggagatggagcaggcccagaaggccaagaacccccaggagcagaagagcttctttgccaagtactggatgtacatcatccctgtggtgctcttcctgatgatgtctggggccccagacacaggaggccagggcggcggcggcggcggcggcggcggcggcggcagcggccgctgctgcgtgccccccagcctgtag

SEQ ID NO: 7520 - DNA, 480 bp, Artificial Sequence
  Description of Artificial Sequence: Synthetic coding sequence
atgagcagcccccagaggaggaaggccatgccctgggccctgagcctgctgctgatgggcttccagctgctggtgacctacgcctggtgcagcgaggaggagatgggcggcaacaacaagatcgtgcaggaccccatgttcctggccaccgtggagtttgccctgaacaccttcaacgtgcagagcaaggaggagcacgcctaccgcctgctgcgggtgctgagctcctggagagaagattccatggacaggaagtggaggggcaagatggtgttctccatgaacctgcagctgcggcagacagtgtgcaggaagtttgaagatgacatcgacaactgccccttccaggagagcctggagctgaacaacgtgcggcagggcatctccttcccccaggtgcacagctgtggctgctgcatgggctgcggcgtgggcaccggggctgctgacaaggccatcccccgggacaagggcaagtag

SEQ ID NO: 7521 - DNA, 1737 bp, Artificial Sequence
  Description of Artificial Sequence: Synthetic coding sequence
atgctgctgctgctgctgctggcccccctcttcctgcggcccccaggagctggaggagcccagaccccaaatgccaccagcgagggctgccagatcatccaccccccctgggagggcggcatccgctaccggggcctgacccgggaccaggtgaaggccatcaacttcctgcctgtggactatgaaattgaatatgtgtgccgcggggagcgggaggtggtgggccccaaggtgaggaagtgcctggccaacggctcctggacagacatggacacccccagccgctgtgtgcgcatctgcagcaagagctacctgaccctggagaatggcaaggtgttcctgactggaggagacctgcctgccctggatggagcccgggtggacttccgctgtgaccctgacttccacctggtgggcagcagccgcagcatctgcagccagggccagtggagcacccccaagccccactgccaggtgaacagaacaccccacagcgagaggagagctgtgtacatcggggccctcttccccatgtctgggggctggccaggcggccaggcctgccagcctgctgtggagatggccctggaggatgtgaacagccggcgggacatcctgcctgactatgagctgaagctgatccaccacgacagcaaatgtgaccccggccaggccaccaagtacctgtatgagctgctgtacaatgaccccatcaagatcatcctgatgcctggctgcagctctgtgtccaccctggtggccgaggccgccaggatgtggaacctgattgtgctgtcctatggcagcagcagccctgccctgagcaaccggcagcgcttccccaccttcttccgcacccaccccagcgccaccctgcacaaccccaccagggtgaagctgtttgagaagtggggctggaagaagatcgccaccatccagcagaccacagaggtgttcaccagcaccctggatgacctggaggagcgggtgaaggaggccggcatcgagatcaccttccggcagagcttcttcagtgaccctgctgtgcctgtgaagaacctgaagaggcaggatgcccgcatcatcgtgggcctcttctatgaaacagaggccaggaaggtgttctgtgaggtgtacaaggagcggctgtttgggaagaagtatgtgtggttcctgattggctggtatgctgacaactggttcaagatctatgaccccagcatcaactgcaccgtggatgagatgacagaggccgtggagggccacatcaccacagaaattgtgatgctgaacccagccaacaccaggagcatcagcaacatgaccagccaggagtttgtggagaagctgaccaagaggctgaagaggcaccctgaggagactggaggcttccaggaggcccccctggcctatgatgccatctgggccctggccctggccctgaacaagaccagcggcggcggcggccgctctggagtgcggctggaggacttcaactacaacaaccagaccatcacagaccagatctaccgggccatgaacagcagcagctttgagggcgtgtctggccacgtggtgtttgatgccagcggcagcaggatggcctggaccctgattgagcagctgcagggcggcagctacaagaagattggctactatgacagcaccaaggatgacctgtcctggagcaagacagacaagtggatcgtcatcagcaggacccacagccccacctag

SEQ ID NO: 7522 - DNA, 444 bp, Artificial Sequence
  Description of Artificial Sequence: Synthetic coding sequence
atgctgggcctgccctggaagggcggcctgtcctgggccctgctgctgctgctgctgggcagccagatcctgctgatctatgcctggcacttccacgagcagagggactgtgatgagcacaacgtgatggcccgctacctgcctgccaccgtggagtttgctgtgcacaccttcaaccagcagagcaaggactactatgcctaccgcctgggccacatcctgaacagctggaaggagcaggtggagagcaagacagtgttctccatggagctgctgctgggccgcacccgctgtgggaagtttgaagatgacatcgacaactgccacttccaggagagcacagagctgaacaacaccttcacctgcttcttcaccatcagcacccggccctggatgacccagttcagcctgctgaacaagacctgcctggagggcttccactag

SEQ ID NO: 7523 - DNA, 444 bp, Artificial Sequence
  Description of Artificial Sequence: Synthetic coding sequence
atgtggagcctgccccccagccgggccctgagctgtgcccccctgctgctgctcttctccttccagttcctggtgacctacgcctggaggttccaggaggaggaggagtggaatgaccagaagcagattgctgtgtacctgccccccaccctggagtttgctgtgtacaccttcaacaagcagagcaaggactggtacgcctacaagctggtgcctgtgctggcctcctggaaggagcagggctatgacaagatgaccttctccatgaacctgcagctgggccgcaccatgtgtgggaagtttgaagatgacatcgacaactgccccttccaggagagccctgagctgaacaacacctgcacctgcttcttcaccatcggcatcgagccctggaggaccaggtttgacctgtggaacaagacctgcagcggcggccacagctag

SEQ ID NO: 7524 - DNA, 2535 bp, Artificial Sequence; identical to SEQ ID NO: 7302
  Description of Artificial Sequence: Synthetic coding sequence

SEQ ID NO: 7525 - DNA, 2700 bp, Artificial Sequence
  Description of Artificial Sequence: Synthetic coding sequence
atgctgctgctgctgctgctggcccccctcttcctgcggcccccaggagctggaggagcccagaccccaaatgccaccagcgagggctgccagatcatccaccccccctgggagggcggcatccgctaccggggcctgacccgggaccaggtgaaggccatcaacttcctgcctgtggactatgaaattgaatatgtgtgccgcggggagcgggaggtggtgggccccaaggtgaggaagtgcctggccaacggctcctggacagacatggacacccccagccgctgtgtgaacagaacaccccacagcgagaggagagctgtgtacatcggggccctcttccccatgtctgggggctggccaggcggccaggcctgccagcctgctgtggagatggccctggaggatgtgaacagccggcgggacatcctgcctgactatgagctgaagctgatccaccacgacagcaaatgtgaccccggccaggccaccaagtacctgtatgagctgctgtacaatgaccccatcaagatcatcctgatgcctggctgcagctctgtgtccaccctggtggccgaggccgccaggatgtggaacctgattgtgctgtcctatggcagcagcagccctgccctgagcaaccggcagcgcttccccaccttcttccgcacccaccccagcgccaccctgcacaaccccaccagggtgaagctgtttgagaagtggggctggaagaagatcgccaccatccagcagaccacagaggtgttcaccagcaccctggatgacctggaggagcgggtgaaggaggccggcatcgagatcaccttccggcagagcttcttcagtgaccctgctgtgcctgtgaagaacctgaagaggcaggatgcccgcatcatcgtgggcctcttctatgaaacagaggccaggaaggtgttctgtgaggtgtacaaggagcggctgtttgggaagaagtatgtgtggttcctgattggctggtatgctgacaactggttcaagatctatgaccccagcatcaactgcaccgtggatgagatgacagaggccgtggagggccacatcaccacagaaattgtgatgctgaacccagccaacaccaggagcatcagcaacatgaccagccaggagtttgtggagaagctgaccaagaggctgaagaggcaccctgaggagactggaggcttccaggaggcccccctggcctatgatgccatctgggccctggccctggccctgaacaagaccagcggcggcggcggccgctctggagtgcggctggaggacttcaactacaacaaccagaccatcacagaccagatctaccgggccatgaacagcagcagctttgagggcgtgtctggccacgtggtgtttgatgccagcggcagcaggatggcctggaccctgattgagcagctgcagggcggcagctacaagaagattggctactatgacagcaccaaggatgacctgtcctggagcaagacagacaagtggattggaggcagccccccagctgaccagaccctggtgatcaagaccttccgcttcctgagccagaagctgttcatctctgtgtctgtgctgagcagcctgggcatcgtgctggccgtggtgtgcctgtccttcaacatctacaacagccacgtgcgctacatccagaacagccagcccaacctgaacaacctgacagctgtgggctgcagcctggccctggccgctgtgttccccctgggcctggatggctaccacatcggcaggaaccagttcccctttgtgtgccaggcccggctgtggctgctgggcctgggcttcagcctgggctacggctccatgttcaccaagatctggtgggtgcacacagtgttcaccaagaaggaggagaagaaggagtggaggaagaccctggagccctggaagctgtatgccaccgtgggcctgctggtgggcatggatgtgctgaccctggccatctggcagatcgtggaccccctgcacaggaccatcgagacctttgccaaggaggagcccaaggaggacattgatgtgtccatcctgccccagctggagcactgcagcagcaggaagatgaacacctggctgggcatcttctacggctacaagggcctgctgctgctgctgggcatcttcctggcctatgagaccaagtctgtgtccacagagaagatcaatgaccacagagctgtgggcatggccatctacaacgtggccgtgctgtgcctgatcacagcccctgtgaccatgatcctgagcagccagcaggatgctgcctttgcctttgccagcctggccatcgtgttcagcagctacatcaccctggtggtgctgtttgtgcccaagatgaggaggctcatcaccagaggagagtggcagagcgaggcccaggacaccatgaagacaggcagcagcaccaacaacaatgaggaggagaagagccggctgctggagaaggagaaccgggagctggagaagatcatcgccgagaaggaggagcgggtgtctgagctgcggcaccagctgcagagccggcagcagctgcggagcagaagacacccccccaccccacctgagcccagcggcggcctgccccggggccccccagagcccccagaccggctgagctgtgatggcagccgggtgcacctgctgtacaagtag

SEQ ID NO: 7526 - DNA, 2886 bp, Artificial Sequence
  Description of Artificial Sequence: Synthetic coding sequence
atgctgctgctgctgctgctggcccccctcttcctgcggcccccaggagctggaggagcccagaccccaaatgccaccagcgagggctgccagatcatccaccccccctgggagggcggcatccgctaccggggcctgacccgggaccaggtgaaggccatcaacttcctgcctgtggactatgaaattgaatatgtgtgccgcggggagcgggaggtggtgggccccaaggtgaggaagtgcctggccaacggctcctggacagacatggacacccccagccgctgtgtgcgcatctgcagcaagagctacctgaccctggagaatggcaaggtgttcctgactggaggagacctgcctgccctggatggagcccgggtggacttccgctgtgaccctgacttccacctggtgggcagcagccgcagcatctgcagccagggccagtggagcacccccaagccccactgccaggtgaacagaacaccccacagcgagaggagagctgtgtacatcggggccctcttccccatgtctgggggctggccaggcggccaggcctgccagcctgctgtggagatggccctggaggatgtgaacagccggcgggacatcctgcctgactatgagctgaagctgatccaccacgacagcaaatgtgaccccggccaggccaccaagtacctgtatgagctgctgtacaatgaccccatcaagatcatcctgatgcctggctgcagctctgtgtccaccctggtggccgaggccgccaggatgtggaacctgattgtgctgtcctatggcagcagcagccctgccctgagcaaccggcagcgcttccccaccttcttccgcacccaccccagcgccaccctgcacaaccccaccagggtgaagctgtttgagaagtggggctggaagaagatcgccaccatccagcagaccacagaggtgttcaccagcaccctggatgacctggaggagcgggtgaaggaggccggcatcgagatcaccttccggcagagcttcttcagtgaccctgctgtgcctgtgaagaacctgaagaggcaggatgcccgcatcatcgtgggcctcttctatgaaacagaggccaggaaggtgttctgtgaggtgtacaaggagcggctgtttgggaagaagtatgtgtggttcctgattggctggtatgctgacaactggttcaagatctatgaccccagcatcaactgcaccgtggatgagatgacagaggccgtggagggccacatcaccacagaaattgtgatgctgaacccagccaacaccaggagcatcagcaacatgaccagccaggagtttgtggagaagctgaccaagaggctgaagaggcaccctgaggagactggaggcttccaggaggcccccctggcctatgatgccatctgggccctggccctggccctgaacaagaccagcggcggcggcggccgctctggagtgcggctggaggacttcaactacaacaaccagaccatcacagaccagatctaccgggccatgaacagcagcagctttgagggcgtgtctggccacgtggtgtttgatgccagcggcagcaggatggcctggaccctgattgagcagctgcagggcggcagctacaagaagattggctactatgacagcaccaaggatgacctgtcctggagcaagacagacaagtggattggaggcagccccccagctgaccagaccctggtgatcaagaccttccgcttcctgagccagaagctgttcatctctgtgtctgtgctgagcagcctgggcatcgtgctggccgtggtgtgcctgtccttcaacatctacaacagccacgtgcgctacatccagaacagccagcccaacctgaacaacctgacagctgtgggctgcagcctggccctggccgctgtgttccccctgggcctggatggctaccacatcggcaggaaccagttcccctttgtgtgccaggcccggctgtggctgctgggcctgggcttcagcctgggctacggctccatgttcaccaagatctggtgggtgcacacagtgttcaccaagaaggaggagaagaaggagtggaggaagaccctggagccctggaagctgtatgccaccgtgggcctgctggtgggcatggatgtgctgaccctggccatctggcagatcgtggaccccctgcacaggaccatcgagacctttgccaaggaggagcccaaggaggacattgatgtgtccatcctgccccagctggagcactgcagcagcaggaagatgaacacctggctgggcatcttctacggctacaagggcctgctgctgctgctgggcatcttcctggcctatgagaccaagtctgtgtccacagagaagatcaatgaccacagagctgtgggcatggccatctacaacgtggccgtgctgtgcctgatcacagcccctgtgaccatgatcctgagcagccagcaggatgctgcctttgcctttgccagcctggccatcgtgttcagcagctacatcaccctggtggtgctgtttgtgcccaagatgaggaggctcatcaccagaggagagtggcagagcgaggcccaggacaccatgaagacaggcagcagcaccaacaacaatgaggaggagaagagccggctgctggagaaggagaaccgggagctggagaagatcatcgccgagaaggaggagcgggtgtctgagctgcggcaccagctgcagagccggcagcagctgcggagcagaagacacccccccaccccacctgagcccagcggcggcctgccccggggccccccagagcccccagaccggctgagctgtgatggcagccgggtgcacctgctgtacaagtag

SEQ ID NO: 7527 - DNA, 882 bp, Artificial Sequence
  Description of Artificial Sequence: Synthetic coding sequence
atgaacaacctgtccttcagcgagctgtgctgcctcttctgctgccccccctgccctgggaagatcgccagcaagctggccttcctgcccccagaccccacctacaccctgatgtgtgatgagagcggcagccgctggaccctgcacctgtctgaaagagctgactggcagtacagcagccgggagaaggatgccatcgagtgcttcatgaccaggaccagcaaaggaaacagaattgcctgcatgtttgtgcgctgcagccccaatgccaagtacaccctgctcttcagccacggcaatgctgtggacctgggccagatgagcagcttctacatcggcctgggcagccgcatcaactgcaacatcttctcctatgactacagcggctacggggccagcagcggcaagcccacagagaagaacctgtatgctgacatcgaggccgcctggctggccctgcggaccaggtatggcatccggccagaaaatgtcatcatctacggccagagcattggaacagtgcccagcgtggacctggccgcccgctatgaatctgctgctgtgatcctgcacagccccctgaccagcggcatgagggtggccttcccagacaccaagaagacctactgctttgatgccttccccaacatcgacaagatcagcaagatcaccagccctgtgctgatcatccatggaacagaagatgaagtcatcgacttcagccacggcctggccctgtttgagcgctgccagaggcctgtggagcccctgtgggtggagggcgccggccacaatgatgtggagctgtatggccagtacctggagcggctgaagcagtttgtgtcccaggagctggtgcagaagcacaaggagggcaagtag

SEQ ID NO: 7528 - DNA, 1155 bp, Artificial Sequence
  Description of Artificial Sequence: Synthetic coding sequence
atgtggtacgtgtccacccggggcgtggccccccgggtgaactttgaaggagccctcttcagcggctacgccccagatggcggcctcttcatgcctgaggagctgccccagctggaccggggcaccctgtgccagtggagcaccctgagctacccaggcctggtgaaggagctgtgtgccctcttcatcggcagcgagctgctgcccaaggatgagctgaatgacctgattgaccgggccttcagccgcttccgccaccgggaggtggtgcacctgagccggctgagaaatggcctgaatgtgctggagctgtggcacggcgtgacctacgccttcaaggacctgagcctgagctgcaccacccagttcctgcagtacttcctggagaagcgggagaagcacgtgacagtggtggtgggcaccagcggggacaccggcagcgctgccatcgagagcgtgcagggcgccaagaacatggacatcatcgtgctgctgcccaagggccactgcaccaagatccaggagctgcagatgaccaccgtgctgaagcagaatgtgcacgtgtttggagtggagggcaacagtgatgagctggatgagcccatcaagacagtgtttgctgatgtggcctttgtgaagaagcacaacctgatgagcctgaacagcatcaactggagccgggtgctggtgcagatggcccaccacttctttgcctacttccagtgcacccccagcctggacacccaccccctgcccctggtggaggtggtggtgcccaccggggctgctggcaacctggccgccggctacatcgcccagaagattggcctgcccatccggctggtggtggccgtgaacagaaatgacatcatccacaggacagtgcagcagggcgacttcagcctgtctgaggccgtgaagagcaccctggccagcgccatggacatccaggtgccctacaacatggagagggtcttctggctgctgagcggcagtgacagccaggtgacccgggccctgatggagcagtttgagaggacccagagcgtgaacctgcccaaggagctgcacagcaagcacagccctgtgctgccccggccctgcctgtgcagccaggtgcccggcagctgccccggctgctggccagacccctag

SEQ ID NO: 7529 - DNA, 2889 bp, Artificial Sequence
  Description of Artificial Sequence: Synthetic coding sequence
atgctgcggcggcctgccccagccctggccccagctgcccggctgctgctggccggcctgctgtgtggcggcggcgtgtgggccgcccgggtgaacaagcacaagccctggctggagcccacctaccatggaattgtgacagaaaatgacaacacagtgctgctggaccccccactcatcgccctggacaaggatgcccccctgcgctttgctgagagctttgaggtgacagtgaccaaggagggggagatctgtggcttcaagatccacggccagaatgtgccctttgatgctgtggtggtggacaagagcactggagagggcgtcatccgcagcaaggagaagctggactgtgagctgcagaaggactacagcttcaccatccaggcctatgactgtgggaaaggaccagatggcaccaacgtgaagaagagccacaaggccaccgtgcacatccaggtgaatgatgtgaatgaatatgcccctgtgttcaaggagaagagctacaaggccaccgtcatcgagggcaagcagtatgacagcatcctgcgggtggaggccgtggatgctgactgcagcccccagttcagccagatctgcagctatgagatcatcaccccagatgtgcccttcaccgtggacaaggatggctacatcaagaacacagagaagctgaactacggcaaggagcaccagtacaagctgactgtgacagcctatgactgtgggaagaagagggccacagaagatgtgctggtgaagatcagcatcaagcccacctgcaccccaggctggcagggctggaacaaccgcatcgagtatgagcccggcaccggggccctggccgtgttccccaacatccacctggagacctgtgatgagcctgtggcctctgtgcaggccaccgtggagctggagaccagccacatcggcaagggctgtgaccgggacacctacagcgagaagagcctgcaccggctgtgtggggctgctgctggaacagctgagctgctgcccagccccagcggcagcctgaactggaccatgggcctgcccacagacaatggacatgacagcgaccaggtgtttgagttcaacggcacccaggccgtgcgcatcccagatggagtggtgtctgtgagccccaaggagcccttcaccatctctgtgtggatgagacatggcccctttggaaggaagaaggagaccatcctgtgcagcagtgacaagacagacatgaacagacaccactacagcctgtatgtgcacggctgccgcctcatcttcctgttccggcaggaccccagcgaggagaagaagtacagacctgctgagttccactggaagctgaaccaggtgtgtgatgaggagtggcaccactacgtgctgaatgtggagttccccagcgtgaccctgtatgtggatggcaccagccatgagcccttctctgtgacagaggactaccccctgcaccccagcaagattgagacccagctggtggtgggcgcctgctggcagggcggggacctgcacatgacccagttcttccggggcaacctggccggcctgaccctgcggagcggcaagctggccgacaagaaggtgattgactgcctgtacacctgcaaggagggcctggacctgcaggtgctggaggacagcggccggggcgtgcagatccaggcccaccccagccagctggtgctgaccctggagggggaggacctgggggagctggacaaggccatgcagcacatctcctacctgaacagccggcagttccccaccccaggcatccggcggctgaagatcaccagcaccatcaagtgcttcaatgaggccacctgcatctctgtgccccctgtggatggctacgtgatggtgctgcagcctgaggagcccaagatcagcctgtctggagtgcaccactttgcccgggccgccagcgagtttgagagcagcgagggcgtcttcctgtttcctgagctgcgcatcatcagcaccatcacccgggaggtggagccagaaggagatggagctgaggaccccaccgtgcaggagagcctggtgtctgaggagatcgtgcatgacctggacacctgtgaggtgacagtggagggggaggagctgaaccacgagcaggagagcctggaggtggacatggcccggctgcagcagaagggcatcgaggtgagcagcagcgagctgggcatgaccttcaccggggtggacaccatggccagctatgaggaggtgctgcacctgctgcgctacagaaactggcacgcccggagcctgctggacaggaagttcaagctgatctgcagcgagctgaatggccgctacatcagcaatgagttcaaggtggaggtgaatgtcatccacacagccaaccccatggagcacgccaaccacatggccgcccagccccagtttgtgcaccctgagcacaggagctttgtggacctgagcggccacaacctggccaacccccacccctttgctgtggtgcccagcacagccaccgtggtgattgtggtgtgtgtgtccttcctggtgttcatgatcatcctgggcgtcttccgcatccgggccgcccacaggaggaccatgagggaccaggacaccgggaaggaaaatgagatggactgggatgattctgccctgaccatcaccgtgaaccccatggagacctatgaggaccagcacagcagcgaggaggaggaggaggaggaggaggaggaggagagtgaagatggagaggaggaggatgacatcaccagcgctgagagcgagagcagcgaggaggaggagggggagcagggcgacccccagaatgccacccggcagcagcagctggagtgggatgacagcaccctgagctactag

SEQ ID NO: 7530 - DNA, 2946 bp, Artificial Sequence
  Description of Artificial Sequence: Synthetic coding sequence
atgctgcggcggcctgccccagccctggccccagctgcccggctgctgctggccggcctgctgtgtggcggcggcgtgtgggccgcccgggtgaacaagcacaagccctggctggagcccacctaccatggaattgtgacagaaaatgacaacacagtgctgctggaccccccactcatcgccctggacaaggatgcccccctgcgctttgctgagagctttgaggtgacagtgaccaaggagggggagatctgtggcttcaagatccacggccagaatgtgccctttgatgctgtggtggtggacaagagcactggagagggcgtcatccgcagcaaggagaagctggactgtgagctgcagaaggactacagcttcaccatccaggcctatgactgtgggaaaggaccagatggcaccaacgtgaagaagagccacaaggccaccgtgcacatccaggtgaatgatgtgaatgaatatgcccctgtgttcaaggagaagagctacaaggccaccgtcatcgagggcaagcagtatgacagcatcctgcgggtggaggccgtggatgctgactgcagcccccagttcagccagatctgcagctatgagatcatcaccccagatgtgcccttcaccgtggacaaggatggctacatcaagaacacagagaagctgaactacggcaaggagcaccagtacaagctgactgtgacagcctatgactgtgggaagaagagggccacagaagatgtgctggtgaagatcagcatcaagcccacctgcaccccaggctggcagggctggaacaaccgcatcgagtatgagcccggcaccggggccctggccgtgttccccaacatccacctggagacctgtgatgagcctgtggcctctgtgcaggccaccgtggagctggagaccagccacatcggcaagggctgtgaccgggacacctacagcgagaagagcctgcaccggctgtgtggggctgctgctggaacagctgagctgctgcccagccccagcggcagcctgaactggaccatgggcctgcccacagacaatggacatgacagcgaccaggtgtttgagttcaacggcacccaggccgtgcgcatcccagatggagtggtgtctgtgagccccaaggagcccttcaccatctctgtgtggatgagacatggcccctttggaaggaagaaggagaccatcctgtgcagcagtgacaagacagacatgaacagacaccactacagcctgtatgtgcacggctgccgcctcatcttcctgttccggcaggaccccagcgaggagaagaagtacagacctgctgagttccactggaagctgaaccaggtgtgtgatgaggagtggcaccactacgtgctgaatgtggagttccccagcgtgaccctgtatgtggatggcaccagccatgagcccttctctgtgacagaggactaccccctgcaccccagcaagattgagacccagctggtggtgggcgcctgctggcaggagttctctggagtggagaatgacaatgaaacagagcctgtgacagtggccagcgctggaggagacctgcacatgacccagttcttccggggcaacctggccggcctgaccctgcggagcggcaagctggccgacaagaaggtgattgactgcctgtacacctgcaaggagggcctggacctgcaggtgctggaggacagcggccggggcgtgcagatccaggcccaccccagccagctggtgctgaccctggagggggaggacctgggggagctggacaaggccatgcagcacatctcctacctgaacagccggcagttccccaccccaggcatccggcggctgaagatcaccagcaccatcaagtgcttcaatgaggccacctgcatctctgtgccccctgtggatggctacgtgatggtgctgcagcctgaggagcccaagatcagcctgagcggcgtgcaccactttgcccgggccgccagcgagtttgagagcagcgagggcgtcttcctgtttcctgagctgcgcatcatcagcaccatcacccgggaggtggagccagaaggagatggagctgaggaccccaccgtgcaggagagcctggtgtctgaggagatcgtgcatgacctggacacctgtgaggtgacagtggagggggaggagctgaaccacgagcaggagagcctggaggtggacatggcccggctgcagcagaagggcatcgaggtgagcagcagcgagctgggcatgaccttcaccggggtggacaccatggccagctatgaggaggtgctgcacctgctgcgctacagaaactggcacgcccggagcctgctggacaggaagttcaagctgatctgcagcgagctgaatggccgctacatcagcaatgagttcaaggtggaggtgaatgtcatccacacagccaaccccatggagcacgccaaccacatggccgcccagccccagtttgtgcaccctgagcacaggagctttgtggacctgagcggccacaacctggccaacccccacccctttgctgtggtgcccagcacagccaccgtggtgattgtggtgtgtgtgtccttcctggtgttcatgatcatcctgggcgtcttccgcatccgggccgcccacaggaggaccatgagggaccaggacaccgggaaggaaaatgagatggactgggatgacagcgccctgaccatcaccgtgaaccccatggagacctatgaggaccagcacagcagcgaggaggaggaggaggaggaggaggaggaggagagtgaagatggagaggaggaggatgacatcaccagcgctgagagcgagagcagcgaggaggaggagggggagcagggcgacccccagaatgccacccggcagcagcagctggagtgggatgacagcaccctgagctactag

SEQ ID NO: 7531 - DNA, 678 bp, Artificial Sequence
  Description of Artificial Sequence: Synthetic coding sequence
atgagcggctgcagcaagcgctgcaagctgggctttgtgaagtttgcccagaccatcttcaagctgatcaccggcaccctgagcaaggacaagattgaagatgagctggagatgaccatggtgtgccacaggcctgagggcctggagcagctggaggcccagaccaacttcaccaagcgggagctgcaggtgctgtaccggggcttcaagaatgaatgtccttctggagtggtgaatgaagacaccttcaagcagatctatgcccagttcttcccccatggagatgccagcacctacgcccactacctgttcaatgcctttgacaccacccagacaggctctgtgaagtttgaggactttgtgacagccctgagcatcctgctgcggggcaccgtgcatgagaagctgcgctggaccttcaacctgtatgacatcaacaaggatggctacatcaacaaggaggagatgatggacatcgtgaaggccatctatgacatgatgggcaagtacacctaccctgtgctgaaggaggacaccccccggcagcacgtggatgtgttcttccagaagatggacaagaacaaggatggcatcgtgaccctggatgagttcctggagagctgccaggaggatgacaacatcatgaggagcctgcagctgttccagaatgtgatgtag

SEQ ID NO: 7532 - DNA, 420 bp, Artificial Sequence
  Description of Artificial Sequence: Synthetic coding sequence
atgtacaagctggccagctgctgcctgctcttcatcggcttcctgaaccccctgctgagcctgcccctgctggacagccgggagatctccttccagctgagcgcccctcatgaagatgcccggctgaccccagaggagctggagcgggccagcctgctgcagatcctgcctgagatgctgggcgctgagcggggggacatcctgaggaaggctgacagcagcaccaacatcttcaacccccggggcaacctgaggaagttccaggacttcagcggccaggaccccaacatcctgctgagccacctgctggcccgcatctggaagccctacaagaagcagaggaggaagctgcggcaggacctgcggctgtggaagaaggagcccggcctgcgcatcttcaagaactacgtgtgggtgtag

SEQ ID NO: 7533 - DNA, 879 bp, Artificial Sequence
  Description of Artificial Sequence: Synthetic coding sequence
atggaggtgacagctgtggccacccagggcggctacggcagcagtgactgggtgaccagctacctgctgatgttcagtgatggcggcaggaactggaagcagtaccgccgggaggagagcatctggggcttccctggcaacaccaatgctgacagcgtggtgcactaccgcctgcagcccccatttgaggcccgcttcctgcgcttcctgcccctggcctggaacccccggggccgcatcggcatgagaattgaggtgtatggctgtgcctacaagtctgaggtggtgtactttgatggccagagcgccctgctgtaccgcctggacaagaagcccctgaagcccatcagagatgtgatcagcctgaagttcaaggccatgcagagcaatggcatcctgctgcaccgggagggccagcacggcaaccacatcaccctggagctgatcaagggcaagctggtgttcttcctgaacagcggaaatgccaagctgcccagcaccatcgcccctgtgaccctgaccctgggcagcctgctggatgaccagcactggcacagcgtgctgattgagctgctggacacccaggtgaacttcaccgtggacaagcacacccaccacttccaggccaagggggacagcagctacctggacctgaactttgagatcagctttggaggcatccccaccccaggccgcagccgggccttccggaggaagagcttccacggctgcctggagaacctgtactacaatggagtggatgtgacagagctggccaagaagcacaagccccagatcctgatgatggagctggcccacggcctgcaggaccagaacctgaagatcagcctgactgtgtgccaccagaccacccagtag

SEQ ID NO: 7534 - DNA, 783 bp, Artificial Sequence
  Description of Artificial Sequence: Synthetic coding sequence
atgaagaccagtgatggcttcaccctgaatgctgagagctatgtgtccttcaccaccaagctggacatccccacagctgccaagtatgaatatggagtgcccctgcagaccagtgacagcttcctgcgcttccccagcagcctgaccagcagcctgtgcacagacaacaacccagctgccttcctggtgaaccaggccgtgaagtgcaccaggaagatcaacctggagcagtgtgaggagattgaggccctgtccatggccttctacagcagccctgagatcctgcgggtgcctgacagcaggaagaaggtgcccatcaccgtgcagagcatcgtcatccagagcctgaacaagaccctgacccggcgggaggacacagatgtgctgcagcccaccctggtgaatgccggccacttcagcctgtgtgtgaatgtggtgctggaggtgaagtacagcctgacctacacagatgctggggaggtgaccaaggctgacctgagctttgtgctgggcaccgtgtcctctgtggtggtgcccctgcagcagaagtttgagatccacttcctgcagacagactggagcagccctgtgtctgcccggagcacagaaggagaggagcctgctgtgggccctggcctgccccggctgcggggccccttctggaagtttcctggccctggccatgctggcctgggcgcccaccccctgcaccaccctgtgatccagcaggagggcttcctgcctgccccccggggcttcggctacagaagtgaggtggactag

SEQ ID NO: 7535 - DNA, 3624 bp, Artificial Sequence
  Description of Artificial Sequence: Synthetic coding sequence
atggcctctgtggcctgggccgtgctgaaggtgctgctgctgctgcccacccagacctggagccctgtgggcgccggcaaccccccagactgtgatgcccccctggccagcgccctgcccaggagcagcttcagcagcagcagcgagctgagcagcagccacggccctggcttcagccggctgaacagaagagatggagctgggggctggacccccctggtgagcaacaagtaccagtggctgcagattgacctgggggagaggatggaggtgacagctgtggccacccagggcggctacggcagcagtgactgggtgaccagctacctgctgatgttcagtgatggcggcaggaactggaagcagtaccgccgggaggagagcatctggggcttccctggcaacaccaatgctgacagcgtggtgcactaccgcctgcagcccccatttgaggcccgcttcctgcgcttcctgcccctggcctggaacccccggggccgcatcggcatgagaattgaggtgtatggctgtgcctacaagtctgaggtggtgtactttgatggccagagcgccctgctgtaccgcctggacaagaagcccctgaagcccatcagagatgtgatcagcctgaagttcaaggccatgcagagcaatggcatcctgctgcaccgggagggccagcacggcaaccacatcaccctggagctgatcaagggcaagctggtgttcttcctgaacagcggaaatgccaagctgcccagcaccatcgcccctgtgaccctgaccctgggcagcctgctggatgaccagcactggcacagcgtgctgattgagctgctggacacccaggtgaacttcaccgtggacaagcacacccaccacttccaggccaagggggacagcagctacctggacctgaactttgagatcagctttggaggcatccccaccccaggccgcagccgggccttccggaggaagagcttccacggctgcctggagaacctgtactacaatggagtggatgtgacagagctggccaagaagcacaagccccagatcctgatgatgggaaatgtgtccttcagctgcccccagccccagacagtgcctgtgaccttcctgagcagccgcagctacctggccctgcccggcaacagcggggaggacaaggtgtctgtgaccttccagttccgcacctggaacagagctggccacctgctgtttggagagctgcggcggggcagcggcagctttgtgctcttcctgaaggatggcaagctgaagctgagcctcttccagcccggccagagccccagaaatgtgacagctggggccggcctgaatgatggccagtggcacagcgtgtccttcagcgccaagtggagccacatgaatgtggtggtggatgatgacacagctgtgcagcccctggtggccgtgctgattgattctggggacacctactactttggaggctgcctggacaacagcagcggcagcggctgcaagagccccctgggcggcttccagggctgcctgcggctcatcaccatcggggacaaggctgtggaccccatcctggtgcagcagggcgccctgggcagcttccgggacctgcagattgacagctgtggcatcacagaccgctgcctgcccagctactgtgagcacggcggagaatgttcccagagctgggacaccttcagctgtgactgcctgggcaccggctacacaggagagacctgccacagcagcctgtatgagcagagctgtgaggcccacaagcaccggggcaaccccagcggcctgtactacattgatgctgatggcagcggccccctgggccccttcctggtgtactgcaacatgacagatgctgcctggacagtggtgcagcacggcggcccagatgctgtgaccctgcggggggcccccagcggccaccccaggtctgctgtgtcctttgcctatgctgctggggccggccagctgcggtctgctgtgaacctggccgagcgctgtgagcagaggctggccctgcgctgtggcacagcccggcggccagacagcagagatggcacccccctgtcctggtgggtgggccgcaccaatgagacccacacctcctggggcggcagcctgcctgatgcccagaagtgcacctgtggcctggagggcaactgcatcgacagccagtactactgcaactgtgatgctggaagaaatgagtggaccagtgacaccatcgtgctgagccagaaggagcacctgcctgtgacccagatcgtgatgacagatgctggccggccccacagcgaggccgcctacaccctgggccccctgctgtgccgcggggaccagagcttctggaacagcgccagcttcaacacagagaccagctacctgcacttccctgccttccatggagagctgacagcagatgtgtgcttcttcttcaagaccaccgtgagcagcggggtcttcatggagaacctgggcatcacagacttcatcagaattgagctgcgggcccccacagaggtgaccttctcctttgatgtgggcaatggcccctgtgaggtgacagtgcagagccccacccccttcaatgacaaccagtggcaccacgtgcgggcagagagaaatgtgaagggggccagcctgcaggtggaccagctgccccagaagatgcagcctgccccagcagatggccacgtgcggctgcagctgaacagccagctgttcatcgagatcagcgcctactttgccaccggcagctccatgacctaccacttccaggagcactacaccctgtctgagaacagcagcagcctggtgagcagcctgcacagagatgtgaccctgacccgggagatgatcaccctgtccttccgcaccaccaggacccccagcctgctgctgtatgtgtcctccttctatgaggagtacctgagcgtcatcctggccaacaacggcagcctgcagatccgctacaagctggacagacaccagaacccagatgccttcacctttgacttcaagaacatggctgatggccagctgcaccaggtgaagatcaaccgggaggaggccgtggtgatggtggaggtgaaccagagcaccaagaagcaggtgatcctgagcagcggcacagagttcaatgctgtgaagagcctcatcctgggcaaggtgctggaggccgccggggctgaccctgacacccggcgggccgccaccagcggcttcaccggctgcctgtctgctgtgcgcttcggccgggccgcccccctgaaggccgccctgcggcccagcggccccagccgggtgacagtgcggggccacgtggcccccatggcccgctgtgccgccggggccgccagcggcagccctgcccgggagctggccccccggctggccggcggggccggccgcagcggccctgcagatgaaggagagcccctggtgaatgctgaccggcgggacagcgctgtgattggaggagtgattgctgtggtgatcttcatcctgctgtgcatcacagccatcgccatccgcatctaccagcagaggaagctgaggaaagaaaatgaaagcaaggtgtccaagaaggaggagtgctag

SEQ ID NO: 7536 - DNA, 2238 bp, Artificial Sequence
  Description of Artificial Sequence: Synthetic coding sequence
atggcctctgtggcctgggccgtgctgaaggtgctgctgctgctgcccacccagacctggagccctgtgggcgccggcaaccccccagactgtgatgcccccctggccagcgccctgcccaggagcagcttcagcagcagcagcgagctgagcagcagccacggccctggcttcagccggctgaacagaagagatggagctgggggctggacccccctggtgagcaacaagtaccagtggctgcagattgacctgggggagaggatggaggtgacagctgtggccacccagggcggctacggcagcagtgactgggtgaccagctacctgctgatgttcagtgatggcggcaggaactggaagcagtaccgccgggaggagagcatctggggcttccctggcaacaccaatgctgacagcgtggtgcactaccgcctgcagcccccatttgaggcccgcttcctgcgcttcctgcccctggcctggaacccccggggccgcatcggcatgagaattgaggtgtatggctgtgcctacaagtctgaggtggtgtactttgatggccagagcgccctgctgtaccgcctggacaagaagcccctgaagcccatcagagatgtgatcagcctgaagttcaaggccatgcagagcaatggcatcctgctgcaccgggagggccagcacggcaaccacatcaccctggagctgatcaagggcaagctggtgttcttcctgaacagcggaaatgccaagctgcccagcaccatcgcccctgtgaccctgaccctgggcagcctgctggatgaccagcactggcacagcgtgctgattgagctgctggacacccaggtgaacttcaccgtggacaagcacacccaccacttccaggccaagggggacagcagctacctggacctgaactttgagatcagctttggaggcatccccaccccaggccgcagccgggccttccggaggaagagcttccacggctgcctggagaacctgtactacaatggagtggatgtgacagagctggccaagaagcacaagccccagatcctgatgatgggaaatgtgtccttcagctgcccccagccccagacagtgcctgtgaccttcctgagcagccgcagctacctggccctgcccggcaacagcggggaggacaaggtgtctgtgaccttccagttccgcacctggaacagagctggccacctgctgtttggagagctgcggcggggcagcggcagctttgtgctcttcctgaaggatggcaagctgaagctgagcctcttccagcccggccagagccccagaaatgtgacagctggggccggcctgaatgatggccagtggcacagcgtgtccttcagcgccaagtggagccacatgaatgtggtggtggatgatgacacagctgtgcagcccctggtggccgtgctgattgattctggggacacctactactttggaggctgcctggacaacagcagcggcagcggctgcaagagccccctgggcggcttccagggctgcctgcggctcatcaccatcggggacaaggctgtggaccccatcctggtgcagcagggcgccctgggcagcttccgggacctgcagattgacagctgtggcatcacagaccgctgcctgcccagctactgtgagcacggcggagaatgttcccagagctgggacaccttcagctgtgactgcctgggcaccggctacacaggagagacctgccacagcagcctgtatgagcagagctgtgaggcccacaagcaccggggcaaccccagcggcctgtactacattgatgctgatggcagcggccccctgggccccttcctggtgtactgcaacatgacagatgctgcctggacagtggtgcagcacggcggcccagatgctgtgaccctgcggggggcccccagcggccaccccaggtctgctgtgtcctttgcctatgctgctggggccggccagctgcggtctgctgtgaacctggccgagcgctgtgagcagaggctggccctgcgctgtggcacagcccggcggccagacagcagagatggcacccccctgtcctggtgggtgggccgcaccaatgagacccacacctcctggggcggcagcctgcctgatgcccagaagtgcacctgtggcctggagggcaactgcatcgacagccagtactactgcaactgtgatgctggaagaaatgagtggtag

SEQ ID NO: 7537 - DNA, 549 bp, Artificial Sequence
  Description of Artificial Sequence: Synthetic coding sequence
atggagccccagctgggccctgaggccgccgccctgcggcccggctggctggccctgctgctgtgggtgtctgccctgagctgcagcttcagcctgcctgccagcagcctgagcagcctggtgccccaggtgaggaccagctacaactttggccgcaccttcctgggcctggacaagtgcaatgcctgcatcggcaccagcatctgcaagaagttcttcaaggaggagatccgcagtgacaactggctggccagccacctgggcctgcccccagacagcctgctgagctacccagccaactacagtgatgacagcaagatctggaggcctgtggagatcttccggctggtgtccaagtaccagaatgagatcagtgaccggcgcatctgtgccagcgccagcgcccccaagacctgcagcattgagcgggtgctgaggaagacagagcgcttccagaagtggctgcaggccaagaggctgaccccagacctggtgcaggactgccaccagggccagcgggagctgaagttcctgtgcatgctgaggtag

SEQ ID NO: 7538 - DNA, 282 bp, Artificial Sequence
  Description of Artificial Sequence: Synthetic coding sequence
atggacagcctgaggaagatgctgatctctgtggccatgctgggcgctggggccggcgtgggctacgccctgctggtgattgtgaccccaggagagaggaggaagcaggagatgctgaaggagatgcccctgcaggaccccaggagccgggaggaggccgcccggacccagcagctgctgctggccaccctgcaggaggccgccaccacccaggagaatgtggcctggaggaagaactggatggtgggcggggagggcggggccggcggccgcagcccctag

SEQ ID NO: 7539 - DNA, 387 bp, Artificial Sequence
  Description of Artificial Sequence: Synthetic coding sequence
atgggcaagagcgccagcaagcagttccacaatgaggtgctgaaggcccacaatgagtaccggcagaagcacggcgtgccccccctgaagctgtgcaagaacctgaaccgggaggcccagcagtacagcgaggccctggccagcacccgcatcctgaagcacagccctgagagcagccggggccagtgtggggagaacctggcctgggccagctatgaccagacaggccacttcaccgccatggtgtggaagaacaccaagaagatgggcgtgggcaaggccagcgccagtgatggcagcagctttgtggtggcccgctacttccctgctggaaatgtggtgaatgaaggcttctttgaagaaaatgtgctgccccccaagaagtag

SEQ ID NO: 7540 - DNA, 465 bp, Artificial Sequence
  Description of Artificial Sequence: Synthetic coding sequence
atgggcaagagcgccagcaagcagttccacaatgaggtgctgaaggcccacaatgagtaccggcagaagcacggcgtgccccccctgaagctgtgcaagaacctgaaccgggaggcccagcagtacagcgaggccctggccagcacccgcatcctgaagcacagccctgagagcagccggggccagtgtggggagaacctggcctgggccagctatgaccagacaggcaaggaggtggccgaccgctggtacagcgagatcaagaactacaacttccagcagcccggcttcaccagcggcaccggccacttcaccgccatggtgtggaagaacaccaagaagatgggcgtgggcaaggccagcgccagtgatggcagcagctttgtggtggcccgctacttccctgctggaaatgtggtgaatgaaggcttctttgaagaaaatgtgctgccccccaagaagtag

SEQ ID NO: 7541 - DNA, 831 bp, Artificial Sequence
  Description of Artificial Sequence: Synthetic coding sequence
atggacagcagccgggagcccaccctgggccgcctggatgctgctggcttctggcaggtgtggcagagatttgatgctgatgagaagggctacatcgaggagaaggagctggatgccttcttcctgcacatgctgatgaagctgggcacagatgacacagtgatgaaggccaacctgcacaaggtgaagcagcagttcatgaccacccaggatgccagcaaggatggccgcatccgcatgaaggagctggccggcatgttcctgtctgaagatgagaacttcctgctgctcttcagaagagagaaccccctggacagctctgtggagttcatgcagatctggaggaaatatgatgctgacagcagcggcttcatctctgctgctgagctgaggaacttcctgcgggacctcttcctgcaccacaagaaggccatcagcgaggccaagctggaggagtacacaggcaccatgatgaagatctttgacaggaacaaggatggccgcctggacctgaatgacctggcccgcatcctggccctgcaggagaacttcctgctgcagttcaagatggatgcctgcagcacagaggagaggaagagggactttgagaagatctttgcctactatgatgtgtccaagacaggagccctggagggccctgaggtggatggctttgtgaaggacatgatggagctggtgcagcccagcatcagcggcgtggacctggacaagttccgggagatcctgctgcggcactgtgatgtgaacaaggatggcaagatccagaagtctgagctggccctgtgcctgggcctgaagatcaacccctag

SEQ ID NO: 7542 - DNA, 216 bp, Artificial Sequence
  Description of Artificial Sequence: Synthetic coding sequence
atgcctgctggggtgcccatgagcacctacctgaagatgtttgctgccagcctgctggccatgtgtgccggggctgaggtggtgcaccgctactacagaccagacctgaccatccctgagatcccccccaagagaggagagctgaagacagagctgctgggcctgaaggagaggaagcacaagccccaggtgtcccagcaggaggagctgaagtag

SEQ ID NO: 7543 - DNA, 1287 bp, Artificial Sequence
  Description of Artificial Sequence: Synthetic coding sequence
atgaagcccatgctgaaggacttcagcaacctgctgctggtggtgctgtgtgactatgtgctgggggaggccgagtacctgctgctgcgggagcccggccacgtggccctgagcaatgacacagtgtatgtggacttccagtactttgatggagccaacggcaccctgagaaatgtgtctgtgctgctgctggaggccaacaccaaccagacagtgaccaccaagtacctgctgaccaaccagagccagggcaccctgaagtttgagtgcttctacttcaaggaggccggggactactggttcaccatgaccccagaggccacagacaacagcacccccttcccctggtgggagaagagcgccttcctgaaggtggagtggcctgtgttccacgtggacctgaacagaagtgccaaggctgctgagggcaccttccaggtgggcctcttcaccagccagcccctgtgccccttccctgtggacaagcccaacatcgtggtggatgtgatcttcaccaacagcctgcctgaggcccggaggaacagccggcagcccctggagatccgcaccagcaagaggacagagctggcccagggccagtgggtggagtttggctgtgcccccctgggccctgaggcctacgtgacagtggtgctgaagctgctgggccgggacagcgtcatcaccagcacaggccccatcgacctggcccagaagtttggctacaagctggtgatggtgcctgagctgacctgtgagagcggcgtggaggtgacagtgctgcccccaccctgcacctttgtgcagggcgtggtgacagtgttcaaggaggccccccgctacccaggcaagaggaccatccacctggccgagaacagcctgcccctgggggagaggaggaccatcttcaactgcaccctgtttgacatgggcaagaacaagtactgctttgattttggcatcagcagccgcagccacttcagcgccaaggaggagtgcatgctgatccagaggaacacagagacctggggcctgtggcagccctggagccagtgcagcgccacctgtggagatggagtgcgggagcggcggcgggtgtgcctgaccagcttccccagcagccctgtgtgccccggcatgagcctggaggccagcctgtgcagcctggaggagtgtgccggccgcttccgcagctgctgccccggctggagcgccatggtgcgcagccggctgaccaacagcgccagccgggtgcaggccatcctgctgccccagcccctggcctag

SEQ ID NO: 7544 - DNA, 312 bp, Artificial Sequence
  Description of Artificial Sequence: Synthetic coding sequence
atgaagctgtgtgtgacagtgctgagcctgctggtgctggtggccgccttctgcagcctggccctgagcgcccccatgggcagtgaccccccaacagcctgctgcttctcctacacagccaggaagctgcccaggaactttgtggtggactactatgagaccagcagcctgtgcagccagcctgctgtggtgtaccgggagagcgccagcagcgctgcccctggccgcatccccagcacccgggccgcccctcatggcccctggagcggccggggccgctgcctgccccaggcccgggacaaggccaggtag

SEQ ID NO: 7545 - DNA, 279 bp, Artificial Sequence
  Description of Artificial Sequence: Synthetic coding sequence
atgaagctgtgtgtgacagtgctgagcctgctggtgctggtggccgccttctgcagcctggccctgagcgcccccatgggcagtgaccccccaacagcctgctgcttctcctacacagccaggaagctgcccaggaactttgtggtggactactatgagaccagcagcctgtgcagccagcctgctgtgccctgggacagcaacctgggcaagcaggtgtgtgccgaccccagcgagagctgggtgcaggagtatgtgtatgacctggagctgaactag

SEQ ID NO: 7546 - DNA, 282 bp, Artificial Sequence
  Description of Artificial Sequence: Synthetic coding sequence
atgcaggtgtccacagctgccctggccgtgctgctgtgcaccatggccctgtgcaaccaggtgctgagcgcccccctggccgctgacacccccacagcctgctgcttctcctacaccagccggcagatcccccagaacttcatcgctgactactttgagaccagcagccagtgcagcaagcccagcgtcatcttcctgaccaagaggggccggcaggtgtgtgccgaccccagcgaggagtgggtgcagaagtatgtgtctgacctggagctgagcgcctag

SEQ ID NO: 7547 - DNA, 1869 bp, Artificial Sequence
  Description of Artificial Sequence: Synthetic coding sequence
atgggcaagtctgagggccctgtgggcatggtggagagcgctggccgggccggccagaagaggcctggcttcctggagggcggcctgctgctgctgctgctgctggtgacagctgccctggtggccctgggcgtgctgtatgctgaccggcggggcaagcagctgccccggctggccagccggctgtgcttcctgcaggaggagaggacctttgtgaagaggaagccccggggcatccctgaggcccaggaggtgtctgaggtgtgcaccaccccaggctgtgtgattgctgctgcccgcatcctgcagaacatggaccccaccacagagccctgtgatgacttctaccagtttgcctgtggcggctggctgcggagacatgtgattcctgagaccaacagccgctacagcatctttgatgtgctgagagatgagctggaggtgatcctgaaggtggagctggagacccagctggccaaggccaccgtgccccaggaggagagacatgatgtgattgccctgtaccacaggatgggcctggaggagctgcagagccagtttggcctgaagggcttcaactggaccctcttcatccagacagtgctgagctctgtgaagatcaagctgctgcctgatgaggaggtggtggtgtatggcatcccctacctgcagaacctggagaacatcatcgacacctacagcgcccggaccatccagaactacctggtgtggaggctggtgctggacagaattggcagcctgagccagcgcttcaaggacaccagggtgaactacaggaaggccctgtttggcaccatggtggaggaggtgcgctggagagaatgtgtgggctacgtgaacagcaacatggagaatgctgtgggcagcctgtatgtgcgggaggccttccctggggacagcaagtccatggtgcgggagctgattgacaaggtgaggacagtgtttgtggagaccctggatgagctgggctggatggatgaggagagcaagaagaaggcccaggagaaggccatgagcatccgggagcagatcggccacccagactacatcctggaggagatgaacagaaggctggatgaggagtacagcaacctgaacttcagcgaggacctgtactttgagaacagcctgcagaacctgaaggtgggcgcccagaggagcctgaggaagctgcgggagaaggtggaccccaacctgtggatcattggagctgctgtggtgaatgccttctacagccccaacagaaaccagatcgtgtttcctgctggcatcctgcagccccccttcttcagcaaggagcagccccaggccctgaactttggaggcatcggcatggtgattggccacgagatcacccacggctttgatgacaatggaagaaactttgacaagaatggaaacatgatggactggtggagcaacttcagcacccagcacttccgggagcagagcgagtgcatgatctaccagtatggcaactacagctgggacctggctgatgagcagaatgtgaatggcttcaacaccctgggagaaaatattgctgacaatggaggagtgcggcaggcctacaaggcctacctgaagtggatggccgagggcggcaaggaccagcagctgcccggcctggacctgacccatgagcagctgttcttcatcaactatgcccaggtgtggtgtggcagctacagacctgagtttgccatccagagcatcaagacagatgtgcacagccccctgaagtacagagtgctgggcagcctgcagaacctggccgcctttgctgacaccttccactgtgcccggggcacccccatgcaccccaaggagcgctgccgggtgtggtag

SEQ ID NO: 7548 - DNA, 2340 bp, Artificial Sequence
  Description of Artificial Sequence: Synthetic coding sequence
atgggcaagtctgagggccctgtgggcatggtggagagcgctggccgggccggccagaagaggcctggcttcctggagggcggcctgctgctgctgctgctgctggtgacagctgccctggtggccctgggcgtgctgtatgctgaccggcggggcaagcagctgccccggctggccagccggctgtgcttcctgcaggaggagaggacctttgtgaagaggaagccccggggcatccctgaggcccaggaggtgtctgaggtgtgcaccaccccaggctgtgtgattgctgctgcccgcatcctgcagaacatggaccccaccacagagccctgtgatgacttctaccagtttgcctgtggcggctggctgcggagacatgtgattcctgagaccaacagccgctacagcatctttgatgtgctgagagatgagctggaggtgatcctgaaggctgtgctggagaacagcacagccaaggacaggcctgctgtggagaaggcccggaccctgtaccgcagctgcatgaaccagagcgtgattgagaagaggggcagccagcccctgctggacatcctggaggtggtgggcggctggcctgtggccatggaccgctggaatgaaacagtgggcctggagtgggagctggagcggcagctggccctgatgaacagccagttcaacagaagagtgctgattgacctcttcatctggaatgatgaccagaacagcagccgccacatcatctacatcgaccagcccaccctgggcatgcccagccgggagtactacttcaacggcggcagcaacaggaaggtgcgggaggcctacctgcagttcatggtgtctgtggccaccctgctgcgggaggatgccaacctgccccgggacagctgcctggtgcaggaggacatggtgcaggtgctggagctggagacccagctggccaaggccaccgtgccccaggaggagagacatgatgtgattgccctgtaccacaggatgggcctggaggagctgcagagccagtttggcctgaagggcttcaactggaccctcttcatccagacagtgctgagctctgtgaagatcaagctgctgcctgatgaggaggtggtggtgtatggcatcccctacctgcagaacctggagaacatcatcgacacctacagcgcccggaccatccagaactacctggtgtggaggctggtgctggaccgcatcggcagcctgagccagcgcttcaaggacaccagggtgaactacaggaaggccctgtttggcaccatggtggaggaggtgcgctggagagaatgtgtgggctacgtgaacagcaacatggagaatgctgtgggcagcctgtatgtgcgggaggccttccctggggacagcaagtccatggtgcgggagctgattgacaaggtgaggacagtgtttgtggagaccctggatgagctgggctggatggatgaggagagcaagaagaaggcccaggagaaggccatgagcatccgggagcagatcggccacccagactacatcctggaggagatgaacagaaggctggatgaggagtacagcaacctgaacttctctgaagatctctactttgagaacagcctgcagaacctgaaggtgggcgcccagaggagcctgaggaagctgcgggagaaggtggaccccaacctgtggatcatcggggctgctgtggtgaatgccttctacagccccaacagaaaccagatcgtgtttcctgctggcatcctgcagccccccttcttcagcaaggagcagccccaggccctgaactttggaggcatcggcatggtgattggacatgagatcacccacggctttgatgacaatggaagaaactttgacaagaatggaaacatgatggactggtggagcaacttcagcacccagcacttccgggagcagagcgagtgcatgatctaccagtatggcaactacagctgggacctggctgatgagcagaatgtgaatggcttcaacaccctgggggagaacattgctgacaatggaggagtgcggcaggcctacaaggcctacctgaagtggatggccgagggcggcaaggaccagcagctgcccggcctggacctgacccatgagcagctgttcttcatcaactatgcccaggtgtggtgtggcagctacagacctgagtttgccatccagagcatcaagacagatgtgcacagccccctgaagtacagagtgctgggcagcctgcagaacctggccgcctttgctgacaccttccactgtgcccggggcacccccatgcaccccaaggagcgctgccgggtgtggtag

SEQ ID NO: 7549 - DNA, 258 bp, Artificial Sequence
  Description of Artificial Sequence: Synthetic coding sequence
atgtctgtgcacatgcctgccatgaagatctgtgagaagctgaagaagctggacagccagatctgtgagctgaagtatgagaagaccctggacctggcctctgtggacctgaggaagatgagggtggccgagctgaagcagatcctgcacagctggggcgaggagtgccgggcctgtgccgagaagacagattatgtgaacctgatccaggagctggcccccaagtatgctgccacccaccccaagacagagctgtag

SEQ ID NO: 7550 - DNA, 657 bp, Artificial Sequence
  Description of Artificial Sequence: Synthetic coding sequence
atgggccgggtcttcctgactggagagaaggccaacagcatcctgaagcgctacccccgggccaacggcttctttgaggagatccggcagggcaacatcgagcgggagtgcaaggaggagttctgcacctttgaggaggcccgggaggcctttgagaacaatgagaagaccaaggagttctggagcacctacaccaaggcccagcagggcgagagcaacagaggaagtgactggttccagttctacctgaccttccccctcatcttcggcctcttcatcatcctgctggtgatcttcctgatctggcgctgcttcctgaggaacaagacccggcggcagacagtgacagagggccacatccccttcccccagcacctgaacatcatcaccccacctcctcctccagatgaggtgtttgacagcagcggcctgagccctggcttcctgggctacgtggtgggccgcagtgacagcgtgtccacccggctgagcaactgtgaccccccacccacctatgaggaggccaccggccaggtgaacctgcagaggagtgaaacagagccccacctggaccccccaccagaatatgaagatattgtgaacagcaacagcgccagcgccatccccatggtgcctgtggtgaccaccatcaagtag

SEQ ID NO: 7551 - DNA, 1365 bp, Artificial Sequence; identical to SEQ ID NO: 7033
  Description of Artificial Sequence: Synthetic coding sequence

SEQ ID NO: 7552 - DNA, 417 bp, Artificial Sequence
  Description of Artificial Sequence: Synthetic coding sequence
atgacctggaggcaggccgtgctgctgagctgcttctctgctgtggtgctgctgtccatgctgcgggagggcacctctgtgtctgtgggcaccatgcagatggccggggaggaggcctctgaagatgccaagcagaagatcttcatgcaggagagtgatgccagcaacttcctgaagaggcggggcaagaggagccccaagagcagagatgaggtgaatgtggagaaccggcagaagctgcgggtggatgagctgcggcgggagtactatgaggagcagagaaatgaatttgagaactttgtggaggagcagaatgatgagcaggaggagaggagccgggaggccgtggagcagtggaggcagtggcactatgatggcctgcaccccagctacctgtacaacagacaccacacctag

SEQ ID NO: 7553 - DNA, 729 bp, Artificial Sequence
  Description of Artificial Sequence: Synthetic coding sequence
atggccctgaagaacaagttcagctgcctgtggatcctgggcctgtgcctggtggccaccaccagcagcaagatccccagcatcacagacccccacttcatcgacaactgcatcgaggcccacaatgagtggaggggcaaggtgaaccccccagctgctgacatgaagtacatgatctgggacaagggcctggccaagatggccaaggcctgggccaaccagtgcaagtttgagcacaatgactgcctggacaagagctacaagtgctatgctgcctttgaatatgtgggggagaacatctggctgggcggcatcaagagcttcacccccaggcatgccatcacagcctggtacaatgagacccagttctatgactttgacagcctgagctgcagccgggtgtgtggccactacacccagctggtgtgggccaacagcttctacgtgggctgtgctgtggccatgtgccccaacctgggcggggccagcacagccatctttgtgtgcaactacggccctgctggcaactttgccaacatgccaccctacgtgcggggggagagctgcagcctgtgcagcaaggaggagaagtgtgtgaagaacctgtgcaggaccccccagctgatcatccccaaccagaaccccttcctgaagcccaccggccgggccccccagcagacagccttcaaccccttcagcctgggcttcctgctgctgcgcatcttctag

SEQ ID NO: 7554 - DNA, 813 bp, Artificial Sequence
  Description of Artificial Sequence: Synthetic coding sequence
atgctgcggcagctgctgctggccgccctgtgcctggccggccccccagccccagcccgggcctgccagctgcccagcgagtggaggcccctgtctgagggctgcagagctgagctggccgagaccatcgtgtatgcccgggtgctggccctgcaccctgaggcccctggcctgtacaaccacctgccctggcagtaccacgccggccagggcggcctcttctacagcgctgaggtggagatgctgtgtgaccaggcctggggctccatgctggaggtgcctgctggcagccggctgaacctgaccggcctgggctacttcagctgccacagccacacagtggtgcaggactacagctacttcttcttcctgaggatggatgagaactacaacctgctgccccatggagtgaacttccaggatgccatcttcccagacacccaggagaacagaaggatgttcagcagcctcttccagttcagcaactgcagccagggccagcagctggccaccttcagcagtgactgggagatccaggaggacagccggctgatgtgcagctctgtgcagaaggccctgtttgaggaggaggaccacgtgaagaagctgcagcagaaggtggccaccctggagaagaggaaccggcagctgcgggagcgggtgaagaaggtgaagaggagcctgcggcaggccaggaagaagggccgccacctggagctggccaaccagaagctgtctgagaagctggccgccggggccctgccccacatcaatgcccggggccctgtgcggcccccctacctgcggggctag

SEQ ID NO: 7555 - DNA, 438 bp, Artificial Sequence
  Description of Artificial Sequence: Synthetic coding sequence
atggatgagaactacaacctgctgccccacggcgtgaacttccaggatgccatcttcccagacacccaggagaacagaaggatgttcagcagcctcttccagttcagcaactgcagccagggccagcagctggccaccttcagcagtgactgggagatccaggaggacagccggctgatgtgcagctctgtgcagaaggccctgtttgaggaggaggaccacgtgaagaagctgcagcagaaggtggccaccctggagaagaggaaccggcagctgcgggagcgggtgaagaaggtgaagaggagcctgcggcaggccaggaagaagggccgccacctggagctggccaaccagaagctgtctgagaagctggccgccggggccctgccccacatcaatgcccggggccctgtgcggcccccctacctgcggggctag

SEQ ID NO: 7556 - DNA, 1830 bp, Artificial Sequence
  Description of Artificial Sequence: Synthetic coding sequence
atggagctgggctgctggacccagctgggcctgaccttcctgcagctgctgctgatcagcagcctgccccgggagtacaccgtcatcaatgaggcctgccctggagctgagtggaacatcatgtgccgggagtgctgtgaatatgaccagattgaatgtgtgtgccctgggaagcgggaggtggtgggctacaccatcccctgctgcagaaatgaagaaaatgaatgtgacagctgcctgatccaccctggctgcaccatctttgagaactgcaagagctgcagaaatggctcctggggcggcaccctggatgacttctacgtgaagggcttctactgtgctgaatgtcgggccggctggtatggaggagactgcatgccctgcagcagcagcccctgcttccatgatggcacctgtgtgctggacaaggccggcagctacaagtgtgcctgcctggccggctacacaggccagagatgtgagaacctgctggaggagaggaactgcagcgaccccggcggccctgtgaatggctaccagaagatcactggaggccctggcctcatcaatggaagacatgccaagattggcaccgtggtgtccttcttctgcaacaacagctatgtgctgtctggaaatgagaagaggacctgccagcagaatggagagtggagcggcaagcagcccatctgcatcaaggcctgccgggagcccaagatcagtgacctggtgagaagaagagtgctgcccatgcaggtgcagagccgggagacccccctgcaccagctgtacagcgctgccttcagcaagcagaagctgcagagcgcccccaccaagaagccagccctgccctttggagacctgcccatgggctaccagcacctgcacacccagctgcagtatgagtgcatcagccccttctacagaaggctgggcagcagcaggaggacctgcctgaggacaggcaagtggagcggccgggcccccagctgcatccccatctgtgggaagattgagaacatcacagcccccaagacccagggcctgcgctggccctggcaggccgccatctacagaaggaccagcggcgtgcatgatggcagcctgcacaagggggcctggttcctggtgtgcagcggggccctggtgaatgaaagaacagtggtggtggccgcccactgtgtgacagacctgggcaaggtgaccatgatcaagacagctgacctgaaggtggtgctgggcaagttctacagagatgatgacagagatgagaagaccatccagagcctgcagatcagcgccatcatcctgcaccccaactatgaccccatcctgctggatgctgacatcgccatcctgaagctgctggacaaggcccgcatcagcaccagggtgcagcccatctgcctggccgccagccgggacctgagcaccagcttccaggagagccacatcaccgtggccggctggaatgtgctggctgatgtgcgcagccctggcttcaagaatgacaccctgcggtctggagtggtgtctgtggtggacagcctgctgtgtgaggagcagcacgaggaccacggcatccctgtgtctgtgacagacaacatgttctgtgcctcctgggagcccacagcccccagcgacatctgcacagctgagaccggcggcattgctgctgtgtccttccctggccgggccagccctgagccccgctggcacctgatgggcctggtgtcctggagctatgacaagacctgcagccaccggctgagcacagccttcaccaaggtgctgcccttcaaggactggattgaaagaaacatgaagtag

SEQ ID NO: 7557 - DNA, 2163 bp, Artificial Sequence
  Description of Artificial Sequence: Synthetic coding sequence
atggagctgggctgctggacccagctgggcctgaccttcctgcagctgctgctgatcagcagcctgccccgggagtacaccgtcatcaatgaggcctgccctggagctgagtggaacatcatgtgccgggagtgctgtgaatatgaccagattgaatgtgtgtgccctgggaagcgggaggtggtgggctacaccatcccctgctgcagaaatgaagaaaatgaatgtgacagctgcctgatccaccctggctgcaccatctttgagaactgcaagagctgcagaaatggctcctggggcggcaccctggatgacttctacgtgaagggcttctactgtgctgaatgtcgggccggctggtatggaggagactgcatgagatgtggccaggtgctgcgggcccccaagggccagatcctgctggagagctaccccctgaatgcccactgtgagtggaccatccacgccaagccaggcttcgtcatccagctgcgctttgtgatgctgagcctggagtttgactacatgtgccagtatgactatgtggaggtgagagatggagacaacagagatggccagatcatcaagagggtgtgtggaaatgaaagacctgcccccatccagagcatcggcagcagcctgcacgtgctcttccacagtgatggcagcaagaactttgatggcttccacgccatctatgaggagatcacagcctgcagcagcagcccctgcttccatgatggcacctgtgtgctggacaaggccggcagctacaagtgtgcctgcctggccggctacacaggccagagatgtgagaacctgctggaggagaggaactgcagcgaccccggcggccctgtgaatggctaccagaagatcaccggcggccctggcctcatcaatggaagacatgccaagattggaacagtggtgtccttcttctgcaacaacagctatgtgctgtctggaaatgagaagaggacctgccagcagaatggagagtggagcggcaagcagcccatctgcatcaaggcctgccgggagcccaagatcagtgacctggtgagaagaagagtgctgcccatgcaggtgcagagccgggagacccccctgcaccagctgtacagcgctgccttcagcaagcagaagctgcagagcgcccccaccaagaagccagccctgccctttggagacctgcccatgggctaccagcacctgcacacccagctgcagtatgagtgcatcagccccttctaccgccgcctgggcagcagcaggaggacctgcctgaggacaggcaagtggagcggccgggcccccagctgcatccccatctgtgggaagattgagaacatcacagcccccaagacccagggcctgcgctggccctggcaggccgccatctacagaaggaccagcggcgtgcatgatggcagcctgcacaagggggcctggttcctggtgtgcagcggggccctggtgaatgaaagaacagtggtggtggccgcccactgtgtgacagacctgggcaaggtgaccatgatcaagacagctgacctgaaggtggtgctgggcaagttctacagagatgatgacagagatgagaagaccatccagagcctgcagatcagcgccatcatcctgcaccccaactatgaccccatcctgctggatgctgacatcgccatcctgaagctgctggacaaggcccgcatcagcaccagggtgcagcccatctgcctggccgccagccgggacctgagcaccagcttccaggagagccacatcaccgtggccggctggaatgtgctggctgatgtgcgcagccctggcttcaagaatgacaccctgcggtctggagtggtgtctgtggtggacagcctgctgtgtgaggagcagcatgaagatcatggcatccctgtgtctgtgacagacaacatgttctgtgcctcctgggagcccacagcccccagcgacatctgcacagctgagactggaggcattgctgctgtgtccttccctggccgggccagccctgagccccgctggcacctgatgggcctggtgtcctggagctatgacaagacctgcagccaccggctgagcacagccttcaccaaggtgctgcccttcaaggactggattgaaagaaacatgaagtag

SEQ ID NO: 7558 - DNA, 1134 bp, Artificial Sequence
  Description of Artificial Sequence: Synthetic coding sequence
atggaggccctgctgctgggcgccggcctgctgctgggcgcctacgtgctggtgtactacaacctggtgaaggccccaccctgtggcggcatgggcaacctgcggggccgcacagctgtggtgactggagccaacagcggcatcggcaagatgacagccctggagctggcccggcggggggcccgggtggtgctggcctgccgcagccaggagcggggggaggccgccgcctttgacctgcggcaggagagcggcaacaatgaagtcatcttcatggccctggacctggccagcctggcctctgtgcgggcctttgccacagccttcctgagcagcgagccccggctggacatcctgatccacaatgccggcatcagcagctgtggccgcacccgggaggccttcaacctgctgctgcgggtgaaccacatcggccccttcctgctgacccacctgctgctgccctgcctgaaggcctgtgcccccagccgggtggtggtggtggccagcgctgcccactgccggggccgcctggacttcaagaggctggacaggcctgtggtgggctggaggcaggagctgcgggcctatgctgacaccaagctggccaacgtgctgtttgcccgggagctggccaaccagctggaggccaccggggtgacctgctacgccgcccaccctggccctgtgaacagcgagctgttcctgcggcacgtgcccggctggctgcggcccctgctgcggcccctggcctggctggtgctgcgggccccccggggcggggcccagacccccctgtactgtgccctgcaggagggcatcgagcccctgagcggccgctactttgccaactgccacgtggaggaggtgcccccagctgccagagatgacagagctgcccaccggctgtgggaggccagcaagaggctggccggcctgggccctggagaagatgctgagccagatgaggacccccagagcgaggacagcgaggcccccagcagcctgagcaccccccaccctgaggagcccaccgtgtcccagccctaccccagcccccagagcagcccagacctgagcaagatgacccaccgcatccaggccaaggtggagcctgagatccagctgtcctag

SEQ ID NO: 7559 - DNA, 381 bp, Artificial Sequence
  Description of Artificial Sequence: Synthetic coding sequence
atgatctccttccacgtgatcttcctgagcctgggccggggcaagctgttcctgcctgtgaacttctgcttcctgaagctgaagaacagccaggtgcgcatccccaaggacttcacctgcaacctgcacgtgctcttcagaacagtgcagggcgaggacaggaacaccatgttccggggccactggagcatctacagcaggaacttccccctggccgtggtgcctgcctacgtgacagaagatggcaagaacaccagccaccgggccagcggccagttctgcaatgccctgagccagggcgagatccccagcagcctgcagctggtgaacagctatgccctggagcccaggacagacatgccctgcaacttcctgacctag

SEQ ID NO: 7560 - DNA, 876 bp, Artificial Sequence
  Description of Artificial Sequence: Synthetic coding sequence
atggctgtgaccctgagcctgctgctgggcggccgggtgtgtgccgctgtgacccgctgtggctttgccacccggggcgtggccggccctggccccatcggccgggagccagaccctgacagcgactgggagcctgaggagcgggagctgcaggaggtggagagcaccctgaagaggcagaagcaggccatccgcttccagaagatccggcggcagatggaggcccctggggccccacccaggaccctgacctgggaggccatggagcagatccgctacctgcacgaggagttccctgagagctggagcgtgccccggctggccgagggctttgatgtgtccacagatgtgatcagaagagtgctgaagagcaagttcctgcccaccctggagcagaagctgaagcaggaccagaaggtgctgaagaaggccggcctggcccacagcctgcagcacctgcggggcagcggcaacaccagcaagctgctgcctgctggccacagcgtgtctggcagcctgctgatgcctggccacgaggccagcagcaaggaccccaaccacagcacagccctgaaggtgattgaaagtgacacccacaggaccaacaccccaagaagaaggaagggcaggaacaaggagatccaggacctggaggagagctttgtgcctgtggccgcccccctgggccacccccgggagctgcagaagtacagcagtgacagcgagagcccccggggcactggaagtggggccctgcccagcggccagaagctggaggagctgaaggccgaggagccagacaacttcagcagcaaggtggtgcagaggggccgggagttctttgacagcaatggaaacttcctgtaccgcatctag

SEQ ID NO: 7561 - DNA, 2541 bp, Artificial Sequence
  Description of Artificial Sequence: Synthetic coding sequence
atgttcaagtgctggagcgtggtgctggtgctgggcttcatcttcctggagagcgagggccggcccaccaaggagggcggctacggcctgaagagctaccagcccctgatgaggctgcggcacaaggagaagaaccaggagagcagccgggtgaagggcttcatgatccaggacggccccttcggcagctgtgagaacaagtactgcggcctgggccgccactgtgtgaccagccgggagaccggccaggctgaatgtgcctgcatggacctgtgcaagaggcactacaagcctgtgtgtggcagtgatggagagttctatgagaaccactgtgaggtgcaccgggccgcctgcctgaagaagcagaagatcaccatcgtgcacaatgaagactgcttcttcaagggggacaagtgcaagaccacagagtacagcaagatgaagaacatgctgctggacctgcagaaccagaagtacatcatgcaggagaatgaaaaccccaatggagatgacatcagcaggaagaagctgctggtggaccagatgttcaagtactttgatgctgacagcaatggcctggtggacatcaatgagctgacccaggtgatcaagcaggaggagctgggcaaggacctgtttgactgcaccctgtatgtgctgctgaagtatgatgacttcaatgctgacaagcacctggccctggaggagttctaccgggccttccaggtgatccagctgagcctgcctgaggaccagaagctgagcatcacagctgccaccgtgggccagagcgctgtgctgagctgtgccatccagggcaccctgcggccccccatcatctggaagaggaacaacatcatcctgaacaacctggacctggaggacatcaatgactttggagatgatggcagcctgtacatcaccaaggtgaccaccacccacgtgggcaactacacctgctacgcagatggctatgagcaggtgtaccagacccacatcttccaggtgaatgtgccccctgtgatccgggtgtacccagagagccaggcccgggagcccggggtgacagccagcctgcgctgccacgccgagggcatccccaagccccagctgggctggctgaagaatggcatcgacatcacccccaagctgagcaagcagctgaccctgcaggccaatggaagtgaggtgcacatcagcaatgtgcgctatgaagatactggagcctacacctgcatcgccaagaatgaggccggcgtggatgaggacatcagcagcctgtttgtggaggacagcgccaggaagaccctggccaacatcctgtggagggaggagggcctgggcatcggcaacatgttctacgtgttctatgaagatggcatcaaggtgatccagcccattgaatgtgagttccagaggcacatcaagcccagcgagaagctgctgggcttccaggatgaggtgtgccccaaggccgagggagatgaggtgcagagatgtgtgtgggccagcgctgtgaatgtgaaggacaagttcatctacgtggcccagcccaccctggacagagtgctgattgtggatgtgcagagccagaaggtggtgcaggccgtgtccacagatcctgtgcctgtgaagctgcactatgacaagagccatgaccaggtgtgggtgctgtcctggggcaccctggagaagaccagccccaccctgcaggtgatcaccctggccagcggaaatgtgccccaccacaccatccacacccagcctgtgggcaagcagtttgacagagtggatgacttcttcatccccaccaccaccctcatcatcacccacatgagatttggcttcatcctgcacaaggatgaagctgccctgcagaagattgacctggagaccatgagctacatcaagaccatcaacctgaaggactacaagtgtgtgccccagagcctggcctacacccacctgggcggctactacttcatcggctgcaagccagacagcactggagctgtgagcccccaggtgatggtggatggagtgacagacagcgtcatcggcttcaacagtgatgtgacaggcaccccctacgtgtccccagatggccactacctggtgtccatcaatgatgtgaagggcctggtgcgggtgcagtacatcaccatccggggggagatccaggaggcctttgacatctacaccaacctgcacatcagtgacctggccttccagcccagcttcacagaggcccaccagtacaacatctacggcagcagcagcacccagacagatgtgctgtttgtggagctgagcagcggcaaggtgaagatgatcaagagcctgaaggagcccctgaaggccgaggagtggccctggaacaggaagaaccggcagatccaggacagcggcctgtttggccagtacctgatgacccccagcaaggacagcctcttcatcctggatggccgcctgaacaagctgaactgtgagatcacagaggtggagaagggcaacacagtcatctgggtgggagatgcctag

SEQ ID NO: 7562 - DNA, 291 bp, Artificial Sequence
  Description of Artificial Sequence: Synthetic coding sequence
atgagggtgaccagcgccacctgtgccctgctgctggccctgatctgcagcgtgcagctgggagatgcctgcctggacatcgacaagctgctggccaacgtggtgtttgatgtgtcccaggacctgctgaaggaggagctggcccgctacaaccccagccccctgacagaggagagcttcctgaatgtgcagcagtgctttgccaacgtgtctgtgacagaaagatttgcccacagcgtggtgatcaagaagatcctgcagagcaatgactgcatcgaggccgccttctag

SEQ ID NO: 7563 - DNA, 1971 bp, Artificial Sequence
  Description of Artificial Sequence: Synthetic coding sequence
atgaggacagtggtgctgaccatgaaggcctctgtgattgagatgttcctggtgctgctggtgactggagtgcacagcaacaaggagacagccaagaagatcaagaggcccaagttcaccgtgccccagatcaactgtgatgtgaaggccggcaagatcatcgaccctgagttcatcgtgaagtgcccagctggctgccaggaccccaagtaccacgtgtatggaacagatgtgtatgccagctacagctctgtgtgtggggctgctgtgcacagcggcgtgctggacaacagcggcggcaagatcctggtgaggaaggtggccggccagagcggctacaagggcagctacagcaatggagtgcagagcctgagcctgccccgctggagggagagcttcatcgtgctggagagcaagcccaagaagggcgtgacctaccccagcgccctgacctacagcagcagcaagagccctgctgcccaggccggggagaccaccaaggcctaccagaggcctcccatccctggcaccacagcccagcctgtgaccctgatgcagctgctggccgtgacagtggccgtggccacccccaccaccctgccccggcccagccccagcgctgccagcaccaccagcatcccccggccccagagcgtgggccacaggagccaggagatggacctgtggagcacagccacctacaccagcagccagaaccggcccagggctgaccccggcctggtgcccaaggaggagctgagcacccagagcctggagcctgtgtccctgggggaccccaactgcaagattgacctgtccttcctgattgatggcagcaccagcatcggcaagaggcgcttccgcatccagaagcagctgctggctgatgtggcccaggccctggacatcggccctgctggccccctgatgggcgtggtgcagtatggagacaacccagccacccacttcaacctgaagacccacaccaacagccgggacctgaagacagccatcgagaagatcacccagagaggaggcctgagcaatgtgggccgggccatcagctttgtgaccaagaacttcttcagcaaggccaacggcaacagaagtggggcccccaacgtggtggtggtgatggtggatggctggcccacagacaaggtggaggaggccagccggctggcccgggagagcggcatcaacatcttcttcatcaccattgaaggagctgctgaaaatgagaagcagtatgtggtggagcccaactttgccaacaaggctgtgtgcaggaccaacggcttctacagcctgcacgtgcagagctggtttggcctgcacaagaccctgcagcccctggtgaagagggtgtgtgacacagaccggctggcctgcagcaagacctgcctgaacagcgctgacatcggctttgtgattgatggcagcagctctgtgggcaccggcaacttcagaacagtgctgcagtttgtgaccaacctgaccaaggagtttgagatcagtgacacagacacccgcatcggggctgtgcagtacacctatgagcagaggctggagtttggatttgacaagtacagcagcaagccagacatcctgaatgccatcaagagggtgggctactggagcggcggcaccagcactggagctgccatcaactttgccctggagcagctgttcaagaagagcaagcccaacaagaggaagctgatgatcctgatcacagatggccgctcctatgatgatgtgcgcatcccagccatggccgcccacctgaagggcgtcatcacctacgccatcggcgtggcctgggccgcccaggaggagctggaggtgattgccacccacccagcccgggaccacagcttctttgtggatgaatttgacaacctgcaccagtatgtgccccgcatcatccagaacatctgcacagagttcaacagccagcccagaaattag

SEQ ID NO: 7564 - DNA, 2082 bp, Artificial Sequence
  Description of Artificial Sequence: Synthetic coding sequence
atgaggacagtggtgctgaccatgaaggcctctgtgattgagatgttcctggtgctgctggtgactggagtgcacagcaacaaggagacagccaagaagatcaagaggcccaagttcaccgtgccccagatcaactgtgatgtgaaggccggcaagatcatcgaccctgagttcatcgtgaagtgcccagctggctgccaggaccccaagtaccacgtgtatggaacagatgtgtatgccagctacagctctgtgtgtggggctgctgtgcacagcggcgtgctggacaacagcggcggcaagatcctggtgaggaaggtggccggccagagcggctacaagggcagctacagcaatggagtgcagagcctgagcctgccccgctggagggagagcttcatcgtgctggagagcaagcccaagaagggcgtgacctaccccagcgccctgacctacagcagcagcaagagccctgctgcccaggccggggagaccaccaaggcctaccagaggcctcccatccctggcaccacagcccagcctgtgaccctgatgcagctgctggccgtgacagtggccgtggccacccccaccaccctgccccggcccagccccagcgctgccagcaccaccagcatcccccggccccagagcgtgggccacaggagccaggagatggacctgtggagcacagccacctacaccagcagccagaaccggcccagggctgaccccggcatccagaggcaggaccccagcggggccgccttccagaagcctgtgggcgcagatgtgtccctgggggagatggacagctggaagccaggctctgtgctgctggatgagggcctggtgcccaaggaggagctgagcacccagagcctggagcctgtgtccctgggggaccccaactgcaagattgacctgtccttcctgattgatggcagcaccagcatcggcaagaggcgcttccgcatccagaagcagctgctggctgatgtggcccaggccctggacatcggccctgctggccccctgatgggcgtggtgcagtacggggacaacccagccacccacttcaacctgaagacccacaccaacagccgggacctgaagacagccatcgagaagatcacccagaggggcggcctgagcaatgtgggccgggccatcagctttgtgaccaagaacttcttcagcaaggccaatggaaacagaagtggggccccaaatgtggtggtggtgatggtggatggctggcccacagacaaggtggaggaggccagccggctggcccgggagagcggcatcaacatcttcttcatcaccatcgagggcgctgctgaaaatgagaagcagtatgtggtggagcccaactttgccaacaaggctgtgtgcaggaccaacggcttctacagcctgcacgtgcagagctggtttggcctgcacaagaccctgcagcccctggtgaagagggtgtgtgacacagaccggctggcctgcagcaagacctgcctgaacagcgctgacattggatttgtgattgatggcagcagctctgtgggcactggaaacttcagaacagtgctgcagtttgtgaccaacctgaccaaggagtttgagatcagtgacacagacaccagaattggagctgtgcagtacacctatgagcagaggctggagtttggatttgacaagtacagcagcaagccagacatcctgaatgccatcaagagggtgggctactggagcggcggcaccagcactggagctgccatcaactttgccctggagcagctgttcaagaagagcaagcccaacaagaggaagctgatgatcctgatcacagatggccgctcctatgatgatgtgcgcatcccagccatggccgcccacctgaagggcgtcatcacctacgccatcggcgtggcctgggccgcccaggaggagctggaggtgattgccacccacccagcccgggaccacagcttctttgtggatgaatttgacaacctgcaccagtatgtgccccgcatcatccagaacatctgcacagagttcaacagccagcccaggaactag

SEQ ID NO: 7565 - DNA, 555 bp, Artificial Sequence
  Description of Artificial Sequence: Synthetic coding sequence
atgttctgcctgctgcacctgtgcttctacctggccaactttgccagcagcatcaagaggacccatgctgtgaatggctgctgcggcctgcagatgattgccctgtgggcccagagcagtggaaatgctgatgcccgggtggaggagatcctggccggggaggagcggcggctggccgccctgctgggcagccagggcatgaggttctgggtgtgcctggccgcctgccgggccatgtggggcctggccgcccggcggggccgggcagaggacagcagcagcagccctgtggatgccagcaagttcccctggaggggcggccagcacaggaccaccatgatgccctgcctgctgcgggtgggcgtcttccggccctgccacgtgcggcccactggagaccccagctgtgatgtgcagcccccccggctgggcttcagccgggtgcctgacacccaggtggccttctacggcagcggccactgggaccccacccccttctctgtgcacagctgcttcttcaacttccaggtgaggaagatcatcttcctgctgtag

SEQ ID NO: 7566 - DNA, 864 bp, Artificial Sequence
  Description of Artificial Sequence: Synthetic coding sequence
atgaccagcgctgcccactactaccccaagctgatgagcatcatgggaaatgtgctgcgcttcctgcctgcctttgtgaggatgaagcagctgattgaggagggctacgtgggggagcccctggtgtgtgaggtgcaggtgcacggcggcagcctgctgggcaagaagtacaactggagctgtgatgacctgatgggcggcggcggcctgcacagcgtgggcacctacatcatcgacctgctgaccttcctgaccggccagaaggctgtgaaggtgcacggcctgctgaagacctttgtgaagcagacagaccacatcaagggcatccggcagatcaccagtgatgacttctgcaccttccagatggtgctggagggcggcgtgtgctgcaccgtgaccctgaacttcaacgtgcctggagagttcaagcaggatgtgacagtggtgggcagcgctggccgcctgctggccgtgggcacagacctgtatggccagaggaacagcgcccctgagcaggagctgctggtgcaggatgccacccctgtgagcaacagcctgctgcctgagaaggccttcagtgacatccccagcccctacctgcggggcaccatcaagatgatgcaggccgtgcggcaggccttccaggaccaggatgacaggaggacctgggatggccggcccctgaccatggccgccacctttgatgactgcctgtatgccctgtgtgtggtggacaccatcaagaggagcagccagacaggagagtggcagaacatcgccatcatgacagaggagcctgagctgagccctgcctacctgatcagcgaggccatgagaagaagcaggatgagcctgtactgctag

SEQ ID NO: 7567 - DNA, 1173 bp, Artificial Sequence
  Description of Artificial Sequence: Synthetic coding sequence
atgctgcccggggtgggcgtgtttggcaccagcctgacagcccgggtcatcatccccctgctgaaggatgagggctttgctgtgaaggccctgtggggccgcacccaggaggaggccgaggagctggccaaggagatgtctgtgcccttctacaccagcagaattgatgaggtgctgctgcaccaggatgtggacctggtgtgcatcaacctgcccccacccctgacccggcagattgctgtgaagaccctgggcatcggcaagaatgtcatctgtgacagaacagccacccccctggatgccttcaggatgaccagcgctgcccactactaccccaagctgatgagcatcatgggaaatgtgctgcgcttcctgcctgcctttgtgaggatgaagcagctgattgaggagggctacgtgggggagcccctggtgtgtgaggtgcaggtgcatggaggcagcctgctgggcaagaagtacaactggagctgtgatgacctgatgggcggcggcggcctgcacagcgtgggcacctacatcatcgacctgctgaccttcctgaccggccagaaggctgtgaaggtgcacggcctgctgaagacctttgtgaagcagacagaccacatcaagggcatccggcagatcaccagtgatgacttctgcaccttccagatggtgctggagggcggcgtgtgctgcaccgtgaccctgaacttcaacgtgcctggagagttcaagcaggatgtgacagtggtgggcagcgctggccgcctgctggccgtgggcacagacctgtatggccagagaaattctgcccctgagcaggagctgctggtgcaggatgccacccctgtgagcaacagcctgctgcctgagaaggccttcagtgacatccccagcccctacctgcggggcaccatcaagatgatgcaggccgtgcggcaggccttccaggaccaggatgacaggaggacctgggatggccggcccctgaccatggccgccacctttgatgactgcctgtatgccctgtgtgtggtggacaccatcaagaggagcagccagacaggagagtggcagaacatcgccatcatgacagaggagcctgagctgagccctgcctacctgatcagcgaggccatgaggaggagcaggatgagcctgtactgctag

SEQ ID NO: 7568 - DNA, 5718 bp, Artificial Sequence
  Description of Artificial Sequence: Synthetic coding sequence
atgcagagccggctgctgctgctgggcgcccctgggggccacggcggccctgccagcaggaggatgaggctgctgctgcggcaggtggtgcagaggaggcctggaggagaccggcagaggcctgaggtgcggctgctgcacgccggcagcggggctgacaccggggacacagtgaacattggagatgtgtcctacaagctgaagatccccaagaaccctgagctggtgccccagaactacatcagtgacagcctggcccagagcgtggtgcagcacctgcgctggatcatgcagaaggacctgctgggccaggatgtgttcctgattggccccccaggccccctgcggcgcagcatcgccatgcagtacctggagctgaccaagcgggaggtggagtacatcgccctgagccgggacaccacagaaacagacctgaagcagaggcgggagatccgggccggcacagccttctacatcgaccagtgtgctgtgcgggccgccacagagggccgcaccctcatcctggagggcctggagaaggccgagagaaatgtgctgcctgtgctgaacaacctgctggagaaccgggagatgcagctggaggatggccgcttcctgatgtctgctgagagatatgacaagctgctgcgggaccacaccaagaaggagctggacagctggaagatcgtgcgggtgtctgagaacttccgggtgattgccctgggcctgcctgtgccccgctacagcggcaaccccctggacccccccctgcggagccgcttccaggcccgggacatctactacctgcccttcaaggaccagctgaagctgctgtacagcattggagccaacgtgtctgctgagaaggtgtcccagctgctgagctttgccaccaccctgtgcagccaggagagcagcaccctgggcctgcctgacttccccctggacagcctggccgctgctgtgcagatcctggacagcttccccatgatgcccatcaagcacgccatccagtggctgtacccctacagcatcctgctgggccacgagggcaagatggctgtggagggcgtgctgaagagatttgagctgcaggacagcggcagcagcctgctgcccaaggagatcgtgaaggtggagaagatgatggagaaccacgtgtcccaggcctctgtgaccatcagaattgctgacaaggaggtgaccatcaaggtgcctgctggcacccggctgctgagccagccctgtgccagtgaccgcttcatccagaccctgagccacaagcagctgcaggccgagatgatgcagagccacatggtgaaggacatctgcctgattggaggcaagggctgcggcaagacagtcatcgccaagaactttgctgacaccctgggctacaacatcgagcccatcatgctgtaccaggacatgacagcccgggacctgctgcagcagcgctacaccctgcccaatggagacacagcctggaggagcagccccctggtgaatgctgccctggagggcaagctggtgctgctggatggcatccaccgggtgaatgccggcaccctggccgtgctgcagaggctcatccatgaccgggagctgagcctgtatgatggcagccggctgctgagagaagatcgctacatgaggctgaaggaggagctgcagctgagtgatgagcagctgcagaagaggagcatcttccccatccaccccagcttccgcatcatcgccctggccgagccccctgtgattggcagcacagcccaccagtggctgggccctgagttcctgaccatgttcttcttccactacatgaagcccctggtgaagtctgaggagatccaggtgatcaaggagaaggtgcccaacgtgccccaggaggccctggacaagctgctgtccttcacccacaagctgcgggagacccaggaccccacagcccagagcctggccgccagcctgagcacccggcagctgctgcgcatcagccggcggctgagccagtacccaaatgaaaacctgcacagcgctgtgaccaaggcctgcctgagccgcttcctgcccagcctggcccggagcgccctggagaagaacctggctgatgccaccatcgagatcaacacagatgacaacctggagcctgagctgaaggactacaagtgtgaggtgaccagcggcaccctgagaattggagctgtgtctgcccccatctacaatgcccacgagaagatgaaggtgcctgatgtgctcttctatgacaacatccagcacgtgattgtgatggaggacatgctgaaggacttcctgctgggggagcacctgctgctggtgggcaaccagggcgtgggcaagaacaagatcgtggaccgcttcctgcacctgctgaaccggccccgggagtacatccagctgcaccgggacaccaccgtgcagaccctgaccctgcagcccagcgtgaaggatggcctgattgtgtatgaggacagccccctggtgaaggctgtgaagctgggccacatcctggtggtggatgaagctgacaaggcccccaccaacgtgacctgcatcctgaagaccctggtggagaatggagagatgatcctggctgatggaagaagaattgtggccaacagcgccaacgtgaatggccgggagaatgtggtggtgatccacccagacttcaggatgattgtgctggccaaccggcccggcttccccttcctgggcaatgacttcttcggcaccctgggggacatcttcagctgccacgctgtggacaaccccaagccccacagcgagctggagatgctgcggcagtatggccccaacgtgcctgagcccatcctgcagaagctggtggccgcctttggagagctgcggagcctggccgaccagggcatcatcaactacccctacagcacccgggaggtggtgaacatcgtgaagcacctgcagaagttccccacagagggcctgagctctgtggtgagaaatgtgtttgattttgacagctacaacaatgacatgagggagatcctgatcaacaccctgcacaagtatggcatccccatcggggccaagcccacctctgtgcagctggccaaggagctgaccctgcctgagcagaccttcatgggctactggaccatcggccaggcccggagcggcatgcagaagctgctgtgccctgtggagacccaccacatcgacatcaagggccctgccctgatcaacatccaggagtaccccatcgagagacatgaggagaggagcctgaacttcacagaggagtgtgcctcctggaggatccccctggatgagatcaacatcatctgtgacatcgccaccagccatgaaaatgagcagaacaccctgtatgtggtgacctgcaacccagccagcctgtacttcatgaacatgaccgggaagagcggcttctttgtggacttctttgacatcttccccaggacagccaacggggtgtggcacccctttgtgacagtggcccccctgggcagccccctgaagggccaggtggtgctgcacgagcagcagagcaatgtcatcctgctgctggacaccaccggccgggccctgcacaggctcatcctgcccagcgagaagttcaccagcaagaagcccttctggtggaacaaggaggaggccgagacctacaagatgtgcaaggagttcagccacaagaactggctggtgttctacaaggagaagggcaacagcctgactgtgctggatgtgctggagggccgcacccacaccatcagcctgcccatcaacctgaagacagtgttcctggtggccgaggacaagtggctgctggtggagagcaagaccaaccagaagtacctgctgaccaagccagcccacattgaaagtgagggcagcggcgtgtgccagctgtatgtgctgaaggaggagccccccagcactggatttggagtgacccaggagacagagttcagcatcccccacaagatcagcagtgaccagctgagcagcgagcacctgagcagcgctgtggagcagaagatcgccagccccaaccgcatcctgagtgatgagaagaactatgccaccatcgtggtgggcttcccagacctgatgagccccagcgaggtgtacagctggaagaggcccagcagcctgcacaagaggtctggaacagacaccagcttctaccggggcaagaagaagaggggcacccccaagcagagcaactgtgtgaccctgctggacaccaaccaggtggtgcgcatcctgcccccaggagaggtgcccctgaaggacatctaccccaaggatgtgaccccaccccagaccagcggctacatcgaggtgacagacctgcagagcaagaagctgcgctacatccccatccccaggtctgagagcctgagcccctacaccacctggctgagcaccatcagtgacacagatgccctgctggccgagtgggacaagtctggagtggtgacagtggacatgggcggccacatccggctgtgggagaccggcctggagcggctgcagaggagcctgatggagtggaggaacatgattggccaggatgacaggaacatgcagatcaccatcaacagagacagcggggaggatgtgagcagccccaagcacggcaaggaggaccctgacaacatgcctcatgtgggcggcaacacctgggccggcggcactggaggccgggacacagctggcctgggcggcaagggcggcccctaccgcctggatgctggccacacagtgtaccaggtgtcccaggccgagaaggatgctgtgcctgaggaggtgaagagagctgcccgggagatgggccagagggccttccagcagaggctgaaggagatccagatgtctgaatatgatgctgccacctatgagcgcttcagcggggctgtgcggcggcaggtgcacagcctgcgcatcatcctggacaacctgcaggccaagggcaaggagcggcagtggctgcggcaccaggccaccggggagctggatgatgccaagatcattgatggcctgactggagagaaggccatctacaagagaagaggagagctggagccccagctgggcagcccccagcagaagcccaagaggctgcggctggtggtggatgtgtctggctccatgtaccgcttcaacaggatggatggccgcctggagaggaccatggaggccgtgtgcatggtgatggaggcctttgagaactatgaggagaagttccagtatgacatcgtgggccacagcggagatggctacaacatcggcctggtgcccatgaacaagatccccaaggacaacaagcagaggctggagatcctgaagaccatgcacgcccacagccagttctgcatgtctggggaccacaccctggagggcacagaacatgccatcaaggagatcgtgaaggaggaggctgatgagtactttgtgattgtgctgagtgatgccaacctgagccgctatggcatccacccagccaagtttgcccagatcctgacccgggacccccaggtgaatgcctttgccatcttcatcggcagcctgggggaccaggccacccggctgcagaggaccctgcctgctggccgcagctttgtggccatggacaccaaggacatcccccagatcctgcagcagatcttcaccagcaccatgctgagctctgtgtag

SEQ ID NO: 7569 - DNA, 561 bp, Artificial Sequence
  Description of Artificial Sequence: Synthetic coding sequence
atggaggccctgcccctgctggccgccaccaccccagaccacggccgccaccggcggctgctgctgctgcccctgctgctcttcctgctgcctgctggagctgtgcagggctgggagacagaggagcggcccaggacccgggaggaggagtgccacttctacgccggcggccaggtgtacccaggagaggccagccgggtgtctgtggccgaccacagcctgcacctgagcaaggccaagatcagcaagccagccccctactgggagggcacagctgtgattgatggagagttcaaggagctgaagctgacagactaccggggcaagtacctggtgttcttcttctaccccctggacttcacctttgtgtgccccacagagatcatcgcctttggagaccggctggaggagttccgcagcatcaacacagaggtggtggcctgcagcgtggacagccagttcacccacctggcctggagcgtgtcctacacctacatccggaggaagaagaggatggacctgctgctgaagcacggccagatcaccctggacatgatctag

SEQ ID NO: 7570 - DNA, 816 bp, Artificial Sequence
  Description of Artificial Sequence: Synthetic coding sequence
atggaggccctgcccctgctggccgccaccaccccagaccacggccgccaccggcggctgctgctgctgcccctgctgctcttcctgctgcctgctggagctgtgcagggctgggagacagaggagcggcccaggacccgggaggaggagtgccacttctacgccggcggccaggtgtacccaggagaggccagccgggtgtctgtggccgaccacagcctgcacctgagcaaggccaagatcagcaagccagccccctactgggagggcacagctgtgattgatggagagttcaaggagctgaagctgacagactaccggggcaagtacctggtgttcttcttctaccccctggacttcacctttgtgtgccccacagagatcatcgcctttggagaccggctggaggagttccgcagcatcaacacagaggtggtggcctgcagcgtggacagccagttcacccacctggcctggatcaacaccccccggcggcagggcggcctgggccccatccgcatccccctgctgagtgacctgacccaccagatcagcaaggactatggagtgtacctggaggacagcggccacaccctgcggggcctcttcatcattgatgacaagggcatcctgcggcagatcaccctgaatgacctgcctgtgggccgctctgtggatgagaccctgcggctggtgcaggccttccagtacacagacaagcatggagaggtgtgcccagctggctggaagccaggcagcgagaccatcatcccagaccctgctgggaagctgaagtactttgacaagctgaactag

SEQ ID NO: 7571 - DNA, 558 bp, Artificial Sequence
  Description of Artificial Sequence: Synthetic coding sequence
atggaccacaggagccggctgcggggcaccggcctgaaccgcatccctggcacccagagccgggccccccgggtgcccctgcccttccacgtgcagcaggaggcccgggagggggaggactgggagcgggagcccccccggcagaggcctcccatctatgagcccccagagagcgaggagctgcctgacaacgtgatggtgtccaagccagccccctactgggagggcacagctgtgattgatggagagttcaaggagctgaagctgacagactaccggggcaagtacctggtgttcttcttctaccccctggacttcacctttgtgtgccccacagagatcatcgcctttggagaccggctggaggagttccgcagcatcaacacagaggtggtggcctgcagcgtggacagccagttcacccacctggcctggatcaacaccccccggcggcagggcggcctgggccccatccgcatccccctgctgagtgacctgacccaccagatcagcaaggactatggagtgtacctggaggacagcggccacaccctgtag

SEQ ID NO: 7572 - DNA, 843 bp, Artificial Sequence
  Description of Artificial Sequence: Synthetic coding sequence
atggcccgcttctgggtgtgtgtggccggggccggcttcttcctggccttcctggtgctgcacagccgcttctgtggcagccctgtgctgaggaacttcacctttgctgtgtcctggaggacagagaagatcctgtaccgcctggatgtgggctggcccaagcaccctgagtacttcaccggcaccaccttctgtgtggccgtggacagcctgaatggcctggtgtacatcggccagagaggagacaacatccccaagatcctggtgttcacagaagatggctacttcctgcgggcctggaactacacagtggacaccccccacggcatctttgctgccagcaccctgtatgagcagagcgtgtggatcacagatgtgggcagtgacttcatgatcctgtggctgcacggggagaatggaactggacctgccaagttcaacatcccccacagcgtgaccctggacagcgctggccgggtgtgggtggccgaccggggcaacaagaggatccaggtgtttgacaaggacacaggagagtggctgggcgcctggaacaactgcttcacagaggagggccccagctctgtgcgcttcaccccagatggcaagtacctgattgtggcccagctgaacctgagccggctgtctgtggtggccgcccctcctgtgggcagcatcggggagtgcagcgtcatcagcaccatccagctggccgaccaggtgctgccccacctgctggaggtggacaggaagacaggagctgtgtatgtggccgagatcggggccaagcaggtgcagaagtatgtgcccctgaacagctatgtgcccagctttggcagctag

SEQ ID NO: 7573 - DNA, 1044 bp, Artificial Sequence
  Description of Artificial Sequence: Synthetic coding sequence
atggcccgcttctgggtgtgtgtggccggggccggcttcttcctggccttcctggtgctgcacagccgcttctgtggcagccctgtgctgaggaacttcacctttgctgtgtcctggaggacagagaagatcctgtaccgcctggatgtgggctggcccaagcaccctgagtacttcaccggcaccaccttctgtgtggccgtggacagcctgaatggcctggtgtacatcggccagagaggagacaacatccccaagatcctggtgttcacagaagatggctacttcctgcgggcctggaactacacagtggacaccccccacggcatctttgctgccagcaccctgtatgagcagagcgtgtggatcacagatgtgggcagcggcttcttcggccacacagtgaagaagtacagcagctttggagacctggtgcaggtgctgggcaccccaggcaagaagggcaccagcctgaaccccctgcagtttgacaacccagctgagctgtatgtggaggacaccggggacatctacatcgtggatggagatggcggcctgaacaacagactcatcaagctgagccaggacttcatgatcctgtggctgcatggagaaaatggcaccggccctgccaagttcaacatcccccacagcgtgaccctggacagcgctggccgggtgtgggtggccgaccggggcaacaagaggatccaggtgtttgacaaggacaccggggagtggctgggcgcctggaacaactgcttcacagaggagggccccagctctgtgcgcttcaccccagatggcaagtacctgattgtggcccagctgaacctgagccggctgtctgtggtggccgcccctcctgtgggcagcattggagaatgttctgtcatcagcaccatccagctggccgaccaggtgctgccccacctgctggaggtggacaggaagacaggagctgtgtatgtggccgagattggagccaagcaggtgcagaagtatgtgcccctgaacagctatgtgcccagctttggcagctag

SEQ ID NO: 7574 - DNA, 1707 bp, Artificial Sequence
  Description of Artificial Sequence: Synthetic coding sequence
atggtgctgctgcactggtgcctgctgtggctgctcttccccctgagcagcaggacccagaagctgcccaccagagatgaggagctgttccagatgcagatccgggacaaggccttcttccatgacagcagcgtcatcccagatggagctgagatcagcagctacctgttccgggacacccccaagcgctacttctttgtggtggaggaggacaacacccccctgtctgtgacagtgaccccctgtgatgcccccctggagtggaagctgagcctgcaggagctgcctgaagatagaagtggagagggcagcggggacctggagcccctggagcagcagaagcagcagatcatcaatgaggagggcacagagctgttctcctacaagggaaatgatgtggagtacttcatcagcagcagcagccccagcggcctgtaccagctggacctgctgagcacagagaaggacacccacttcaaggtgtatgccaccaccaccccagagagtgaccagccctacccagagctgccctatgacccccgggtggatgtgaccagcctgggccgcaccaccgtgaccctggcctggaagcccagccccacagccagcctgctgaagcagcccatccagtactgtgtggtgatcaacaaggagcacaacttcaagagcctgtgtgctgtggaggccaagctgtctgcagatgatgccttcatgatggcccccaagccaggcctggacttcagcccctttgattttgcccacttcggcttccccagcgacaacagcggcaaggagaggagcttccaggccaagcccagccccaagctgggcagacatgtgtacagccggcccaaggtggacatccagaagatctgcatcggcaacaagaacatcttcaccgtgtctgacctgaagccagacacccagtactactttgatgtgtttgtggtgaacatcaacagcaacatgagcacagcctacgtgggcacctttgcccggaccaaggaggaggccaagcagaagacagtggagctgaaggatggcaagatcacagatgtgtttgtgaagaggaagggggccaagttcctgcgctttgcccctgtgagcagccaccagaaggtgaccttcttcatccacagctgcctggatgctgtgcagatccaggtgagaagagatggcaagctgctgctgagccagaatgtggagggcatccagcagttccagctgcggggcaagcccaaggccaagtacctggtgcggctgaagggcaacaagaagggggcctccatgctgaagatcctggccaccacccggcccaccaagcagagcttccccagcctgcctgaggacacccgcatcaaggcctttgacaagctgcggacctgcagcagcgccaccgtggcctggctgggcacccaggagaggaacaagttctgcatctacaagaaggaggtggatgacaactacaatgaagaccagaagaagcgggagcagaaccagtgcctgggccctgacatcaggaagaagtctgagaaggtgctgtgcaagtacttccacagccagaacctgcagaaggctgtgaccacagagaccatcaagggcctgcagcccgggaagagctacctgctggatgtgtatgtgattggccacggcggccacagcgtgaagtaccagagcaaggtggtgaagaccaggaagttctgctag

SEQ ID NO: 7575 - DNA, 489 bp, Artificial Sequence
  Description of Artificial Sequence: Synthetic coding sequence
atgaagggcttcaccgccaccctcttcctgtggaccctcatcttccccagctgcagcggcggcggcggcggcaaggcctggcccacccacgtggtgtgcagcgacagcggcctggaggtgctgtaccagagctgtgaccccctgcaggactttggcttctctgtggagaagtgcagcaagcagctgaagagcaacatcaacatccgcttcggcatcatcctgcgggaggacatcaaggagctgttcctggacctggccctgatgagccagggcagctctgtgctgaacttctcctaccccatctgtgaggccgccctgcccaagttctccttctgtggccgcaggaagggggagcagatctactatgccggccctgtgaacaaccctgagttcaccatcccccagggcgagtaccaggtgctgctggagctgtacacagagaagaggagcacagtggcctgtgccaatgccaccatcatgtgcagctag

SEQ ID NO: 7576 - DNA, 1698 bp, Artificial Sequence
  Description of Artificial Sequence: Synthetic coding sequence
atggacttcctgctggccctggtgctggtgagcagcctgtacctgcaggccgctgctgagtttgatggccgctggccccggcagatcgtgagcagcatcggcctgtgccgctatggaggaagaattgactgctgctggggctgggcccggcagagctggggccagtgccagcctgtgtgccagccccgctgcaagcacggggagtgcatcggccccaacaagtgcaagtgccaccctggctacgccggcaagacctgcaaccaggacctgaatgaatgtggcctgaagccccggccctgcaagcaccgctgcatgaacacctacggcagctacaagtgctactgcctgaatggctacatgctgatgccagatggcagctgcagcagcgccctgacctgcagcatggccaactgccagtatggctgtgatgtggtgaagggccagatccgctgccagtgccccagccctggcctgcagctggccccagatggccgcacctgtgtggatgtggatgaatgtgccaccggccgggccagctgcccccgcttccggcagtgtgtgaacaccttcggcagctacatctgcaagtgccacaagggctttgacctgatgtacatcggcggcaagtaccagtgccacgacattgatgaatgttccctgggccagtaccagtgcagcagctttgcccgctgctacaacatccggggcagctacaagtgcaagtgcaaggagggctaccagggagatggcctgacctgtgtgtacatccccaaggtgatgattgagcccagcggccccatccacgtgcccaagggaaatggcaccatcctgaagggggacaccggcaacaacaactggatcccagatgtgggcagcacctggtggccacccaagaccccctacatcccccccatcatcaccaaccggcccaccagcaagcccaccacccggcccacccccaagcccacccccatccccaccccacctcctcctccacccctgcccacagagctgcggacccccctgccccccaccaccccagagcggcccaccaccggcctgaccaccatcgccccagctgccagcaccccacctgggggcatcaccgtggacaacagagtgcagacagacccccagaagcccagaggagatgtgttcatcccccggcagcccagcaatgacctgtttgagatctttgaaattgagcggggcgtgtctgcagatgatgaggccaaggatgatcctggggtgctggtgcacagctgcaactttgaccacggcctgtgtggctggatccgggagaaggacaatgacctgcactgggagcccatccgggaccctgctgggggccagtacctgactgtgtctgctgccaaggcccctgggggcaaggccgcccggctggtgctgcccctgggccgcctgatgcacagcggggacctgtgcctgtccttccgccacaaggtgacaggcctgcacagcggcaccctgcaggtgtttgtgaggaagcacggggcccatggagctgccctgtggggcagaaatggaggccacggctggaggcagacccagatcaccctgcggggagctgacatcaagtctgtggtgttcaagggggagaagaggcggggccacactggagaaattggcctggatgatgtgtccctgaagaagggccactgcagcgaggagaggtag

SEQ ID NO: 7577 - DNA, 1413 bp, Artificial Sequence
  Description of Artificial Sequence: Synthetic coding sequence
atgaagaggtctgtggccgtgtggctgctggtgggcctgagcctgggcgtgccccagtttgggaagggggacatctgtgaccccaacccctgtgaaaatggaggcatctgcctgcccggcctggctgatggcagcttcagctgtgaatgtccagatggcttcacagaccccaactgcagctctgtggtggaggtgggcccctgcacccccaacccctgccacaatggaggcacctgtgagatcagcgaggcctacagaggagacaccttcatcggctacgtgtgcaagtgcccccggggcttcaacggcatccactgccagcacaacatcaatgaatgtgaggtggagccctgcaagaatggaggcatctgcacagacctggtggccaactacagctgtgagtgccctggagagttcatgggcaggaactgccagtacaagtgcagcggccccctgggcatcgagggcggcatcatcagcaaccagcagatcacagccagcagcacccaccgggccctgtttggcctgcagaagtggtacccctactatgcccggctgaacaagaagggcctcatcaatgcctggacagctgctgaaaatgaccgctggccctggatccagatcaacctgcagaggaagatgagggtgactggagtcatcacccagggcgccaagagaattggcagccctgagtacatcaagagctacaagatcgcctacagcaatgatggcaagacctgggccatgtacaaggtgaagggcaccaatgaagacatggtgttccggggcaacatcgacaacaacaccccctatgccaacagcttcaccccacccatcaaggcccagtatgtgcggctgtacccccaggtgtgccgccgccactgcaccctgaggatggagctgctgggctgtgagctgagcggctgcagcgagcccctgggcatgaagagcggccacatccaggactaccagatcacagccagcagcatcttccgcaccctgaacatggacatgttcacctgggagcccaggaaggcccggctggacaagcagggcaaggtgaatgcctggaccagcggccacaatgaccagagccagtggctgcaggtggacctgctggtgcccaccaaggtgacaggcatcatcacccagggcgccaaggactttggacatgtgcagtttgtgggcagctacaagctggcctacagcaatgatggagagcactggacagtgtaccaggatgagaagcagaggaaggacaaggtgttccagggcaactttgacaatgacacccacaggaagaatgtgattgatcctcccatctatgcccggcacatccgcatcctgccctggagctggtacggccgcatcaccctgcggtctgagctgctgggctgcacagaggaggagtag

SEQ ID NO: 7578 - DNA, 1254 bp, Artificial Sequence
  Description of Artificial Sequence: Synthetic coding sequence
atggccagctacctgtatggagtgctgtttgctgtgggcctgtgtgcccccatctactgtgtgtccccagccaatgcccccagcgcctacccccggcccagcagcaccaagagcaccccagccagccaggtgtacagcctgaacacagactttgccttccggctgtacagaaggctggtgctggagacccccagccagaacatcttcttcagccctgtgtctgtgtccaccagcctggccatgctgagcctgggcgcccacagcgtgaccaagacccagatcctgcagggcctgggcttcaacctgacccacaccccagagagcgccatccaccagggcttccagcacctggtgcacagcctgactgtgcccagcaaggacctgaccctgaagatgggcagcgccctgtttgtgaagaaggagctgcagctgcaggccaacttcctgggcaatgtgaagaggctgtatgaggccgaggtgttcagcacagacttcagcaaccccagcatcgcccaggcccgcatcaacagccacgtgaagaagaagacccagggcaaggtggtggacatcatccagggcctggacctgctgacagccatggtgctggtgaaccacatcttcttcaaggccaagtgggagaagcccttccaccctgagtacaccaggaagaacttccccttcctggtgggggagcaggtgacagtgcacgtgcccatgatgcaccagaaggagcagtttgccttcggcgtggacacagagctgaactgctttgtgctgcagatggactacaagggagatgctgtggccttctttgtgctgcccagcaagggcaagatgaggcagctggagcaggccctgagcgcccggaccctgaggaagtggagccacagcctgcagaagcgctggattgaggtgttcatcccccgcttcagcatcagcgccagctacaacctggagaccatcctgcccaagatgggcatccagaatgtgtttgacaagaatgctgacttcagcggcatcgccaagagggacagcctgcaggtgtccaaggccacccacaaggctgtgctggatgtgtctgaggagggcacagaggccacagctgccaccaccaccaagttcatcgtgcgcagcaaggatggccccagctacttcaccgtgtccttcaacagaaccttcctgatgatgatcaccaacaaggccacagatggcatcctcttcctgggcaaggtggagaaccccaccaagagctag

SEQ ID NO: 7579 - DNA, 486 bp, Artificial Sequence
  Description of Artificial Sequence: Synthetic coding sequence
atgctgatgcctgtgcacttcctgctgctgctgctgctgctgctgggcggccccaggacaggcctgccccacaagttctacaaggccaagcccatcttcagctgcctgaacacagccctgtctgaggccgagaagggccagtgggaggatgccagcctgctgagcaagaggagcttccactacctgcggagcagagatgccagcagtggagaggaggaggagggcaaggagaagaagaccttccccatcagcggggcccggggcggggcccggggcacccgctaccgctacgtgtcccaggcccagccccggggcaagccccggcaggacacagccaagagcccccacaggaccaagttcaccctgagcctggatgtgcccaccaacatcatgaacctgctcttcaacatcgccaaggccaagaacctgcgggcccaggccgccgccaatgcccacctgatggcccagattggaaggaagaagtag

SEQ ID NO: 7580 - DNA, 2091 bp, Artificial Sequence
  Description of Artificial Sequence: Synthetic coding sequence
atggccatggcccggctgggctcctggctgggggaggcccagtggctggccctggtgtccctgtttgtggccgccctggccaccgtgggcctgtacctggcccagtgggccctggcccgggcccggccccagccccagaggagagctgtggagcccggggagggcccccggcccggcagtgatgccctgctgtcctggatcctgaccctgggctcctggaggagccagtggcaggccgcctgggtgacagccctgaatgaggaggccgagaggaagggcggcccccccttcctgagctttgaggaggacccccggcagcaggccctggagctggtggtgcaggaggtgtcctctgtgctgcggtctgctgaggagaaggtggtggtgtgccacgtggtgggccaggccatccagttcctggtgtctgagaccccagccctgggcgccggctgccgcctgtatgacatgaggctgagccccttccacctgcagctggagttccacatgaaggagaagcgggaggacctgcagatctcctggagcttcatctctgtgcctgagatggctgtgaacatccagcccaaggccctgggggaggaccaggtggccgagaccagcgccatgtctgatgtgctgaaggacatcctgaagcacctggccggcagcgccagccccagcgtggtgctgatcaccaagcccaccaccgtgaaggaggcccagaacctgcagtgtgccgccagcacagcccaggagagctgcccccccaagccaccccgggcccacgagctgaagctgctggtgaggaacatccacgtgctgctgctgtctgagcccggggccagcggccacatcaatgctgtgtgtgtggtgcagctgaatgaccctgtgcagcgcttcagcagcaccctgaccaagaacaccccagacctgatgtgggaggaggagttcacctttgagctgaatgccaagagcaaggagctgcacctgcagatcagcgaggccggccgcagcagcgagggcctgctggccacagccaccgtgcccctggacctcttcaagaagcagcccagcggcccccagagcttcaccctgaccagcggcagcgcctgtggcagctctgtgctgggctctgtgacagctgagttctcctacatggagcctggagagctgaagtcctggcccatccccccacctgtgcctgctgccaagattgagaaggacagaacagtgatgccctgtggcaccgtggtgaccaccgtgacagctgtgaagaccaagccccgggtggatgtgggccgggccagccccctgagcagtgacagccctgtgaagacccccatcaaggtgaaggtgattgagaaggacatctctgtgcaggccatcgcctgccgcagcgcccctgtgtccaagaccctgagcagcagtgacacagagctgctggtgctgaatggaagtgaccctgtggccgaggtggccatccggcagctgtctgagagcagcaagctgaagctgaagagccccaggaagaagagcaccatcatcatcagcggcatcagcaagaccagcctgagccaggaccatgatgctgccctgatgcagggctacacagcctctgtggacagcacccaccaggaggatgcccccagccaccctgagagagctgctgccagcgcccctcctgaggaggccgagagcgcccaggccagcctggcccccaagccccaggaggatgagctggacagctgggacctggagaaggagccccaggccgccgcctggagcagccaggtgctgctggaccctgatggagatgagctgtctgagagctccatgtctgtgctggagcccggcacagccaagaagcacaagggcggcatcctgaggaaaggagccaagctgttcttcagaagaagacaccagcagaaggaccccggcatgagccagagccacaatgacctggtgttcctggagcagcctgagggcagcaggaggaagggcatcaccctgacccgcatcctgaacaagaagctgctgagccgccacaggaacaagaacaccatgaatggagcccctgtggagccctgcacctag

SEQ ID NO: 7581 - DNA, 669 bp, Artificial Sequence
  Description of Artificial Sequence: Synthetic coding sequence
atgcctgccagcagccccttcctgctggcccccaagggccccccaggcaacatgggcggccctgtgcgggagcccgccctgtctgtggccctgtggctgtcctggggcgccgccctgggcgctgtggcctgtgccatggccctgctgacccagcagacagagctgcagagcctgcggcgggaggtgtcccggctgcagggcaccggcggccccagccagaatggagagggctacccctggcagagcctgcctgagcagcacagcgtgctgcacctggtgcccatcaatgccaccagcaaggatgacagtgatgtgacagaggtgatgtggcagcctgccctgcggcggggccggggcctgcaggcccagggctatggagtgcgcatccaggatgctggggtgtacctgctgtacagccaggtgctcttccaggatgtgaccttcaccatgggccaggtggtgtcccgggagggccagggccggcaggagaccctcttccgctgcatccgctccatgcccagccacccagaccgggcctacaacagctgctacagcgctggggtcttccacctgcaccagggcgacatcctgagcgtcatcatcccccgggcccgggccaagctgaacctgagcccccacggcaccttcctgggctttgtgaagctgtag

SEQ ID NO: 7582 - DNA, 2205 bp, Artificial Sequence
  Description of Artificial Sequence: Synthetic coding sequence
atgtggggcctgctgctggccctggccgcctttgccccagctgtgggccctgccctgggcgcccccagaaattctgtgctgggcctggcccagcccggcaccaccaaggtgcccggcagcaccccagccctgcacagcagccctgcccagcccccagctgagacagccaacggcaccagcgagcagcacgtgcgcatccgggtcatcaagaagaagaaggtgatcatgaagaagaggaagaagctgaccctgacccggcccacccccctggtgacagctggccccctggtgacccccaccccagctggcaccctggaccctgctgagaagcaggagaccggctgcccccccctgggcctggagagcctgcgggtgtctgacagccggctggaggccagcagcagccagagctttggcctgggcccccaccggggccgcctgaacatccagagcggcctggaggatggagacctgtatgatggagcctggtgtgccgaggagcaggatgctgacccctggttccaggtggatgctggccaccccacccgcttctctggagtcatcacccagggcaggaacagcgtgtggaggtatgactgggtgaccagctacaaggtgcagttcagcaatgacagcaggacctggtggggcagcaggaaccacagcagcggcatggatgctgtgtttcctgccaacagcgaccctgagacccctgtgctgaacctgctgcctgagccccaggtggcccgcttcatccggctgctgccccagacctggctgcagggcggggccccctgcctgcgggcagagatcctggcctgccctgtgtctgaccccaatgacctcttcctggaggccccagccagcggcagcagtgaccccctggacttccagcaccacaactacaaggccatgaggaagctgatgaagcaggtgcaggagcagtgccccaacatcacccgcatctacagcatcggcaagagctaccagggcctgaagctgtatgtgatggagatgtctgacaagccaggagagcacgagctgggggagcctgaggtgcgctacgtggccggcatgcacggcaatgaggccctgggccgggagctgctgctgctgctgatgcagttcctgtgccacgagttcctgcggggcaacccccgggtgacccggctgctgtctgagatgaggatccacctgctgcccagcatgaacccagatggctatgagatcgcctaccaccggggcagcgagctggtgggctgggccgagggccgctggaacaaccagagcattgacctgaaccacaactttgctgacctgaacacccccctgtgggaggcccaggatgatggcaaggtgccccacatcgtgcccaaccaccacctgcccctgcccacctactacaccctgcccaatgccaccgtggcccctgagaccagggctgtgatcaagtggatgaagaggatcccctttgtgctgagcgccaacctgcacggcggggagctggtggtgtcctacccctttgacatgaccaggaccccctgggccgcccgggagctgacccccaccccagatgatgctgtgttccgctggctgagcacagtgtatgccggcagcaacctggccatgcaggacaccagccggcggccctgccacagccaggacttctctgtgcacggcaacatcatcaacggggctgactggcacacagtgcccggctccatgaatgacttctcctacctgcacaccaactgctttgaggtgacagtggagctgagctgtgacaagttcccccatgaaaatgagctgccccaggagtgggagaacaacaaggatgccctgctgacctacctggagcaggtgaggatgggcattgctggggtggtgcgggacaaggacacagagctgggcattgctgatgctgtgattgctgtggatggcatcaaccatgatgtgaccacagcctggggcggggactactggaggctgctgacccctggggactacatggtgacagccagcgctgagggctaccacagcgtgaccaggaactgccgggtgacctttgaggagggccccttcccctgcaactttgtgctgaccaagacccccaagcagaggctgcgggagctgctggccgccggggccaaggtgcccccagacctgcggcggcggctggagcggctgcggggccagaaggactag

SEQ ID NO: 7583 - DNA, 759 bp, Artificial Sequence
  Description of Artificial Sequence: Synthetic coding sequence
atgagggcccccctgctgcccccagcccctgtggtgctgagcctgctgatcctgggcagcggccactacgccgccggcctggacctgaatgacacctacagcggcaagcgggagcccttcagcggggaccacagcgcagatggctttgaggtgaccagccgctctgagatgagcagcggcagcgagatcagccctgtgtctgagatgcccagcagcagcgagcccagcagtggagctgactatgactacagcgaggagtatgacaatgagccccagatccctggctacatcgtggatgattctgtgcgggtggagcaggtggtgaagccaccccagaacaagacagaaagtgagaacaccagtgacaagcccaagaggaagaagaagggcggcaagaatggcaagaacagaagaaacaggaagaagaagaacccctgcaatgctgagttccagaacttctgcatccacggggagtgcaagtacatcgagcacctggaggccgtgacctgcaagtgccagcaggagtactttggagagcgctgtggggagaagtccatgaagacccacagcatgattgacagcagcctgagcaagatcgccctggccgccatcgccgccttcatgtctgctgtgatcctgacagctgtggccgtcatcaccgtgcagctgcggcggcagtatgtgaggaaatatgaaggagaggccgaggagaggaagaagctgcggcaggagaatggaaatgtgcacgccatcgcctag

SEQ ID NO: 7584 - DNA, 8487 bp, Artificial Sequence
  Description of Artificial Sequence: Synthetic coding sequence
atgcccaagagggcccactggggcgccctgtctgtggtgctgatcctgctgtggggccacccccgggtggccctggcctgcccccacccctgtgcctgctacgtgcccagcgaggtgcactgcaccttccgcagcctggcctctgtgcctgctggcatcgccaagcacgtggagcgcatcaacctgggcttcaacagcatccaggccctgtctgagaccagctttgctggcctgaccaagctggagctgctgatgattcatggaaatgagatccccagcatcccagatggagccctgcgggacctgagcagcctgcaggtgttcaagttctcctacaacaagctgcgggtcatcaccggccagaccctgcagggcctgagcaacctgatgaggctgcacatcgaccacaacaagattgagttcatccacccccaggccttcaacggcctgaccagcctgcggctgctgcacctggagggcaacctgctgcaccagctgcaccccagcaccttcagcaccttcaccttcctggactacttccggctgagcaccatccgccacctgtacctggccgagaacatggtgaggaccctgcctgcctccatgctgaggaacatgcccctgctggagaacctgtacctgcagggcaacccctggacctgtgactgtgagatgcgctggttcctggagtgggatgccaagagccggggcatcctgaagtgcaagaaggacaaggcctatgaaggaggccagctgtgtgccatgtgcttcagccccaagaagctgtacaagcatgagatccacaagctgaaggacatgacctgcctgaagcccagcattgagagccccctgcggcagaacagaagccgcagcattgaggaggagcaggagcaggaggaggatggcggcagccagctgatcctggagaagttccagctgccccagtggagcatcagcctgaacatgacagatgagcacggcaacatggtgaacctggtgtgtgacatcaagaagcccatggatgtgtacaagatccacctgaaccagacagaccccccagacatcgacatcaatgccaccgtggccctggactttgagtgccccatgacccgggagaactatgagaagctgtggaagctgattgcctactacagcgaggtgcctgtgaagctgcaccgggagctgatgctgagcaaggacccccgggtgtcctaccagtaccggcaggatgctgatgaggaggccctgtactacacaggagtgcgggcccagatcctggccgagcctgagtgggtgatgcagcccagcattgacatccagctgaacagacggcagagcacagccaagaaggtgctgctgagctactacacccagtacagccagaccatcagcaccaaggacacccggcaggcccggggccgctcctgggtgatgattgagcccagcggggctgtgcagagggaccagacagtgctggagggcggcccctgccagctgagctgcaatgtgaaggccagcgagagccccagcatcttctgggtgctgcctgatggcagcatcctgaaggcccccatggatgatcctgacagcaagttcagcatcctgagcagcggctggctgcgcatcaagtccatggagcccagcgacagcggcctgtaccagtgcatcgcccaggtgagagatgagatggacaggatggtgtacagagtgctggtgcagagccccagcacccagcctgctgagaaggacacagtgaccatcggcaagaaccctggagagagcgtgaccctgccctgcaatgccctggccatccctgaggcccacctgtcctggatcctgcccaacagacgcatcatcaatgacctggccaacaccagccacgtgtacatgctgcccaacggcaccctgagcatccccaaggtgcaggtgtctgacagcggctactaccgctgtgtggccgtgaaccagcagggcgctgaccacttcaccgtgggcatcaccgtgaccaagaagggcagcggcctgcccagcaagagaggaagaagacctggggccaaggccctgagccgggtgagagaagatattgtggaggatgagggcggcagcggcatgggagatgaggagaacaccagccggcggctgctgcaccccaaggaccaggaggtgttcctgaagaccaaggatgatgccatcaacggggacaagaaggccaagaagggccgcaggaagctgaagctgtggaagcacagcgagaaggagcctgagaccaacgtggccgagggccggcgggtgtttgagagcagaagacgcatcaacatggccaacaagcagatcaaccctgagcgctgggccgacatcctggccaaggtgcggggcaagaacctgcccaagggcacagaggtgcccccactcatcaagaccaccagcccccccagcctgagcctggaggtgaccccacccttccctgccatcagcccccccagcgccagccctgtgcagacagtgaccagcgctgaggagagcagcgcagatgtgcccctgctgggggaggaggagcacgtgctgggcaccatcagcagcgcctccatgggcctggagcacaaccacaacggggtcatcctggtggagcctgaggtgaccagcacccccctggaggaggtggtggatgacctgtctgagaagacagaggagatcaccagcacagaaggagacctgaagggcacagctgcccccaccctcatcagcgagccctatgagcccagccccaccctgcacaccctggacacagtgtatgagaagcccacccatgaggagacagccacagagggctggagcgctgctgatgtgggcagcagccctgagcccaccagcagtgaatatgagccccccctggatgctgtgtccctggccgagagcgagcccatgcagtactttgatcctgacctggagaccaagagccagccagatgaggacaagatgaaggaggacacctttgcccacctgacccccacccccaccatctgggtgaatgacagcagcaccagccagctgtttgaggacagcaccatcggggagcccggggtgcccggccagagccacctgcagggcctgacagacaacatccacctggtgaagagcagcctgagcacccaggacaccctgctgatcaagaagggcatgaaggagatgagccagaccctgcagggcggcaacatgctggagggggaccccacccacagccgcagcagcgagagcgagggccaggagagcaagagcatcaccctgcctgacagcaccctgggcatcatgagctccatgagccctgtgaagaagccagctgagaccaccgtgggcaccctgctggacaaggacaccaccacagccaccaccaccccccggcagaaggtggcccccagcagcaccatgagcacccaccccagcagaagaagacccaacggcagaagaaggctgcggcccaacaagttccgccaccgccacaagcagaccccacccaccacctttgcccccagcgagaccttcagcacccagcccacccaggccccagacatcaagatcagcagccaggtggagagcagcctggtgcccacagcctgggtggacaacacagtgaacacccccaagcagctggagatggagaagaatgctgagcccaccagcaagggcacccccaggaggaagcacggcaagaggcccaacaagcaccgctacacccccagcacagtgagcagccgggccagcggcagcaagcccagccccagccctgagaacaagcacaggaacatcgtgacccccagcagcgagaccatcctgctgcccaggacagtgtccctgaagacagagggcccctatgacagcctggactacatgaccaccaccaggaagatctacagcagctaccccaaggtgcaggagaccctgcctgtgacctacaagcccaccagtgatggcaaggagatcaaggatgatgtggccaccaacgtggacaagcacaagagtgacatcctggtgactggagagagcatcaccaatgccatccccaccagccgcagcctggtgtccaccatgggagagttcaaggaggagagcagccctgtgggcttccctggcacccccacctggaaccccagcaggacagcccagcccggccgcctgcagacaggcatccctgtgaccaccagcggggagaacctgacagatcctcccctgctgaaggagctggaggatgtggacttcaccagcgagttcctgagcagcctgactgtgtccacccccttccaccaggaggaggccggcagcagcaccaccctgagcagcatcaaggtggaggtggccagcagccaggccgagaccaccaccctggaccaggaccacctggagaccaccgtggccatcctgctgtctgagacccggccccagaaccacacccccacagctgccaggatgaaggagcccgccagcagcagccccagcaccatcctgatgagcctgggccagaccaccaccaccaagccagccctgcccagcccccgcatcagccaggccagccgggacagcaaagaaaatgtgttcctgaactacgtgggcaaccctgagacagaggccacccctgtgaacaatgaaggcacccagcacatgagcggccccaatgagctgagcacccccagcagtgaccaggatgccttcaacctgagcaccaagctggagctggagaagcaggtgtttggcagccgcagcctgccccggggccctgacagccagaggcaggacggccgggtgcacgccagccaccagctgaccagggtgcctgccaagcccatcctgcccacagccaccgtgcggctgcctgagatgagcacccagagcgccagccgctactttgtgaccagccagagccccaggcactggaccaacaagccagagatcaccacctaccccagcggggccctgcctgagaacaagcagttcaccaccccccggctgagcagcaccaccatccccctgcccctgcacatgagcaagcccagcatccccagcaagttcacagacagaagaacagaccagttcaacggctacagcaaggtgtttggaaacaacaacatccctgaggccagaaatcctgtgggcaagccacccagcccccgcatcccccactacagcaatggccgcctgcccttcttcaccaacaagaccctgtccttcccccagctgggcgtgacccggcggccccagatccccaccagccctgcccctgtgatgagggagaggaaggtgattcctggcagctacaaccgcatccacagccacagcaccttccacctggactttggccccccagccccacccctgctgcacaccccccagaccaccggcagccccagcaccaacctgcagaacatccccatggtgagcagcacccagagcagcatctccttcatcaccagctctgtgcagagcagcggcagcttccaccagagcagcagcaagttctttgctgggggccccccagccagcaagttctggagcctgggggagaagccccagatcctgaccaagagcccccagacagtgtctgtgacagctgagacagacacagtgttcccctgtgaggccaccgggaagcccaagccctttgtgacctggaccaaggtgtccactggagccctgatgacccccaacacccgcatccagagatttgaggtgctgaagaatggcaccctggtgatcaggaaggtgcaggtgcaggaccggggccagtacatgtgcacagccagcaacctgcacggcctggacaggatggtggtgctgctgtctgtgacagtgcagcagccccagatcctggccagccactaccaggatgtgacagtgtacctgggggacaccatcgccatggagtgcctggccaagggcaccccagccccccagatctcctggatcttcccagacagaagagtgtggcagacagtgtcccctgtggagggccgcatcaccctgcacgagaacagaaccctgagcatcaaggaggccagcttcagtgacagaggagtgtacaagtgtgtggccagcaatgctgctggagctgacagcctggccatccggctgcacgtggccgccctgccccctgtgatccaccaggagaagctggagaacatcagcctgcccccaggcctgagcatccacatccactgcacagccaaggccgcccccctgcccagcgtgcgctgggtgctgggagatggcacccagatccggcccagccagttcctgcacggcaacctgtttgtgttccccaacggcaccctgtacatccggaacctggcccccaaggacagcggccgctatgaatgtgtggccgccaacctggtgggcagcgcccggaggacagtgcagctgaatgtgcagagagctgctgccaatgcccgcatcaccggcaccagccccaggagaacagatgtgcgctatggaggcaccctgaagctggactgcagcgccagcggggacccctggccccgcatcctgtggaggctgcccagcaagaggatgattgatgccctcttctcctttgacagccgcatcaaggtgtttgccaacggcaccctggtggtgaagtctgtgacagacaaggatgctggggactacctgtgtgtggccaggaacaaggtgggagatgattatgtggtgctgaaggtggatgtggtgatgaagccagccaagattgagcacaaggaggagaatgaccacaaggtgttctatggaggagacctgaaggtggactgtgtggccaccggcctgcccaaccctgagatctcctggagcctgcctgatggcagcctggtgaacagcttcatgcagagtgatgacagcggcggccgcaccaagagatatgtggtgttcaacaacggcaccctgtacttcaatgaggtgggcatgagggaggagggggactacacctgctttgctgagaaccaggtgggcaaggatgagatgagggtgcgggtgaaggtggtgacagccccagccaccatccggaacaagacctacctggccgtgcaggtgccctatggagatgtggtgacagtggcctgtgaggccaagggggagcccatgcccaaggtgacctggctgagccccaccaacaaggtgatccccaccagcagcgagaagtaccagatctaccaggacggcaccctgctgatccagaaggcccagaggagtgacagcggcaactacacctgcctggtgagaaattctgctggggaggacaggaagacagtgtggatccacgtgaatgtgcagccccccaagatcaatggaaaccccaaccccatcaccaccgtgcgggagattgctgctgggggcagcaggaagctgattgactgcaaggccgagggcatccccaccccccgggtgctgtgggccttccctgagggcgtggtgctgcctgccccctactacggcaaccgcatcaccgtgcacggcaatggcagcctggacatccgcagcctgaggaagagtgacagcgtgcagctggtgtgcatggccagaaatgaaggaggagaggcccggctcatcctgcagctgactgtgctggagcccatggagaagcccatcttccatgaccccatcagcgagaagatcacagccatggccggccacaccatcagcctgaactgcagcgctgctggcacccccacccccagcctggtgtgggtgctgcccaacggcacagacctgcagagcggccagcagctgcagcgcttctaccacaaggcagatggcatgctgcacatcagcggcctgagctctgtggatgctggggcctaccgctgtgtggccagaaatgctgctggccacacagagcggctggtgtccctgaaggtgggcctgaagccagaggccaacaagcagtaccacaacctggtgtccatcatcaatggagagaccctgaagctgccctgcaccccacctggggccggccagggccgcttctcctggaccctgcccaacggcatgcacctggagggcccccagaccctgggccgggtgtccctgctggacaatggcaccctgactgtgcgggaggcctctgtgtttgaccggggcacctacgtgtgcaggatggagacagaatatggccccagcgtgaccagcatccctgtgattgtgattgcctacccaccccgcatcaccagcgagcccacccctgtgatctacaccaggcctggcaacacagtgaagctgaactgcatggccatgggcatccccaaggctgacatcacctgggagctgcctgacaagagccacctgaaggccggcgtgcaggcccggctgtatggcaaccgcttcctgcacccccagggcagcctgaccatccagcacgccacccagagagatgctggcttctacaagtgcatggccaagaacatcctgggcagtgacagcaagaccacctacatccacgtgttctag

SEQ ID NO: 7585 - DNA, 3330 bp, Artificial Sequence
  Description of Artificial Sequence: Synthetic coding sequence
atgaggctgctgctgctggtgcccctgctgctggccccagcccctggcagcagcgcccccaaggtgcggcggcagagcgacacctggggcccctggagccagtggagcccctgcagcaggacctgtggcggcggcgtgtccttccgggagcggccctgctacagccagaggagagatggcggcagcagctgtgtgggccctgcccggagccacaggagctgcaggacagagagctgcccagatggagcccgggacttccgggcagagcagtgtgccgagtttgatggagctgagttccagggccgccgctaccgctggctgccctactacagcgcccccaacaagtgtgagctgaactgcatccccaagggggagaacttctactacaagcaccgggaggccgtggtggatggcaccccctgtgagcccgggaagagagatgtgtgtgtggatggcagctgccgggtggtgggctgtgaccacgagctggacagcagcaagcaggaggacaagtgcctgcgctgtggaggagatggcaccacctgctaccctgtggccggcacctttgatgccaatgacctgagccggggctacaaccagatcctgattgtgcccatgggcgccaccagcatcctgattgatgaggccgccgccagcaggaacttcctggccgtgaagaatgtgcggggggagtactacctgaatggccactggaccatcgaggccgcccgggccctgcctgctgccagcaccatcctgcactatgaaagaggagctgagggggacctggcccctgagcggctgcacgcccggggccccaccagcgagcccctggtgattgagctgatcagccaggagcccaaccctggggtgcactatgagtaccacctgcccctgcggcggcccagccctggcttctcctggagccacggctcctggagcgactgcagcgcagaatgtggcggcggccaccagagccggctggtgttctgcaccatcgaccacgaggcctacccagaccacatgtgccagaggcagcccaggcctgctgaccggcgcagctgcaacctgcacccctgcccagagaccaagcgctggaaggccggcccctgggccccctgcagcgccagctgtggcggcggcagccagagccgctctgtgtactgcatcagcagtgatggagctggcatccaggaggccgtggaggaggctgaatgtgccggcctgcccgggaagcccccagccatccaggcctgcaacctgcagagatgtgccgcctggagccctgagccctggggcgagtgcagcgtgtcctgtggggtgggcgtgaggaagaggtctgtgacctgccgcggggagcggggcagcctgctgcacacagctgcctgcagcctggaggacaggcctcccctgacagagccctgtgtgcatgaggactgccccctgctgagtgaccaggcctggcacgtgggcacctggggcctgtgcagcaagagctgcagcagcggcacccggcggcggcaggtgatctgtgccatcggcccccccagccactgcggcagcctgcagcacagcaagcctgtggatgtggagccctgcaacacccagccctgccacctgccccaggaggtgcccagcatgcaggatgtgcacaccccagccagcaacccctggatgcccctgggcccccaggagagccctgccagtgacagccggggccagtggtgggccgcccaggagcaccccagcgcccggggggaccacagaggagagcggggggaccccaggggggaccagggcacccacctgagcgccctgggccctgcccccagcctgcagcagcccccctaccagcagcccctgcggagcggcagcggcccccatgactgccgccacagcccccacggctgctgcccagatggccacacagccagcctgggcccccagtggcagggctgccctggggccccctgccagcagagccgctatggctgctgcccagacagagtgtctgtggccgagggcccccaccacgccggctgcaccaagagctatggaggagacagcactggaggcatgcccaggagcagagctgtggccagcacagtgcacaacacccaccagccccaggcccagcagaatgagcccagcgagtgccggggcagccagtttggctgctgctatgacaacgtggccacagctgctggccccctgggggagggctgtgtgggccagcccagccacgcctaccctgtgcgctgcctgctgcccagcgcccacggcagctgtgccgactgggccgcccgctggtactttgtggcctctgtgggccagtgcaaccgcttctggtacggcggctgccacggcaatgccaacaactttgccagcgagcaggagtgcatgagcagctgccagggcagcctgcacggcccccggcggccccagcccggggccagcggccgcagcacccacacagatggcggcggcagcagccctgctggggagcaggagcccagccagcacaggactggagctgctgtgcagaggaagccctggcccagcggcggcctgtggaggcaggaccagcagcccggccctggagaggccccccacacccaggcctttggagagtggccctggggccaggagctgggcagccgggcccctggcctgggcggagatgctggcagccctgccccacccttccacagcagcagctaccgcatcagcctggccggcgtggagcccagcctggtgcaggccgccctgggccagctggtgcggctgagctgcagtgatgacacagcccctgagagccaggccgcctggcagaaggatggccagcccatcagcagtgacagacaccggctgcagtttgatggcagcctcatcatccaccccctgcaggctgaagatgctggcacctacagctgtggcagcaccaggcctggccgggacagccagaagatccagctgcgcatcattggaggagacatggctgtgctgtctgaggccgagctgagccgcttcccccagccccgggaccctgcccaggactttggccaggccggggccgccggccccctgggcgccatccccagcagccacccccagcctgccaaccggctgcggctggaccagaaccagccccgggtggtggatgccagccctggccagaggatccgcatgacctgcagagctgagggcttccccccaccagccatcgagtggcagagagatggccagcctgtgagcagccccagcacccacaggcctgcccagggcccctggcagggcctgcggcggcctgcccgggccggccagctgtag

SEQ ID NO: 7586 - DNA, 405 bp, Artificial Sequence
  Description of Artificial Sequence: Synthetic coding sequence
atgaagtctgtgctgctgctgaccaccctgctggtgcctgcccacctggtggccgcctggagcaacaactatgctgtggactgcccccagcactgtgacagcagcgagtgcaagagcagcccccgctgcaagaggacagtgctggatgactgtggctgctgccgggtgtgtgccgccggccgcggggagacctgctacagaacagtgtctggcatggatggcatgaagtgtggccctggcctgcgctgccagcccagcaatggagaggacccctttggagaggagtttggcatctgcaaggagcatgacatggccagcggagatggcaacatcgtgcgggaggaggtggtgaaggaaaatgctgctggcagccctgtgatgaggaagtggctgaaccccaggtag

SEQ ID NO: 7587 - DNA, 555 bp, Artificial Sequence
  Description of Artificial Sequence: Synthetic coding sequence
atgaagtctgtgctgctgctgaccaccctgctggtgcctgcccacctggtggccgcctggagcaacaactatgctgtggactgcccccagcactgtgacagcagcgagtgcaagagcagcccccgctgcaagaggacagtgctggatgactgtggctgctgccgggtgtgtgccgccggccgcggggagacctgctacagaacagtgtctggcatggatggcatgaagtgtggccctggcctgcgctgccagcccagcaatggagaggacccctttggagaggagtttggcatctgcaaggactgcccctacggcaccttcggcatggactgccgggagacctgcaactgccagagcggcatctgtgaccggggcaccgggaagtgcctgaagttccccttcttccagtacagcgtgaccaagagcagcaacagatttgtgtccctgacagaacatgacatggccagcggagatggcaacatcgtgcgggaggaggtggtgaaggaaaatgctgctggcagccctgtgatgaggaagtggctgaaccccaggtag

SEQ ID NO: 7588 - DNA, 597 bp, Artificial Sequence
  Description of Artificial Sequence: Synthetic coding sequence
atgcccatcccagccagccccctgcacccccccctgcccagcctgctgctgtacctgctgctggagctggccggcgtgacccacgtgttccacgtgcagcagacagagatgagccagacagtgtccactggagagagcatcatcctgagctgcagcgtgcccaacaccctgcccaatggacctgtgctgtggttcaagggcaccggccccaacaggaagctgatctacaacttcaagcagggcaacttcccccgggtgaaggagattggagacaccaccaagccaggcaacacagacttcagcacccgcatccgggagatcagcctggctgatgctggcacctactactgtgtgaagttcatcaagggccgggccatcaaggagtaccagagcggccggggcacccaggtgtttgtgacagctgagcagaaccccaggcctcccaagaacagacctgctggccgggccggcagccgggcccaccatgatgcccacacctgcctgagcgccctgcctgagaggaacagcaccaactactttgtgcagccctgctgctgcctgcggctgctgggcctgaccggcctgctgagcaagtag

SEQ ID NO: 7589 - DNA, 594 bp, Artificial Sequence
  Description of Artificial Sequence: Synthetic coding sequence
atgcccatcccagccagccccctgcacccccccctgcccagcctgctgctgtacctgctgctggagctggccggcgtgacccacgtgttccacgtgcagcagacagagatgagccagacagtgtccactggagagagcatcatcctgagctgcagcgtgcccaacaccctgcccaatggacctgtgctgtggttcaagggcaccggccccaacaggaagctgatctacaacttcaagcagggcaacttcccccgggtgaaggagattggagacaccaccaagccaggcaacacagacttcagcacccgcatccgggagatcagcctggctgatgctggcacctactactgtgtgaagttcatcaagggccgggccatcaaggagtaccagagcggccggggcacccaggtgtttgtgacagagcagaacccccggccccccaagaacagacctgctggccgggccggcagccgggcccaccatgatgcccacacctgcctgagcgccctgcctgagaggaacagcaccaactactttgtgcagccctgctgctgcctgcggctgctgggcctgaccggcctgctgagcaagtag

SEQ ID NO: 7590 - DNA, 1563 bp, Artificial Sequence
  Description of Artificial Sequence: Synthetic coding sequence
atgaccacagatgacacagaggtgcctgccatgaccctggcccctggccacgccgccctggagacccagaccctgtctgctgagaccagcagccgggccagcaccccagctggccccatccctgaggccgagaccaggggggccaagaggatcagccctgcccgggagaccaggagcttcaccaagaccagccccaacttcatggtgctgattgccacctctgtggagaccagcgctgccagcggcagccctgagggcgccggcatgaccaccgtgcagaccatcaccggcagtgacccccgggaggccatctttgacaccctgtgcacagatgacatcagcgaggaggccaagaccctgaccatggacatcctgaccctggcccacaccagcacagaggccaagggcctgagcagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagctggagccctggcagtgatgtgaccctgctggccgaggccctggtgacagtgaccaacatcgaggtgatcaactgcagcatcacagaaattgagaccaccaccagcagcatccctggggccagtgacacagacctgatccccacagagggcgtgaaggccagcagcaccagtgaccccccagccctgcctgacagcaccaacaccaagccccacatcacagaggtgacagccagcgctgagaccctgagcacagctggcaccacagagagcgctgccccagatgccaccatcggcacccccctgcccaccaacagcaccatcgagcgggaggtgacagcccctggggccaccaccctgagcggggccctggccactggaaaccccctggaggagaccagcgccctgtctgtggagacccccagctatgtgaaggtgtctggggccgcccctgtgtccattgaagctggcagcgctgtgggcaagaccaccagctttgctggcagcagcgccagcagctacagccccctggaggccgccctgaagaacttcacccccagcgagaccctgaccacagacatcgccaccaagggccccttccccaccagccgggaccccctgcccagcgtgccccccaccaccaccaacagcagccggggcaccaacagcaccctggccaagatcaccaccagcgccaagaccaccatgaagcccccaacagccacccccaccacagcccggacccggcccaccacagatgtgtctgctggagaaaatggaggcttcctgctgctgcggctgtctgtggccagccctgaggacctgacagacccccgggtggccgagcggctgatgcagcagctgcaccgggagctgcacgcccacgccccccacttccaggtgtccctgctgcgggtgcggcggggctag

SEQ ID NO: 7591 - DNA, 600 bp, Artificial Sequence
  Description of Artificial Sequence: Synthetic coding sequence
atgctgtggaggcagctgatctactggcagctgctggccctcttcttcctgcccttctgcctgtgccaggatgagtacatggagagcccccagacaggaggcctgcccccagactgcagcaagtgctgccaccacggcaacaacggcaacaatggagccaccggccacaagggggagaagggctacccaggcatccccccagagctgcagatcgccttcatggccagcctggccacccacttcagcaaccagaacagcggcatcatcttcagctctgtggagaccaacatcggcaacttctttgatgtgatgacaggccgctttggagcccctgtgtctggagtgtacttcttcaccttctccatgatgaagcatgaagatgtggaggaggtgtatgtgtacctgatgcacaacggcaacacagtgttctccatgtacagctatgagatgaagggcaagagtgacaccagcagcaaccacgctgtgctgaagctggccaagggagatgaggtgtggctgaggatgggaaatggagccctgcatggagaccaccagcgcttcagcacctttgctggcttcctgctgtttgagaccaagtag

SEQ ID NO: 7592 - DNA, 960 bp, Artificial Sequence
  Description of Artificial Sequence: Synthetic coding sequence
atgctgtggaggcagctgatctactggcagctgctggccctcttcttcctgcccttctgcctgtgccaggatgagtacatggaggtgtctggccgcaccaacaaggtggtggcccgcatcgtgcagagccaccagcagacaggccgcagcggcagcagaagagagaaggtgcgggagaggagccaccccaagacaggaacagtggacaacaacaccagcacagacctgaagagcctgcggccagatgagctgccccaccctgaggtggatgacctggcccagatcaccaccttctggggccagagcccccagacaggaggcctgcccccagactgcagcaagtgctgccacggggactacagcttccggggctaccagggccccccaggccccccaggccccccaggcatccctggcaaccacggcaacaacggcaacaatggagccaccggccacgagggcgccaagggggagaagggggacaagggggacctgggccccagaggagagcggggccagcacggccccaagggggagaagggctacccaggcatccccccagagctgcagatcgccttcatggccagcctggccacccacttcagcaaccagaacagcggcatcatcttcagctctgtggagaccaacatcggcaacttctttgatgtgatgacaggccgctttggagcccctgtgtctggagtgtacttcttcaccttctccatgatgaagcatgaagatgtggaggaggtgtatgtgtacctgatgcacaacggcaacacagtgttctccatgtacagctatgagatgaagggcaagagtgacaccagcagcaaccacgctgtgctgaagctggccaagggagatgaggtgtggctgaggatgggaaatggagccctgcatggagaccaccagcgcttcagcacctttgctggcttcctgctgtttgagaccaagtag

SEQ ID NO: 7593 - DNA, 855 bp, Artificial Sequence
  Description of Artificial Sequence: Synthetic coding sequence
atgaccaagagcagcctgcggcccctgcagaagcagagcccccagacaggaggcctgcccccagactgcagcaagtgctgccacggggactacagcttccggggctaccagggccccccaggccccccaggccccccaggcatccctggcaaccacggcaacaatggaaacaacggggccactggacatgaaggagccaagggggagaagggggacaagggggacctgggccccagaggagagcggggccagcacggccccaagggggagaagggctacccaggcatccccccagagctgcagatcgccttcatggccagcctggccacccacttcagcaaccagaacagcggcatcatcttcagctctgtggagaccaacatcggcaacttctttgatgtgatgacaggccgctttggagcccctgtgtctggagtgtacttcttcaccttctccatgatgaagcatgaagatgtggaggaggtgtatgtgtacctgatgcacaatggaaacacagtgttctccatgtacagctatgagatgaagggcaagagtgacaccagcagcaaccacgctgtgctgaagctggccaagggagatgaggtgtggctgaggatgggaaatggagccctgcacggggaccaccagcgcttcagcacctttgctggcttcctgctgtttgagaccaagtgccacggggagaccccagctggcccccgggacagcgctgctgggaagagcaaggcctacctgtgccaggccgagtggatctggcctgtgaggaagctgctgcctgtgtcctggccccgctaccagctgtttggatttgtgcgctggaaggagcagcacatctag

SEQ ID NO: 7594 - DNA, 234 bp, Artificial Sequence
  Description of Artificial Sequence: Synthetic coding sequence
atggccaccaggtctgtgctgctggccctggtggtgctgaacctgctcttctacgtgcccccaggccgcagcggccccaacgtgtacatccagaagatctttgccagctgctggaggctgcagggcacctgccggcccaagtgcctgaagaatgagcagtaccgcatcctgtgtgacaccatccacctgtgctgcgtgaaccccaagtacctgcccatcctgaccgggaagtag

SEQ ID NO: 7595 - DNA, 237 bp, Artificial Sequence
  Description of Artificial Sequence: Synthetic coding sequence
atgaacctgtgcctgagcgccctgctcttcttcctggtgatcctgctgcccagcggcaagggcatgtttggaaatgatggagtgaaggtgaggacctgcaccagccagaaggctgtgtgcttcttcggctgccccccaggctaccgctggatcgccttctgccacaacatcctgagctgctgcaagaacatgacccgcttccagcccccccaggccaaggacccctgggtgcactag

SEQ ID NO: 7596 - DNA, 627 bp, Artificial Sequence
  Description of Artificial Sequence: Synthetic coding sequence
atgggcgcccagggcgcccaggagagcatcaaggccatgtggagggtgcccggcaccaccaggaggcctgtgactggagagagccctggcatgcacaggcctgaggccatgctgctgctgctgaccctggccctgctgggcggccccacctgggccggcaagatgtatggccctgggggcggcaagtacttcagcaccacagaggactatgaccacgagatcaccggcctgcgggtgtctgtgggcctgctgctggtgaagtctgtgcaggtgaagctgggggacagctgggatgtgaagctgggcgccctgggcggcaacacccaggaggtgaccctgcagcctggagagtacatcaccaaggtgtttgtggccttccaggccttcctgcggggcatggtgatgtacaccagcaaggaccgctacttctactttgggaagctggatggccagatcagcagcgcctaccccagccaggagggccaggtgctggtgggcatctacggccagtaccagctgctgggcatcaagagcattggatttgagtggaactaccccctggaggagcccaccacagagccccctgtgaacctgacctacagcgccaacagccctgtgggccgctag

SEQ ID NO: 7597 - DNA, 288 bp, Artificial Sequence
  Description of Artificial Sequence: Synthetic coding sequence
atgaagttcctgctgctggtgctggccgccctgggcttcctgacccaggtgatcccagccagcgctgggggcagcaaatgtgtgagcaacaccccaggctactgcaggacctgctgccactggggcgagacagccctcttcatgtgcaatgccagcaggaagtgctgcatctcctacagcttcctgcccaagccagacctgccccagctgattggcaaccactggcagagcagaagaagaaacacccagaggaaggacaagaagcagcagaccaccgtgaccagctag

SEQ ID NO: 7598 - DNA, 339 bp, Artificial Sequence
  Description of Artificial Sequence: Synthetic coding sequence
atgtttgtgctgctgtatgtgaccagctttgccatctgtgccagcggccagccccggggcaaccagctgaagggggagaactacagcccccgctacatctgcagcatccctggcctgcccggccccccaggccccccaggggccaacggcagccctggcccccacggccgcatcggcctgcccggcagagatggaagagatggcaggaagggggagaagggggagaagggcacagctggcctgcggggcaagacaggccccctgggcctggccggggagaagggggaccagggcgagaccgggaagaagggccccatcggccctgagggggagaagtag

SEQ ID NO: 7599 - DNA, 300 bp, Artificial Sequence
  Description of Artificial Sequence: Synthetic coding sequence
atgggcctcttcatgatcatcgccatcctgctcttccagaagcccaccgtgacagagcagctgaagaagtgctggaacaactacgtgcagggccactgcaggaagatctgccgggtgaatgaggtgcctgaggccctgtgtgaaaatggccgctactgctgcctgaacatcaaggagctggaggcctgcaagaagatcaccaagccaccccggcccaagccagccaccctggccctgaccctgcaggactatgtgaccatcatcgagaacttccccagcctgaagacccagagcacctag

SEQ ID NO: 7600 - DNA, 336 bp, Artificial Sequence
  Description of Artificial Sequence: Synthetic coding sequence
atgaagagcctgctcttcaccctggccgtgttcatgctgctggcccagctggtgtctggcaactggtacgtgaagaagtgcctgaatgatgtgggcatctgcaagaagaagtgcaagccagaggagatgcacgtgaagaatggctgggccatgtgtgggaagcagagggactgctgcgtgcctgctgaccggcgggccaactaccctgtgttctgtgtgcagaccaagaccacccgcatcagcacagtgacagccaccacagccaccaccaccctgatgatgaccacagcctccatgagctccatggcccccacccctgtgagccccaccggctag

SEQ ID NO: 7601 - DNA, 1698 bp, Artificial Sequence
  Description of Artificial Sequence: Synthetic coding sequence
atggaggacagcgacagcgctgccaagcagctgggcctggccgaggccgctgctgtggccgctgctgctgctgtggccgctgctgctgctgctgctgctggaggagaggccgaggagcctgtgctgagcagagatgaggacagcgaggaggatgctgacagcgaggccgagcgggagaccccccgggtgacagctgtggccgtgatggctgctgagcccggccacatggacatgggcgctgaggccctgcccggcccagatgaagctgctgctgctgctgcctttgctgaggtgaccaccgtgacagtggccaacgtgggcgctgctgctgacaacgtgttcaccacctctgtggccaatgctgccagcatcagcggccacgtgctgagcggccgcacagccctgcagattggagacagcctgaacacagagaaggccaccctgattgtggtgcacacagatggcagcatcgtggagaccaccggcctgaagggccctgctgcccccctgaccccaggcccccagagcccccccacccccctggcccctggccaggagaagggcggcaccaagtacaactgggaccccagcgtgtatgattctgagctgcctgtgcgctgcaggaacatcagcggcaccctgtacaagaaccggctgggcagcggcggccggggccgctgcatcaagcagggcgagaactggtacagccccacagaatttgaggccatggccggccgggccagcagcaaggactggaagaggagcatccgctatgccggccggcccctgcagtgcctgatccaggacggcatcctgaacccccacgccgccagctgcacctgtgccgcctgctgtgatgacatgaccctgagcggccctgtgcggctgtttgtgccctacaagaggaggaagaaggaaaatgagctgcccaccacccctgtgaagaaggacagccccaagaacatcaccctgctgcctgccacagctgccaccaccttcaccgtgacccccagcggccagatcaccaccagcggggccctgacctttgaccgggccagcacagtggaggccacagctgtgatcagcgagagccctgcccagggagatgtgtttgctggggccaccgtgcaggaggcctctgtgcagcccccctgccgggccagccaccctgagccccactacccaggctaccaggacagctgccagatcgcccccttccctgaggccgccctgcccaccagccaccccaagatcgtgctgaccagcctgcctgccctggccgtgcccccacccacccccaccaaggccgcccccccagccctggtgaatggcctggagctgtctgagcccaggtcctggctgtacctggaggagatggtgaacagcctgctgaacacagcccagcagctgaagaccctgtttgagcaggccaagcacgccagcacctaccgggaggccgccaccaaccaggccaagatccatgctgatgctgagaggaaggagcagagctgtgtgaactgtggccgggaggccatgtctgagtgcaccggctgccacaaggtgaactactgcagcaccttctgccagaggaaggactggaaggaccaccagcacatctgtggccagagcgctgctgtgacagtgcaggctgatgaggtgcacgtggccgagagcgtgatggagaaggtgacagtgtag

SEQ ID NO: 7602 - DNA, 471 bp, Artificial Sequence
  Description of Artificial Sequence: Synthetic coding sequence
atgaacatcctgatgctgaccttcatcatctgtggcctgctgaccagggtgaccaagggcagctttgagccccagaagtgctggaagaacaacgtgggccactgcagaagacgctgcctggacacagagcgctacatcctgctgtgcaggaacaagctgagctgctgcatcagcatcatcagccatgagtacacccggcggcctgccttccctgtgatccacctggaggacatcaccctggactacagtgatgtggacagcttcaccggcagccctgtgtccatgctgaatgacctgatcacctttgacaccaccaagtttggagagaccatgaccccagagaccaacaccccagagaccaccatgcctccttctgaggccaccaccccagagaccaccatgcctccttctgaaacagccaccagcgagaccatgcccccacccagccagacagccctgacccacaactag

SEQ ID NO: 7603 - DNA, 837 bp, Artificial Sequence
  Description of Artificial Sequence: Synthetic coding sequence
atgggcggcccccgggccctgctggccgccctgtgggccctggaggccgccggcacagctgccctgcgcatcggggccttcaacatccagagctttggagacagcaaggtgtctgaccctgcctgtggcagcatcatcgccaagatcctggccggctatgacctggccctggtgcaggaggtgcgggaccctgacctgtctgctgtgtctgccctgatggagcagatcaacagcgtgtctgagcacgagtacagctttgtgagcagccagcccctgggccgggaccagtacaaggagatgtacctgtttgtgtacaggaaggatgctgtgtctgtggtggacacctacctgtacccagaccctgaagatgtgttcagccgggagccctttgtggtgaagttcagcgcccctggaacagcccagaacctggtgctgatccccctgcacgccgccccccaccaggccgtggccgagattgatgccctgtatgatgtgtacctggatgtgattgacaagtggggcacagatgacatgctgttcctgggggacttcaatgctgactgcagctatgtgcgggcccaggactgggccgccatccggctgcggagcagcgaggtgttcaagtggctgatcccagacagcgctgacaccaccgtgggcaacagcgactgtgcctatgacagaattgtggcctgtggggcccggctgcggcgcagcctgaagccccagagcgccaccgtgcatgacttccaggaggagtttggcctggaccagacccaggccctggccatcagtgaccacttccctgtggaggtgaccctgaagttccacaggtag

SEQ ID NO: 7604 - DNA, 3039 bp, Artificial Sequence
  Description of Artificial Sequence: Synthetic coding sequence
atggccgaggccgccctggaggccgtgcgctctgagctgcgggagttccctgctgctgcccgggagctgtgtgtgcccctggccgtgccctacctggacaagccacccacccccctgcacttctacagagactgggtgtgccccaaccggccctgcatcatcagaaatgccctgcagcactggccagccctgcagaagtggagcctgccctacttccgggccaccgtgggcagcacagaggtgtctgtggccgtgaccccagatggctatgcagatgctgtgcggggggaccgcttcatgatgcctgctgagcggcggctgcccctgagctttgtgctggatgtgctggagggccgggcccagcaccctggggtgctgtatgtgcagaagcagtgcagcaacctgcccagcgagctgccccagctgctgcctgacctggagagccacgtgccctgggccagcgaggccctgggcaagatgccagatgctgtgaacttctggctgggggaggccgctgctgtgaccagcctgcacaaggaccactatgaaaatctctactgtgtggtgtctggagagaagcacttcctgttccaccccccaagtgaccggcccttcatcccctatgagctgtacaccccagccacctaccagctgacagaggagggcaccttcaaggtggtggatgaggaggccatggagaaggccgaggtgtccaggacctgcctgctgactgtgcgggtgctgcaggcccaccggctgcccagcaaggacctggtgacccccagcgactgctacgtgaccctgtggctgcccacagcctgcagccaccggctgcagaccaggacagtgaagaacagcagcagccctgtgtggaaccagagcttccacttccgcatccaccggcagctgaagaatgtgatggagctgaaggtgtttgaccaggacctggtgactggagatgatcctgtgctgtctgtgctgtttgatgctggcaccctgcgggccggggagttcagaagagagagcttcagcctgagcccccagggcgagggccgcctggaggtggagttccggctgcagagcctggccgacagaggagagtggctggtgtccaatggagtgctggtggcccgggagctgagctgcctgcacgtgcagctggaggagaccggggaccagaagagcagcgagcaccgggtgcagctggtggtgcccggcagctgtgagggcccccaggaggcctctgtgggcaccggcaccttccgcttccactgcccagcctgctgggagcaggagctgagcatccggctgcaggatgcccctgaggagcagctgaaggcccccctgagcgccctgcccagcggccaggtggtgcggctggtgttccccaccagccaggagcccctgatgagggtggagctgaagaaggaggccggcctgcgggagctggccgtgcggctgggcttcggcccctgtgccgaggagcaggccttcctgagcaggaggaagcaggtggtggccgccgccctgcggcaggccctgcagctggatggagacctgcaggaggatgagatccctgtggtggccatcatggccactggaggcggcatccgggccatgaccagcctgtatggccagctggccggcctgaaggagctgggcctgctggactgtgtgtcctacatcactggagccagcggcagcacctgggccctggccaacctgtatgaagatcctgagtggagccagaaggacctggccggccccacagagctgctgaagacccaggtgaccaagaacaagctgggcgtgctggcccccagccagctgcagcgctaccggcaggagctggccgagcgggcccggctgggctaccccagctgcttcaccaacctgtgggccctgatcaatgaggccctgctgcatgatgagccccatgaccacaagctgagtgaccagcgggaggccctgagccacggccagaaccccctgcccatctactgtgccctgaacaccaagggccagagcctgaccacctttgaatttggagagtggtgtgagttcagcccctatgaggtgggcttccccaagtacggggccttcatccccagcgagctgtttggaagtgagttcttcatgggccagctgatgaagaggctgcctgagagccgcatctgcttcctggagggcatctggagcaacctgtatgctgccaacctgcaggacagcctgtactgggccagcgagcccagccagttctgggaccgctgggtgaggaaccaggccaacctggacaaggagcaggtgcccctgctgaagattgaggagccccccagcacagctggaagaattgctgagttcttcacagacctgctgacctggaggcccctggcccaggccacccacaacttcctgcggggcctgcacttccacaaggactacttccagcacccccacttcagcacctggaaggccaccaccctggatggcctgcccaaccagctgacccccagcgagccccacctgtgcctgctggatgtgggctacctgatcaacaccagctgcctgcccctgctgcagcccaccagagatgtggacctgatcctgagcctggactacaacctgcacggggccttccagcagctgcagctgctgggccgcttctgccaggagcagggcatccccttcccccccatcagccccagccctgaggagcagctgcagccccgggagtgccacaccttcagtgaccccacctgccctggggccccagctgtgctgcacttccccctggtgtctgacagcttccgggagtacagcgcccctggggtgcggaggaccccagaggaggccgctgctggggaggtgaacctgagcagcagtgacagcccctaccactacaccaaggtgacctacagccaggaggatgtggacaagctgctgcacctgacccactacaacgtgtgcaacaaccaggagcagctgctggaggccctgcggcaggccgtgcagaggcggcggcagaggcggccccactag

SEQ ID NO: 7605 - DNA, 1548 bp, Artificial Sequence
  Description of Artificial Sequence: Synthetic coding sequence
atggcctggccctacttcctggactgccaccgctacttcacccgggaggatgagggctgctatgaccccctggagaagctgcggggcggcctggaggctgatgaggccctgcccagcggcctgccccccaccttcatccgcttcagccaccacagctatgcccagatggtgcgggtgctgcggaggacagccagccgctgtgcccacgtggcccggacctacagcatcggccgcagctttgatggccgggagctgctggtgattgagttcagcagccggcccggccagcacgagctgatggagcctgaggtgaagctgattggcaacatccatggaaatgaggtggccggccgggagatgctgatctacctggcccagtacctgtgcagcgagtacctgctgggcaacccccgcatccagaggctgctgaacaccacccgcatccacctgctgcccagcatgaacccagatggctatgaggtggccgctgctgagggcgccggctacaacggctggaccagcggccggcagaatgcccagaacctggacctgaacagaaacttcccagacctgaccagcgagtactaccgcctggccgagaccaggggggcccggagtgaccacatccccatcccccagcactactggtggggcaaggtggcccctgagaccaaggccatcatgaagtggatgcagaccatcccctttgtgctgagcgccagcctgcatggaggagacctggtggtgtcctacccctttgacttcagcaagcacccccaggaggagaagatgttcagccccaccccagatgagaagatgttcaagctgctgagccgggcctatgcagatgtgcaccccatgatgatggacagaagtgaaaatagatgtggcggcaacttcctgaagaggggcagcatcatcaacggggctgactggtacagcttcaccggcggcatgtctgacttcaactacctgcacaccaactgctttgagatcaccgtggagctgggctgtgtgaagttccccccagaggaggccctgtacatcctgtggcagcacaacaaggagagcctgctgaactttgtggagaccgtgcaccggggcatcaagggcgtggtgacagacaagtttgggaagcctgtgaagaatgcccgcatctctgtgaagggcatcagacatgacatcaccacagccccagatggagactactggaggctgctgcccccaggcatccacatcgtgattgcccaggcccctggctacgccaaggtgatcaagaaggtgatcatcccagccaggatgaagagagctggccgggtggacttcatcctgcagcccctgggcatgggccccaagaacttcatccacggcctgcggaggacaggcccccatgaccccctgggcggggccagcagcctgggggaggccacagagccagaccccctgcgggcccggcggcagcccagcgcagatggcagcaagccctggtggtggagctacttcaccagcctgagcacccaccggccccgctggctgctgaagtactag

SEQ ID NO: 7606 - DNA, 285 bp, Artificial Sequence
  Description of Artificial Sequence: Synthetic coding sequence
atgaggaccctggccatcctggccgccatcctgctggtggccctgcaggcccaggccgagcccctgcaggcccgggcagatgaggtggccgccgcccctgagcagattgctgctgacatccctgaggtggtggtgtccctggcctgggatgagagcctggcccccaagcaccctggcagcaggaagaacatggcctgctactgccgcatcccagcctgcatcgccggggagcggcgctatggcacctgcatctaccagggccgcctgtgggccttctgctgctag

SEQ ID NO: 7607 - DNA, 420 bp, Artificial Sequence
  Description of Artificial Sequence: Synthetic coding sequence
atgggcaaccctgggggcgtgggcagcgagaggatgagggtggcccggaggaccagaaatgtgtgccgctgccccagggctgctggccctggggtgcctgagcccagggctgcccccctgcccctgctggccatggcccctcctccagcctgccgcagccccatgagccccccacctccacccctgctgctgctgctgctgagcctggccctgctgggcgcccgggcccgggcagagcctgctggcagcgctgtgcctgcccagagccggccctgtgtggactgccacgcctttgagttcatgcagagggccctgcaggacctgaggaagacagcctgcagcctggatgccaggacagagaccctgctgctgcaggccgagcggcgggccctgtgtgcctgctggccagctggccactag

SEQ ID NO: 7608 - DNA, 471 bp, Artificial Sequence
  Description of Artificial Sequence: Synthetic coding sequence
atggccccagctgtgacccggctgctcttcctgcagctggtgctgggccccaccctggtgatggacatcaagatgcagatcggcagcaggaacttctacaccctgagcattgactacccccgggtgaactaccccaagggcttccggggctactgcaatggcctgatgagctacatgaggggcaagatgcagaacagcgactgccccaagatccactacgtgatccacgccccctggaaggccatccagaagttctgcaagtacagcgacagcttctgtgagaactacaatgagtactgcaccctgacccaggacagcctgcccatcaccgtgtgcagcctgagccaccagcagccccccaccagctgctactacaacagcaccctgaccaaccagaagctgtacctgctgtgcagcaggaaatatgaggccgaccccatcggcattgctggcctgtacagcggcatctag

SEQ ID NO: 7609 - DNA, 444 bp, Artificial Sequence
  Description of Artificial Sequence: Synthetic coding sequence
atgatcatcatggtgatcatcttcctggtgctgctcttctgggagaatgaggtgaatgatgaggccgtgatgagcaccctggagcacctgcacgtggactacccccagaatgatgtgcctgtgcctgcccgctactgcaaccacatgatcatccagagggtcatccgggagccagaccacacctgcaagaaggagcacgtgttcatccacgagcggcccaggaagatcaatggcatctgcatcagccccaagaaggtggcctgccagaacctgagcgccatcttctgcttccagagcgagaccaagttcaagatgacagtgtgccagctgattgagggcacccgctacccagcctgccgctaccactacagccccacagagggctttgtgctggtgacctgtgatgacctgcggccagacagcttcctgggctacgtgaagtag

SEQ ID NO: 7610 - DNA, 453 bp, Artificial Sequence; identical to SEQ ID NO: 7139
  Description of Artificial Sequence: Synthetic coding sequence

SEQ ID NO: 7611 - DNA, 2742 bp, Artificial Sequence; identical to SEQ ID NO: 7141
  Description of Artificial Sequence: Synthetic coding sequence

SEQ ID NO: 7612 - DNA, 453 bp, Artificial Sequence; identical to SEQ ID NO: 7139
  Description of Artificial Sequence: Synthetic coding sequence

SEQ ID NO: 7613 - DNA, 567 bp, Artificial Sequence; identical to SEQ ID NO: 7502
  Description of Artificial Sequence: Synthetic coding sequence

SEQ ID NO: 7614 - DNA, 2535 bp, Artificial Sequence; identical to SEQ ID NO: 7302
  Description of Artificial Sequence: Synthetic coding sequence

SEQ ID NO: 7615 - DNA, 237 bp, Artificial Sequence; identical to SEQ ID NO: 7333
  Description of Artificial Sequence: Synthetic coding sequence

SEQ ID NO: 7616 - DNA, 2700 bp, Artificial Sequence; identical to SEQ ID NO: 7525
  Description of Artificial Sequence: Synthetic coding sequence

SEQ ID NO: 7617 - DNA, 2886 bp, Artificial Sequence; identical to SEQ ID NO: 7526
  Description of Artificial Sequence: Synthetic coding sequence

SEQ ID NO: 7618 - DNA, 2535 bp, Artificial Sequence; identical to SEQ ID NO: 7302
  Description of Artificial Sequence: Synthetic coding sequence

SEQ ID NO: 7619 - DNA, 2535 bp, Artificial Sequence; identical to SEQ ID NO: 7302
  Description of Artificial Sequence: Synthetic coding sequence

SEQ ID NO: 7620 - DNA, 2700 bp, Artificial Sequence; identical to SEQ ID NO: 7525
  Description of Artificial Sequence: Synthetic coding sequence

SEQ ID NO: 7621 - DNA, 2886 bp, Artificial Sequence; identical to SEQ ID NO: 7526
  Description of Artificial Sequence: Synthetic coding sequence

SEQ ID NO: 7622 - DNA, 2535 bp, Artificial Sequence; identical to SEQ ID NO: 7302
  Description of Artificial Sequence: Synthetic coding sequence

SEQ ID NO: 7623 - DNA, 3090 bp, Artificial Sequence
  Description of Artificial Sequence: Synthetic coding sequence
atgccacccaccaagtctgtgtctgagcctgtgccctttgaaacagaggcccccagcatgaccatcgtgcccaccacagacatcgagcctgtgacagtgaggacagaggccaccgtgaccaccctggcccccaagaccagccagaggaccaggacccggcggccccggcccaagcacaagaccacccccaggcctgagaccctgcagaccaagctggactttggccccatcaccccaggcaccagcagcgcccccaccaccaccaccaagaggacccggcggccccaccccaagcccaagaccaccccccaccctgaggtgccccagaccaagctggtgcctgccaccatcctggagcctgtgctgaggacagaggccagcggcaccacagctgtgcctgccaccatctttgagcctgtgagccccatcaaggaggcccctggcaccacctttgtgcctgtgacagacctggagcctgtgaccttcagaacagagatcccagccaccaccctggccaccaagaccagcaagaggaccaggcctccccggccccggcccaagaccacccccagcccccaggcccctgagaccaagcctgtgcctgccaccgtgctggagcctgtgaccctgcggcctgaggccagcaccaccctggccagcaagaccagccagaggacccggcggccccggctgcggaccaagaccacccccaggcctgaggcccctgagagcaagcctgtgcccacagctgagctgaagcctgtgaccctgaggacagagacctgggtgaccacccaggcccccaagaccagccagaggacccggcggccccggcccaagaccaagaccacccccagccctgaggtgccccagaccaagctggtgcccagcacagacctggagcccggcaccctgaggacagaggcccccaagaccatggtggtgaccaccgtgctggagccagacaccttccgcaccaagtttcctgagaccaccctggcccccaagacccagaggacccggcggccccggccccggcccaagaccaccagcagccctgaggtgccccagaacaagtctgtgtctgtgacaggctttgagcctgtggtgcacagcacagatgcccctggcaccacctttgccctgacagagctgcagaccctcatcctgaagcctgtgaccagccccagcctggagatgacagagagccagcctgtgtctgatgtgctggagagcgtgaccctgagcacagagagccccaaggagaccatcgccccagccaagacagattatgtgtaccccacagccaaggcccccctgtggccagaggagcccaagacagaggtggtggagagcatcacctacgtgtctgagcccccagagaccaccctggagaccagccccctgcccagccagagcatcaccctgcccagcccagatgagccccagacagagcccgcccccaagcagaccccccgggccccacccaagcccaagaccagcccccggccccgcatcccccagacccagcctgtgcccaaggtgccccagagggtgacagccaagcccaagaccagccccagccctgaggtgtcctacaccaccccagcccccaaggatgtgctgctgccccacaagccctacccagaggtgtcccagagcgagcccgcccccctggagacccggggcatccccttcatccccatgatcagccccagccccagccaggaggagctgcagaccaccctggaggagacagaccagagcacccaggagcccttcaccaccaagatccccaggaccacagagctggccaagaccacccaggccccccaccgcttctacaccaccgtgcggcccaggaccagtgacaagccccacatccggcctggggtgaagcaggccccccggcccagcggggctgacagaaatgtgtctgtggacagcacccaccccaccaagaagccaggcaccaggaggcctcccctgcccccccggcccacccaccccaggaggaagcccctgccccccaacaacgtgacaggcaagccaggcagcgctggcatcatcagcagcggccccatcaccaccccacccctgcggagcaccccccggcccaccggcacccccctggagcgcatcgagacagacatcaagcagcccaccgtgcctgccagcggggaggagctggagaacatcacagacttcagcagcagccccacccgggagacagaccccctgggcaagccccgcttcaagggcccccacgtgcgctacatccagaagccagacaacagcccctgcagcatcacagattctgtgaagcgcttccccaaggaggaggccacagagggcaatgccaccagccccccccagaacccccccaccaacctgactgtggtgacagtggagggctgccccagctttgtgatcctggactgggagaagcccctgaatgacacagtgacagaatatgaagtcatcagcagagaaaatggcagcttcagcggcaagaacaagagcatccagatgaccaaccagaccttcagcacagtggagaacctgaagcccaacaccagctatgagttccaggtgaagcccaagaaccccctgggggagggccctgtgagcaacacagtggccttcagcacagagagcgctgacccccgggtgtctgagcctgtgtctgctggaagagatgccatctggacagagcggcccttcaacagcgacagctacagtgaatgtaaaggcaagcagtatgtgaagaggacctggtacaagaagtttgtgggcgtgcagctgtgcaacagcctgcgctacaagatctacctgagtgacagcctgaccgggaagttctacaacatcggggaccagaggggccacggggaggaccactgccagtttgtggacagcttcctggatggccgcacaggccagcagctgaccagtgaccagctgcccatcaaggagggctacttccgggctgtgcggcaggagcctgtgcagtttggagaaattggaggccacacccagatcaactacgtgcagtggtatgaatgtggcaccaccatccctgggaagtggtag

SEQ ID NO: 7624 - DNA, 2355 bp, Artificial Sequence
  Description of Artificial Sequence: Synthetic coding sequence
atgaccatcgtgcccaccacagacatcgagcctgtgacagtgaggacagaggccaccgtgaccaccctggcccccaagaccagccagaggaccaggacccggcggccccggcccaagcacaagaccacccccaggcctgagaccctgcagaccaagctggactttggccccatcaccccaggcaccagcagcgcccccaccaccaccaccaagaggacccggcggccccaccccaagcccaagaccaccccccaccctgaggtgccccagaccaagctggcccccaaggtgccccagaggacccaccggccccaccccaagcccaagaccaccctgagccctgaggagctgcagacagagctggtgcctgtgacagacctggagcctgtgaccttcagaacagagatcccagccaccaccctggccaccaagaccagcaagaggaccaggcctccccggccccggcccaagaccacccccagcccccaggcccctgagaccaagcctgtgcctgccaccgtgctggagcctgtgaccctgcggcctgaggccagcaccaccctggccagcaagaccagccagaggacccggcggccccggctgcggaccaagaccacccccaggcctgaggcccctgagagcaagccagcccccaagcagaccccccgggccccacccaagcccaagaccagcccccggccccgcatcccccagacccagcctgtgcccaaggtgccccagagggtgacagccaagcccaagaccagccccagccctgaggtgtcctacaccaccccagcccccaaggatgtgctgctgccccacaagccctacccagaggtgtcccagagcgagcccgcccccctggagacccggggcatccccttcatccccatgatcagccccagccccagccaggaggagctgcagaccaccctggaggagacagaccagagcacccaggagcccttcaccaccaagatccccaggaccacagagctggccaagaccacccaggccccccaccgcttctacaccaccgtgcggcccaggaccagtgacaagccccacatccggcctgtgctgaacagaaccaccacccggcccacccggcccaagcccagcggcatgcccagcggaaatggagtgggcactggagtgaagcaggccccccggcccagcggggctgacagaaatgtgtctgtggacagcacccaccccaccaagaagccaggcacccggcggccccccctgcccccccggcccacccaccccaggaggaagcccctgccccccaacaacgtgacaggcaagccaggcagcgctggcatcatcagcagcggccccatcaccaccccacccctgcggagcaccccccggcccaccggcacccccctggagagaattgaaacagacatcaagcagcccaccgtgcctgccagcggggaggagctggagaacatcacagacttcagcagcagccccacccgggagacagaccccctgggcaagccccgcttcaagggcccccacgtgcgctacatccagaagccagacaacagcccctgcagcatcacagacagcgtgaagcgcttccccaaggaggaggccacagagggcaatgccaccagccccccccagaacccccccaccaacctgactgtggtgacagtggagggctgccccagctttgtgatcctggactgggagaagcccctgaatgacacagtgacagaatatgaggtgatcagccgggagaatggcagcttcagcggcaagaacaagagcatccagatgaccaaccagaccttcagcacagtggagaacctgaagcccaacaccagctatgagttccaggtgaagcccaagaaccccctgggggagggccctgtgagcaacacagtggccttcagcacagaatctgctgacccccgggtgtctgagcctgtgtctgctggaagagatgccatctggacagagcggcccttcaacagcgacagctacagcgagtgcaagggcaagcagtatgtgaagaggacctggtacaagaagtttgtgggcgtgcagctgtgcaacagcctgcgctacaagatctacctgagtgacagcctgaccgggaagttctacaacattggagaccagaggggccatggagaggaccactgccagtttgtggacagcttcctggatggccgcacaggccagcagctgaccagtgaccagctgcccatcaaggagggctacttccgggctgtgcggcaggagcctgtgcagtttggagagatcggcggccacacccagatcaactacgtgcagtggtatgaatgtggcaccaccatccctgggaagtggtag

SEQ ID NO: 7625 - DNA, 1584 bp, Artificial Sequence
  Description of Artificial Sequence: Synthetic coding sequence
atgctgatgctgtttgtgtttggagtgctgctgcacgaggtgtccctgagcggccagaatgaggccccacccaacacccacagcatccctggagagcccctgtacaactatgccagcatccggctgcctgaggagcacatccccttcttcctgcacaacaacagacacatcgccaccgtgtgcaggaaggacagcctgtgcccctacaagaagcacctggagaagctgaagtactgctggggctatgagaagagctgcaagccagagttccgcttcggctaccctgtgtgcagctatgtggacatgggctggacagacaccctggagagcgctgaggacatcttctggaagcaggccgactttggctacgcccgggagcggctggaggagatgcacgtgctgtgccagcccaaggagaccagtgacagcagcctggtgtgcagccgctacctgcagtactgccgggccaccaacctgtacctggacctgaggaacatcaagaggaaccacgaccgcttcaaggaggacttcttccagagcggggagattggaggccactgcaagctggacatccgcaccctgaccagcgagggccagaggaagagccccctgcagagctggtttgctgagctgcagagctacacccagctgaacttccggcccattgaagatgccaagtgtgacatcgtgattgagaagcccacctacttcatgaagctggatgctggggtgaacatgtaccaccacttctgtgacttcatcaacctgtacatcacccagcacgtgaacaacagcttcagcacagatgtgtacatcgtgatgtgggacaccagcagctatggctacggggacctcttcagtgacacctggaatgccttcacagattatgatgtgatccacctgaagacctatgacagcaagagggtgtgcttcaaggaggccgtgttcagcctgctgcccaggatgagatatggcctcttctacaacacccccctcatcagcggctgccagaacacaggcctcttccgggcctttgcccagcacgtgctgcaccggctgaacatcacccaggagggccccaaggatggcaagatccgggtgaccatcctggcccggagcacagagtacaggaagatcctgaaccagaatgagctggtgaatgccctgaagacagtgtccacctttgaggtgcagatcgtggactacaagtaccgggagctgggcttcctggaccagctgcgcatcacccacaacacagacatcttcatcggcatgcacggggccggcctgacccacctgctcttcctgcctgactgggccgctgtgtttgagctgtacaactgtgaagatgagcgctgctacctggacctggcccggctgcggggcgtgcactacatcacctggaggcggcagaacaaggtgttcccccaggacaagggccaccaccccaccctgggggagcaccccaagttcaccaactacagctttgatgtggaggagttcatgtacctggtgctgcaggccgctgaccacgtgctgcagcaccccaagtggcccttcaagaagaagcatgatgagctgtag

SEQ ID NO: 7626 - DNA, 2004 bp, Artificial Sequence; identical to SEQ ID NO: 7024
  Description of Artificial Sequence: Synthetic coding sequence

SEQ ID NO: 7627 - DNA, 1101 bp, Artificial Sequence
  Description of Artificial Sequence: Synthetic coding sequence
atgcccatgatctctgtgctgggcaagatgttcctgtggcagcgggagggccctgggggccgctggacctgccagaccagccggcgggtgtccagtgaccctgcctgggccgtggagtggattgagctgccccggggcctgagcctgagcagcctgggcagcgcccggaccctgcggggctggagccgcagcagccggcccagctctgtggacagccaggacctgcctgaggtgaatgtgggggacacagtggccatgctgcccaagagcagaagagccctgaccatccaggagattgctgccctggcccggagcagcctgcacggcatcagccaggtggtgaaggaccacgtgaccaagcccacagccatggcccagggccgggtggcccacctgattgagtggaagggctggagcaagcccagcgacagccctgctgccctggagagcgccttcagcagctacagcgacctgtctgagggggagcaggaggccaggtttgctgctggggtggccgagcagtttgccatcgccgaggccaagctgcgggcctggagctctgtggatggagaggacagcacagatgacagctatgatgaggactttgctgggggcatggacacagacatggccggccagctgcccctgggcccccacctgcaggacctcttcaccggccaccgcttcagcaggcctgtgcggcagggctctgtggagcctgagagtgactgcagccagacagtgtccccagacaccctgtgcagcagcctgtgcagcctggaggatggcctgctgggcagccctgcccggctggccagccagctgctgggagatgagctgctgctggccaagctgccccccagccgggagagcgccttccgcagcctgggccccctggaggcccaggacagcctgtacaacagccccctgacagagagctgcctgagccctgctgaggaggagcccgccccctgcaaggactgccagcccctgtgcccccccctgaccggctcctgggagcggcagaggcaggccagtgacctggccagcagtggagtggtgtccctggatgaagatgaagctgagcctgaggagcagtag

SEQ ID NO: 7628 - DNA, 5172 bp, Artificial Sequence
  Description of Artificial Sequence: Synthetic coding sequence
atgcagttccagctgaccctcttcctgcacctgggctggctgagctacagcaaggcccaggatgactgcaacagaggagcctgccaccccaccaccggggacctgctggtgggcaggaacacccagctgatggccagcagcacctgtggcctgagccgggcccagaagtactgcatcctgagctacctggagggggagcagaagtgcttcatctgtgacagccgcttcccctatgacccctatgaccagcccaacagccacaccattgaaaatgtgattgtgtcctttgagccagaccgggagaagaagtggtggcagagtgaaaatggcctggaccacgtgtccatccggctggacctggaggccctcttccgcttcagccacctgatcctgaccttcaagaccttccggcctgctgccatgctggtggagaggagcacagattatggccacaactggaaggtgttcaagtactttgccaaggactgtgccaccagcttccccaacatcaccagcggccaggcccagggcgtgggggacatcgtgtgtgacagcaagtacagcgacatcgagcccagcactggaggagaggtggtgctgaaggtgctggaccccagctttgaaattgagaacccctacagcccctacatccaggacctggtgaccctgaccaacctgcgcatcaacttcaccaagctgcacaccctgggagatgccctgctgggccggcggcagaatgacagcctggacaagtactactatgccctgtatgagatgattgtgcggggcagctgcttctgcaatggccacgcctctgaatgtcggcccatgcagaagatgagaggagatgtgttcagccccccaggcatggtgcacggccagtgtgtgtgccagcacaacacagatggccccaactgtgagcgctgcaaggacttcttccaggatgccccctggaggcctgctgctgacctgcaggacaatgcctgccgcagctgcagctgcaacagccacagcagccgctgccactttgacatgaccacctacctggccagcggcggcctgtctggaggagtgtgtgaggactgccagcacaacacagagggccagcactgtgaccgctgccggcccctcttctacagagaccccctgaagaccatcagtgacccctatgcctgcatcccctgtgaatgtgaccctgatggcaccatcagcggcggcatctgtgtgagccacagcgaccctgccctgggctctgtggccggccagtgcctgtgcaaggaaaatgtggagggcgccaagtgtgaccagtgcaagcccaaccactacggcctgagcgccacagaccccctgggctgccagccctgtgactgcaaccccctgggcagcctgcccttcctgacctgtgatgtggacaccggccagtgcctgtgcctgtcctatgtgactggagcccactgtgaggagtgcaccgtgggctactggggcctgggcaaccacctgcacggctgcagcccctgtgactgtgacatcggcggggcctacagcaatgtgtgcagccccaagaatggccagtgtgagtgccggccccacgtgacaggccgcagctgcagcgagcccgcccctggctacttctttgcccccctgaacttctacctgtatgaagctgaggaggccaccaccctgcagggcctggcccccctgggcagcgagaccttcggccagagccctgctgtgcacgtggtgctgggggagcctgtgcccggcaaccctgtgacctggacaggccctggctttgcccgggtgctgcctggagctggcctgcgctttgctgtgaacaacatccccttccctgtggacttcaccatcgccatccactatgagacccagagcgctgctgactggacagtgcagatcgtggtgaaccccccaggcggcagcgagcactgcatccccaagaccctgcagagcaagccccagagctttgccctgcctgctgccacccgcatcatgctgctgcccacccccatctgcctggagccagatgtgcagtacagcattgatgtgtacttcagccagcccctgcagggcgagagccacgcccacagccacgtgctggtggacagcctgggcctcatcccccagatcaacagcctggagaacttctgcagcaagcaggacctggatgagtaccagctgcacaactgtgtggagatcgccagcgccatgggcccccaggtgctgcccggggcctgtgagcggctcatcatctccatgtctgccaagctgcatgatggagctgtggcctgcaagtgccacccccagggctctgtgggcagcagctgcagccggctgggcggccagtgccagtgcaagcccctggtggtgggccgctgctgtgaccgctgcagcacaggcagctatgacctgggccaccacggctgccacccctgccactgccacccccagggcagcaaggacacagtgtgtgaccaggtgacaggccagtgcccctgccacggggaggtgtctggaagaagatgtgaccgctgcctggccggctacttcggcttccccagctgccacccctgcccctgcaacagatttgctgagctgtgtgaccctgagaccggcagctgcttcaactgtggcggcttcaccactggaagaaactgtgagcgctgcattgatggctactacggcaaccccagcagcggccagccctgccggccctgcctgtgcccagatgaccccagcagcaaccagtactttgcccacagctgctaccagaacctgtggagcagtgatgtgatctgcaactgcctgcagggctacacaggcacccagtgtggagaatgttccacaggcttctacggcaacccccgcatcagcggggccccctgccagccctgtgcctgcaacaacaacattgatgtgacagatcctgagagctgcagccgggtgactggagagtgcctgcgctgcctgcacaacacccagggcgccaactgccagctgtgcaagccaggccactacggcagcgccctgaaccagacctgccgccgctgcagctgccacgccagcggcgtgagccccatggagtgccccccaggcggcggggcctgcctgtgtgaccctgtgactggagcctgcccctgcctgcccaacgtgacaggcctggcctgtgacagatgtgctgatggctactggaacctggtgcccggccggggctgccagagctgtgactgtgaccccaggaccagccagagcagccactgtgaccagctgaccggccagtgcccctgcaagctgggctatggaggcaagcgctgcagcgagtgccaggagaactactacggggaccccccaggccgctgcatcccctgtgactgcaacagagctggcacccagaagcccatctgtgaccctgacaccggcatgtgccgctgccgggagggcgtgtctggccagagatgtgacagatgtgcccggggccacagccaggagttccccacctgcctgcagtgccacctgtgctttgaccagtgggaccacaccatcagcagcctgagcaaggctgtgcagggcctgatgaggctggccgccaacatggaggacaagcgggagaccctgcctgtgtgtgaggccgacttcaaggacctgcggggaaatgtgtctgaaattgagcgcatcctgaagcaccctgtgttccccagcggcaagttcctgaaggtgaaggactaccatgacagcgtgcggcggcagatcatgcagctgaatgagcagctgaaggctgtgtatgagttccaggacctgaaggacaccatcgagcgggccaagaatgaggccgacctgctgctggaggacctgcaggaggagattgacctgcagagctctgtgctgaatgccagcattgctgacagcagcgagaacatcaagaagtactaccacatcagcagcagcgctgagaagaagatcaatgagaccagcagcaccatcaacaccagcgccaacaccagaaatgacctgctgaccatcctggacaccctgaccagcaagggcaacctgagcctggagcggctgaagcagatcaagatcccagacatccagatcctgaatgagaaggtgtgtggggaccctggaaatgtgccctgtgtgcccctgccctgtggcggggccctgtgcaccggcaggaagggccacaggaagtgccggggccctggctgccacggcagcctgaccctgagcaccaatgccctgcagaaggcccaggaggccaagagcatcatccggaacctggacaagcaggtgcggggcctgaagaaccagatcgagagcatcagcgagcaggccgaggtgtccaagaacaatgccctgcagctgcgggagaagctgggcaacatccggaaccagagcgacagcgaggaggagaacatcaacctcttcatcaagaaggtgaagaacttcctgctggaggagaatgtgcccccagaagatattgagaaggtggccaacggggtgctggacatccacctgcccatccccagccagaacctgacagatgagctggtgaagatccagaagcacatgcagctgtgtgaggactacagaacagatgaaaatcggctgaatgaggaggctgatggagcccagaagctgctggtgaaggccaaggctgctgagaaggccgccaacatcctgctgaacctggacaagaccctgaaccagctgcagcaggcccagatcacccagggccgggccaacagcaccatcacccagctgacagccaacatcaccaagatcaagaagaatgtgctgcaggccgagaaccagacccgggagatgaagtctgagctggagctggccaagcagaggagcggcctggaggatggcctgagcctgctgcagaccaagctgcagaggcaccaggaccatgctgtgaatgccaaggtgcaggccgagagcgcccagcaccaggccggcagcctggagaaggagtttgtggagctgaagaagcagtatgccatcctgcagaggaagaccagcaccaccggcctgaccaaggagaccctgggcaaggtgaagcagctgaaggatgctgctgagaagctggccggggacacagaggccaagatccgccgcatcaccggctgcttccagaacagcgccaggtag

SEQ ID NO: 7629 - DNA, 5286 bp, Artificial Sequence
  Description of Artificial Sequence: Synthetic coding sequence
atgcagttccagctgaccctcttcctgcacctgggctggctgagctacagcaaggcccaggatgactgcaacagaggagcctgccaccccaccaccggggacctgctggtgggcaggaacacccagctgatggccagcagcacctgtggcctgagccgggcccagaagtactgcatcctgagctacctggagggggagcagaagtgcttcatctgtgacagccgcttcccctatgacccctatgaccagcccaacagccacaccattgaaaatgtgattgtgtcctttgagccagaccgggagaagaagtggtggcagagtgaaaatggcctggaccacgtgtccatccggctggacctggaggccctcttccgcttcagccacctgatcctgaccttcaagaccttccggcctgctgccatgctggtggagaggagcacagattatggccacaactggaaggtgttcaagtactttgccaaggactgtgccaccagcttccccaacatcaccagcggccaggcccagggcgtgggggacatcgtgtgtgacagcaagtacagcgacatcgagcccagcactggaggagaggtggtgctgaaggtgctggaccccagctttgaaattgagaacccctacagcccctacatccaggacctggtgaccctgaccaacctgcgcatcaacttcaccaagctgcacaccctgggagatgccctgctgggccggcggcagaatgacagcctggacaagtactactatgccctgtatgagatgattgtgcggggcagctgcttctgcaatggccacgcctctgaatgtcggcccatgcagaagatgagaggagatgtgttcagccccccaggcatggtgcacggccagtgtgtgtgccagcacaacacagatggccccaactgtgagcgctgcaaggacttcttccaggatgccccctggaggcctgctgctgacctgcaggacaatgcctgccgcagctgcagctgcaacagccacagcagccgctgccactttgacatgaccacctacctggccagcggcggcctgtctggaggagtgtgtgaggactgccagcacaacacagagggccagcactgtgaccgctgccggcccctcttctacagagaccccctgaagaccatcagtgacccctatgcctgcatcccctgtgaatgtgaccctgatggcaccatcagcggcggcatctgtgtgagccacagcgaccctgccctgggctctgtggccggccagtgcctgtgcaaggaaaatgtggagggcgccaagtgtgaccagtgcaagcccaaccactacggcctgagcgccacagaccccctgggctgccagccctgtgactgcaaccccctgggcagcctgcccttcctgacctgtgatgtggacaccggccagtgcctgtgcctgtcctatgtgactggagcccactgtgaggagtgcaccgtgggctactggggcctgggcaaccacctgcacggctgcagcccctgtgactgtgacatcggcggggcctacagcaatgtgtgcagccccaagaatggccagtgtgagtgccggccccacgtgacaggccgcagctgcagcgagcccgcccctggctacttctttgcccccctgaacttctacctgtatgaagctgaggaggccaccaccctgcagggcctggcccccctgggcagcgagaccttcggccagagccctgctgtgcacgtggtgctgggggagcctgtgcccggcaaccctgtgacctggacaggccctggctttgcccgggtgctgcctggagctggcctgcgctttgctgtgaacaacatccccttccctgtggacttcaccatcgccatccactatgagacccagagcgctgctgactggacagtgcagatcgtggtgaaccccccaggcggcagcgagcactgcatccccaagaccctgcagagcaagccccagagctttgccctgcctgctgccacccgcatcatgctgctgcccacccccatctgcctggagccagatgtgcagtacagcattgatgtgtacttcagccagcccctgcagggcgagagccacgcccacagccacgtgctggtggacagcctgggcctcatcccccagatcaacagcctggagaacttctgcagcaagcaggacctggatgagtaccagctgcacaactgtgtggagatcgccagcgccatgggcccccaggtgctgcccggggcctgtgagcggctcatcatctccatgtctgccaagctgcatgatggagctgtggcctgcaagtgccacccccagggctctgtgggcagcagctgcagccggctgggcggccagtgccagtgcaagcccctggtggtgggccgctgctgtgaccgctgcagcacaggcagctatgacctgggccaccacggctgccacccctgccactgccacccccagggcagcaaggacacagtgtgtgaccaggtgacaggccagtgcccctgccacggggaggtgtctggaagaagatgtgaccgctgcctggccggctacttcggcttccccagctgccacccctgcccctgcaacagatttgctgagctgtgtgaccctgagaccggcagctgcttcaactgtggcggcttcaccactggaagaaactgtgagcgctgcattgatggctactacggcaaccccagcagcggccagccctgccggccctgcctgtgcccagatgaccccagcagcaaccagtactttgcccacagctgctaccagaacctgtggagcagtgatgtgatctgcaactgcctgcagggctacacaggcacccagtgtggagaatgttccacaggcttctacggcaacccccgcatcagcggggccccctgccagccctgtgcctgcaacaacaacattgatgtgacagatcctgagagctgcagccgggtgactggagagtgcctgcgctgcctgcacaacacccagggcgccaactgccagctgtgcaagccaggccactacggcagcgccctgaaccagacctgccgccgctgcagctgccacgccagcggcgtgagccccatggagtgccccccaggcggcggggcctgcctgtgtgaccctgtgactggagcctgcccctgcctgcccaacgtgacaggcctggcctgtgacagatgtgctgatggctactggaacctggtgcccggccggggctgccagagctgtgactgtgaccccaggaccagccagagcagccactgtgaccagctgaccggccagtgcccctgcaagctgggctatggaggcaagcgctgcagcgagtgccaggagaactactacggggaccccccaggccgctgcatcccctgtgactgcaacagagctggcacccagaagcccatctgtgaccctgacaccggcatgtgccgctgccgggagggcgtgtctggccagagatgtgacagatgtgcccggggccacagccaggagttccccacctgcctgcagtgccacctgtgctttgaccagtgggaccacaccatcagcagcctgagcaaggctgtgcagggcctgatgaggctggccgccaacatggaggacaagcgggagaccctgcctgtgtgtgaggccgacttcaaggacctgcggggaaatgtgtctgaaattgagcgcatcctgaagcaccctgtgttccccagcggcaagttcctgaaggtgaaggactaccatgacagcgtgcggcggcagatcatgcagctgaatgagcagctgaaggctgtgtatgagttccaggacctgaaggacaccatcgagcgggccaagaatgaggccgacctgctgctggaggacctgcaggaggagattgacctgcagagctctgtgctgaatgccagcattgctgacagcagcgagaacatcaagaagtactaccacatcagcagcagcgctgagaagaagatcaatgagaccagcagcaccatcaacaccagcgccaacaccagaaatgacctgctgaccatcctggacaccctgaccagcaagggcaacctgagcctggagcggctgaagcagatcaagatcccagacatccagatcctgaatgagaaggtgtgtggggaccctggaaatgtgccctgtgtgcccctgccctgtggcggggccctgtgcaccggcaggaagggccacaggaagtgccggggccctggctgccacggcagcctgaccctgagcaccaatgccctgcagaaggcccaggaggccaagagcatcatccggaacctggacaagcaggtgcggggcctgaagaaccagatcgagagcatcagcgagcaggccgaggtgtccaagaacaatgccctgcagctgcgggagaagctgggcaacatccggaaccagagcgacagcgaggaggagaacatcaacctcttcatcaagaaggtgaagaacttcctgctggaggagaatgtgcccccagaagatattgagaaggtggccaacggggtgctggacatccacctgcccatccccagccagaacctgacagatgagctggtgaagatccagaagcacatgcagctgtgtgaggactacagaacagatgaaaatcggctgaatgaggaggctgatggagcccagaagctgctggtgaaggccaaggctgctgagaaggccgccaacatcctgctgaacctggacaagaccctgaaccagctgcagcaggcccagatcacccagggccgggccaacagcaccatcacccagctgacagccaacatcaccaagatcaagaagaatgtgctgcaggccgagaaccagacccgggagatgaagtctgagctggagctggccaagcagaggagcggcctggaggatggcctgagcctgctgcagaccaagctgcagaggcaccaggaccatgctgtgaatgccaaggtgcaggccgagagcgcccagcaccaggccggcagcctggagaaggagtttgtggagctgaagaagcagtatgccatcctgcagaggaagaccagcaccaccggcctgaccaaggagaccctgggcaaggtgaagcagctgaaggatgctgctgagaagctggccggggacacagaggccaagatccgccgcatcacagacctggagaggaagatccaggacctgaacctgagccggcaggccaaggctgaccagctgcgcatcctggaggaccaggtggtggccatcaagaatgaaattgtggagcaggagaagaagtatgcccgctgctacagctag

SEQ ID NO: 7630 - DNA, 1455 bp, Artificial Sequence
  Description of Artificial Sequence: Synthetic coding sequence
atgggcgctgaggccctgcccggcccagatgaggccgctgctgctgctgcctttgctgaggtgaccaccgtgacagtggccaacgtgggcgctgctgctgacaacgtgttcaccacctctgtggccaatgctgccagcatcagcggccacgtgctgagcggccgcacagccctgcagatcggggacagcctgaacacagagaaggccaccctcatcgtggtgcacacagatggcagcatcgtggagaccaccggcctgaagggccctgctgcccccctgaccccaggcccccagagcccccccacccccctggcccctggccaggagaagggcggcaccaagtacaactgggaccccagcgtgtatgacagcgagctgcctgtgcgctgcaggaacatcagcggcaccctgtacaagaaccggctgggcagcggcggccggggccgctgcatcaagcagggcgagaactggtacagccccacagaatttgaggccatggccggccgggccagcagcaaggactggaagaggagcatccgctatgccggccggcccctgcagtgcctgatccaggacggcatcctgaacccccatgctgccagctgcacctgtgccgcctgctgtgatgacatgaccctgagcggccctgtgcggctgtttgtgccctacaagaggaggaagaaggaaaatgagctgcccaccacccctgtgaagaaggacagccccaagaacatcaccctgctgcctgccacagctgccaccaccttcaccgtgaccccatctggccagatcaccaccagcggggccctgacctttgaccgggccagcacagtggaggccacagctgtgatcagcgagagccctgcccagggagatgtgtttgctggggccaccgtgcaggaggcctctgtgcagcccccctgccgggccagccaccctgagccccactacccaggctaccaggacagctgccagatcgcccccttccctgaggccgccctgcccaccagccaccccaagatcgtgctgaccagcctgcctgccctggccgtgcccccacccacccccaccaaggccgcccccccagccctggtgaatggcctggagctgtctgagcccaggtcctggctgtacctggaggagatggtgaacagcctgctgaacacagcccagcagctgaagaccctgtttgagcaggccaagcacgccagcacctaccgggaggccgccaccaaccaggccaagatccacgcagatgctgagaggaaggagcagagctgtgtgaactgtggccgggaggccatgtctgaatgtacaggctgccacaaggtgaactactgcagcaccttctgccagaggaagcgctggagcctgaccatgctgaccagcctggtgtccatctcctggctgcgggccatcctgccctgccagccccccaaggtgctgggcctgtag

SEQ ID NO: 7631 - DNA, 1512 bp, Artificial Sequence
  Description of Artificial Sequence: Synthetic coding sequence
atgtctggggccctgctgtggcccctgctgcccctgctgctgctgctgctgagcgccagagatggagtgcgggccgcccagccccaggcccctggctacctgattgctgcccccagcgtcttccgggccggcgtggaggaggtgatctctgtgaccatcttcaacagcccccgggaggtgacagtgcaggcccagctggtggcccagggcgagcctgtggtgcagagccagggcgccatcctggacaagggcaccatcaagctgaaggtgcccaccggcctgcggggccaggccctgctgaaggtgtggggccggggctggcaggccgaggagggccccctcttccacaaccagacctctgtgacagtggatggccgcggggcctctgtgttcatccagacagacaagcctgtgtaccggccccagcaccgggtgctgatcagcatcttcaccgtgagccccaacctgcggcctgtgaatgagaagctggaggcctacatcctggacccccggggcagcaggatgattgagtggaggcacctgaagcccttctgctgcggcatcaccaacatgtccttccccctgagtgaccagcctgtgctgggggagtggttcatctttgtggagatgcagggccacgcctacaacaagagctttgaggtgcagaagtatgtgctgcccaagtttgagctgctgattgatcctccccgctacatccaggacctggatgcctgtgaaacaggaacagtgcgggcccgctacaccttcggcaagcctgtggccggggccctgatgatcaacatgacagtgaatggagtgggctactacagccatgaggtgggccggcctgtgctgcggaccaccaagatcctgggcagccgggactttgacatctgtgtgcgggacatgatcccagcagatgtgcctgagcacttccggggccgggtgtccatctgggccatggtgacctctgtggatggcagccagcaggtggcctttgatgacagcacccctgtgcagaggcagctggtggacatccgctacagcaaggacaccaggaagcagttcaagccaggcctggcctacgtgggcaaggtggagctgagctacccagatggcagccctgctgagggcgtgacagtgcagatcaaggccgagctgacccccaaggacaacatctacaccagcgaggtggtgtcccagaggggcctggtgggctttgagatccccagcatccccaccagcgcccagcacgtgtggctggaggtgttccaggagctggaggactatgatgtgtctgacagctttggagtgtccagagaagatggccccttctggtgggccggcctgacagcccagaggagaagaagaagctctgtgttcccctggccctggggcatcaccaaggacagcggctttgccttcaccgtgagaagaggaaatggaactggaggagatgaccggcccagcgagcctgagcccccagctggccgctggcccctgcacaggtag

SEQ ID NO: 7632 - DNA, 144 bp, Artificial Sequence
  Description of Artificial Sequence: Synthetic coding sequence
atgaagctgtgtgtgacagtgctgagcctgctggtgctggtggccgccttctgcagcctggccctgagcgcccccaaggccagcaagagcgccctgacccctgtgtccccaggcagccgcagcacctgcatgacctggaactag

SEQ ID NO: 7633 - DNA, 861 bp, Artificial Sequence
  Description of Artificial Sequence: Synthetic coding sequence
atggaggtgtacatccgccacctggagaaggtgctgcggcgctacgtgcagaggctgcagtggctgctgagcggccctgtgctgtgcagcaggacctggtaccggcagagcatggacagaggagtgatgatgacagctgccagcggcagcagaagactctttggcaccgtgctggagagcaaggtgtgcatcctgctggacaccagcggctccatgggcccctacctgcagcaggtgaagacagagctggtgctgctgatctgggagcagctgaggaagtgctgtgacagcttcaacctgctgagctttgctgagagcttccagagctggcaggacaccctggtggagaccacagatgctgcctgccacgaggccatgcagtgggtgacccacctgcaggcccagggcagcaccagcatcctgcaggccctgctgaaggccttctccttccatgacctggagggcctgtacctgctgacagatggcaagccagacaccagctgcagcctggtgctgaatgaggtgcagaagctgcgggagaagagagatgtgaaggtgcacaccatcagcctgaactgcagcgacagagctgctgtggagttcctgaggaagctggccagcttcaccggcggccgctaccactgccctgtgggggaggacaccctgagcaagatccacagcctgctgaccaagggcttcatcaatgagaaggaccccaccctgcccccatttgaaggagatgacctgcgcatcctggcccaggagatcaccaaggcccgctccttcctgtggcaggcccagagcttccgcagccagctgcagaagaagaatgatgctgagcccaaggtgaccctgtcctag

SEQ ID NO: 7634 - DNA, 3555 bp, Artificial Sequence
  Description of Artificial Sequence: Synthetic coding sequence
atgaagaagtacaggaagatcagcatcggctgctttgccatggccacccagaccagccacgtgttccacggccaggagaacatgttcctggagaaccactgcatcagaagaaacacaggccgggacagcaagaagcccctgaagcagaagaacatgaatggcctgggccagaacagcgacaatggcctgctggtgacccacgtgaaccagacccaggacctgctgcggctgcagggcagcgagacccagagcagtgactgggaggacagcgaggactggctgagcgcccacagcctgaagtgccagaagctgaccctggccgacctgatcagccagggcacagaggtgctggaggagggcaccaacgtggtgcagaagatctgcttcagcacccagatcatccgccactttgagagcaagctgagtgacaccatcgaggtgtaccaggagcgcatccagtggctgacagagaacagcaagaaggccttcggcctcatcaagggggcccgggtgtccatcctgattgatgtgtctgccatcagcagcggcccccagaaggaggagttccagaaggacctgatgagcctgattgatgagcagctgagccacaaggagaagctgtttgtgctgagctttggcaccaatgccggcagcctgtggccagaccccatggaggtgtctgccagcaccctgcaggagctgaagctgtgggtgaagaccctgcagccagatggcggcagcaacctgctgcaggccctgaagaagatcttcaccctgaagggcctggacagcctggtggccatcatgaggagctgcccagaccagcccagcgagatcctgagtgactacatccagcagagcaccatgggccgggacctgatcatccacttcatcacctaccgctgtgatgaccagatgcctcctgctgtgctgaagaacctggccgaggccgtgcggggctactaccactgctacagccccaagatggagcactacaccagccgggacatggatgagctgctggccgagatccagaaggcccagagcctgctgagccacgtgcaggccctgcagcacagcagcccctgtgaggccctgacctgcaccatggaggagatcagcacagagatcaccaacggccccctcatcagcctgctgcccaagccacccaagcatgatgcccccctgaccatcgagttccccaacctggacaagaccagcgctgagtggctgaaggtgaatggcctgaaggccaagaagctgagcctgtaccaggtgctggccccaaatgccttcagccctgtggaggagtttgtgcccatcctgcagaagacagtgagcagcaccatccacgagaaggccatgatccagtttgagtggcatgatggcaccgtgaagaacatccacgtggacccccccttcctgtacaagtaccagcagcagctgagccgggccatgaggatgtatgaaagaagaattgagtggctgagcctggccagccgccgcatctggggcaccgtgtgtgagaagagggtggtggtgctgctggacatcagcgccaccaacagcatgtacatcatccacatccagcacagcctgcggctgctgctggaggagcagctgagcaacaaggactgcttcaacctgattgccttcggcagcaccatcgagagctggaggcctgagatggtgcctgtgagccacaacaacctgcagagcgcctggcgctgggccctgaacctgcgctgccggggcagcagaaatgtgctgagcgccctgaggaaggctgtggaggtggacttcaaggacaaggacaagcaccagagccagggcatctacctgttcaccggcggcatcccagaccaggacatgcccaccctgagcgcctacatggccgaggcctgtggcggctgtgacctgcagctgaatgtgtgcctcttctacgtgggggagcccaagatggacaccaccccaccagcccgctatgccagccacacagacacagctgctgcctacaaggaggtgaccagggctgctgggggccgcttccactggtttggagacaccggcatctatgaaagtgatgacatcaacagcatcatgtctgagatggagaaggccctgaactacagccagaagtgtgccttcctgatggccagcctgaagaaccacagcggcaaggtgctgggcagcagcgccctgcccaaggagaagcccaagaccctgcagctgcggagccagcccaagaagctgtgccccccccggcccaccgtgcccctgggcgccaggatgagcatcaaggatgatcctgaccgggagaagagcccccccctgaagagcctgaagtggaggcccctgagcagccgggtgggcatcagccctgctgctgcccagcccaccaaggagggcatgatggagctgcggaggaagaccaagagccgggaggccgagaccagcctgctgctcttctacacagagaagggaaatgatgtgggctctgtgtacaagaagtacccccagggccggggcctgcggaggaccagcagcagcattgacctgcccaggaaggacacagtgtgcagcagccaggagtgggtggccaagtatggcctgaagaagctgaagctggagatcagccgctgcatgggccccaactgcacccaccagaagagcggccagaggtctgccagcgccaagcactgcagcatcttccccagcgtggagatccacggcgtggtgcgccacatccagtggaccccccgggagatggaggtgtacatccgccacctggagaaggtgctgcggcgctacgtgcagaggctgcagtggctgctgagcggcagcagaagactctttggcaccgtgctggagagcaaggtgtgcatcctgctggacaccagcggctccatgggcccctacctgcagcaggtgaagacagagctggtgctgctgatctgggagcagctgaggaagtgctgtgacagcttcaacctgctgagctttgctgagagcttccagagctggcaggacaccctggtggagaccacagatgctgcctgccacgaggccatgcagtgggtgacccacctgcaggcccagggcagcaccagcatcctgcaggccctgctgaaggccttctccttccatgacctggagggcctgtacctgctgacagatggcaagccagacaccagctgcagcctggtgctgaatgaggtgcagaagctgcgggagaagagagatgtgaaggtgcacaccatcagcctgaactgcagcgacagagctgctgtggagttcctgaggaagctggccagcttcaccggcggccgctaccactgccctgtgggggaggacaccctgagcaagatccacagcctgctgaccaagggcttcatcaatgagaaggaccccaccctgcccccatttgaaggagatgacctgcgcatcctggcccaggagatcaccaaggcccgctccttcctgtggcaggcccagagcttccgcagccagctgcagaagaagaatgatgctgagcccaaggtgaccctgtcctag

SEQ ID NO: 7635 - DNA, 906 bp, Artificial Sequence; identical to SEQ ID NO: 6929
  Description of Artificial Sequence: Synthetic coding sequence

SEQ ID NO: 7636 - DNA, 4722 bp, Artificial Sequence
  Description of Artificial Sequence: Synthetic coding sequence
atgagggtgctggcctgcctgctggccgccctggtgggcatccaggccgtggagcggctgcggctggctgatggcccccacggctgtgccggccgcctggaggtgtggcatggaggccgctggggcaccgtgtgtgatgatggctgggacctgagagatgctgctgtggcctgccggcagctgggctgcggcggggccctggccgcccctgggggcgccttctttggagagggcgccggccctgtgtggctgtctgagctggcctgcagaggaaatgaaggccagctgggcctgtgccaccaccggggctggaaggcccacatctgcagccatgaagaagatgctggggtggtgtgtgccggccagagggtggccaacagcagagatgacagcaccagccccctggatggagccccctggccaggcctgctgctggagctgagccccagcacagaggagcccctggtgacccacgcccccaggcctgctggcaacccccagaatgccagcaggaagaagagcccccggcccaagcaggccaagagcacccgggcccccctgctgaccaccggggccccccggcaggagcggctgcggctggtgtctggcccccaccgctgtgccggccgcctggaggtgtggcatggaggccgctggggcaccgtgtgtgatgatggctgggacctgagagatgctgctgtggcctgccgggagctgggctgcggcggggccctggccgcccctgggggcgccaggtttggacctggagctggccctgtgtggatggatgatgtgggctgcggcggcggggagcaggccctgcgggactgccccaggagcccctggggccgcagcaactgtgaccacagtgaagatgctggcctggtgtgcaccggccctgccccccggctgcggctggctgatggcccccacggctgtgccggccgcctggaggtgtggcatggaggccgctggggctctgtgtgtgatgatgcctgggacctgagagatgctgctgtggcctgccgggagctgggctgcggcggggccctggccgcccctgggggcgccttctttggagagggcagcggccccatcatcctggatgacctgcgctgcagaggaaatgaaacagccctgcgcttctgcccagcccggccctggggccagcacgactgccaccacagagaagatgctggagctgtgtgtgatggcatgcccctgggctacgtgcccccaacagcccccacagacagcaacaacagcaccccccgggaggccgccagcaggcctcccagcaccatgaccagccaggcccctggaacagctggggtgtccccacctccagccagccccaccgtgctgtgggagcccggccctgaggccggcagcccccagctgcggctggtggccggccccagcaaatgttctggccgcctggaggtgtggcatgaccagcgctggggcaccgtgtgtgatgacagctgggacatgagggacagcgctgtggtgtgccgggagctgggctgcggcggcccccagcagcctgaccctgctgctggccgcttcggctggggcgccggccccatctggctggatgatgtgggctgtgtgggcacagaggccagcctgagtgactgcccagctgccccctggggcaagcacaactgtgcccacaatgaagatgtgggcgtgacctgcaccggccccccaggcctggacagcatcagtgaccccttctcctggagctggatccctggcctgggccgggacagagatgcctggctgcctggagagctggccaccaagcccagcgcctctgtgacagcctctgtgctggagaagaccaccaccaaggcccctgggaagatgcccaagagcaccaagaagtgggtgaccaagaatgccaagaggcccaccacccagccccctgtgatgcccaccaccaagcacagccgggcccagagccccccagacctgaccagccagaccacagctgccctgaccacagaggccagccggcggcccaccagcgagttcacccggcggcccaccacagaggccccccagcgctggaccagccacaccacagccaccctgaccccccaggccccccgggagaggaccaccaagaccatggccatgctgaccacccagggcccccaggagatgaccagcgagagcaccatcaagagcatcccccaggccagcctggagcccagcgctgagatccctgagggcagccctgagagccccaaggaccctgcccccagccccagcgtgtccaccaccggggagagcggcctcttccgggtgcggctggctgatggccccaacagatgtgccggccgcctggaggtgtggcacgccggccgctggggcaccgtgtgtgatgacaactgggacctgagagatgccaccgtggcctgctgggagctgggctgcggcaaggtgcggccccgggtgggcaagacccactacggccctggcaccggccccatctggctggatgacatgggctgcaagggcagcgaggccagcctgagtgactgccccagcggggcctggggcaagcacaactgtgaccatgaagaagatgtgggcctgacctgcaccggctacacagattatgatgactacccaccctggacctgggaccccaccagccgggaggacctggccaagggcaccaccacagctggggtgcccggccacaccctgccctggaggaccaccaggaggcctggcagcagcagccctgccatccggcggctgcctgacaccggcagcaaggatggctacaagctgccctggacctgggacacccccagcggccggggcctggccgagggcacccccacagctgggaagctgggccccaccctgggcgccggcaccaccaggagccctggcagcccccccaccctgcgggtgcatggagacaccggcagccccaggaagccctggccagagcggcggccccccaggcctgctgccaccaggacagccccacccacccccagccctggccccagcgccagccctggccccccaggccctgccctgaccagtgacagcagccgggagctgaccccccacagcgccctgaccagcgaggccaccagtgatgccccagacaccagcccccccaccccagaccctgccagcaggaccaacccagacctgatcctgaccagcccagactttgccctgagcaccccagacagctctgtggtgcctgccctgaccccagagcccagccccacccccctgcccaccctgcccaaggagctgaccagtgaccccagcacccccagcgaggtgaccagcctgagccccaccagcgagcaggtgcctgagagtgacaccaccccagacctggacaccaccccctacagcagcacagtgtctgagtacagccgcagcccagaccccagccccagcccccaccccaccaccaccccagaccccaccatggccccagaccccatcaccaccctgaaccccaccgtgaccccccacttccccaccaccccccaccccaccaccaccccccaccccaccaccatcacccacagcaccatgatcccagaccccaccaccaccccccagcccttcaccaccatcacccacagcaccatgatcccagaccccaccaccaccccccagcccttcaccaccatgcagcccaccaccaccccccacagcaccaccccccaccccaccaccaccccccaccccaccaccatcacccacagcaccatgatcccagaccccaccaccaccccccagcccttcaccaccatgcagcccaccaccatgccccaccccaccaccaccccccaccccaccaccaccccccaccccaccaccaccccccaccccaccaccaccccccaccccaccatgaccccagaccccaccaccaccccctaccccaccaccaccccagaccccaccaccaccccccaccccaccaccccagaccccagcagcacccctgtgatcaccaccgtgtccctgcccaccagcctgggcacagagctgagcagccccaccctggcccccaccgtgaagcccagcctgcacccccagctgaccttcaccgccccagccccccacaccagcaccagccagatccccaccctggagcccagccctgccctggagagcagccccagccgcagcagcacagccacctccatggaccccctgagcacagaggacttcaagccacccaggagccagagccccaacctgaccccaccacccacccacaccccccacagcgccagtgacctgactgtgtccccagaccccctgctgagccccacagcccaccccctggaccacccccccctggaccccctgaccctgggccccaccccaggccagagccctggcccccacggcccctgtgtggcccccaccccacctgtgcgggtgatggcctgtgagcccccagccctggtggagctggtggccgctgtgagagatgtgggcggccagctgcagaggctgacccaggtggtggagcaggagcggcaggagcggcaggccctgctgctgggcctgacccagctggtggaggccgcccggggcctgggccagctgggggaggccgtgaagaggctggccgagatggcctggaccacctccatgcctgcccccaccaccaccaccccagaggaggaggagcggcccctgcggggagatgtgtag

SEQ ID NO: 7637 - DNA, 1911 bp, Artificial Sequence; identical to SEQ ID NO: 7237
  Description of Artificial Sequence: Synthetic coding sequence

SEQ ID NO: 7638 - DNA, 2037 bp, Artificial Sequence
  Description of Artificial Sequence: Synthetic coding sequence
atgaggacagtggtgctgaccatgaaggcctctgtgattgagatgttcctggtgctgctggtgactggagtgcacagcaacaaggagacagccaagaagatcaagaggcccaagttcaccgtgccccagatcaactgtgatgtgaaggccggcaagatcatcgaccctgagttcatcgtgaagtgcccagctggctgccaggaccccaagtaccacgtgtatggaacagatgtgtatgccagctacagctctgtgtgtggggctgctgtgcacagcggcgtgctggacaacagcggcggcaagatcctggtgaggaaggtggccggccagagcggctacaagggcagctacagcaatggagtgcagagcctgagcctgccccgctggagggagagcttcatcgtgctggagagcaagcccaagaagggcgtgacctaccccagcgccctgacctacagcagcagcaagagccctgctgcccaggccggggagaccaccaaggcctaccagaggcctcccatccctggcaccacagcccagcctgtgaccctgatgcagctgctggccgtgacagtggccgtggccacccccaccaccctgccccggcccagccccagcgctgccagcaccaccagcatcccccggccccagagcgtgggccacaggagccaggagatggacctgtggagcacagccacctacaccagcagccagaaccggcccagggctgaccccggcatccagaggcaggaccccagcggggccgccttccagaagcctgtgggcgcagatgtgtccctgggcctggtgcccaaggaggagctgagcacccagagcctggagcctgtgtccctgggggaccccaactgcaagattgacctgtccttcctgattgatggcagcaccagcatcggcaagaggcgcttccgcatccagaagcagctgctggctgatgtggcccaggccctggacatcggccctgctggccccctgatgggcgtggtgcagtatggagacaacccagccacccacttcaacctgaagacccacaccaacagccgggacctgaagacagccatcgagaagatcacccagagaggaggcctgagcaatgtgggccgggccatcagctttgtgaccaagaacttcttcagcaaggccaacggcaacagaagtggggcccccaacgtggtggtggtgatggtggatggctggcccacagacaaggtggaggaggccagccggctggcccgggagagcggcatcaacatcttcttcatcaccattgaaggagctgctgaaaatgagaagcagtatgtggtggagcccaactttgccaacaaggctgtgtgcaggaccaacggcttctacagcctgcacgtgcagagctggtttggcctgcacaagaccctgcagcccctggtgaagagggtgtgtgacacagaccggctggcctgcagcaagacctgcctgaacagcgctgacatcggctttgtgattgatggcagcagctctgtgggcaccggcaacttcagaacagtgctgcagtttgtgaccaacctgaccaaggagtttgagatcagtgacacagacacccgcatcggggctgtgcagtacacctatgagcagaggctggagtttggatttgacaagtacagcagcaagccagacatcctgaatgccatcaagagggtgggctactggagcggcggcaccagcactggagctgccatcaactttgccctggagcagctgttcaagaagagcaagcccaacaagaggaagctgatgatcctgatcacagatggccgctcctatgatgatgtgcgcatcccagccatggccgcccacctgaagggcgtcatcacctacgccatcggcgtggcctgggccgcccaggaggagctggaggtgattgccacccacccagcccgggaccacagcttctttgtggatgaatttgacaacctgcaccagtatgtgccccgcatcatccagaacatctgcacagagttcaacagccagcccagaaattag

SEQ ID NO: 7639 - DNA, 324 bp, Artificial Sequence
  Description of Artificial Sequence: Synthetic coding sequence
tgaacagtggccgcccccagcgtcttcatcttccccccatctgatgagcagctgaagagcggcacagcctctgtggtgtgcctgctgaacaacttctacccccgggaggccaaggtgcagtggaaggtggacaatgccctgcagagcggcaacagccaggagagcgtgacagagcaggacagcaaggacagcacctacagcctgagcagcaccctgaccctgagcaaggctgactatgagaagcacaaggtgtatgcctgtgaggtgacccaccagggcctgagcagccctgtgaccaagagcttcaacagaggagagtgctag

SEQ ID NO: 7640 - DNA, 366 bp, Artificial Sequence
  Description of Artificial Sequence: Synthetic coding sequence
atggtgctgcagacccaggtgttcatcagcctgctgctgtggatcagcggggcctatggagacatcgtgatgacccagagcccagacagcctggccgtgtccctgggggagcgggccaccatcaactgcaagagcagccagagcgtgctgtacagcagcaacaacaagaactacctggcctggtaccagcagaagccaggccagccccccaagctgctgatctactgggccagcacccgggagagcggcgtgcctgaccgcttcagcggcagcggcagcggcacagacttcaccctgaccatcagcagcctgcaggctgaagatgtggccgtgtactactgccagcagtactacagcaccccctag

SEQ ID NO: 7641 - DNA, 984 bp, Artificial Sequence
  Description of Artificial Sequence: Synthetic coding sequence
gccagcaccaagggccccagcgtcttccccctggccccctgcagccgcagcaccagcgagagcacagctgccctgggctgcctggtgaaggactacttccctgagcctgtgacagtgtcctggaacagcggggccctgaccagcggcgtgcacaccttccctgctgtgctgcagagcagcggcctgtacagcctgagctctgtggtgacagtgcccagcagcagcctgggcaccaagacctacacctgcaatgtggaccacaagcccagcaacaccaaggtggacaagagggtggagagcaaatatggccccccctgccccagctgcccagcccctgagttcctgggcggccccagcgtcttcctgttcccccccaagcccaaggacaccctgatgatcagcaggaccccagaggtgacctgtgtggtggtggatgtgtcccaggaggaccctgaggtgcagttcaactggtacgtggatggagtggaggtgcacaatgccaagaccaagccccgggaggagcagttcaacagcacctacagagtggtgtctgtgctgactgtgctgcaccaggactggctgaatggcaaggagtacaagtgcaaggtgagcaacaagggcctgcccagcagcattgagaagaccatcagcaaggccaagggccagccccgggagccccaggtgtacaccctgccccccagccaggaggagatgaccaagaaccaggtgtccctgacctgcctggtgaagggcttctaccccagcgacattgctgtggagtgggagagcaatggccagcctgagaacaactacaagaccaccccacctgtgctggacagtgatggcagcttcttcctgtacagccggctgactgtggacaagagccgctggcaggagggcaatgtgttcagctgcagcgtgatgcatgaggccctgcacaaccactacacccagaagagcctgagcctgagcctgggcaagtag

SEQ ID NO: 7642 - DNA, 981 bp, Artificial Sequence
  Description of Artificial Sequence: Synthetic coding sequence
gccagcaccaagggccccagcgtcttccccctggccccctgcagccgcagcaccagcgagagcacagctgccctgggctgcctggtgaaggactacttccctgagcctgtgacagtgtcctggaacagcggggccctgaccagcggcgtgcacaccttccctgctgtgctgcagagcagcggcctgtacagcctgagctctgtggtgacagtgcccagcagcaactttggcacccagacctacacctgcaatgtggaccacaagcccagcaacaccaaggtggacaagacagtggagaggaagtgctgcgtggagtgccccccctgcccagcccctcctgtggccggccccagcgtcttcctgtttcctcccaagcccaaggacaccctgatgatcagcaggaccccagaggtgacctgtgtggtggtggatgtgtcccatgaggaccctgaggtgcagttcaactggtacgtggatggagtggaggtgcacaatgccaagaccaagccccgggaggagcagttcaacagcaccttccgggtggtgtctgtgctgactgtggtgcaccaggactggctgaatggcaaggagtacaagtgcaaggtgagcaacaagggcctgcctgcccccatcgagaagaccatcagcaagaccaagggccagccccgggagccccaggtgtacaccctgccccccagccgggaggagatgaccaagaaccaggtgtccctgacctgcctggtgaagggcttctaccccagcgacatctctgtggagtgggagagcaatggccagcctgagaacaactacaagaccaccccacccatgctggacagtgatggcagcttcttcctgtacagcaagctgactgtggacaagagccgctggcagcagggcaatgtgttcagctgcagcgtgatgcatgaggccctgcacaaccactacacccagaagagcctgagcctgagccctgggaagtag

SEQ ID NO: 7643 - DNA, 993 bp, Artificial Sequence
  Description of Artificial Sequence: Synthetic coding sequence
gccagcaccaagggccccagcgtcttccccctggcccccagcagcaagagcaccagcggcggcacagctgccctgggctgcctggtgaaggactacttccctgagcctgtgacagtgtcctggaacagcggggccctgaccagcggcgtgcacaccttccctgctgtgctgcagagcagcggcctgtacagcctgagctctgtggtgacagtgcccagcagcagcctgggcacccagacctacatctgcaatgtgaaccacaagcccagcaacaccaaggtggacaagaaggtggagcccaagagctgtgacaagacccacacctgccccccctgcccagcccctgagctgctgggcggccccagcgtcttcctgtttcctcccaagcccaaggacaccctgatgatcagcaggaccccagaggtgacctgtgtggtggtggatgtgtcccatgaggaccctgaggtgaagttcaactggtacgtggatggagtggaggtgcacaatgccaagaccaagccccgggaggagcagtacaacagcacctacagagtggtgtctgtgctgactgtgctgcaccaggactggctgaatggcaaggagtacaagtgcaaggtgagcaacaaggccctgcctgcccccatcgagaagaccatcagcaaggccaagggccagccccgggagccccaggtgtacaccctgccccccagcagagatgagctgaccaagaaccaggtgtccctgacctgcctggtgaagggcttctaccccagcgacattgctgtggagtgggagagcaatggccagcctgagaacaactacaagaccaccccacctgtgctggacagtgatggcagcttcttcctgtacagcaagctgactgtggacaagagccgctggcagcagggcaatgtgttcagctgcagcgtgatgcatgaggccctgcacaaccactacacccagaagagcctgagcctgagccctgggaagtag

SEQ ID NO: 7644 - DNA, 651 bp, Artificial Sequence; identical to SEQ ID NO: 7159
  Description of Artificial Sequence: Synthetic coding sequence

SEQ ID NO: 7645 - DNA, 762 bp, Artificial Sequence; identical to SEQ ID NO: 7063
  Description of Artificial Sequence: Synthetic coding sequence

SEQ ID NO: 7646 - DNA, 468 bp, Artificial Sequence
  Description of Artificial Sequence: Synthetic coding sequence
atgttccagaggctgctgctgctgctgctgctgtccatgggcggcacctgggccagcaaggagcccctgcggccccgctgccggcccatcaatgccaccctggccgtggagaaggagggctgccctgtgtgcatcaccgtgaacaccaccatctgtgccggctactgccccaccatgaccagggtgctgcagggcgtgctgcctgccctgccccaggtggtgtgcaactacagagatgtgcgctttgagagcatccggctgcccggctgcccccggggcgtgaaccctgtggtgtcctatgctgtggccctgagctgccagtgtgccctgtgccgccgcagcaccacagactgtggcggccccaaggaccaccccctgacctgtgatgacccccgcttccaggacagcagcagcagcaaggcccccccacccagcctgcccagccccagccggctgcccggcccctag

SEQ ID NO: 7647 - DNA, 1554 bp, Artificial Sequence
  Description of Artificial Sequence: Synthetic coding sequence
atggctgtgtccaggaaggactggagcgccctgagcagcctggcccggcagaggaccctggaggatgaggaggagcaggagcgggagaggagaagaagacacaggaacctgagcagcaccacagatgatgaggccccccggctgagccagaatggagaccggcaggccagcgccagcgagcggctgcccagcgtggaggaggccgaggtgcccaagcccctgcccccagccagcaaggatgaagatgaggacatccagagcatcctgcggacccggcaggagcggcggcagaggcggcaggtggtggaggccgcccaggcccccatccaggagcggctggaggccgaggagggcaggaacagcctgagccctgtgcaggccacccagaagcccctggtgtccaagaaggagctggagatccccccaagaagaaggctgagccgggagcagaggggcccctgggccctggaggaggagagcctggtgggccgggagcctgaggagaggaagaagggcgtgcctgagaagagccctgtgctggagaagagctccatgcccaagaagacagcccctgagaagagcctggtgtctgacaagaccagcatcagcgagaaggtgctggccagcgagaagaccagcctgtctgagaagattgctgtgtctgagaagaggaacagcagcgagaagaagtctgtgctggagaagacctctgtgtctgagaagagcctggcccctggcatggccctgggcagcggccgccgcctggtgtctgagaaggccagcatctttgagaaggccctggccagcgagaagagccccacagcagatgccaagccagcccccaagagggccacagccagcgagcagcccctggcccaggagcccccagccagcggcggcagccctgccaccaccaaggagcagaggggccgggccctgcccgggaagaacctgcccagcctggccaagcagggcgccagtgaccccccaacagtggccagccggctgccccctgtgaccctgcaggtgaagatccccagcaaggaggaggaggccgacatgagcagccccacccagaggacctacagcagcagcctgaagaggagcagccccaggaccatctccttcaggatgaagcccaagaaggaaaattctgagaccaccctgaccaggtctgcctccatgaagctgcctgacaacacagtgaagctgggggagaagctggagcgctaccacacagccatccgccgctctgagagcgtgaagagccggggcctgccctgcacagagctgtttgtggcccctgtgggcgtggccagcaagaggcacctgtttgagaaggagctggccggccagagcagagctgagcccgccagcagcaggaaagaaaacctgcggctgagcggcgtggtgaccagccggctgaacctgtggatcagcaggacccaggagagcggggaccaggacccccaggaggcccagaaggccagcagcgccacagagaggacccagtggggccagaagagtgacagcagcctggatgctgaggtgtag

SEQ ID NO: 7648 - DNA, 270 bp, Artificial Sequence; identical to SEQ ID NO: 7123
  Description of Artificial Sequence: Synthetic coding sequence

SEQ ID NO: 7649 - DNA, 1302 bp, Artificial Sequence
  Description of Artificial Sequence: Synthetic coding sequence
atgggaaatgcctgctgggagctgtactgcctggagcacggcatccagccagatggccagatgcccagcgacaagaccatcggcggcggagatgacagcttcaccaccttcttctgtgaaacaggagctgggaagcacgtgcccagggctgtgtttgtggacctggagcccaccgtgattgatgagatcagaaatggcccctaccggcagctgttccaccctgagcagctgatcaccgggaaggaggatgctgccaacaactatgcccggggccactacaccatcggcaaggagatcatcgaccctgtgctggaccgcatcaggaagctgagtgaccagtgcaccggcctgcagggcttcctggtgttccacagctttggaggcggcaccggcagcggcttcaccagcctgctgatggagcggctgtctgtggactatggcaagaagagcaagctggagttcagcatctacccagccccccaggtgtccacagctgtggtggagccctacaacagcatcctgaccacccacaccaccctggagcacagcgactgtgccttcatggtggacaatgaggccatctatgacatctgcagaagaaacctggacatcgagcggcccacctacaccaacctgaacagactcatcagccagatcgtgagcagcatcacagccagcctgcgctttgatggagccctgaatgtggacctgacagagttccagaccaacctggtgccctacccccgcatccacttccccctggccacctacgcccctgtgatctctgctgagaaggcctaccacgagcagctgtctgtggccgagatcaccaatgcctgctttgagcccgccaaccagatggtgaagtgtgaccccaggcatggcaagtacatggcctgctgcctgctgtacagaggagatgtggtgcccaaggatgtgaatgctgccatcgccgccatcaagaccaagaggagcatccagtttgtggactggtgccccaccggcttcaaggtgggcatcaactaccagccccccaccgtggtgcctggaggagacctggccaaggtgcagagagctgtgtgcatgctgagcaacaccacagccatcgccgaggcctgggcccggctggaccacaagtttgacctgatgtatgccaagagggcctttgtgcactggtacgtgggggagggcatggaggagggggagttcagcgaggcccgggaggacatggccgccctggagaaggactatgaggaggtgggcatcgacagctatgaagatgaagatgaaggagaggagtag

SEQ ID NO: 7650 - DNA, 1965 bp, Artificial Sequence; identical to SEQ ID NO: 7022
  Description of Artificial Sequence: Synthetic coding sequence

SEQ ID NO: 7651 - DNA, 1173 bp, Artificial Sequence
  Description of Artificial Sequence: Synthetic coding sequence
atgaagttccagggccccctggcctgcctgctgctggccctgtgcctgggcagcggggaggccggccccctgcagagcggggaggagagcacaggcaccaacattggagaggccctgggccacggcctgggagatgccctgtctgagggcgtgggcaaggccatcggcaaggaggccggcggcgctgctggcagcaaggtgtctgaggccctgggccagggcacccgggaggccgtgggcactggagtgcggcaggtgcccggctttggagtggctgatgccctgggcaacagagtgggggaggccgcccacgccctgggcaacacaggccatgaaattggccggcaggccgaggatgtgatcagacatggagcagatgctgtgcggggctcctggcagggcgtgcccggccacaatggagcctgggagaccagcggcggccacggcatcttcggcagccagggcggcctgggcggccagggccagggcaaccctgggggcctgggcaccccctgggtgcacggctacccaggcaacagcgctggcagctttggcatgaacccccagggcgccccctggggccagggcggcaatggaggcccccccaactttggcaccaacacccagggcgctgtggcccagcccggctacggctctgtgcgggccagcaaccagaatgaaggctgcaccaaccccccaccttctggcagcggcggcggcagcagcaacagcggcggcggcagcggcagccagagcggcagcagcggcagcggcagcaatggagacaacaacaacggcagcagcagcggcggcagcagcagcggcagcagcagcggcggcagcagcggcggcagcagcggcggcagcagcggcaacagcggcggcagcagaggagacagcggcagcgagagctcctggggcagcagcacaggcagcagcagcggcaaccacggcggcagcggcggcggcaatggccacaagccaggctgtgagaagccaggaaatgaggcccggggcagcggggagagcggcatccagggcttccggggccagggcgtgagcagcaacatgaggaacagcgagaccagccctggcatgttcaactttgacaccttctggaagaacttcaagagcaagctgggcttcatcaactgggatgccatcaacaagtag

SEQ ID NO: 7652 - DNA, 846 bp, Artificial Sequence; identical to SEQ ID NO: 7230
  Description of Artificial Sequence: Synthetic coding sequence

SEQ ID NO: 7653 - DNA, 876 bp, Artificial Sequence
  Description of Artificial Sequence: Synthetic coding sequence
gtgctgagcgccagcggccctggcaggaagatgggcagccggggccagggcctgctgctggcctactgcctgctgctggcctttgccagcggcctggtgctgagccgggtgccccacgtgcagggcgagcagcaggagtgggagggcacagaggagctgcccagccccccagaccacgccgagagagctgaggagcagcacgagaagtaccggcccagccaggaccagggcctgcctgccagccgctgcctgcgctgctgtgaccccggcacctccatgtacccagccacagctgtgccccagatcaacatcaccatcctgaagggggagaagggggacagaggagaccggggcctgcagggcaagtatggcaagacaggcagcgctggggcccggggccacacaggccccaagggccagaagggctccatgggcgcccctggagagcgctgcaagagccactacgccgccttctctgtgggcaggaagaagcccatgcacagcaaccactactaccagaccgtcatctttgacacagaatttgtgaacctgtatgaccacttcaacatgttcaccgggaagttctactgctacgtgcccggcctgtacttcttcagcctgaatgtgcacacctggaaccagaaggagacctacctgcacatcatgaagaatgaggaggaggtggtgatcctgtttgcccaggtgggggacaggagcatcatgcagagccagagcctgatgctggagctgcgggagcaggaccaggtgtgggtgcggctgtacaagggggagcgggagaatgccatcttcagcgaggagctggacacctacatcaccttcagcggctacctggtgaagcacgccacagagccctag

SEQ ID NO: 7654 - DNA, 1002 bp, Artificial Sequence
  Description of Artificial Sequence: Synthetic coding sequence
atggtgtccaagagccgctggaagctgctggccatgctggccctggtgctggtggtgatggtgtggtacagcatcagccgggaggaccgctacatcgagctgttctacttccccatccctgagaagaaggagccctgcctgcagggcgaggccgagagcaaggccagcaagctgtttggaaactacagccgggaccagcccatcttcctgcggctggaggactacttctgggtgaagacccccagcgcctatgagctgccctacggcaccaagggcagcgaggacctgctgctgcgggtgctggccatcaccagcagcagcatccccaagaacatccagagcctgcgctgccgccgctgtgtggtggtgggcaatggccaccggctgaggaacagcagcctgggagatgccatcaacaagtatgatgtggtgatccggctgaacaatgcccctgtggccggctatgaaggagatgtgggcagcaagaccaccatgaggctcttctacccagagagcgcccactttgaccccaaggtggagaacaacccagacaccctgctggtgctggtggccttcaaggccatggacttccactggattgagaccatcctgagtgacaagaagagggtgaggaagggcttctggaagcagcccccactcatctgggatgtgaaccccaagcagatccgcatcctgaaccccttcttcatggagattgctgctgacaagctgctgagcctgcccatgcagcagcccaggaagatcaagcagaagcccaccaccggcctgctggccatcaccctggccctgcacctgtgtgacctggtgcacatcgccggcttcggctacccagatgcctacaacaagaagcagaccatccactactatgagcagatcaccctgaagtccatggccggcagcggccacaacgtgtcccaggaggccctggccatcaagaggatgctggagatgggcgccatcaagaacctgaccagcttctag

SEQ ID NO: 7655 - DNA, 312 bp, Artificial Sequence; identical to SEQ ID NO: 7320
  Description of Artificial Sequence: Synthetic coding sequence

SEQ ID NO: 7656 - DNA, 312 bp, Artificial Sequence; identical to SEQ ID NO: 7320
  Description of Artificial Sequence: Synthetic coding sequence

SEQ ID NO: 7657 - DNA, 312 bp, Artificial Sequence; identical to SEQ ID NO: 7320
  Description of Artificial Sequence: Synthetic coding sequence

SEQ ID NO: 7658 - DNA, 312 bp, Artificial Sequence; identical to SEQ ID NO: 7320
  Description of Artificial Sequence: Synthetic coding sequence

SEQ ID NO: 7659 - DNA, 2268 bp, Artificial Sequence
  Description of Artificial Sequence: Synthetic coding sequence
atgccacccttcctgctgctggaggccgtgtgtgtgttcctgttcagccgggtgccccccagcctgcccctgcaggaggtgcacgtgtccaaggagaccatcggcaagatctctgctgccagcaagatgatgtggtgcagcgctgctgtggacatcatgttcctgctggatggcagcaacagcgtgggcaagggcagctttgagaggagcaagcactttgccatcaccgtgtgtgatggcctggacatcagccctgagcgggtgcgggtgggcgccttccagttcagcagcaccccccacctggagttccccctggacagcttcagcacccagcaggaggtgaaggcccgcatcaagaggatggtgttcaagggcggccgcacagaaacagagctggccctgaagtacctgctgcaccggggcctgcccggcggcagaaatgcctctgtgccccagatcctgatcatcgtgacagatggcaagagccagggagatgtggccctgcccagcaagcagctgaaggagcggggcgtgacagtgtttgctgtgggcgtgcgcttcccccgctgggaggagctgcacgccctggccagcgagccccggggccagcacgtgctgctggccgagcaggtggaggatgccaccaacggcctcttcagcaccctgagcagcagcgccatctgcagcagcgccaccccagactgccgggtggaggcccacccctgtgagcacaggaccctggagatggtgcgggagtttgctggaaatgccccctgctggaggggcagcaggaggaccctggccgtgctggccgcccactgccccttctacagctggaagagggtcttcctgacccacccagccacctgctaccgcaccacctgccccggcccctgtgacagccagccctgccagaatggaggcacctgtgtgcctgagggcctggatggctaccagtgcctgtgccccctggccttcggcggggaggccaactgtgccctgaagctgagcctggagtgccgggtggacctgctcttcctgctggacagcagcgctggcaccaccctggatggcttcctgcgggccaaggtgtttgtgaagagatttgtgcgggctgtgctgtctgaggacagccgggcccgggtgggcgtggccacctacagccgggagctgctggtggccgtgcctgtgggggagtaccaggatgtgcctgacctggtgtggagcctggatggcatccccttccggggcggccccaccctgaccggcagcgccctgcggcaggccgctgagcggggcttcggcagcgccaccaggacaggccaggaccggccccggcgggtggtggtgctgctgacagagagccacagtgaagatgaggtggccggccctgcccggcatgcccgggcccgggagctgctgctgctgggcgtgggcagcgaggccgtgcgggcagagctggaggagatcaccggcagccccaagcacgtgatggtgtacagcgacccccaggacctcttcaaccagatccctgagctgcagggcaagctgtgcagccggcagaggcctggctgcaggacccaggccctggacctggtgttcatgctggacaccagcgcctctgtgggcccagaaaattttgcccagatgcagagctttgtgcgcagctgtgccctgcagtttgaggtgaacccagatgtgacccaggtgggcctggtggtgtatggcagccaggtgcagacagccttcggcctggacaccaagcccacccgggccgccatgctgcgggccatcagccaggccccctacctgggcggcgtgggcagcgctggaacagccctgctgcacatctatgacaaggtgatgacagtgcagagaggagcccggcctggggtgcccaaggctgtggtggtgctgaccggcggcagaggagcagaagatgctgctgtgcctgcccagaagctgaggaacaacggcatctctgtgctggtggtgggcgtgggccctgtgctgtctgagggcctgcggcggctggccggcccccgggacagcctcatccacgtggccgcctatgctgacctgcgctaccaccaggatgtgctgattgagtggctgtgtggggaggccaagcagcctgtgaacctgtgcaagcccagcccctgcatgaatgaaggcagctgtgtgctgcagaatggcagctaccgctgcaagtgcagagatggctgggagggcccccactgtgagaaccgcttcctgcggcggccctag

SEQ ID NO: 7660 - DNA, 816 bp, Artificial Sequence
  Description of Artificial Sequence: Synthetic coding sequence
atgatcactggagtcttctccatgaggctgtggacccctgtgggcgtgctgaccagcctggcctactgcctgcaccagaggagagtggccctggccgagctgcaggaggctgatggccagtgccctgtggacaggagcctgctgaagctgaagatggtgcaggtggtgttcagacatggagcccggagccccctgaagcccctgcccctggaggagcaggtggagtggaacccccagctgctggaggtgcccccccagacccagtttgactacacagtgaccaacctggccggcggccccaagccctacagcccctatgacagccagtaccacgagaccaccctgaagggcggcatgtttgctggccagctgaccaaggtgggcatgcagcagatgtttgccctgggggagcggctgaggaagaactacgtggaggacatccccttcctgagccccaccttcaacccccaggaggtgttcatccgcagcaccaacatcttcaggaacctggagagcacccgctgcctgctggccggcctcttccagtgccagaaggagggccccatcatcatccacacagatgaggccgacagcgaggtgctgtaccccaactaccagagctgctggagcctgcggcagaggacccggggccggcggcagacagccagcctgcagcccggcatcagcgaggacctgaagaaggtgaaggacaggatgggcatcgacagcagtgacaaggtggacttcttcatcctgctggacaacgtggccgctgagcaggagaagatgggcagctgccgcttccacggcagctag

SEQ ID NO: 7661 - DNA, 1395 bp, Artificial Sequence
  Description of Artificial Sequence: Synthetic coding sequence
atggagcacagcgtgtgccccagcagcgctgtgcacctgatccctgtgtccacccccaagaatggcatgagcagcaagagcaggaagaggatcatgccagaccctgtgacagagccccctgtgacagatcctgtgtatgaggccctgctgtactgcaacatccccagcgtggccgagaggtccatggagggccacgccccccaccacttcaagctggtgtctgtgcacgtgttcatcagacatggagaccgctaccccctgtatgtgatccccaagaccaagaggcctgagattgactgcaccctggtggccaacaggaagccctaccaccccaagctggaggccttcatcagccacatgagcaagggcagcggggccagctttgagagccccctgaacagcctgcccctgtaccccaaccaccccctgtgtgagatgggagagctgacccagacaggagtggtgcagcacctgcagaatggccagctgctgcgggacatctacctgaagaagcacaagctgctgcccaatgactggagcgctgaccagctgtacctggagaccaccgggaagagcaggaccctgcagagcggcctggccctgctgtatggcttcctgcctgactttgactggaagaagatctacttccgccaccagcccagcgccctcttctgcagcggcagctgctactgccctgtgaggaaccagtacctggagaaggagcagaggcggcagtacctgctgcggctgaagaacagccagctggagaagacctatggagagatggccaagatcgtggatgtgcccaccaagcagctgcgggccgccaaccccatcgacagcatgctgtgccacttctgccacaacgtgtccttcccctgcaccagaaatggctgtgtggacatggagcacttcaaggtgatcaagacccaccagattgaagatgagcgggagcggcgggagaagaagctgtacttcggctacagcctgctgggcgcccaccccatcctgaaccagaccatcggccgcatgcagagggccacagagggcaggaaggaggagctgtttgccctgtacagcgcccatgatgtgaccctgagccctgtgctgagcgccctgggcctgtctgaggcccgcttccccaggtttgctgcccggctcatctttgagctgtggcaggaccgggagaagcccagcgagcacagcgtgcgcatcctgtacaacggggtggatgtgaccttccacaccagcttctgccaggaccaccacaagaggagccccaagcccatgtgccccctggagaacctggtgcgctttgtgaagagggacatgtttgtggccctgggcggcagcggcaccaactactatgatgcctgccaccgggagggcttctag

SEQ ID NO: 7662 - DNA, 1443 bp, Artificial Sequence; identical to SEQ ID NO: 6994
  Description of Artificial Sequence: Synthetic coding sequence

SEQ ID NO: 7663 - DNA, 1311 bp, Artificial Sequence; identical to SEQ ID NO: 7298
  Description of Artificial Sequence: Synthetic coding sequence

SEQ ID NO: 7664 - DNA, 1161 bp, Artificial Sequence; identical to SEQ ID NO: 7407
  Description of Artificial Sequence: Synthetic coding sequence

SEQ ID NO: 7665 - DNA, 990 bp, Artificial Sequence
  Description of Artificial Sequence: Synthetic coding sequence
atgaggcctcctccagccctggccctggccggcctgtgcctgctggccctgcctgctgctgctgccagctacttcggcctgaccggccgggaggtgctgacccccttccctggcctgggcacagctgctgccccagcccagggcggggcccacctgaagcagtgtgacctgctgaagctgagccggcggcagaagcagctgtgcagaagagagcccggcctggccgagaccctgagagatgctgcccacctgggcctgctggagtgccagttccagttcagacatgagcgctggaactgcagcctggagggccgcatgggcctgctgaagaggggcttcaaggagacagccttcctgtatgctgtgagcagcgctgccctgacccacaccctggcccgggcctgcagcgctggccgcatggagcgctgcacctgtgatgacagccctggcctggagagccggcaggcctggcagtggggcgtgtgtggggacaacctgaagtacagcaccaagttcctgagcaacttcctgggcagcaagaggggcaacaaggacctgcgggcccgggcagatgcccacaacacccacgtgggcatcaaggctgtgaagagcggcctgcggaccacctgcaagtgccacggcgtgtctggcagctgtgctgtgaggacctgctggaagcagctgagccccttccgggagaccggccaggtgctgaagctgcgctatgacagcgctgtgaaggtgagcagcgccaccaatgaggccctgggccgcctggagctgtgggccccagcccggcagggcagcctgaccaagggcctggcccccaggtctggggacctggtgtacatggaggacagccccagcttctgccggcccagcaagtacagccctggaacagctggctggagcgctgtggcccggagccagctgatcaccaccagcaccagccgcatccaggccatcctgcccagccagctgcctgagtag

SEQ ID NO: 7666 - DNA, 579 bp, Artificial Sequence
  Description of Artificial Sequence: Synthetic coding sequence
atgaggctggccggccctgagagctctgtgacagctgccccccgggccaggaagtacaagtgtggcctgccccagccctgcccagaggagcacctggccttccgggtggtgtctggggccgccaacgtcatcggccccaagatctgcctggaggacaagatgctgatgagctctgtgaaggacaacgtgggccggggcctgaacatcgccctggtgaatggagtgtctggagagctgattgaggcccgggcctttgacatgtgggccggagatgtgaatgacctgctgaagttcatccggcccctgcacgagggcaccctggtgtttgtggccagctatgatgatcctgccaccaagatgaatgaggagaccaggaagctgttcagcgagctgggcagcagaaatgccaaggagctggccttccgggacagctgggtgtttgtgggcgccaagggcgtgcagaacaagagcccctttgagcagcacgtgaagaacagcaagcacagcaacaagtatgagggctggccagaggccctggagatggagggctgcatccccaggaggagcacagccagctag

SEQ ID NO: 7667 - DNA, 1053 bp, Artificial Sequence; identical to SEQ ID NO: 7256
  Description of Artificial Sequence: Synthetic coding sequence

SEQ ID NO: 7668 - DNA, 189 bp, Artificial Sequence
  Description of Artificial Sequence: Synthetic coding sequence
atgaagatccagctgttcttcttcatcctgcacttctgggtgaccatcctgcctgcccggagcaactttgagcccaagtacagatttgagcgctgtgagaaggtgcggggcatctgcaagaccttctgtgatgatgtggagtatgactatggctactgcatcaagtggaggagccagtgctgcgtgtag

SEQ ID NO: 7669 - DNA, 738 bp, Artificial Sequence
  Description of Artificial Sequence: Synthetic coding sequence
atgaccctcttccctgtgctgctcttcctggtggccggcctgctgcccagcttccctgccaatgaagacaaggaccctgccttcaccgccctgctgaccacccagacccaggtgcagcgggagatcgtgaacaagcacaatgagctgcggcgggctgtgtccccaccagccaggaacatgctgaagatggagtggaacaaggaggccgccgccaatgcccagaagtgggccaaccagtgcaactaccgccacagcaaccccaaggacaggatgaccagcctgaagtgtggggagaacctgtacatgagcagcgccagcagctcctggagccaggccatccagagctggtttgatgagtacaatgactttgattttggagtgggccccaagaccccaaatgctgtggtgggccactacacccaggtggtgtggtacagcagctacctggtgggctgtggaaatgcctactgccccaaccagaaggtgctgaagtactactacgtgtgccagtactgcccagctggcaactgggccaaccggctgtatgtgccctatgagcagggcgccccctgtgccagctgcccagacaactgtgatgatggcctgtgcaccaacggctgcaagtatgaggacctgtacagcaactgcaagagcctgaagctgaccctgacctgcaagcaccagctggtgcgggacagctgcaaggccagctgcaactgcagcaacagcatctactag

SEQ ID NO: 7670 - DNA, 1341 bp, Artificial Sequence; identical to SEQ ID NO: 6995
  Description of Artificial Sequence: Synthetic coding sequence

SEQ ID NO: 7671 - DNA, 585 bp, Artificial Sequence; identical to SEQ ID NO: 6927
  Description of Artificial Sequence: Synthetic coding sequence

SEQ ID NO: 7672 - DNA, 585 bp, Artificial Sequence; identical to SEQ ID NO: 6927
  Description of Artificial Sequence: Synthetic coding sequence

SEQ ID NO: 7673 - DNA, 348 bp, Artificial Sequence
  Description of Artificial Sequence: Synthetic coding sequence
atgaccatgaggcacaactggaccccagacctgagccccctgtgggtgctgctgctgtgtgcccacgtggtgaccctgctggtgcgggccacccctgtgtcccagaccaccacagctgccacagcctctgtgcgcagcaccaaggacccctgccccagccagccccctgtgtttcctgctgccaagcagtgcccagccctggaggtgacctggccagaggtggaggtgcccctgtcctgggccgagggcaacctggccccccaccccaggagccctgccctgcagccccagcagagcacagctgctggcctgcggctgagcacaggccctgctgctgcccagccctag

SEQ ID NO: 7674 - DNA, 528 bp, Artificial Sequence; identical to SEQ ID NO: 7066
  Description of Artificial Sequence: Synthetic coding sequence

SEQ ID NO: 7675 - DNA, 993 bp, Artificial Sequence
  Description of Artificial Sequence: Synthetic coding sequence
atgggcaagctgtgcctgggccccaccctgtgcccagctgctgctgctgaggagagcagagatgctgagccccggcgggagctgctgtgcagcggccggccctggacctggagggctgctgcccgggtgaccaccatgatcccctgggtgctgctggcctgtgccctgccctgtgccgctgaccccctgctgggcgcctttgcccggcgggacttcaggaagggcagcccccagctggtgtgcagcctgcccggcccccagggccccccaggccccccaggggcccctggccccagcggcatgatgggccgcatgggcttccctgggaaggatggccaggacggccatgatggagacagaggagacagcggggaggagggccccccaggccgcacaggcaacagaggcaagccaggccccaagggcaaggccggggccatcggccgggccggcccccggggccccaagggcgtgaatggcacccctgggaagcacggcacccctgggaagaagggccccaagggcaagaagggggagcccggcctgcccggcccctgcagctgtggcagcggccacaccaagagcgccttctctgtggccgtgaccaagagctacccccgggagcggctgcccatcaagtttgacaagatcctgatgaatgaaggaggccactacaatgccagcagcggcaagtttgtgtgtggggtgcccggcatctactacttcacctatgacatcaccctggccaacaagcacctggccatcggcctggtgcacaacggccagtaccgcatccgcacctttgatgccaacacaggcaaccatgatgtggccagcggcagcaccatcctggccctgaagcagggagatgaggtgtggctgcagatcttctacagcgagcagaatggcctcttctatgacccctactggacagacagcctcttcaccggcttcctgatctatgctgaccaggatgaccccaatgaggtgtag

SEQ ID NO: 7676 - DNA, 390 bp, Artificial Sequence
  Description of Artificial Sequence: Synthetic coding sequence
atgaggctgctgctgctggtgcccctgctgctggccccagcccctggcagcagcgcccccaaggtgcggcggcagagcgacacctggggcccctggagccagtggagcccctgcagcaggacctgtggcggcggcgtgtccttccgggagcggccctgctacagccagaggagagatggcggcagcagctgtgtgggccctgcccggagccacaggagctgcaggacagagagctgcccagatggagcccgggacttccgggcagagcagtgtgccgagtttgatggagctgagttccagggccgccgctaccgctggctgccctactacagcgcccccaacaagtgtgagctgaactgcatccccaagggcctgggcctgcagggctag

SEQ ID NO: 7677 - DNA, 1227 bp, Artificial Sequence
  Description of Artificial Sequence: Synthetic coding sequence
atgttcagcaatgccaacagccgcagcaagatgtggctgctgctgaccatggccagcctcatctctgtgctgggcaccacccacggcctgtttgggaagctgcaccctggcagccctgaggtgaccatgaacatcagccagatgatcacctactggggctacccaaatgaggagtatgaggtggtgacagaagatggctacatcctggaggtgaaccgcatcccctacggcaagaagaacagcggcaacacaggccagaggcctgtggtgttcctgcagcacggcctgctggccagcgccaccaactggatcagcaacctgcccaacaacagcctggccttcatcctggctgatgctggctatgatgtgtggctgggcaacagccggggcaacacctgggcccggaggaacctgtactacagcccagacagcgtggagttctgggccttctcctttgatgagatggccaagtatgacctgcctgccaccatcgacttcatcgtgaagaagacaggccagaagcagctgcactacgtgggccacagccagggcaccaccatcggcttcatcgccttcagcaccaaccccagcctggccaagaggatcaagaccttctacgccctggcccctgtggccaccgtgaagtacaccaagagcctcatcaacaagctgcgctttgtgccccagagcctcttcaagttcatctttggagacaagatcttctacccccacaacttctttgaccagttcctggccacagaggtgtgcagccgggagatgctgaacctgctgtgcagcaatgccctcttcatcatctgtggctttgacagcaagaacttcaacaccagccggctggatgtgtacctgagccacaacccagctggcacctctgtgcagaacatgttccactggacccaggccgtgaagagcggcaagttccaggcctatgactggggcagccctgtgcagaacaggatgcactatgaccagagccagcccccctactacaacgtgacagccatgaatgtgcccatcgctgtgtggaatggaggcaaggacctgctggccgacccccaggatgtgggcctgctgctgcccaagctgcccaacctgatctaccacaaggagatccccttctacaaccacctggacttcatctgggccatggatgccccccaggaggtgtacaatgacatcgtgtccatgatcagcgaggacaagaagtag

SEQ ID NO: 7678 - DNA, 393 bp, Artificial Sequence; identical to SEQ ID NO: 7216
  Description of Artificial Sequence: Synthetic coding sequence

SEQ ID NO: 7679 - DNA, 393 bp, Artificial Sequence; identical to SEQ ID NO: 7216
  Description of Artificial Sequence: Synthetic coding sequence

SEQ ID NO: 7680 - DNA, 1731 bp, Artificial Sequence
  Description of Artificial Sequence: Synthetic coding sequence
atgattgtgtttggctgggccgtgttcctggccagccgcagcctgggccagggcctgctgctgaccctggaggagcacatcgcccacttcctgggcactggaggagctgccaccaccatgggcaacagctgcatctgcagagatgacagcggcacagatgattctgtggacacccagcagcagcaggccgagaacagcgctgtgcccacagctgacaccaggagccagccccgggaccctgtgcggcccccaagaagaggccggggcccccatgagcccaggaggaagaagcagaatgtggatggcctggtgctggacaccctggccgtcatccgcaccctggtggacaatgaccaggagcccccctacagcatgatcaccctgcacgagatggccgagacagatgagggctggctggatgtggtgcagagcctcatccgggtcatccccctggaggaccccctgggccctgctgtgatcaccctgctgctggatgagtgccccctgcccaccaaggatgccctgcagaagctgacagagatcctgaacctgaatggagaggtggcctgccaggacagcagccacccagccaagcacaggaacaccagcgctgtgctgggctgcctggccgagaagctggccggccctgccagcatcggcctgctgagccctggcatcctggagtacctgctgcagtgcctgaagctgcagagccaccccaccgtgatgctgtttgccctgattgccctggagaagtttgcccagaccagcgagaacaagctgaccatcagcgagagcagcatcagtgaccggctggtgaccctggagagctgggccaatgaccctgactacctgaagaggcaggtgggcttctgtgcccagtggagcctggacaacctcttcctgaaggagggccggcagctgacctatgagaaggtgaacctgagcagcatccgggccatgctgaacagcaatgatgtgtctgagtacctgaagatcagcccccacggcctggaggcccgctgtgatgccagcagctttgaatctgtgcgctgcaccttctgtgtggatgctggggtgtggtactatgaggtgacagtggtgaccagcggcgtgatgcagatcggctgggccacccgggacagcaagttcctgaaccacgagggctacggcattggagatgatgagtacagctgtgcctatgatggctgccggcagctgatctggtacaatgcccggagcaagccccacatccacccctgctggaaggagggggacacagtgggcttcctgctggacctgaatgagaagcagatgatcttcttcctgaatggaaaccagctgcccccagagaagcaggtgttcagcagcacagtgtctggcttctttgctgctgccagcttcatgagctaccagcagtgtgagttcaactttggagccaagcccttcaagtacccacccagcatgaagttcagcaccttcaatgactatgccttcctgacagctgaggagaagatcatcctgcccaggcaccggcggctggccctgctgaagcaggtgtccatccgggagaactgctgcagcctgtgctgtgatgaggtggccgacacccagctgaagccctgtggccacagcgacctgtgcatggactgtgccctgcagctggagacctgccccctgtgcaggaaggagatcgtgagccgcatccggcagatcagccacatctcctag

SEQ ID NO: 7681 - DNA, 360 bp, Artificial Sequence
  Description of Artificial Sequence: Synthetic coding sequence
atggcccggcccggcatggagcgctggagggaccggctggccctggtgactggagccagcggcggcattggagctgctgtggcccgggccctggtgcagcagggcctgaaggtggtgggctgtgccaggacagtgggcaacatcgaggagctggccgctgagtgcaagtctgctggctacccaggcaccctcatcccctaccgctgtgacctgagcaatgaggaggacatcctgtccatgttcagcgccatccgcagccagcacagcggcgtggacatctgcatcaacaatgccggcctggcccggccagacaccctgctgagcggcagcaccagcggctggaaggacatgttcaactag

SEQ ID NO: 7682 - DNA, 144 bp, Artificial Sequence
  Description of Artificial Sequence: Synthetic coding sequence
atgcaggtgtccacagctgccctggccgtgctgctgtgcaccatggccctgtgcaaccaggtgctgagcgccccccaggccggccgctctgtgctgacccctgtgcgcagcggcagcaggaacacctctgtgacctggagctag

SEQ ID NO: 7683 - DNA, 159 bp, Artificial Sequence
  Description of Artificial Sequence: Synthetic coding sequence
atgcaggtgtccacagctgccctggccgtgctgctgtgcaccatggccctgtgcaaccaggtgctgagcgcccccctgagccggccccgggaggccggccgctctgtgctgacccctgtgcgcagcggcagcaggaacacctctgtgacctggagctag

SEQ ID NO: 7684 - DNA, 1272 bp, Artificial Sequence
  Description of Artificial Sequence: Synthetic coding sequence
atggagctggagctgatgcccttcaacgtgctgctgcggaccaccctggacctgctgcaggagaaggaccctgcccacatctttgctgagcctgtgaacctgtctgaggtgcctgactacctggagttcatcagcaagcccatggacttcagcaccatgaggaggaagctggagagccacctgtaccgcaccctggaggagtttgaggaggacttcaacctgattgtgaccaactgcatgaagtacaatgccaaggacaccatcttccacagagctgctgtgcggctgcgggacctgggcggggccatcctgcggcatgcccggcggcaggccgagaacatcggctatgaccctgagcggggcacccacctgcctgagagccccaagctggaggacttctaccgcttctcctgggaggatgtggacaacatcctgatccctgagaacagagcccacctgagccctgaggtgcagctgaaggagctgctggagaagctggacctggtgtctgccatgaggagcagcggggcccggacccggcgggtgcggctgctgcggcgggagatcaatgccctgcggcagaagctggcccagcccccaccaccccagccccccagcctgaacaagacagtgtccaatggagagctgcctgctggcccccagggagatgctgctgtgctggagcaggccctgcaggaggagccagaagatgatggagacagagatgacagcaagctgcccccaccacccaccctggagcccactggacctgcccccagcctgtctgagcaggagagccccccagagccccccaccctgaagcccatcaatgacagcaagccacccagccgcttcctgaagcccaggaaggtggaggaggatgagctgctggagaagagccccctgcagctgggcaatgagcccctgcagaggctgctgagtgacaatggcatcaaccggctgagcctgatggccccagacaccccagctggcacccccctgtctggagtgggccgccgcacctctgtgctcttcaagaaggccaagaatggagtgaagctgcagaggagcccagacagagtgctggagaatggagaggaccacggcgtggccggcagccctgccagccctgccagcattgaggaggagcggcacagcaggaagaggcccaggagccgcagctgcagcgagagcgagggggagaggagcccccagcaggaggaggagaccggcatgaccaacggctttgggaagcacaggaagagggtgtag

SEQ ID NO: 7685 - DNA, 3030 bp, Artificial Sequence
  Description of Artificial Sequence: Synthetic coding sequence
atgggcagcggccgggtgcccggcctgtgcctgctggtgctgctggtgcacgcccgggccgcccagtacagcaaggccgcccaggatgtggatgaatgtgtggagggcacagacaactgccacattgatgccatctgccagaacacccccaggagctacaagtgcatctgcaagagcggctacacaggagatggcaagcactgcaaggatgtggatgaatgtgaaagagaagataatgccggctgtgtgcatgactgtgtgaacatccctggcaactaccgctgcacctgctatgatggcttccacctggcccatgatggccacaactgcctggatgtggatgaatgtgccgagggcaatggaggctgccagcagagctgtgtgaacatgatgggcagctatgagtgccactgccgggagggcttcttcctgagtgacaaccagcacacctgcatccagaggcctgaggagggcatgaactgcatgaacaagaaccacggctgtgcccacatctgccgggagacccccaagggcggcatcgcctgtgaatgtcggcccggctttgagctgaccaagaaccagagggactgcaagctgacctgcaactatggaaatggaggctgccagcacacctgtgatgacacagagcagggcccccgctgtggctgccacatcaagtttgtgctgcacacagatggcaagacctgcattggagagcggcggctggagcagcacatccccacccaggccgtgtccaatgagacctgtgctgtgaacaacggcggctgtgacagcaagtgccatgatgctgccaccggggtgcactgcacctgccctgtgggcttcatgctgcagcctgacaggaagacctgcaaggacattgatgagtgccgcctgaacaatggaggctgtgaccacatctgcaggaacacagtgggcagctttgagtgcagctgcaagaagggctacaagctgctgatcaatgaaagaaactgccaggacattgatgaatgttcctttgacaggacctgtgaccacatctgtgtgaacaccccaggcagcttccagtgcctgtgccaccggggctacctgctgtatggcatcacccactgtggagatgtggatgagtgcagcatcaacagaggaggctgccgcttcggctgcatcaacaccccaggcagctaccagtgcacctgcccagctggccagggccgcctgcactggaatggcaaggactgcacagagcccctgaagtgccagggcagccctggggccagcaaggccatgctgagctgcaacagaagtggcaagaaggacacctgtgccctgacctgccccagccgggcccgcttcctgcctgagagtgaaaatggcttcaccgtgtcctgtggcacccccagcccccgggccgccccagcccgggccggccacaacggcaacagcaccaacagcaaccactgccacgaggccgctgtgctgagcatcaagcagagggccagcttcaagatcaaggatgccaagtgccgcctgcacctgagaaataaaggcaagacagaggaggccggccgcatcactggacctggaggagccccctgcagcgagtgccaggtgaccttcatccacctgaagtgtgacagcagcaggaaaggaaaaggaagaagagcccggaccccacctgggaaggaggtgacccggctgaccctggagctggaggccgaggtgcgggcagaggagaccacagccagctgtggcctgccctgcctgcggcagaggatggagcggcggctgaagggcagcctgaagatgctgaggaagagcatcaaccaggaccgcttcctgctgcggctggccggcctggactatgagctggcccacaagccaggcctggtggccggggagagagctgagcccatggagagctgcaggcctggccagcaccgggccggcaccaagtgtgtgtcctgcccccagggcacctactaccacggccagacagagcagtgtgtgccctgcccagctggcaccttccaggagcgggagggccagctgagctgtgacctgtgccccggcagtgatgcccacggccccctgggcgccaccaacgtgaccacctgtgccggccagtgccccccaggccagcacagcgtggatggcttcaagccctgccagccctgcccccggggcacctaccagcctgaggccggccgcaccctgtgcttcccctgtggcggcggcctgaccaccaagcatgagggcgccatctccttccaggactgtgacaccaaggtgcagtgcagccctggccactactacaacaccagcatccaccgctgcatccgctgtgccatgggcagctaccagcctgacttccggcagaacttctgcagccgctgccccggcaacaccagcacagactttgatggcagcacctctgtggcccagtgcaagaaccggcagtgtggcggggagctgggggagttcaccggctacatcgagagccccaactacccaggcaactacccagctggggtggagtgcatctggaacatcaaccccccacccaagaggaagatcctgattgtggtgcctgagatcttcctgcccagtgaagatgaatgtggagatgtgctggtgatgaggaagaacagcagccccagcagcatcaccacctatgagacctgccagacctatgagcggcccatcgccttcaccgcccggagcaggaagctgtggatcaacttcaagaccagcgaggccaacagcgcccggggcttccagatcccctacgtgacctatgatgaggactatgagcagctggtggaggacatcgtgagagatggccgcctgtatgccagcgagaaccaccaggagatcctgaaggacaagaagctgatcaaggccttctttgaggtgctggcccacccccagaactacttcaagtacacagagaagcacaaggagatgctgcccaagagcttcatcaagctgctgcggagcaaggtgtcctccttcctgcggccctacaagtag

SEQ ID NO: 7686 - DNA, 984 bp, Artificial Sequence
  Description of Artificial Sequence: Synthetic coding sequence
atgacagccctggagctggcccggcggggggcccgggtggtgctggcctgccgcagccaggagcggggggaggccgccgcctttgacctgcggcaggagagcggcaacaatgaagtcatcttcatggccctggacctggccagcctggcctctgtgcgggcctttgccacagccttcctgagcagcgagccccggctggacatcctgatccacaatgccggcatcagcagctgtggccgcacccgggaggccttcaacctgctgctgcgggtgaaccacatcggccccttcctgctgacccacctgctgctgccctgcctgaaggcctgtgcccccagccgggtggtggtggtggccagcgctgcccactgccggggccgcctggacttcaagaggctggacaggcctgtggtgggctggaggcaggagctgcgggcctatgctgacaccaagctggccaacgtgctgtttgcccgggagctggccaaccagctggaggccaccggggtgacctgctacgccgcccaccctggccctgtgaacagcgagctgttcctgcggcacgtgcccggctggctgcggcccctgctgcggcccctggcctggctggtgctgcgggccccccggggcggggcccagacccccctgtactgtgccctgcaggagggcatcgagcccctgagcggccgctactttgccaactgccacgtggaggaggtgcccccagctgccagagatgacagagctgcccaccggctgtgggaggccagcaagaggctggccggcctgggccctggagaagatgctgagccagatgaggacccccagagcgaggacagcgaggcccccagcagcctgagcaccccccaccctgaggagcccaccgtgtcccagccctaccccagcccccagagcagcccagacctgagcaagatgacccaccgcatccaggccaaggtggagcctgagatccagctgtcctag

SEQ ID NO: 7687 - DNA, 1320 bp, Artificial Sequence; identical to SEQ ID NO: 6983
  Description of Artificial Sequence: Synthetic coding sequence

SEQ ID NO: 7688 - DNA, 3687 bp, Artificial Sequence; identical to SEQ ID NO: 6944
  Description of Artificial Sequence: Synthetic coding sequence

SEQ ID NO: 7689 - DNA, 1596 bp, Artificial Sequence
  Description of Artificial Sequence: Synthetic coding sequence
atgaagggggcccggctgtttgtgctgctgagcagcctgtggagcggcggcatcggcctgaacaacagcaagcacagctggaccatcccagaagatggcaacagccagaagaccatgcccagcgcctctgtgccccccaacaagatccagagcctgcagatcctgcccaccaccagggtgatgtctgctgagatcgccaccaccccagagaaggccgagggcgtggtgaagctgcagaacctgaccctgcccaccaatgccagcatcaagttcaaccctggagctgagagcgtggtgctgagcaacagcaccctgaagttcctgcagagctttgccaggaagagcaatgagcaggccaccagcctgaacacagtgggcggcaccggcggcattggaggagtgggcggcactggaggagtgggcaacagagccccccgggagacctacctgagcagaggagacagcagcagcagccagaggacagactaccagaagagcaactttgagaccacccggggcaagaactggtgtgcctacgtgcacacccggctgagccccaccgtcatcctggacaaccaggtgacctacgtgcctgggggcaagggcccctgtggctggacaggaggcagctgcccccagaggagccagaagatcagcaaccctgtgtacaggatgcagcacaagatcgtgaccagcctggactggcgctgctgccccggctacagcggccccaagtgccagctgcgggcccaggagcagcagagcctcatccacaccaaccaggccgagagccacacagctgtgggccggggcgtggccgagcagcagcagcagcagggctgtggggaccctgaggtgatgcagaagatgacagaccaggtgaactaccaggccatgaagctgaccctgctgcagaagaagattgacaacatcagcctgactgtgaatgatgtgaggaacacctacagcagcctggagggcaaggtgtctgaggacaagagccgggagttccagagcctgctgaaggaggagtacagcagctgcagccgccacccctgccagaatggaggcacctgcatcaatggaagaaccagcttcacctgtgcctgccgccaccccttcaccggggacaactgcaccatcaagctggtggaggagaatgccctggccccagacttcagcaagggcagctaccgctatgcccccatggtggccttctttgccagccacacctacggcatgaccatccctggccccatcctcttcaacaacctggatgtgaactatggagccagctacacccccaggacaggcaagttccgcatcccctacctgggcgtgtatgtgttcaagtacaccatcgagagcttcagcgcccacatcagcggcttcctggtggtggatggcatcgacaagctggcctttgaaagtgagaacatcaacagcgagatccactgtgacagagtgctgactggagatgccctgctggagctgaactacggccaggaggtgtggctgcggctggccaagggcaccatcccagccaagttcccccctgtgaccaccttcagcggctacctgctgtaccgcacctag

SEQ ID NO: 7690 - DNA, 942 bp, Artificial Sequence; identical to SEQ ID NO: 7248
  Description of Artificial Sequence: Synthetic coding sequence

SEQ ID NO: 7691 - DNA, 834 bp, Artificial Sequence
  Description of Artificial Sequence: Synthetic coding sequence
atgtgcaccgtggtggaccccagaattgtgcggcgctacctgctgcggcggcagctgggccagggcgcctacggcatcgtgtggaaggctgtggacagaagaactggagaggtggtggccatcaagaagatctttgatgccttccgggacaagacagatgcccagaggaccttccgggagatcaccctgctgcaggagtttggagaccaccccaacatcatcagcctgctggatgtgatccgggcagaaaatgaccgggacatctacctggtgtttgagttcatgggctgcccccccagccccccaccacccacagctgtgaggaccctgtctgctgacacagacctgaatgctgtgatcaggaagggcggcctgctgcaggatgtgcacgtgcgcagcatcttctaccagctgctgcgggccacccgcttcctgcacagcggccacgtggtgcaccgggaccagaagcccagcaatgtgctgctggatgccaactgcaccgtgaagctgtgtgactttggcctggcccggagcctgggggacctgcctgagggccctgaggaccaggccgtgacagaatatgtggccacccgctggtaccgggcccctgaggtgctgctgagcagccaccgctacaccctgggcgtggacatgtggagcctgggctgcatcctgggggagatgctgcggggccggcccctcttccctggcaccagcaccctgcaccagctggagctgatcctggagaccatccccccaccttctgaggaggacctgctggccctgggcagcggctgccgggcctctgtgctgcaccagctgggcagcaggtag

SEQ ID NO: 7692 - DNA, 765 bp, Artificial Sequence
  Description of Artificial Sequence: Synthetic coding sequence
atgtgcaccgtggtggaccccagaattgtgcggcgctacctgctgcggcggcagctgggccagggcgcctacggcatcgtgtggaaggctgtggacagaagaactggagaggtggtggccatcaagaagatctttgatgccttccgggacaagacagatgcccagaggaccttccgggagatcaccctgctgcaggagtttggagaccaccccaacatcatcagcctgctggatgtgatccgggcagaaaatgaccgggacatctacctggtgtttgagttcatggacacagacctgaatgctgtgatcagaaaaggaggcctgctgcaggatgtgcacgtgcgcagcatcttctaccagctgctgcgggccacccgcttcctgcacagcggccacgtggtgcaccgggaccagaagcccagcaatgtgctgctggatgccaactgcaccgtgaagctgtgtgactttggcctggcccggagcctgggggacctgcctgagggccctgaggaccaggccgtgacagaatatgtggccacccgctggtaccgggcccctgaggtgctgctgagcagccaccgctacaccctgggcgtggacatgtggagcctgggctgcatcctgggggagatgctgcggggccggcccctcttccctggcaccagcaccctgcaccagctggagctgatcctggagaccatccccccacccagcgaggagggcgcccagacagcctgccgcagcggcaccggggccagcacctag

SEQ ID NO: 7693 - DNA, 474 bp, Artificial Sequence
  Description of Artificial Sequence: Synthetic coding sequence
atggccctgctgctgtgcctggtgtgcctgacagctgccctggcccacggctgcctgcactgccacagcaacttcagcaagaagttctccttctaccgccaccacgtgaacttcaagtcctggtgggtgggggacatccctgtgtctggggccctgctgacagactggagcgatgacaccatgaaggagctgcacctggccatcccagccaagatcacccgggagaagctggaccaggtggccacagctgtgtaccagatgatggaccagctgtaccagggcaagatgtacttccctggctacttccccaatgagctgaggaacatcttccgggagcaggtgcacctgatccagaatgccatcatcgagcggcacctggcccctggctcctggggcggcggccagctgagccgggagggccccagcctggcccctgagggctccatgcccagccccaggggggacctgccctag

SEQ ID NO: 7694 - DNA, 699 bp, Artificial Sequence
  Description of Artificial Sequence: Synthetic coding sequence
atggccctgctgctgtgcctggtgtgcctgacagctgccctggcccacggctgcctgcactgccacagcaacttcagcaagaagttctccttctaccgccaccacgtgaacttcaagtcctggtgggtgggggacatccctgtgtctggggccctgctgacagactggagcgatgacaccatgaaggagctgcacctggccatcccagccaagatcacccgggagaagctggaccaggtggccacagctgtgtaccagatgatggaccagctgtaccagggcaagatgtacttccctggctacttccccaatgagctgaggaacatcttccgggagcaggtgcacctgatccagaatgccatcatcgagagcagaattgactgccagcaccgctgtggcatcttccagtatgagaccatcagctgcaacaactgcacagacagccacgtggcctgcttcggctacaactgtgagagcagcgcccagtggaagtctgctgtgcagggcctgctgaactacatcaacaactggcacaagcaggacacctccatgaggcccaggagcagcgccttctcctggccaggcacccaccgggccaccccagccttcctggtgtccccagccctgcgctgcctggagcccccccacctggccaacctgaccctggaggatgctgctgaatgtctgaagcagcactag

SEQ ID NO: 7695 - DNA, 396 bp, Artificial Sequence
  Description of Artificial Sequence: Synthetic coding sequence
atgggaggagatggccgctacgtgctgaatggccactgggtggtgtccccacctggcacctatgaagctgctggcacccacgtggtgtacacccgggacaccggcccccaggagaccctgcaggccgccggccccaccagccatgacctgctgctgcaggtgctgctgcaggagcccaaccctggcattgaatttgagttctggctgccccgggagcgctacagccccttccaggcccgggtgcaggccctgggctggcccctgcggcagccccagccccggggcgtggagccccagcccccagctgccccagctgtgaccccagcccagacccccaccctggcccctggccccagcgctggccccccacctcctggccctggggaccccctgtag

SEQ ID NO: 7696 - DNA, 447 bp, Artificial Sequence
  Description of Artificial Sequence: Synthetic coding sequence
atggcccgcatccccacagctgccctgggctgcatcagcctgctgtgcctgcagctgcccggcagcctgagccgcagcctgggcggggaccccaggcctgtgaagccccgggagcccccagcccggagccccagcagcagcctgcagcccaggcacccagcccccaggcctgtggtgtggaagctgcaccgggccctgcaggcccagagaggagctggcctggcccctgtgatgggccagcccctgagagatggcggccggcagcacagcggccccaggaggcacagcggccccaggaggacccaggcccagctgctgcgggtgggctgtgtgctgggcacctgccaggtgcagaacctgagccaccggctgtggcagctgatgggccctgctggccggcaggacagcgcccctgtggaccccagcagcccccacagctatggatag

SEQ ID NO: 7697 - DNA, 447 bp, Artificial Sequence; identical to SEQ ID NO: 7696
  Description of Artificial Sequence: Synthetic coding sequence

SEQ ID NO: 7698 - DNA, 537 bp, Artificial Sequence
  Description of Artificial Sequence: Synthetic coding sequence
atggaccgggccgcccgctgcagcggggccagcagcctgcccctgctgctggccctggccctgggcctggtgatcctgcactgtgtggtggctgatggcaacagcaccaggagccctgagaccaacggcctgctgtgtggggaccctgaggagaactgtgccgccaccaccacccagagcaagaggaagggccacttcagccgctgccccaagcagtacaagcactactgcatcaagggccgctgccgctttgtggtggccgagcagacccccagctgtgtgtgtgatgagggctacatcggggcccgctgtgagcgggtggacctcttctacctgcggggggaccggggccagatcctggtgatctgcctgattgctgtgatggtggtgttcatcatcctggtgattggagtgtgcacctgctgccaccccctgaggaagaggaggaagaggaagaagaaggaggaggagatggagaccctgggcaaggacatcacccccatcaatgaagacatcgaggagaccaacatcgcctag

SEQ ID NO: 7699 - DNA, 1251 bp, Artificial Sequence
  Description of Artificial Sequence: Synthetic coding sequence
atgagcatcagcctgagcagcctcatcctgctgcccatctggatcaacatggcccagatccagcagggcggcccagatgagaaggagaagaccacagccctgaaggacctgctgagcagaattgacctggatgagctgatgaagaaggatgagccccccctggacttcccagacaccctggagggctttgaatatgccttcaatgagaagggccagctgcggcacatcaagacaggagagccctttgtgttcaactaccgggaggacctgcaccgctggaaccagaagagatatgaggccctgggggagatcatcaccaagtatgtgtatgagctgctggagaaggactgcaacctgaagaaggtgtccatccctgtggatgccacagaaagtgagcccaagagcttcatcttcatgtctgaagatgccctgaccaacccccagaagctgatggtgctgattcatggcagcggcgtggtgcgggccggccagtgggcccggcggctcatcatcaatgaagacctggacagcggcacccagatccccttcatcaagagagctgtggccgagggctacggcgtgattgtgctgaaccccaatgaaaactacatcgaggtggagaagcccaagatccacgtgcagagcagcagtgacagcagtgatgagcctgctgagaagcgggagaggaaggacaaggtgtccaaggagaccaagaagaggcgggacttctatgagaagtacagaaacccccagcgggagaaggagatgatgcagctgtacatcagagaaaatggcagccctgaggagcacgccatctacgtgtgggaccacttcatcgcccaggccgctgctgaaaatgtgttctttgtggcccacagctatggaggcctggcctttgtggagctgatgatccagcgggaggctgatgtgaagaacaaggtgacagctgtggccctgacagacagcgtgcacaacgtgtggcaccaggaggccggcaagaccatccgggagtggatgagggagaactgctgcaactgggtgagcagcagcgagcccctggacacctctgtggagagcatgctgcctgactgcccccgggtgtctgctggaacagacagacatgagctgacctcctggaagagcttccccagcatcttcaagttcttcacagaggccagcgaggccaagaccagcagcctgaagccagctgtgacccggcgcagccaccgcatcaagcatgaggagctgtag

SEQ ID NO: 7700 - DNA, 840 bp, Artificial Sequence
  Description of Artificial Sequence: Synthetic coding sequence
atgaagatcatcatcctgctgggcttcctgggcgccaccctgagcgcccccctcatcccccagaggctgatgtctgccagcaacagcaatgagctgctgctgaacctgaacaacggccagctgctgcccctgcagctgcagggccccctgaacagctggatcccccccttcagcggcatcctgcagcagcagcagcaggcccagatccctggcctgagccagttcagcctgagcgccctggaccagtttgctggcctgctgcccaaccagatccccctgaccggggaggccagctttgcccagggcgcccaggccggccaggtggaccccctgcagctgcagaccccaccccagacccagcccggccccagccacgtgatgccctacgtgttctccttcaagatgccccaggagcagggccagatgttccagtactaccctgtgtacatggtgctgccctgggagcagccccagcagacagtgcccaggagcccccagcagacccggcagcagcagtatgaggagcagatccccttctacgcccagtttggctacatcccccagctggccgagcccgccatcagcggcggccagcagcagctggcctttgacccccagctgggcacagcccctgagattgctgtgatgagcactggagaggagatcccctacctgcagaaggaggccatcaacttcagacatgacagcgctggggtcttcatgcccagcaccagccccaagcccagcaccaccaacgtgttcaccagcgctgtggaccagaccatcaccccagagctgcctgaggagaaggacaagacagacagcctgcgggagccctag

SEQ ID NO: 7701 - DNA, 444 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagacccctag

SEQ ID NO: 7702 - DNA, 618 bp, Artificial Sequence
  Description of Artificial Sequence: Synthetic coding sequence
atgggcggccctgtgcgggagcccgccctgtctgtggccctgtggctgtcctggggcgccgccctgggcgctgtggcctgtgccatggccctgctgacccagcagacagagctgcagagcctgcggcgggaggtgtcccggctgcagggcactggaggccccagccagaatggagagggctacccctggcagagcctgcctgagcagcacagcgtgctgcacctggtgcccatcaatgccaccagcaaggatgacagtgatgtgacagaggtgatgtggcagcctgccctgcggcggggccggggcctgcaggcccagggctacggcgtgcgcatccaggatgctggggtgtacctgctgtacagccaggtgctcttccaggatgtgaccttcaccatgggccaggtggtgtcccgggagggccagggccggcaggagaccctcttccgctgcatccgctccatgcccagccacccagaccgggcctacaacagctgctacagcgctggggtcttccacctgcaccagggcgacatcctgagcgtcatcatcccccgggcccgggccaagctgaacctgagcccccacggcaccttcctgggctttgtgaagctgtag

SEQ ID NO: 7703 - DNA, 744 bp, Artificial Sequence
  Description of Artificial Sequence: Synthetic coding sequence
atgcctgccagcagccccttcctgctggcccccaagggccccccaggcaacatgggcggccctgtgcgggagcccgccctgtctgtggccctgtggctgtcctggggcgccgccctgggcgctgtggcctgtgccatggccctgctgacccagcagacagagctgcagagcctgcggcgggaggtgtcccggctgcagggcaccggcggccccagccagaatggagagggctacccctggcagagcctgcctgagcagagcagtgatgccctggaggcctgggagaatggagagaggagcaggaagagaagagctgtgctgacccagaagcagaagaagcagcacagcgtgctgcacctggtgcccatcaatgccaccagcaaggatgacagtgatgtgacagaggtgatgtggcagcctgccctgcggcggggccggggcctgcaggcccagggctatggagtgcgcatccaggatgctggggtgtacctgctgtacagccaggtgctcttccaggatgtgaccttcaccatgggccaggtggtgtcccgggagggccagggccggcaggagaccctcttccgctgcatccgctccatgcccagccacccagaccgggcctacaacagctgctacagcgctggggtcttccacctgcaccagggcgacatcctgagcgtcatcatcccccgggcccgggccaagctgaacctgagcccccacggcaccttcctgggcctgtag

SEQ ID NO: 7704 - DNA, 39 bp, Artificial Sequence
  Description of Artificial Sequence: Synthetic coding sequence
atgggcaagtctgagagcctgcagagcctgcagaggtag

SEQ ID NO: 7705 - DNA, 4266 bp, Artificial Sequence
  Description of Artificial Sequence: Synthetic coding sequence
atgatgctgccccagaacagctggcacatcgactttggccgctgctgctgccaccagaacctcttctctgctgtggtgacctgcatcctgctgctgaacagctgcttcctgatcagcagcttcaacggcacagacctggagctgcggctggtgaatggagatggcccctgcagcggcaccgtggaggtgaagttccagggccagtggggcaccgtgtgtgatgatggctggaacaccacagccagcacagtggtgtgcaagcagctgggctgccccttctcctttgccatgttccgcttcggccaggccgtgaccaggcatggcaagatctggctggatgatgtgtcctgctatggaaatgaaagtgccctgtgggagtgccagcaccgggagtggggcagccacaactgctaccatggagaagatgtgggcgtgaactgctacggggaggccaacctgggcctgcggctggtggatggcaacaacagctgcagcggccgggtggaggtgaagttccaggagcgctggggcaccatctgtgatgatggctggaacctgaacacagctgctgtggtgtgccggcagctgggctgccccagcagcttcatcagcagtggagtggtgaacagccctgctgtgctgcggcccatctggctggatgacatcctgtgccagggcaatgagctggccctgtggaactgccgccaccggggctggggcaaccacgactgcagccacaatgaagatgtgaccctgacctgctatgacagcagtgacctggagctgcggctggtgggcggcaccaaccgctgcatgggccgggtggagctgaagatccagggccgctggggcaccgtgtgccaccacaagtggaacaatgctgctgctgatgtggtgtgcaagcagctgggctgcggcacagccctgcactttgctggcctgccccacctgcagagcggcagtgatgtggtgtggctggatggagtgtcctgcagcggaaatgaaagcttcctgtgggactgccgccacagcggcaccgtgaactttgactgcctgcaccagaatgatgtgtctgtcatctgcagtgatggagctgacctggagctgcggctggctgatggcagcaacaactgcagcggccgggtggaggtgcgcatccacgagcagtggtggaccatctgtgaccagaactggaagaatgagcaggccctggtggtgtgcaagcagctgggctgccccttctctgtgtttggcagccggcgggccaagcccagcaatgaggcccgggacatctggatcaacagcatcagctgcacaggaaatgaaagtgccctgtgggactgcacctatgatggcaaggccaagaggacctgcttccgccgcagtgatgctggggtcatctgcagcgacaaggctgacctggacctgcggctggtgggcgcccacagcccctgctacggccgcctggaggtgaagtaccagggcgagtggggcaccgtgtgccacgaccgctggagcaccagaaatgctgctgtggtgtgcaagcagctgggctgcggcaagcccctgcacgtgtttggcatgacctacttcaaggaggccagcggccccatctggctggatgatgtgtcctgcattggaaatgaaagcaacatctgggactgtgagcacagcggctggggcaagcacaactgtgtgcacagagaagatgtgattgtgacctgcagcggagatgccacctggggcctgcggctggtgggcggcagcaaccgctgcagcggccgcctggaggtgtacttccagggccgctggggcaccgtgtgtgatgatggctggaacagcaaggctgctgctgtggtgtgcagccagctggactgccccagcagcatcatcggcatgggcctgggcaatgccagcacaggctacggcaagatctggctggatgatgtgtcctgtgatggagatgaaagtgacctgtggagctgcagaaattctggctggggcaacaatgactgcagccacagtgaagatgtgggcgtcatctgcagtgatgccagtgacatggagctgcggctggtgggcggcagcagccgctgtgccggcaaggtggaggtgaatgtgcagggcgctgtgggcatcctgtgtgccaacggctggggcatgaacattgctgaggtggtgtgccggcagctggagtgtggcagcgccatccgggtgtcccgggagccccacttcacagagaggaccctgcacatcctgatgagcaacagcggctgcaccggcggggaggccagcctgtgggactgcatccgctgggagtggaagcagacagcctgccacctgaacatggaggccagcctcatctgcagcgcccaccggcagccccggctggtgggcgctgacatgccctgcagcggccgggtggaggtgaagcatgctgacacctggaggtctgtgtgtgacagcgacttcagcctgcacgccgccaacgtgctgtgccgggagctgaactgtggagatgccatcagcctgtctgtgggggaccactttggaaaaggaaatggcctgacctgggccgagaagttccagtgtgagggcagcgagacccacctggccctgtgccccatcgtgcagcaccctgaggacacctgcatccacagccgggaggtgggcgtggtgtgcagccgctacacagatgtgcggctggtgaatggcaagagccagtgtgatggccaggtggagatcaacgtgctgggccactggggcagcctgtgtgacacccactgggaccctgaagatgcccgggtgctgtgccggcagctgagctgtggcacagccctgagcaccaccggcggcaagtacatcggggagaggtctgtgcgggtgtggggccaccgcttccactgcctgggcaatgaaagcctgctggacaactgccagatgacagtgctgggcgccccaccctgcatccacggcaacacagtgtctgtcatctgcaccggcagcctgacccagcccctcttcccctgcctggccaacgtgtctgacccctacctgtctgctgtgcctgagggcagcgccctgatctgcctggaggacaagaggctgcggctggtggatggagacagccgctgtgccggccgggtggagatctaccatgatggcttctggggcaccatctgtgatgatggctgggacctgagtgatgcccacgtggtgtgccagaagctgggctgcggcgtggccttcaatgccaccgtgtctgcccactttggagagggcagcggccccatctggctggatgacctgaactgcaccggcatggagagccacctgtggcagtgccccagccggggctggggccagcacgactgccgccacaaggaggatgctggggtcatctgcagcgagttcaccgccctgcggctgtacagcgagacagaaacagagagctgtgccggccgcctggaggtgttctacaacggcacctggggctctgtgggcagaagaaacatcaccacagccatcgccggcatcgtgtgccggcagctgggctgtggggagaatggagtggtgtccctggcccccctgagcaagacaggcagcggcttcatgtgggtggatgacatccagtgccccaagacccacatcagcatctggcagtgcctgagcgccccctgggagcggcgcatcagcagccctgctgaggagacctggatcacctgtgaagatcgcatccgggtgcggggcggggacacagagtgcagcggccgggtggagatctggcacgccggctcctggggcaccgtgtgtgatgacagctgggacctggccgaggccgaggtggtgtgccagcagctgggctgcggcagcgccctggccgccctgagagatgccagctttggccagggcaccggcaccatctggctggatgacatgcgctgcaagggaaatgaaagcttcctgtgggactgccacgccaagccctggggccagagcgactgtggccacaaggaggatgctggggtgcgctgcagcggccagagcctgaagagcctgaatgccagcagcggccacctggccctgatcctgagcagcatcttcggcctgctgctgctggtgctcttcatcctcttcctgacctggtgccgggtgcagaagcagaagcacctgcccctgagagatgacacccccaaccacggctgtgaagatgccagtgacaccagcctgctgggcgtgctgcctgccagcgaggccaccaagtag

SEQ ID NO: 7706 - DNA, 1410 bp, Artificial Sequence; identical to SEQ ID NO: 6897
  Description of Artificial Sequence: Synthetic coding sequence

SEQ ID NO: 7707 - DNA, 837 bp, Artificial Sequence; identical to SEQ ID NO: 7217
  Description of Artificial Sequence: Synthetic coding sequence

SEQ ID NO: 7708 - DNA, 1128 bp, Artificial Sequence
  Description of Artificial Sequence: Synthetic coding sequence
atggagtttgagatcaccttccggccagattctggagatggagtgctgctgtacagctatgacaccggcagcaaggacttcctgagcatcaacctggccggcggccacgtggagttccgctttgactgtggcagcggcactggagtgctgcggtctgaggaccccctgaccctgggcaactggcatgagctgcgggtgtccaggacagccaagaatggcatcctgcaggtggacaagcagaagatcgtggagggcatggccgagggcggcttcacccagatcaagtgcaacacagacatcttcatcggcggcgtgcccaactatgatgatgtgaagaagaacagcggcgtgctgaagcccttcagcggcagcatccagaagatcatcctgaatgacaggaccatccacgtgaagcatgacttcaccagcggcgtgaatgtggagaatgctgcccacccctgtgtgcgggccccctgtgcccatggaggcagctgccggcccaggaaggagggctatgactgtgactgccccctgggctttgagggcctgcactgccagaaggccatcatcgaggccatcgagatcccccagttcatcggccgcagctacctgacctatgacaacccagacatcctgaagagggtgtctggcagccgcagcaatgtgttcatgaggttcaagaccacagccaaggatggcctgctgctgtggaggggggacagccccatgaggcccaacagcgacttcatcagcctgggcctgagagatggagccctggtgttctcctacaacctgggcagcggcgtggccagcatcatggtgaatggcagcttcaatgatggccgctggcaccgggtgaaggctgtgagagatggccagagcggcaagatcaccgtggatgattatggagccaggacaggcaagagccctggcatgatgaggcagctgaacatcaatggagccctgtatgtgggcggcatgaaggagatcgccctgcacaccaaccggcagtacatgaggggcctggtgggctgcatcagccacttcaccctgagcacagactaccacatcagcctggtggaggatgctgtggatggcaagaacatcaacacctgtggggccaagtag

SEQ ID NO: 7709 - DNA, 459 bp, Artificial Sequence
  Description of Artificial Sequence: Synthetic coding sequence
atgaggttcaagaccacagccaaggatggcctgctgctgtggaggggggacagccccatgaggcccaacagcgacttcatcagcctgggcctgagagatggagccctggtgttctcctacaacctgggcagcggcgtggccagcatcatggtgaatggcagcttcaatgatggccgctggcaccgggtgaaggctgtgagagatggccagagcggcaagatcaccgtggatgattatggagccaggacaggcaagagccctggcatgatgaggcagctgaacatcaacggggccctgtatgtgggcggcatgaaggagatcgccctgcacaccaaccggcagtacatgaggggcctggtgggctgcatcagccacttcaccctgagcacagactaccacatcagcctggtggaggatgctgtggatggcaagaacatcaacacctgtggggccaagtag

SEQ ID NO: 7710 - DNA, 1050 bp, Artificial Sequence
  Description of Artificial Sequence: Synthetic coding sequence
atgacagccctgcccggccccctgtggctgctgggcctggccctgtgtgccctgggcggcggcggccctggcctgcggcccccacctggctgcccccagaggcggctgggcgcccgggagaggagagatgtgcagcgggagatcctggccgtgctgggcctgcccggccggccccggccccgggcccctcctgctgccagccggctgcctgccagcgcccccctcttcatgctggacctgtaccacgccatggctggagatgatgatgaagatggagccccagctgagcggcggctgggccgggctgacctggtgatgagctttgtgaacatggtggagcgggaccgggccctgggccaccaggagccccactggaaggagttccgctttgacctgacccagatcccagctggggaggccgtgacagctgctgagttccgcatctacaaggtgcccagcatccacctgctgaacagaaccctgcacgtgtccatgttccaggtggtgcaggagcagagcaaccgggagagtgacctcttcttcctggacctgcagaccctgcgggctggagatgagggctggctggtgctggatgtgacagctgccagtgactgctggctgctgaagaggcacaaggacctgggcctgcggctgtatgtggagacagaagatggagagacctggacaggctggggctggaccaaggacagccggctgcagatgtggaagctgcggctgagcaggaccccctgggtgctgagcctgcacgcccctggccctgcccaggccccagctgagcggcccctgctgtgcctgctgcagggccactgcccagccagccccagccccatccgcacccccagggctgtgcggcccctgcggcggcggcagcccaagaagagcaatgagctgccccaggccaaccggctgcccggcatctttgatgatgtgcacggcagccacggccggcaggtgtgcagaagacatgagctgtatgtgtccttccaggacctgggctggctggtgattgctgacagcagctgcttctag

SEQ ID NO: 7711 - DNA, 1617 bp, Artificial Sequence; identical to SEQ ID NO: 7043
  Description of Artificial Sequence: Synthetic coding sequence

SEQ ID NO: 7712 - DNA, 630 bp, Artificial Sequence
  Description of Artificial Sequence: Synthetic coding sequence
atgtccttcagcgccaccatcctcttcagccccccatctggcagcgaggcccgctgctgctgctgtgcctgcaagtctgagaccaatggaggcaacacaggcagccagggcggcaaccccccacccagcacccccatcaccgtgactggacatggcctggccgtgcagagcagcgagcagctgctgcacgtgatctaccagagggtggacaaggctgtgggcctggccgaggccgccctgggcctggcccgggccaacaatgagctgctgaagaggctgcaggaggaggtgggggacctgcggcagggcaaggtgtccatcccagatgaagatggagagagccgggcccacagcagccccccagaggagcccggccccctgaaggagagccctggagaggccttcaaggccctgtctgctgtggaggaggagtgtgacagcgtgggcagcggcgtgcaggtggtgattgaggagctgcggcagctgggcgccgcctctgtgggccctggccccctgggcttccctgccacccagagggacatgaggctgcccggctgcaccctggccgccagcgaggccgcccccctgctgaaccccctggtggatgattatgtggccagcgagggctag

SEQ ID NO: 7713 - DNA, 1617 bp, Artificial Sequence; identical to SEQ ID NO: 7043
  Description of Artificial Sequence: Synthetic coding sequence

SEQ ID NO: 7714 - DNA, 1524 bp, Artificial Sequence; identical to SEQ ID NO: 7049
  Description of Artificial Sequence: Synthetic coding sequence

SEQ ID NO: 7715 - DNA, 753 bp, Artificial Sequence
  Description of Artificial Sequence: Synthetic coding sequence
atggccagcgagcggctgcccaacagacctgcctgcctgctggtggccagcggggctgctgagggcgtgtctgcccagagcttcctgcactgcttcaccatggccagcacagccttcaacctgcaggtggccacccctgggggcaaggccatggagtttgtggatgtgacagagagcaatgcccgctgggtgcaggacttccggctgaaggcctatgccagccctgccaagctggagagcattgatggagcccgctaccacgccctgctgatccccagctgccctggggccctgacagacctggccagcagcggcagcctggcccgcatcctgcagcacttccacagcgagagcaagcccatctgtgctgtgggccacggcgtggccgccctgtgctgtgccaccaatgaagatcgctcctgggtgtttgacagctacagcctgaccggccccagcgtgtgtgagctggtgcgggcccctggctttgcccggctgcccctggtggtggaggactttgtgaaggacagcggggcctgcttctctggagctgctgccagctgccccaaggctgacagacactggcagcacttccctgtggaggagatcttcctggcctgtggcttcaaggtggccggcctgggcgccgcccctggctggggccggggcggcaagcaggaggacaggcctcctgaggagcagaggcgggccggggaggacttccccatctaccagtgtgtgttcatctacccctag

SEQ ID NO: 7716 - DNA, 1386 bp, Artificial Sequence; identical to SEQ ID NO: 7292
  Description of Artificial Sequence: Synthetic coding sequence

SEQ ID NO: 7717 - DNA, 1386 bp, Artificial Sequence; identical to SEQ ID NO: 7292
  Description of Artificial Sequence: Synthetic coding sequence

SEQ ID NO: 7718 - DNA, 1386 bp, Artificial Sequence; identical to SEQ ID NO: 7292
  Description of Artificial Sequence: Synthetic coding sequence

SEQ ID NO: 7719 - DNA, 1452 bp, Artificial Sequence
  Description of Artificial Sequence: Synthetic coding sequence
atgatcacagcccactgcagcctggacctgctgggctctgtggccgtgctgtgtgtgtgtgacctgagccctgcccagtgtgacatcaactgctgctgtgaccctgactgcagctctgtggacttctctgtgttcagcgcctgcagcgtgcctgtggtgactggagacagccagttctgcagccagaaggccgtcatctacagcctgaacttcaccgccaaccccccccagagggtgtttgagctggtggaccagatcaaccccagcatcttctgcatccacatcaccaactacaagccagccctgtccttcatcaaccctgaggtgcctgatgagaacaactttgacaccctgatgaagaccagtgatggcttcaccctgaatgctgagagctatgtgtccttcaccaccaagctggacatccccacagctgccaagtatgaatatggagtgcccctgcagaccagtgacagcttcctgcgcttccccagcagcctgaccagcagcctgtgcacagacaacaacccagctgccttcctggtgaaccaggccgtgaagtgcaccaggaagatcaacctggagcagtgtgaggagattgaggccctgtccatggccttctacagcagccctgagatcctgcgggtgcctgacagcaggaagaaggtgcccatcaccgtgcagagcatcgtcatccagagcctgaacaagaccctgacccggcgggaggacacagatgtgctgcagcccaccctggtgaatgccggccacttcagcctgtgtgtgaatgtggtgctggaggtgaagtacagcctgacctacacagatgctggggaggtgaccaaggctgacctgagctttgtgctgggcaccgtgtcctctgtggtggtgcccctgcagcagaagtttgagatccacttcctgcaggagaacacccagcctgtgcccctgagcggcaaccctggctacgtggtgggcctgcccctggccgccggcttccagccccacaagacaggagccctgccctgccagctggtggcccagaaggtgaagagcctgctgtggggccagggcttcccagactatgtggccccctttggaaacagccaggcccaggacatgctggactgggtgcccatccacttcatcacccagagcttcaacaggaagcactttgtgctgcaggacagctgccagctgcccggggccctggtgattgaggtgaagtggaccaagtatggcagcctgctgaacccccaggccaagatcgtgaatgtgacagccaacctgatcagcagcagcttccctgaggccaacagcggaaatgaaagaaccatcctgatcagcacagctgtgacctttgtggatgtgtctgccccagctgaggccggcttccgggcccccccagccatcaatgcccggctgcccttcaacttcttcttcccctttgtgtag

SEQ ID NO: 7720 - DNA, 1596 bp, Artificial Sequence
  Description of Artificial Sequence: Synthetic coding sequence
atgtgccagctgctggagagcaccgtcatccagccccagggcgacagccctgtggccgtgctgtgtgtgtgtgacctgagccctgcccagtgtgacatcaactgctgctgtgaccctgactgcagctctgtggacttctctgtgttcagcgcctgcagcgtgcctgtggtgactggagacagccagttctgcagccagaaggccgtcatctacagcctgaacttcaccgccaaccccccccagagggtgtttgagctggtggaccagatcaaccccagcatcttctgcatccacatcaccaactacaagccagccctgtccttcatcaaccctgaggtgcctgatgagaacaactttgacaccctgatgaagaccagtgatggcttcaccctgaatgctgagagctatgtgtccttcaccaccaagctggacatccccacagctgccaagtatgaatatggagtgcccctgcagaccagtgacagcttcctgcgcttccccagcagcctgaccagcagcctgtgcacagacaacaacccagctgccttcctggtgaaccaggccgtgaagtgcaccaggaagatcaacctggagcagtgtgaggagattgaggccctgtccatggccttctacagcagccctgagatcctgcgggtgcctgacagcaggaagaaggtgcccatcaccgtgcagagcatcgtcatccagagcctgaacaagaccctgacccggcgggaggacacagatgtgctgcagcccaccctggtgaatgccggccacttcagcctgtgtgtgaatgtggtgctggaggtgaagtacagcctgacctacacagatgctggggaggtgaccaaggctgacctgagctttgtgctgggcaccgtgtcctctgtggtggtgcccctgcagcagaagtttgagatccacttcctgcaggagaacacccagcctgtgcccctgagcggcaaccctggctacgtggtgggcctgcccctggccgccggcttccagccccacaagatgagcggcatcatccagaccaccaacagatatggccagctgaccatcctgcacagcaccacagagcaggactgcctggccctggagggcgtgaggacccctgtgctgtttggctacaccatgcagagcggctgcaagctgcggctgaccggggccctgccctgccagctggtggcccagaaggtgaagagcctgctgtggggccagggcttcccagactatgtggcccccttcggcaacagccaggcccaggacatgctggactgggtgcccatccacttcatcacccagagcttcaacaggaaggacagctgccagctgcccggggccctggtgattgaggtgaagtggaccaagtatggcagcctgctgaacccccaggccaagatcgtgaatgtgacagccaacctgatcagcagcagcttccctgaggccaacagcggaaatgaaagaaccatcctgatcagcacagctgtgacctttgtggatgtgtctgccccagctgaggccggcttccgggcccccccagccatcaatgcccggctgcccttcaacttcttcttcccctttgtgtag

SEQ ID NO: 7721 - DNA, 1722 bp, Artificial Sequence
  Description of Artificial Sequence: Synthetic coding sequence
atgaggccccggggcctgccccccctgctggtggtgctgctgggctgctgggcctctgtgtctgcccagacagatgccaccccagctgtgaccacagagggcctgaacagcacagaggccgccctggccaccttcggcaccttccccagcaccaggcctcctggcaccccccgggcccctggccccagcagcggcccccggcccacccctgtgacagatgtggccgtgctgtgtgtgtgtgacctgagccctgcccagtgtgacatcaactgctgctgtgaccctgactgcagctctgtggacttctctgtgttcagcgcctgcagcgtgcctgtggtgactggagacagccagttctgcagccagaaggccgtcatctacagcctgaacttcaccgccaaccccccccagagggtgtttgagctggtggaccagatcaaccccagcatcttctgcatccacatcaccaactacaagccagccctgtccttcatcaaccctgaggtgcctgatgagaacaactttgacaccctgatgaagaccagtgatggcttcaccctgaatgctgagagctatgtgtccttcaccaccaagctggacatccccacagctgccaagtatgaatatggagtgcccctgcagaccagtgacagcttcctgcgcttccccagcagcctgaccagcagcctgtgcacagacaacaacccagctggccaggcctactggttcacccctgtgatcccagccctgtgggaggccgaggcccggggcagcctggaggtgcctgacagcaggaagaaggtgcccatcaccgtgcagagcatcgtcatccagagcctgaacaagaccctgacccggcgggaggacacagatgtgctgcagcccaccctggtgaatgccggccacttcagcctgtgtgtgaatgtggtgctggaggtgaagtacagcctgacctacacagatgctggggaggtgaccaaggctgacctgagctttgtgctgggcaccgtgtcctctgtggtggtgcccctgcagcagaagtttgagatccacttcctgcaggagaacacccagcctgtgcccctgagcggcaaccctggctacgtggtgggcctgcccctggccgccggcttccagccccacaagggcagcggcatcatccagaccaccaacagatatggccagctgaccatcctgcacagcaccacagagcaggactgcctggccctggagggcgtgaggacccctgtgctgtttggctacaccatgcagagcggctgcaagctgcggctgaccggggccctgccctgccagctggtggcccagaaggtgaagagcctgctgtggggccagggcttcccagactatgtggcccccttcggcaacagccaggcccaggacatgctggactgggtgcccatccacttcatcacccagagcttcaacaggaaggacagctgccagctgcccggggccctggtgattgaggtgaagtggaccaagtatggcagcctgctgaacccccaggccaagatcgtgaatgtgacagccaacctgatcagcagcagcttccctgaggccaacagcggaaatgaaagaaccatcctgatcagcacagctgtgacctttgtggatgtgtctgccccagctgaggccggcttccgggcccccccagccatcaatgcccggctgcccttcaacttcttcttcccctttgtgtag

SEQ ID NO: 7722 - DNA, 1230 bp, Artificial Sequence
  Description of Artificial Sequence: Synthetic coding sequence
atgaagaccagtgatggcttcaccctgaatgctgagagctatgtgtccttcaccaccaagctggacatccccacagctgccaagtatgaatatggagtgcccctgcagaccagtgacagcttcctgcgcttccccagcagcctgaccagcagcctgtgcacagacaacaacccagctgccttcctggtgaaccaggccgtgaagtgcaccaggaagatcaacctggagcagtgtgaggagattgaggccctgtccatggccttctacagcagccctgagatcctgcgggtgcctgacagcaggaagaaggtgcccatcaccgtgcagagcatcgtcatccagagcctgaacaagaccctgacccggcgggaggacacagatgtgctgcagcccaccctggtgaatgccggccacttcagcctgtgtgtgaatgtggtgctggaggtgaagtacagcctgacctacacagatgctggggaggtgaccaaggctgacctgagctttgtgctgggcaccgtgtcctctgtggtggtgcccctgcagcagaagtttgagatccacttcctgcaggagaacacccagcctgtgcccctgagcggcaaccctggctacgtggtgggcctgcccctggccgccggcttccagccccacaagggcagcggcatcatccagaccaccaacagatatggccagctgaccatcctgcacagcaccacagagcaggactgcctggccctggagggcgtgaggacccctgtgctgtttggctacaccatgcagagcggctgcaagctgcggctgaccggggccctgccctgccagctggtggcccagaaggtgaagagcctgctgtggggccagggcttcccagactatgtggcccccttcggcaacagccaggcccaggacatgctggactgggtgcccatccacttcatcacccagagcttcaacaggaaggacagctgccagctgcccggggccctggtgattgaggtgaagtggaccaagtatggcagcctgctgaacccccaggccaagatcgtgaatgtgacagccaacctgatcagcagcagcttccctgaggccaacagcggaaatgaaagaaccatcctgatcagcacagctgtgacctttgtggatgtgtctgccccagctgaggccggcttccgggcccccccagccatcaatgcccggctgcccttcaacttcttcttcccctttgtgtag

SEQ ID NO: 7723 - DNA, 1779 bp, Artificial Sequence
  Description of Artificial Sequence: Synthetic coding sequence
atgaggccccggggcctgccccccctgctggtggtgctgctgggctgctgggcctctgtgtctgcccagacagatgccaccccagctgtgaccacagagggcctgaacagcacagaggccgccctggccaccttcggcaccttccccagcaccaggcctcctggcaccccccgggcccctggccccagcagcggcccccggcccacccctgtgacagatgtggccgtgctgtgtgtgtgtgacctgagccctgcccagtgtgacatcaactgctgctgtgaccctgactgcagctctgtggacttctctgtgttcagcgcctgcagcgtgcctgtggtgactggagacagccagttctgcagccagaaggccgtcatctacagcctgaacttcaccgccaaccccccccagagggtgtttgagctggtggaccagatcaaccccagcatcttctgcatccacatcaccaactacaagccagccctgtccttcatcaaccctgaggtgcctgatgagaacaactttgacaccctgatgaagaccagtgatggcttcaccctgaatgctgagagctatgtgtccttcaccaccaagctggacatccccacagctgccaagtatgaatatggagtgcccctgcagaccagtgacagcttcctgcgcttccccagcagcctgaccagcagcctgtgcacagacaacaacccagctgccttcctggtgaaccaggccgtgaagtgcaccaggaagatcaacctggagcagtgtgaggagattgaggccctgtccatggccttctacagcagccctgagatcctgcgggtgcctgacagcaggaagaaggtgcccatcaccgtgcagagcatcgtcatccagagcctgaacaagaccctgacccggcgggaggacacagatgtgctgcagcccaccctggtgaatgccggccacttcagcctgtgtgtgaatgtggtgctggaggtgaagtacagcctgacctacacagatgctggggaggtgaccaaggctgacctgagctttgtgctgggcaccgtgtcctctgtggtggtgcccctgcagcagaagtttgagatccacttcctgcaggagaacacccagcctgtgcccctgagcggcaaccctggctacgtggtgggcctgcccctggccgccggcttccagccccacaagggcagcggcatcatccagaccaccaacagatatggccagctgaccatcctgcacagcaccacagagcaggactgcctggccctggagggcgtgaggacccctgtgctgtttggctacaccatgcagagcggctgcaagctgcggctgaccggggccctgccctgccagctggtggcccagaaggtgaagagcctgctgtggggccagggcttcccagactatgtggcccccttcggcaacagccaggcccaggacatgctggactgggtgcccatccacttcatcacccagagcttcaacaggaagcactttgtgctgcaggacagctgccagctgcccggggccctggtgattgaggtgaagtggaccaagtatggcagcctgctgaacccccaggccaagatcgtgaatgtgacagccaacctgatcagcagcagcttccctgaggccaacagcggaaatgaaagaaccatcctgatcagcacagctgtgacctttgtggatgtgtctgccccagctgaggccggcttccgggcccccccagccatcaatgcccggctgcccttcaacttcttcttcccctttgtgtag

SEQ ID NO: 7724 - DNA, 552 bp, Artificial Sequence
  Description of Artificial Sequence: Synthetic coding sequence
atgatcttcctgctgctgatgctgagcctggagctgcagctgcaccagattgctgccctcttcaccgtgacagtgcccaaggagctgtacatcatcgagcacggcagcaatgtgaccctggagtgcaactttgacaccggcagccacgtgaacctgggcgccatcacagccagcctgcagaaggtggagaatgacaccagcccccaccgggagcgggccaccctgctggaggagcagctgcccctgggcaaggccagcttccacatcccccaggtgcaggtgagagatgagggccagtaccagtgcatcatcatctacggcgtggcctgggactacaagtacctgaccctgaaggtgaagggccagatggagcccaggacccaccccacctggctgctgcacatcttcatccccttctgcatcatcgccttcatcttcatcgccaccgtgattgccctgaggaagcagctgtgccagaagctgtacagcagcaaggacaccaccaagaggcctgtgaccaccaccaagcgggaggtgaacagcgccatctag

SEQ ID NO: 7725 - DNA, 822 bp, Artificial Sequence
  Description of Artificial Sequence: Synthetic coding sequence
atgatcttcctgctgctgatgctgagcctggagctgcagctgcaccagattgctgccctcttcaccgtgacagtgcccaaggagctgtacatcatcgagcacggcagcaatgtgaccctggagtgcaactttgacaccggcagccacgtgaacctgggcgccatcacagccagcctgcagaaggtggagaatgacaccagcccccaccgggagcgggccaccctgctggaggagcagctgcccctgggcaaggccagcttccacatcccccaggtgcaggtgagagatgagggccagtaccagtgcatcatcatctacggcgtggcctgggactacaagtacctgaccctgaaggtgaaggccagctacaggaagatcaacacccacatcctgaaggtgcctgagacagatgaggtggagctgacctgccaggccaccggctaccccctggccgaggtgtcctggcccaacgtgtctgtgcctgccaacaccagccacagcaggaccccagagggcctgtaccaggtgacctctgtgctgcggctgaagcccccacctggcaggaacttcagctgtgtgttctggaacacccacgtgcgggagctgaccctggccagcattgacctgcagagccagatggagcccaggacccaccccacctggctgctgcacatcttcatccccttctgcatcatcgccttcatcttcatcgccaccgtgattgccctgaggaagcagctgtgccagaagctgtacagcagcaaggacaccaccaagaggcctgtgaccaccaccaagcgggaggtgaacagcgccatctag

SEQ ID NO: 7726 - DNA, 372 bp, Artificial Sequence
  Description of Artificial Sequence: Synthetic coding sequence
ctgggggaccggcggggccgcagcagcggggcccgggctgctgctgtgggcagcactggagagcggctggagatggaggaggacatcctgcagctgcaggccgaggccacagctgaggtgctgggggaggtggcccaggcccagaaggtgctgcgggacagcgtgcagaggctggaggtgcagctgcggagcgcctggctgggccctgcctaccgggagtttgaggtgctgaaggcccatgctgacaagcagagccacatcctgtgggccctgaccggccacgtgcagaggcagaggcgggagatggtggcccagcagcaccggctgcggcagatccaggagcggctgcacacagctgccctgcctgcctag

SEQ ID NO: 7727 - DNA, 345 bp, Artificial Sequence
  Description of Artificial Sequence: Synthetic coding sequence
atggccagcttcaagctggccgacagcgtgtgggaggacagcctgagcaagaggcagaggaaccagggccgcatgaagaccctgcctgtgctggtgctgagcctgaccctgctgactgtgttcagcgagaccagccccatcctgacagagaagcaggccaagcagctgctgcggagccggcggcaggaccggcccagcaagccaggcttcccagatgagcccatgagggagtacatgcaccacctgctggccctggagcacagagctgaggagcagttcctggagcactggctgaacccccactgcaagccccactgtgacaggaaccgcatccaccctgtgtag

SEQ ID NO: 7728 - DNA, 345 bp, Artificial Sequence; identical to SEQ ID NO: 7727
  Description of Artificial Sequence: Synthetic coding sequence

SEQ ID NO: 7729 - DNA, 444 bp, Artificial Sequence
  Description of Artificial Sequence: Synthetic coding sequence
atggccctgcagaggacccacagcctgctgctgctgctgctgctgaccctgctgggcctgggcctggtgcagcccagctatggccaggacggcatgtaccagcgcttcctgcggcagcacgtgcaccctgaggagaccggcggcagtgaccgctactgcaacctgatgatgcagaggaggaagatgaccctgtaccactgcaagcgcttcaacaccttcatccacgaggacatctggaacatccgcagcatctgcagcaccaccaacatccagtgcaagaatggcaagatgaactgccacgagggcgtggtgaaggtgacagactgccgggacaccggcagcagccgggcccccaactgccgctaccgggccatcgccagcaccaggagagtggtgattgcctgtgagggcaacccccaggtgcctgtgcactttgatggatag

SEQ ID NO: 7730 - DNA, 1302 bp, Artificial Sequence
  Description of Artificial Sequence: Synthetic coding sequence
atggagccccagctgggccctgaggccgccgccctgcggcccggctggctggccctgctgctgtgggtgtctgccctgagctgcagcttcagcctgcctgccagcagcctgagcagcctggtgccccaggtgaggaccagctacaactttggccgcaccttcctgggcctggacaagtgcaatgcctgcatcggcaccagcatctgcaagaagttcttcaaggaggagatccgcagtgacaactggctggccagccacctgggcctgcccccagacagcctgctgagctacccagccaactacagtgatgacagcaagatctggaggcctgtggagatcttccggctggtgtccaagtaccagaatgagatcagtgaccggcgcatctgtgccagcgccagcgcccccaagacctgcagcattgagcgggtgctgaggaagacagagcgcttccagaagtggctgcaggccaagaggctgaccccagacctggtgcagggcctggccagccccctgctgcgctgccccagccagaggctgctggacagagtggtgcggcgctatgcagaggtggctgatgctggcagcatcttcatggaccacttcacagaccgggacaagctgcggctgctgtacaccctggccgtgaacagccaccccatcctgctgcagatcttccctggagctgagggctggcccctgcccaagtacctgggcagctgtggccgcttcctggtgtccaccagcacccggcccctgcaggagttctatgatgcccccccagaccaggccgctgacctggcctaccagctgctgggcgtgctggagagcctgcggagcaatgacctgaactacttcttctacttcacccacattgatgctggcatgtttggagtcttcaacaacggccacctgttcatcagagatgccagcgctgtgggcgtcatcgacaagcaggagggcagccaggaggccaacagagctggggagaacaaggacatcttcagctgcctggtgtctggctgccaggcccagctgcccagctgtgagagcatcagcgagaagcagagcctggtgctggtgtgccagaagctgctgccccggctgctgcagggccgcttccccagccctgtgcaggatgacatcgacagcatcctggtgcagtgtggggacagcatccggccagaccctgaggtgctgggcgccgccagccagctgaaggacatcctgcggcccctgcggacctgtgacagcagatttgcctaccgctacccagactgcaagtacaatgacaagttctag

SEQ ID NO: 7731 - DNA, 600 bp, Artificial Sequence; identical to SEQ ID NO: 7206
  Description of Artificial Sequence: Synthetic coding sequence

SEQ ID NO: 7732 - DNA, 600 bp, Artificial Sequence; identical to SEQ ID NO: 7206
  Description of Artificial Sequence: Synthetic coding sequence

SEQ ID NO: 7733 - DNA, 291 bp, Artificial Sequence
  Description of Artificial Sequence: Synthetic coding sequence
atgctgccctgcctggccctgctgctgctgatggagctgtctgtgtgcaccgtggccggagatggaggagaggagcagaccctgagcacagaggccgagacctgggagggcgccggccccagcatccagctgcagctgcaggaggtgaagacaggcaaggccagccagttcttcggcctgatgggcaagagggtgggcgcctaccagctggagcacaccttccagggcctgctgggcaagaggagcctcttcacagagggcagagaagatgaggcccagggcagcgagtag

SEQ ID NO: 7734 - DNA, 981 bp, Artificial Sequence
  Description of Artificial Sequence: Synthetic coding sequence
atgacaggcctgtgtggctacagcgccccagacatgaggggcctgcggctcatcatgatccctgtggagctgctgctgtgctacctgctgctgcaccctgtggatgccaccagctatggcaagcagaccaacgtgctgatgcacttccccctgagcctggagagccagacccccagcagtgaccccctgagctgccagttcctgcaccccaagagcctgcccggcttcagccacatggcccccctgcccaagttcctggtgtccctggccctgagaaatgccctggaggaggccggctgccaggctgatgtgtgggccctgcagctgcagctgtaccggcagggcggcgtgaatgccacccaggtgctgatccagcacctgcggggcctgcagaagggccgcagcacagaaagaaatgtgtctgtggaggccctggccagcgccctgcagctgctggcccgggagcagcagagcacaggccgggtgggccgcagcctgcccacagaggactgtgaaaatgagaaggagcaggccgtgcacaacgtggtgcagctgctgcccggggtgggcaccttctacaacctgggcacagccctgtactatgccacccagaactgcctgggcaaggcccgggagcggggcagagatggagccatcgacctgggctatgacctgctgatgaccatggccggcatgtctgggggccccatgggcctggccatctctgctgccctgaagccagccctgcggtctggagtgcagcagctgatccagtactaccaggaccagaaggatgccaacatcagccagcctgagaccaccaaggagggcctgcgggccatcagtgatgtgtctgacctggaggagaccaccaccctggccagcttcatcagcgaggtggtgtcctctgccccctactggggctgggccatcatcaagagctatgacctggaccctggagctggcagcctggagatctag

SEQ ID NO: 7735 - DNA, 1476 bp, Artificial Sequence
  Description of Artificial Sequence: Synthetic coding sequence
atgcgctggatcctgtgctggagcctgaccctgtgcctgatggcccagacagccctgggcgccctgcacaccaagaggccccaggtggtgaccaagtatggcaccctgcagggcaagcagatgcacgtgggcaagacccccatccaggtgttcctgggcgtgcccttcagcaggcctcccctgggcatcctgcgctttgcccctcctgagcccccagagccctggaagggcatcagagatgccaccacctacccacctggctgcctgcaggagagctggggccagctggcctccatgtatgtgtccacccgggagcgctacaagtggctgcgcttcagcgaggactgcctgtacctgaatgtgtatgccccagcccgggcccctggggacccccagctgcctgtgatggtgtggttccctgggggcgccttcatcgtgggcgccgccagcagctatgagggcagtgacctggccgcccgggagaaggtggtgctggtgttcctgcagcaccggctgggcatcttcggcttcctgagcacagatgacagccacgcccggggcaactggggcctgctggaccagatggccgccctgcgctgggtgcaggagaacattgctgccttcggcggggaccctggaaatgtgaccctgtttggccagagcgctggggccatgagcatcagcggcctgatgatgagccccctggccagcggcctcttccaccgggccatcagccagagcggcacagccctcttccgcctcttcatcaccagcaaccccctgaaggtggccaagaaggtggcccacctggccggctgcaaccacaacagcacccagatcctggtgaactgcctgcgggccctgagcggcaccaaggtgatgagggtgagcaacaagatgaggttcctgcagctgaacttccagagggaccctgaggagatcatctggagcatgagccctgtggtggatggagtggtgatcccagatgaccccctggtgctgctgacccagggcaaggtgtcctctgtgccctacctgctgggcgtgaacaacctggagttcaactggctgctgccctacaacatcaccaaggagcaggtgcccctggtggtggaggagtacctggacaacgtgaatgaacatgactggaagatgctgaggaacaggatgatggacatcgtgcaggatgccacctttgtgtatgccaccctgcagacagcccactaccaccggggcctgtccatgggcaaggagaaggccctgagcctgcagatgatgaagtactgggccaactttgccaggactggaaaccccaatgatggcaacctgccctgctggccccgctacaacaaggatgagaagtacctgcagctggacttcaccaccagggtgggcatgaagctgaaggagaagaagatggccttctggatgagcctgtaccagagccagaggcctgagaagcagaggcagttctag

SEQ ID NO: 7736 - DNA, 285 bp, Artificial Sequence
  Description of Artificial Sequence: Synthetic coding sequence
atggccgccttcccccacaagatcatcttcttcctggtgtgcagcaccctgacccacgtggccttcagcggcatcttcaacaagagggacttcacccgctggcccaagccccgctgcaagatgtacatccccctggaccctgactacaatgctgactgccccaacgtgacagcccctgtgtgtgccagcaatggccacaccttccagaatgaatgcttcttctgtgtggagcagcgggagttccactaccgcatcaagtttgagaagtatggaaaatgtgactag

SEQ ID NO: 7737 - DNA, 402 bp, Artificial Sequence
  Description of Artificial Sequence: Synthetic coding sequence
atgaggcagaggctgctgcccagcgtgaccagcctgctgctggtggccctgctcttccctggcagcagccaggcccggcacgtgaaccacagcgccacagaggccctgggggagctgcgggagcgggcccctggccagggcaccaacggcttccagctgctgcggcatgctgtgaagagggacctgctgccccccaggaccccaccctaccagggagatgtgcccccaggcatccggaacaccatctgccacatgcagcagggcatctgccgcctcttcttctgccacagcggggagaagaagagggacatctgcagcgacccctggaaccgctgctgcgtgagcaacacagatgaggagggcaaggagaagccagagatggatggccgcagcggcatctag

SEQ ID NO: 7738 - DNA, 564 bp, Artificial Sequence
  Description of Artificial Sequence: Synthetic coding sequence
atgggctgctgcggctgcagcggcggctgcggcagcggctgcggcggctgcggcagcggctgcggcggctgcggcagcagctgctgcgtgcccatctgctgctgcaagcctgtgtgctgctgcgtgcctgcctgcagctgcagcagctgtggcagctgtggcggcagcaaaggaggccggggcagctgtggcggcagcaaaggagactgtggcagctgtggcggcagcaaaggaggctgcggcagctgtggctgcagccagtgcagctgctacaagccctgctgctgcagcagcggctgcggcagcagctgctgccagagcagctgctgcaagccctgctgcagccagagcagctgctgcaagccctgcagctgcagcagcggctgcggcagcagctgctgccagagcagctgctgcaagccctgctgcagccagagcagctgctgcaagccctgctgctgcagcagcggctgcggcagcagctgctgccagagcagctgctgcaagccctgctgcagccagagcagctgctgcgtgcccatctgctgccagtgcaagatctag

SEQ ID NO: 7739 - DNA, 564 bp, Artificial Sequence
  Description of Artificial Sequence: Synthetic coding sequence
atgaggcccctggccggggcccctgtgcccaagaggcagaagtgtgaccactggaccccctgccccagcgacacctacgcctaccgcctgctgagcggcggcggccgcagcaaatatgccaagatctgctttgaggacaacctgctgatgggagagcagctgggcaatgtggcccggggcatcaacatcgccatcgtgaactacgtgactggaaatgtgacagccacccgctgctttgacatgtatgaaggagacaacagcggccccatgaccaagttcatccagagcgctgcccccaagagcctgctcttcatggtgacctatgatgatggcagcacccggctgaacaatgatgccaagaatgccatcgaggccctgggcagcaaggagatccggaacatgaagttccgcagctcctgggtgttcatcgccgccaagggcctggagctgcccagcgagatccagcgggagaagatcaaccacagtgatgccaagaacaaccgctacagcggctggccagctgagatccagatcgagggctgcatccccaaggagaggagctag

SEQ ID NO: 7740 - DNA, 249 bp, Artificial Sequence
  Description of Artificial Sequence: Synthetic coding sequence
atgaagatcctgtgcatcttcctgacctttgtgttcaccgtgtcctgtggccccagcgtgccccagaagaagacccgggaggtggccgagaggaagcgggagtgccagctggtgcggggggcctgcaagccagagtgcaacagctgggagtatgtgtactactactgcaatgtgaacccctgctgtgctgtgtgggagtaccagaagcccatcatcaacaagatcaccagcaagctgcaccagaagtag

SEQ ID NO: 7741 - DNA, 186 bp, Artificial Sequence
  Description of Artificial Sequence: Synthetic coding sequence
atgaagatccacgtgttcctgtttgtgctcttcttcttcctggtgcccatcgccaccagggtgaagtgtgctgtgaaggacacctacagctgcttcatcatgagaggaaaatgtagacatgaatgtcatgactttgagaagcccatcggcttctgcaccaagctgaatgccaactgctacatgtag

SEQ ID NO: 7742 - DNA, 1056 bp, Artificial Sequence
  Description of Artificial Sequence: Synthetic coding sequence
atgggcaacctcttcatgctgtgggccgccctgggcatctgctgtgccgccttcagcgccagcgcctggagcgtgaacaacttcctgatcaccggccccaaggcctacctgacctacaccacctctgtggccctgggcgcccagagcggcatcgaggagtgcaagttccagtttgcctgggagcgctggaactgcccagaaaatgccctgcagctgagcacccacaaccggctgcggagcgccacccgggagaccagcttcatccacgccatcagcagcgctggggtgatgtacatcatcaccaagaactgcagcatgggagactttgagaactgtggctgtgatggcagcaacaacgggaagacaggaggccacggctggatctggggcggctgcagcgacaacgtggagtttggagagcgcatcagcaagctgtttgtggacagcctggagaagggcaaggatgcccgggccctgatgaacctgcacaacaacagagctggccgcctggccgtgcgggccaccatgaagaggacctgcaagtgccacggcatcagcggcagctgcagcatccagacctgctggctgcagctggccgagttccgggagatgggagactacctgaaggccaagtatgaccaggccctgaagattgagatggacaagaggcagctgcgggccggcaacagcgctgagggccactgggtgcctgctgaggccttcctgcccagcgctgaggccgagctgatcttcctggaggagagcccagactactgcacctgcaacagcagcctgggcatctacggcacagagggccgggagtgcctgcagaacagccacaacaccagccgctgggagaggaggagctgtggccgcctgtgcacagaatgtggcctgcaggtggaggagaggaagacagaggtgatcagcagctgcaactgcaagttccagtggtgctgcaccgtgaagtgtgaccagtgcagacatgtggtgtccaagtactactgtgcccggagccctggcagcgcccagagcctgggcaagggcagcgcctag

SEQ ID NO: 7743 - DNA, 1446 bp, Artificial Sequence
  Description of Artificial Sequence: Synthetic coding sequence
atgcagagccggctgctgctgctgggcgcccctgggggccacggcggccctgccagcaggaggatgaggctgctgctgcggcaggtggtgcagaggaggcctggaggagaccggcagaggcctgaggtgcggctgctgcacgccggcagcggggctgacaccggggacacagtgaacattggagatgtgtcctacaagctgaagatccccaagaaccctgagctggtgccccagaactacatcagtgacagcctggcccagagcgtggtgcagcacctgcgctggatcatgcagaaggacctgctgggccaggatgtgttcctgattggccccccaggccccctgcggcgcagcatcgccatgcagtacctggagctgaccaagcgggaggtggagtacatcgccctgagccgggacaccacagaaacagacctgaagcagaggcgggagatccgggccggcacagccttctacatcgaccagtgtgctgtgcgggccgccacagagggccgcaccctcatcctggagggcctggagaaggccgagagaaatgtgctgcctgtgctgaacaacctgctggagaaccgggagatgcagctggaggatggccgcttcctgatgtctgctgagagatatgacaagctgctgcgggaccacaccaagaaggagctggacagctggaagatcgtgcgggtgtctgagaacttccgggtgattgccctgggcctgcctgtgccccgctacagcggcaaccccctggacccccccctgcggagccgcttccaggcccgggacatctactacctgcccttcaaggaccagctgaagctgctgtacagcattggagccaacgtgtctgctgagaaggtgtcccagctgctgagctttgccaccaccctgtgcagccaggagagcagcaccctgggcctgcctgacttccccctggacagcctggccgctgctgtgcagatcctggacagcttccccatgatgcccatcaagcacgccatccagtggctgtacccctacagcatcctgctgggccacgagggcaagatggctgtggagggcgtgctgaagagatttgagctgcaggacagcggcagcagcctgctgcccaaggagatcgtgaaggtggagaagatgatggagaaccacgtgtcccaggcctctgtgaccatcagaattgctgacaaggaggtgaccatcaaggtgcctgctggcacccggctgctgagccagccctgtgccagtgaccgcttcatccagaccctgagccacaagcagctgcaggccgagatgatgcagagccacatggtgaaggacatctgcctgattggaggcaagggctgcggcaagacagtcatcgccaagaactttgctgacaccctgggctacaacatcgagcccatcatgctgtaccagcacaaggtgccccacatctag

SEQ ID NO: 7744 - DNA, 786 bp, Artificial Sequence
  Description of Artificial Sequence: Synthetic coding sequence
atggccagcctggccgtgagcaactggcccaagcccatgcccctcatcccctgcctgtcctggagcacagccagcggggtcttcaccaccggggtgctgagcaagagcatcaactggagggagctggagaagcagtactacacccagacagtgtatgaggaggagatcatccacatgctggagtactgcggcacagacagcttcaagatgggccaggagtttgtgaagcacttcaccagcagcgctgacaagctgaccaacctgaacctggtgtccaggaccctgaacctggacatcagcaaccaggtggtgtcccagaagccagctgactgccacaacagcagcaagacctctgtgtctgccaccagcgagggcctgctgctgcaggacaccagcaagatgaagcgcttcaaccagaccctgagcaccaacaagagcggctacaccagcaggaacccccagagctaccacctgctgagcaaggagcagagcaggaacagcctgaggaaggagagcctcatcttcatgaagggcgtgatggatgagtgcacccacgtggccaacttctctgtgcctgtggaccccagcctcatcatcgtggtgcaggccaaggaggatgcctacatccccaggactggagtgcgcagcctgcaggagatctggccaggctgtgagatccgctacctggagggcggccacatcagcgcctacctgttcaagcagggcctcttccggcaggccatctatgatgcctttgaccgcttcctgcacaagtatgccaactag

SEQ ID NO: 7745 - DNA, 1245 bp, Artificial Sequence
  Description of Artificial Sequence: Synthetic coding sequence
atgggcgtgtccaagctggacatcctgtacagaaggctgctgctgaccaagctgttcatccggggctggggccggcctgaggacctgaagaggctgtttgagttcaggaagatgattggcaaccgggagcgctgccagaacctggtgtccagtgactaccctgtgcacatcgacaagattgaggagcagagcgactgcaagatcctggatggccactttgtgagccccatggcccactacgtgcctgacatcatgcccattgaatctgtgattgcccgcttccagttcatcgtgcccaaggagtggaacagcaagtacagacctgtgtgcatccacctggccggcaccggggaccaccactactggaggaggaggaccctgatggcccggcccatgatcaaggaggccaggatggccagcctgctgctggagaacccctactacggctgcaggaagcccaaggaccaggtgcgcagcagcctgaagaatgtgtctgacctgtttgtgatgggcggggccctggtgctggagagcgctgccctgctgcactggctggagcgggagggctacggccccctgggcatgacaggcatctccatgggcggccacatggccagcctggccgtgagcaactggcccaagcccatgcccctcatcccctgcctgtcctggagcacagccagcggggtcttcaccaccacagacagcttcaagatgggccaggagtttgtgaagcacttcaccagcagcgctgacaagctgaccaacctgaacctggtgtccaggaccctgaacctggacatcagcaaccaggtggtgtcccagaagccagctgactgccacaacagcagcaagacctctgtgtctgccaccagcgagggcctgctgctgcaggacaccagcaagatgaagcgcttcaaccagaccctgagcaccaacaagagcggctacaccagcaggaacccccagagctaccacctgctgagcaaggagcagagcaggaacagcctgaggaaggagagcctcatcttcatgaagggcgtgatggatgaatgtacccacgtggccaacttctctgtgcctgtggaccccagcctcatcatcgtggtgcaggccaaggaggatgcctacatccccaggactggagtgcgcagcctgcaggagatctggccaggctgtgagatccgctacctggagggcggccacatcagcgcctacctgttcaagcagggcctcttcagatag

SEQ ID NO: 7746 - DNA, 747 bp, Artificial Sequence
  Description of Artificial Sequence: Synthetic coding sequence
atgaagctgaccttcttcctgggcctgctggccctgatcagctgcttcaccccatctgagagccagcgcttcagccggcggccctacctgcccggccagctgcccccaccacccctgtaccggccccgctgggtgccccccagccccccaccaccctatgacagccggctgaacagccccctgagcctgccctttgtgcccggccgggtgccccccagcagcttcagccgcttcagccaggccgtcatcctgagccagctgttccccctggagagcatccggcagcccaggctcttccctggctaccccaacctgcacttccccctgcggccctactacgtgggccccatccgcatcctgaagccacccttcccccccatccccttcttcctggccatctacctgcccatcagcaaccctgagccccagatcaacatcaccacagctgacaccaccatcaccaccaacccccccaccacagccacagccaccaccagcaccagcaccaagcccaccatgaccatcagcagcagcacagtgcccatcagcagcaccccagagcccgccaccagcatctctgctgccaccccagctgccagcacagagaacaccacccagatcctggccaaccggccccacacagtgctgctgaatgccaccgtgcaggtgaccaccagcaaccagaccatcctgagcagccctgccttcaagagcttctggcagaagctgtttgccatctttggatag

SEQ ID NO: 7747 - DNA, 231 bp, Artificial Sequence
  Description of Artificial Sequence: Synthetic coding sequence
atgggcgccgccatcagccagggcgccctgattgccatcgtgtgcaatggcctggtgggcttcctgctgctgctgctgtgggtgatcctgtgctgggcctgccacagccgctctgcagatgtggacagcctgtctgagagcagccccaacagcagccctggcccctgcccagagaaggcccccccaccccagaagcccagccatgagggcagctacctgctgcagccctag

SEQ ID NO: 7748 - DNA, 1536 bp, Artificial Sequence; identical to SEQ ID NO: 6937
  Description of Artificial Sequence: Synthetic coding sequence

SEQ ID NO: 7749 - DNA, 1536 bp, Artificial Sequence; identical to SEQ ID NO: 6937
  Description of Artificial Sequence: Synthetic coding sequence

SEQ ID NO: 7750 - DNA, 240 bp, Artificial Sequence
  Description of Artificial Sequence: Synthetic coding sequence
atgaagctgcacagcctcatctctgtgctgctgctgtttgtgaccctcatccccaagggcaagacaggagtcatccctggccagaagcagtgcatcgccctgaagggcgtgtgccgggacaagctgtgcagcaccctggatgacaccatcggcatctgcaatgaaggcaagaagtgctgccgccgctggtggatcctggagccctaccccacccctgtgcccaagggcaagagcccctag

SEQ ID NO: 7751 - DNA, 351 bp, Artificial Sequence; identical to SEQ ID NO: 7504
  Description of Artificial Sequence: Synthetic coding sequence

SEQ ID NO: 7752 - DNA, 543 bp, Artificial Sequence
  Description of Artificial Sequence: Synthetic coding sequence
caggtgatccccatcaacagcggggacctgtttgtgcaccccctgtggaacagaagctgtgtggcctgtggaaatgacatcgccctgatcaagctgagccgcagcgcccagctgggagatgctgtgcagctggccagcctgcccccagctggggacatcctgcccaatgagaccccctgctacatcaccggctggggccgcctgtacaccaacggccccctgcctgacaagctgcaggaggccctgctgcctgtggtggactatgagcactgcagccgctggaactggtggggcagctctgtgaagaagaccatggtgtgtgccggcggggacatccgcagcggctgcaatggagacagcggcggccccctgaactgccccacagaagatggcggctggcaggtgcacggcgtgaccagctttgtgtctgccttcggctgcaacaccaggaggaagcccaccgtcttcaccagggtgtctgccttcatcgactggattgaggagaagctgcagggcaacaaggcccctgagagcaggacatag

SEQ ID NO: 7753 - DNA, 1215 bp, Artificial Sequence
  Description of Artificial Sequence: Synthetic coding sequence
atgccacccttcctgatcaccctcttcctgttccacagctgctgcctgcgggccaacggccacctgcgggagggcatgaccctgctgaagacagaatttgccctgcacctgtaccagagcgtggccgcctgcagaaatgagaccaacttcgtcatcagccctgctggggtgtccctgcccctggagatcctgcagtttggagctgagggcagcacaggccagcagctggctgatgccctgggctacacagtgcatgacaagagggtgaaggacttcctgcatgctgtgtatgccaccctgcccaccagcagccagggcacagagatggagctggcctgcagcctgtttgtgcaggtgggcacccccctgagcccctgctttgtggagcacgtgtcctggtgggccaacagcagcctggagcctgctgacctgtctgagcccaacagcacagccatccagaccagcgagggcgccagccgggagacagctgggggcggccccagcgagggccctgggggctggccctgggagcaggtgtctgctgcctttgcccagctggtgctggtgtccaccatgtccttccagggcacctggaggaagcgcttcagcagcacagacacccagatcctgcccttcacctgtgcctacggcctggtgctgcaggtgcccatgatgcaccagaccacagaggtgaactacggccagttccaggacacagctggccaccaggtgggcgtgctggagctgccctacctgggcagcgctgtgtccctcttcctggtgctgccccgggacaaggacacccccctgagccacatcgagccccacctgacagccagcaccatccacctgtggaccaccagcctgcggcgggccaggatggatgtgttcctgccccgcttccgcatccagaaccagttcaacctgaagagcatcctgaacagctggggcgtgacagacctgtttgaccccctgaaggccaacctgaagggcatcagcggccaggacggcttctacgtgtctgaggccatccacaaggccaagattgaggtgctggaggagggcaccaaggccagcggggccacagccctgctgctgctgaagaggagccgcatccccatcttcaaggctgaccggcccttcatctacttcctgcgggagcccaacacaggctttgtgttcagcatcggccgggtgagcaaccccctggactag

SEQ ID NO: 7754 - DNA, 444 bp, Artificial Sequence; identical to SEQ ID NO: 7701
  Description of Artificial Sequence: Synthetic coding sequence

SEQ ID NO: 7755 - DNA, 2631 bp, Artificial Sequence; identical to SEQ ID NO: 6925
  Description of Artificial Sequence: Synthetic coding sequence

SEQ ID NO: 7756 - DNA, 2631 bp, Artificial Sequence; identical to SEQ ID NO: 6925
  Description of Artificial Sequence: Synthetic coding sequence

SEQ ID NO: 7757 - DNA, 2742 bp, Artificial Sequence; identical to SEQ ID NO: 7141
  Description of Artificial Sequence: Synthetic coding sequence

SEQ ID NO: 7758 - DNA, 444 bp, Artificial Sequence; identical to SEQ ID NO: 7701
  Description of Artificial Sequence: Synthetic coding sequence

SEQ ID NO: 7759 - DNA, 2631 bp, Artificial Sequence; identical to SEQ ID NO: 6925
  Description of Artificial Sequence: Synthetic coding sequence

SEQ ID NO: 7760 - DNA, 2631 bp, Artificial Sequence; identical to SEQ ID NO: 6925
  Description of Artificial Sequence: Synthetic coding sequence

SEQ ID NO: 7761 - DNA, 2631 bp, Artificial Sequence; identical to SEQ ID NO: 6925
  Description of Artificial Sequence: Synthetic coding sequence

SEQ ID NO: 7762 - DNA, 2742 bp, Artificial Sequence; identical to SEQ ID NO: 7141
  Description of Artificial Sequence: Synthetic coding sequence

SEQ ID NO: 7763 - DNA, 2742 bp, Artificial Sequence; identical to SEQ ID NO: 7141
  Description of Artificial Sequence: Synthetic coding sequence

SEQ ID NO: 7764 - DNA, 309 bp, Artificial Sequence
  Description of Artificial Sequence: Synthetic coding sequence
atgtctgtgatgaagccctgcctgatgaccatcgccatcctgatgatcctggcccagaagacccctgggggcctcttccgcagccacaacgggaagagccgggagccctggaacccctgtgagctgtaccagggcatgtgcagaaatgcctgccgggagtatgagatccagtacctgacctgccccaatgaccagaagtgctgcctgaagctgtctgtgaagatcaccagcagcaagaatgtgaaggaggactatgacagcaacagcaacctgtctgtgaccaacagcagcagctacagccacatctag

SEQ ID NO: 7765 - DNA, 267 bp, Artificial Sequence
  Description of Artificial Sequence: Synthetic coding sequence
atgctgcctgaccacttcagccccctgagcggggacatcaagctgtctgtgctggccctggtggtgctggtggtgctggcccagacagccccagatggctggatccgccgctgctactacggcaccggccgctgcaggaagagctgcaaggagattgaaaggaagaaggagaagtgtggggagaagcacatctgctgcgtgcccaaggagaaggacaagctgagccacatccatgaccagaaggagaccagcgagctgtacatctag

SEQ ID NO: 7766 - DNA, 1401 bp, Artificial Sequence; identical to SEQ ID NO: 7220
  Description of Artificial Sequence: Synthetic coding sequence

SEQ ID NO: 7767 - DNA, 207 bp, Artificial Sequence
  Description of Artificial Sequence: Synthetic coding sequence
atgaagctgtgtgtgacagtgctgagcctgctggtgctggtggccgccttctgcagcctggccctgagcgcccccaccaagagcagcgagtggaagctgcagggcgtgtgcttccagtgctgcagcggcaaggaccccatccaccagagctgccccacctggaccatggtgcggcagaggaagatgcccaccactggaaaaggatag

SEQ ID NO: 7768 - DNA, 420 bp, Artificial Sequence
  Description of Artificial Sequence: Synthetic coding sequence
atgtacaagctggccagctgctgcctgctcttcatcggcttcctgaaccccctgctgagcctgcccctgctggacagccgggagatctccttccagctgagcgcccctcatgaagatgcccggctgaccccagaggagctggagcgggccagcctgctgcagatcctgcctgagatgctgggcgctgagcggggggacatcctgaggaaggctgacagcagcaccaacatcttcaacccccggggcaacctgaggaagttccaggacttcagcggccaggaccccaacatcctgctgagccacctgctggcccgcatctggaagccctacaagaagcagaggaggaagctgcggcaggacctgcggctgtggaagaaggagcccggcctgcgcatcttcaagaactacgtgtacatctag

SEQ ID NO: 7769 - DNA, 1974 bp, Artificial Sequence
  Description of Artificial Sequence: Synthetic coding sequence
atgaggacagtggtgctgaccatgaaggcctctgtgattgagatgttcctggtgctgctggtgactggagtgcacagcaacaaggagacagccaagaagatcaagaggcccaagttcaccgtgccccagatcaactgtgatgtgaaggccggcaagatcatcgaccctgagttcatcgtgaagtgcccagctggctgccaggaccccaagtaccacgtgtatggaacagatgtgtatgccagctacagctctgtgtgtggggctgctgtgcacagcggcgtgctggacaacagcggcggcaagatcctggtgaggaaggtggccggccagagcggctacaagggcagctacagcaatggagtgcagagcctgagcctgccccgctggagggagagcttcatcgtgctggagagcaagcccaagaagggcgtgacctaccccagcgccctgacctacagcagcagcaagagccctgctgcccaggccggggagaccaccaaggcctaccagaggcctcccatccctggcaccacagcccagcctgtgaccctgatgcagctgctggccgtgacagtggccgtggccacccccaccaccctgccccggcccagccccagcgctgccagcaccaccagcatcccccggccccagagcgtgggccacaggagccaggagatggacctgtggagcacagccacctacaccagcagccagaaccggcccagggctgaccccggcatccagaggcaggaccccagcggggccgccttccagaagcctgtgggcgcagatgtgtccctggactgcaagattgacctgtccttcctgattgatggcagcaccagcatcggcaagaggcgcttccgcatccagaagcagctgctggctgatgtggcccaggccctggacatcggccctgctggccccctgatgggcgtggtgcagtacggggacaacccagccacccacttcaacctgaagacccacaccaacagccgggacctgaagacagccatcgagaagatcacccagaggggcggcctgagcaatgtgggccgggccatcagctttgtgaccaagaacttcttcagcaaggccaatggaaacagaagtggggccccaaatgtggtggtggtgatggtggatggctggcccacagacaaggtggaggaggccagccggctggcccgggagagcggcatcaacatcttcttcatcaccatcgagggcgctgctgaaaatgagaagcagtatgtggtggagcccaactttgccaacaaggctgtgtgcaggaccaacggcttctacagcctgcacgtgcagagctggtttggcctgcacaagaccctgcagcccctggtgaagagggtgtgtgacacagaccggctggcctgcagcaagacctgcctgaacagcgctgacattggatttgtgattgatggcagcagctctgtgggcactggaaacttcagaacagtgctgcagtttgtgaccaacctgaccaaggagtttgagatcagtgacacagacaccagaattggagctgtgcagtacacctatgagcagaggctggagtttggatttgacaagtacagcagcaagccagacatcctgaatgccatcaagagggtgggctactggagcggcggcaccagcactggagctgccatcaactttgccctggagcagctgttcaagaagagcaagcccaacaagaggaagctgatgatcctgatcacagatggccgctcctatgatgatgtgcgcatcccagccatggccgcccacctgaagggcgtcatcacctacgccatcggcgtggcctgggccgcccaggaggagctggaggtgattgccacccacccagcccgggaccacagcttctttgtggatgaatttgacaacctgcaccagtatgtgccccgcatcatccagaacatctgcacagagttcaacagccagcccaggaactag

SEQ ID NO: 7770 - DNA, 3975 bp, Artificial Sequence
  Description of Artificial Sequence: Synthetic coding sequence
atgagacatggagtggcctgggccctgctggtggccgccgccctgggcctgggcgcccggggcgtgagaggagctgtggccctggccgacttctacccctttggagctgagagaggagatgctgtgacccccaagcaggatgatggcggcagcggcctgcggcccctgtctgtgcccttccccttctttggagctgagcacagcggcctgtatgtgaacaacaacggcatcatctccttcctgaaggaggtgtcccagttcacccctgtggccttccccatcgccaaggacagatgtgtggtggccgccttctgggcagatgtggacaacagaagagctggagatgtgtactaccgggaggccacagatcctgccatgctgcggcgggccacagaagatgtgcgccactacttccctgagctgctggacttcaatgccacctgggtgtttgtggccacctggtacagagtgaccttcttcggcggcagcagcagcagccctgtgaacaccttccagacagtgctgatcacagatggcaagctgtccttcaccatcttcaactatgagagcatcgtgtggaccaccggcacccacgccagcagcggcggcaatgccaccggcctgggcggcattgctgcccaggccggcttcaatgctggagatggccagcgctacttcagcatccctggcagcaggacagctgacatggccgaggtggagaccaccaccaacgtgggcgtgcccggccgctgggccttcagaattgatgatgcccaggtgcgggtgggcggctgcggccacaccacctctgtgtgcctggccctgcggccctgcctgaatggaggaaaatgtattgatgactgtgtgacaggcaaccccagctacacctgcagctgcctgagcggcttcaccggccgccgctgccacctggatgtgaatgaatgtgccagccagccctgccagaatggaggcacctgcacccacggcatcaacagcttccgctgccagtgcccagctggctttggaggccccacctgtgaaacagcccagagcccctgtgacaccaaggagtgccagcacggcggccagtgccaggtggagaatggcagcgctgtgtgtgtgtgccaggccggctacaccggggccgcctgtgagatggatgtggatgactgcagcccagacccctgcctgaatggaggcagctgtgtggacctggtgggcaactacacctgcctgtgtgccgagcccttcaagggcctgcgctgtgagaccggggaccaccctgtgcctgatgcctgcctgagcgccccctgccacaacggcggcacctgtgtggatgctgaccagggctacgtgtgtgagtgcccagagggcttcatgggcctggactgccgggagcgggtgcctgatgactgtgaatgtagaaatggaggccgctgcctgggcgccaacaccaccctgtgccagtgccccctgggcttcttcggcctgctgtgtgaatttgagatcacagccatgccctgcaacatgaacacccagtgcccagatggcggctactgcatggagcacggcggcagctacctgtgtgtgtgccacacagaccacaatgccagccacagcctgcccagcccctgtgacagcgacccctgcttcaacggcggcagctgtgatgcccatgatgacagctacacctgtgagtgcccccggggcttccacggcaagcactgtgagaaggcccggccccacctgtgcagcagcggcccctgcagaaatggaggcacctgcaaggaggccggcggggagtaccactgcagctgcccctaccgcttcaccggccgccactgtgaaattggcaagccagacagctgtgccagcggcccctgccacaacggcggcacctgcttccactacatcggcaagtacaagtgtgactgccccccaggcttcagcggccgccactgtgagatcgcccccagcccctgcttccgcagcccctgtgtgaatggaggcacctgtgaagatcgggacacagacttcttctgccactgccaggccggctacatgggccgccgctgccaggccgaggtggactgtggccccccagaggaggtgaagcacgccaccctgcgcttcaacggcacccggctgggcgctgtggccctgtatgcctgtgaccggggctacagcctgagcgcccccagccgcatccgggtgtgccagccccacggcgtgtggagcgagcccccccagtgcctggagattgatgagtgccgcagccagccctgcctgcacggcggcagctgccaggacagagtggccggctacctgtgcctgtgcagcacaggctatgaaggagcccactgtgagctggagagagatgagtgccgggcccacccctgcagaaatggaggcagctgcaggaacctgcccggggcctacgtgtgccgctgcccagctggctttgtgggcgtgcactgtgaaacagaggtggatgcctgtgacagcagcccctgccagcacggcggccgctgtgagagcggcggcggggcctacctgtgtgtgtgcccagagagcttcttcggctaccactgtgagaccgtgtctgacccctgcttcagcagcccctgtggcggccggggctactgcctggccagcaatggcagccacagctgcacctgcaaggtgggctacaccggggaggactgtgccaaggagctgttccccccaacagccctgaagatggagcgggtggaggagagcggcgtgtccatctcctggaacccccccaacggccctgctgcccggcagatgctggatggctatgctgtgacctacgtgtccagtgatggcagctacagaagaacagactttgtggacaggaccaggagcagccaccagctgcaggccctggccgccggccgggcctacaacatctctgtgttttctgtgaagaggaacagcaacaacaagaatgacatcagcaggcctgctgtgctgctggcccggacccggcccaggcctgtggagggctttgaggtgaccaacgtgacagccagcaccatctctgtgcagtgggccctgcaccgcatcagacatgccaccgtgtctggagtgcgggtgtccatccgccaccctgaggccctgcgggaccaggccacagatgtggacagatctgtggaccgcttcaccttccgggccctgctgcccgggaagcgctacaccatccagctgaccaccctgagcggcctgcggggggaggagcaccccacagagagcctggccacagcccccacccacgtgtggacccggcccctgcccccagccaacctgacagctgcccgggtgacagccaccagcgcccacgtggtgtgggatgcccccaccccaggcagcctgctggaggcctacgtgatcaacgtgaccaccagccagagcaccaagagccgctacgtgcccaacgggaagctggccagctacacagtgcgggacctgctgcccggccgccgctaccagctgtctgtgattgctgtgcagagcacagagctgggcccccagcacagcgagcccgcccacctgtacatcatcaccagccccagagatggagctgaccggcgctggcaccagggcggccaccacccccgggtgctgaagaaccggcccccaccagcccggctgcctgagctgcggctgctgaatgaccacagcgcccctgagacccccacccagcccccacgcttcagcgagctggtggatggccggggccgggtgtctgccaggtttggaggcagccccagcaaggccgccaccgtgcgcagccagcccacagccagcgcccagctggagaacatggaggaggcccccaagagggtgtccctggccctgcagctgcctgagcacggcagcaaggacatcggcagcgagagcgctgccctggtgggcaccctgggcctgacagactgcagccagggcccctag

SEQ ID NO: 7771 - DNA, 732 bp, Artificial Sequence
  Description of Artificial Sequence: Synthetic coding sequence
atgggcatcttcctggtgtatgtgggctttgtgttcttctctgtgctgtatgtgcagcagggcctgagcagccaggccaagttcacagagttccccagaaatgtgacagccacagagggccagaatgtggagatgagctgtgccttccagagcggcagcgcctctgtgtacctggagatccagtggtggttcctgcggggccctgaggacctggaccctggagctgagggcgctggggcccaggtggagctgctgcctgaccgggaccctgacagtgatggcaccaagatcagcacagtgaaggtgcagggcaatgacatcagccacaagctgcagatcagcaaggtgaggaagaaggatgagggcctgtatgaatgtcgggtgacagatgccaactatggagagctgcaggagcacaaggcccaggcctacctgaaggtgaatgccaacagccacgcccggaggatgcaggcctttgaggccagccccatgtggctgcaggacatgaagcccaggaagaatgtgtctgctgccatccccagcagcatccacggcagcgccaaccagaggacccacagcaccagcagcccccaggtggtggccaagatccccaagcagagcccccagagcggcatggagacccactttgagcccttcatcctgcccctgaccaatgccccccagaagggccagagctacagagtggaccgcttcatgaatggagacttctag

SEQ ID NO: 7772 - DNA, 1218 bp, Artificial Sequence; identical to SEQ ID NO: 7261
  Description of Artificial Sequence: Synthetic coding sequence

SEQ ID NO: 7773 - DNA, 573 bp, Artificial Sequence
  Description of Artificial Sequence: Synthetic coding sequence
atgaggacagtggtgctgaccatgaaggcctctgtgattgagatgttcctggtgctgctggtgactggagtgcacagcaacaaggagacagccaagaagatcaagaggcccaagttcaccgtgccccagatcaactgtgatgtgaaggccggcaagatcatcgaccctgagttcatcgtgaagtgcccagctggctgccaggaccccaagtaccacgtgtatggaacagatgtgtatgccagctacagctctgtgtgtggggctgctgtgcacagcggcgtgctggacaacagcggcggcaagatcctggtgaggaaggtggccggccagagcggctacaagggcagctacagcaatggagtgcagagcctgagcctgccccgctggagggagagcttcatcgtgctggagagcaagcccaagaagggcgtgacctaccccagcgccctgacctacagcagcagcaagagccctgctgcccaggccgacctgtggagcacagccacctacaccagcagccagaaccggcccagggctgaccctgtgcagaggcagccctgctacagcctgtag

SEQ ID NO: 7774 - DNA, 399 bp, Artificial Sequence
  Description of Artificial Sequence: Synthetic coding sequence
atggcccccagccccaggacaggcagccggcaggatgccacagccctgcccagcatgagcagcaccttctgggccttcatgatcctggccagcctgctgattgcctactgcagccagctggccgccggcacctgtgaaattgtgaccctggaccgggacagcagccagcccaggaggaccatcgcccggcagacagcccgctgtgcctgcaggaagggccagattgctggcaccacccgggcccggcctgcctgtgtggatgcccgcatcatcaagaccaagcagtggtgtgacatgctgccctgcctggagggggagggctgtgacctgctgatcaacagaagtggctggacctgcacccagcccggcggccgcatcaagaccaccaccgtgtcctag

SEQ ID NO: 7775 - DNA, 957 bp, Artificial Sequence; identical to SEQ ID NO: 7094
  Description of Artificial Sequence: Synthetic coding sequence

SEQ ID NO: 7776 - DNA, 399 bp, Artificial Sequence
  Description of Artificial Sequence: Synthetic coding sequence
atgctgcccctgaccatgacagtgctgatcctgctgctgctgcccaccggccaggccgcccccaaggatggagtgaccaggccagacagcgaggtgcagcaccagctgctgcccaaccccttccagcccggccaggagcagctgggcctgctgcagagctacctgaagggcctgggccgcacagaggtgcagctggagcacctgagccgggagcaggtgctgctgtacctgtttgccctgcatgactatgaccagagcggccagctggatggcctggagctgctgtccatgctgacagctgccctggcccctggggccgccaacagccccaccaccaaccctggcaacctggatgcccggctggatggaggagagaaggccatgcagccccagtggtag

SEQ ID NO: 7777 - DNA, 732 bp, Artificial Sequence
  Description of Artificial Sequence: Synthetic coding sequence
atgctgctgagcctgctgggcgcctgtgctgtggtgggccccttccacggccctgagtgggagcctgtgcagggcctgctgagccagaaccacagctgccgggacccccagtgctgcggcaacctgctggtgctgtgcctcttcctggtgtggcaggtgcgccactgctggcaccaggtgaccaggacccgcttcagcaccagaaatgtcatcaaggtgcccctgcagaagagagctgtgcccagcatgagatgtgaaacagtgttcaagctgaccccagagttcttcagccctgggaagagccggggcctggacagccagcagtgtgcccagaggcagcgctggggctaccgccgcagcctgcaggagagctgggcccagaacctgctgagcccccagcacccctgccccggccccccatctggagtgcacacccacagcgagcccatcttctgcaccaccagcatcagcaacacctgcctgctgccccagaacagctcctggaaggcctggcaggtgccctggtgcctgcatgatggccagaccaggcctgccctggacatgtgccaggagatggagcagctgctgctgcacagccaggagcggctggtgtccctggagcccgtcatctctgtgcgcagccggcccacctccatgaccctgaccaccagcctgcccaacctgctgtctgctgagcggctgcagttctgcccccagagggccccagcctag

SEQ ID NO: 7778 - DNA, 2505 bp, Artificial Sequence; identical to SEQ ID NO: 7110
  Description of Artificial Sequence: Synthetic coding sequence

SEQ ID NO: 7779 - DNA, 1185 bp, Artificial Sequence
  Description of Artificial Sequence: Synthetic coding sequence
atgtggcgctgccccctgggcctgctgctgctgctgcccctggccggccacctggccctgggcgcccagcagggccggggccggcgggagctggcccctggcctgcacctgcggggcatcagagatgctgggggccgctactgccaggagcaggacctgtgctgccggggccgggcagatgactgtgccctgccctacctgggcgccatctgctactgtgacctcttctgcaacagaacagtgtctgactgctgccccttcccccccatccagggctgcatgcatggaggccgcatctaccctgtgctgggcacctactgggacaactgcaaccgctgcacctgccaggagaaccggcagtggcagtgtgaccaggagccctgcctggtggaccctgacatgatcaaggccatcaaccagggcaactacggctggcaggccggcaaccacagcgccttctggggcatgaccctggatgagggcatccgctaccgcctgggcaccatccggcccagcagctctgtgatgaacatgcatgagatctacacagtgctgaaccctggagaggtgctgcccacagcctttgaggccagcgagaagtggcccaacctgatccacgagcccctggaccagggcaactgtgccggctcctgggccttcagcacagctgctgtggccagtgacagagtgtccatccacagcctgggccacatgacccctgtgctgagcccccagaacctgctgagctgtgacacccaccagcagcagggctgccggggcggccgcctggatggagcctggtggttcctgcggcggcggggcgtggtgtctgaccactgctaccccttcagcggccgggagagagatgaagctggccctgccccaccctgcatgatgcacagccgggccatgggccggggcaagaggcaggccacagcccactgccccaacagctatgtgaacaacaatgacatctaccaggtgacccctgtgtaccgcctgggcagcaatgacaaggagatcatgaaggagctgatggagaatggacctgtgcaggccctgatggaggtgcatgaggacttcttcctgtacaagggcggcatctacagccacacccctgtgtccctgggccggcctgagcgctacagaagacatggcacccacagcgtgaagatcactggatag

SEQ ID NO: 7780 - DNA, 303 bp, Artificial Sequence
  Description of Artificial Sequence: Synthetic coding sequence
atggctgctgccctggccctggtggccggcgtgctgtctggagctgtgctgcccctgtggagcgccctgccccagtacaagaagaagatcacagaccgctgcttccaccacagcgagtgctacagcggctgctgcctgatggacctggacagcggcggggccttctgtgccccccgggcccgcatcaccatgatctgcctgccccagaccaagggggccaccaacatcatctgcccctgcaggatgggcctgacctgcatcagcaaggacctgatgtgcagccgccgctgccacatgatctag

SEQ ID NO: 7781 - DNA, 978 bp, Artificial Sequence
  Description of Artificial Sequence: Synthetic coding sequence
atgaggctgcccaggagagctgccctgggcctgctgcccctgctgctgctgctgcccccagcccctgaggccgccaagaagcccaccccctgccaccgctgccggggcctggtggacaagttcaaccagggcatggtggacacagccaagaagaactttggaggcggcaacacagcctgggaggagaagaccctgagcaaatatgagagcagcgagatccggctgctggagatcctggagggcctgtgtgagagcagtgactttgagtgcaaccagatgctggaggcccaggaggagcacctggaggcctggtggctgcagctgaagtctgagtacccagacctgtttgagtggttctgtgtgaagaccctgaaggtgtgctgcagccctggcacctacggccctgactgcctggcctgccagggcggcagccagaggccctgcagcggaaatggccactgcagcggagatggcagccggcagggagatggcagctgccgctgccacatgggctaccagggccccctgtgcacagactgcatggatggctacttcagcagcctgagaaatgagacccacagcatctgcacagcctgtgatgagagctgcaagacctgcagcggcctgaccaacagagactgtggggagtgtgaggtgggctgggtgctggatgagggcgcctgtgtggagtgtgacagcagctgtgtgggctgcacaggagagggccctggcaactgcaaggagtgcatcagcggctacgcccgggagcacggccagtgtgctgatgtggatgaatgttccctggccgagaagacctgtgtgaggaagaatgaaaactgctacaacaccccaggcagctatgtgtgtgtgtgcccagatggctttgaggagacagaagatgcctgtgtgcccccagctgaggccgaggccacagaaggagagagccccacccagctgcccagccgggaggacctgtag

SEQ ID NO: 7782 - DNA, 459 bp, Artificial Sequence
  Description of Artificial Sequence: Synthetic coding sequence
atgaggggccctggccaccccctgctgctgggcctgctgctggtgctgggcgctgctggccggggccggggcggcgctgagccccgggagccagcagatggccaggccctgctgcggctggtggtggagctggtgcaggagctgaggaagcaccacagcgctgagcacaagggcctgcagctgctgggccgggactgtgccctgggccgggcagaggccgccggcctgggccccagccctgagcagagggtggagatcgtgccccgggacctgaggatgaaggacaagttcctgaagcacctgaccggccccctgtacttcagccccaagtgcagcaagcacttccaccggctgtaccacaacacccgggactgcaccatcccagcctactacaagagatgtgcccggctgctgacccggctggccgtgtcccctgtgtgcatggaggacaagcagtag

SEQ ID NO: 7783 - DNA, 411 bp, Artificial Sequence; identical to SEQ ID NO: 7174
  Description of Artificial Sequence: Synthetic coding sequence

SEQ ID NO: 7784 - DNA, 1209 bp, Artificial Sequence
  Description of Artificial Sequence: Synthetic coding sequence
atgaggctgcccaggagagctgccctgggcctgctgcccctgctgctgctgctgcccccagcccctgaggccgccaagaagcccaccccctgccaccgctgccggggcctggtggacaagttcaaccagggcatggtggacacagccaagaagaactttggaggcggcaacacagcctgggaggagaagaccctgagcaaatatgagagcagcgagatccggctgctggagatcctggagggcctgtgtgagagcagtgactttgagtgcaaccagatgctggaggcccaggaggagcacctggaggcctggtggctgcagctgaagtctgagtacccagacctgtttgagtggttctgtgtgaagaccctgaaggtgtgctgcagccctggcacctacggccctgactgcctggcctgccagggcggcagccagaggccctgcagcggaaatggccactgcagcggagatggcagccggcagggagatggcagctgccgctgccacatgggctaccagggccccctgtgcacagactgcatggatggctacttcagcagcctgagaaatgagacccacagcatctgcaccgtgaggacaggcctgagtgacagctacccaccctgctgcctgagcctgggctgctggaggggcgtgggccacgcctggatccggggcaggaacacccacacccagcccggctacagcagccgggtgtggattgctgccttcagccctgcctgtgatgagagctgcaagacctgcagcggcctgaccaacagagactgtggagaatgtgaggtgggctgggtgctggatgaaggagcctgtgtggatgtggatgaatgtgccgctgagcccccaccctgcagcgctgcccagttctgcaagaatgccaacggcagctacacctgtgaagaatgtgacagcagctgtgtgggctgcaccggggagggccctggcaactgcaaggagtgcatcagcggctacgcccgggagcacggccagtgtgctgatgtggatgagtgcagcctggccgagaagacctgtgtgaggaagaatgaaaactgctacaacaccccaggcagctatgtgtgtgtgtgcccagatggctttgaggagacagaagatgcctgtgtgcccccagctgaggccgaggccacagaaggagagagccccacccagctgcccagccgggaggacctgtag

SEQ ID NO: 7785 - DNA, 633 bp, Artificial Sequence
  Description of Artificial Sequence: Synthetic coding sequence
atgtctgctgggaagatgatgaggaccctcatcaccacccaccccctgcccctgctgctgctgccccagcagctgctgcagctggtgcagttccaggaggtggacacagactttgacttccctgaggaggacaagaaggaggagtttgaagaatgtctggagaagttcttcagcactggacctgcccggccccccaccaaggagaaggtgaagagaagagtgctgattgagcccggcatgcccctgaaccacatcgagtactgcaaccacgagatcatgggcaagaatgtgtactacaagcaccgctgggtggccgagcactacttcctgctgatgcagtatgatgagctgcagaagatctgctacaacagatttgtgccctgcaagaatggcatcaggaagtgcaacagaagcaagggcctggtggagggcgtgtactgcaacctgacagaggcctttgagatcccagcctgcaagtatgagagcctgtacaggaagggctacgtgctgatcacctgctcctggcagaatgagatgcagaagaggatcccccacaccatcaatgacctggtggagcccccagagcacaggagcttcctgtctgaagatggagtgtttgtgatcagcccctag

SEQ ID NO: 7786 - DNA, 585 bp, Artificial Sequence; identical to SEQ ID NO: 6927
  Description of Artificial Sequence: Synthetic coding sequence

SEQ ID NO: 7787 - DNA, 4059 bp, Artificial Sequence
  Description of Artificial Sequence: Synthetic coding sequence
atgagacatggagtggcctgggccctgctggtggccgccgccctgggcctgggcgcccggggcgtgagaggagctgtggccctggccgacttctacccctttggagctgagagaggagatgctgtgacccccaagcaggatgatggcggcagcggcctgcggcccctgtctgtgcccttccccttctttggagctgagcacagcggcctgtatgtgaacaacaacggcatcatctccttcctgaaggaggtgtcccagttcacccctgtggccttccccatcgccaaggacagatgtgtggtggccgccttctgggcagatgtggacaacagaagagctggagatgtgtactaccgggaggccacagatcctgccatgctgcggcgggccacagaagatgtgcgccactacttccctgagctgctggacttcaatgccacctgggtgtttgtggccacctggtacagagtgaccttcttcggcggcagcagcagcagccctgtgaacaccttccagacagtgctgatcacagatggcaagctgtccttcaccatcttcaactatgagagcatcgtgtggaccaccggcacccacgccagcagcggcggcaatgccaccggcctgggcggcattgctgcccaggccggcttcaatgctggagatggccagcgctacttcagcatccctggcagcaggacagctgacatggccgaggtggagaccaccaccaacgtgggcgtgcccggccgctgggccttcagaattgatgatgcccaggtgcgggtgggcggctgcggccacaccacctctgtgtgcctggccctgcggccctgcctgaatggaggaaaatgtattgatgactgtgtgacaggcaaccccagctacacctgcagctgcctgagcggcttcaccggccgccgctgccacctggatgtgaatgaatgtgccagccagccctgccagaatggaggcacctgcacccacggcatcaacagcttccgctgccagtgcccagctggctttggaggccccacctgtgaaacagcccagagcccctgtgacaccaaggagtgccagcacggcggccagtgccaggtggagaatggcagcgctgtgtgtgtgtgccaggccggctacaccggggccgcctgtgagatggatgtggatgactgcagcccagacccctgcctgaatggaggcagctgtgtggacctggtgggcaactacacctgcctgtgtgccgagcccttcaagggcctgcgctgtgagaccggggaccaccctgtgcctgatgcctgcctgagcgccccctgccacaacggcggcacctgtgtggatgctgaccagggctacgtgtgtgagtgcccagagggcttcatgggcctggactgccgggagcgggtgcctgatgactgtgaatgtagaaatggaggccgctgcctgggcgccaacaccaccctgtgccagtgccccctgggcttcttcggcctgctgtgtgaatttgagatcacagccatgccctgcaacatgaacacccagtgcccagatggcggctactgcatggagcacggcggcagctacctgtgtgtgtgccacacagaccacaatgccagccacagcctgcccagcccctgtgacagcgacccctgcttcaacggcggcagctgtgatgcccatgatgacagctacacctgtgagtgcccccggggcttccacggcaagcactgtgagaaggcccggccccacctgtgcagcagcggcccctgcagaaatggaggcacctgcaaggaggccggcggggagtaccactgcagctgcccctaccgcttcaccggccgccactgtgaaattggcaagccagacagctgtgccagcggcccctgccacaacggcggcacctgcttccactacatcggcaagtacaagtgtgactgccccccaggcttcagcggccgccactgtgagatcgcccccagcccctgcttccgcagcccctgtgtgaatggaggcacctgtgaagatcgggacacagacttcttctgccactgccaggccggctacatgggccgccgctgccaggccgaggtggactgtggccccccagaggaggtgaagcacgccaccctgcgcttcaacggcacccggctgggcgctgtggccctgtatgcctgtgaccggggctacagcctgagcgcccccagccgcatccgggtgtgccagccccacggcgtgtggagcgagcccccccagtgcctggagattgatgagtgccgcagccagccctgcctgcacggcggcagctgccaggacagagtggccggctacctgtgcctgtgcagcacaggctatgaaggagcccactgtgagctggagagagatgagtgccgggcccacccctgcagaaatggaggcagctgcaggaacctgcccggggcctacgtgtgccgctgcccagctggctttgtgggcgtgcactgtgaaacagaggtggatgcctgtgacagcagcccctgccagcacggcggccgctgtgagagcggcggcggggcctacctgtgtgtgtgcccagagagcttcttcggctaccactgtgagaccgtgtctgacccctgcttcagcagcccctgtggcggccggggctactgcctggccagcaatggcagccacagctgcacctgcaaggtgggctacaccggggaggactgtgccaaggagctgttccccccaacagccctgaagatggagcgggtggaggagagcggcgtgtccatctcctggaacccccccaacggccctgctgcccggcagatgctggatggctatgctgtgacctacgtgtccagtgatggcagctacagaagaacagactttgtggacaggaccaggagcagccaccagctgcaggccctggccgccggccgggcctacaacatctctgtgttttctgtgaagaggaacagcaacaacaagaatgacatcagcaggcctgctgtgctgctggcccggacccggcccaggcctgtggagggctttgaggtgaccaacgtgacagccagcaccatctctgtgcagtgggccctgcaccgcatcagacatgccaccgtgtctggagtgcgggtgtccatccgccaccctgaggccctgcgggaccaggccacagatgtggacagatctgtggaccgcttcaccttccgggccctgctgcccgggaagcgctacaccatccagctgaccaccctgagcggcctgcggggggaggagcaccccacagagagcctggccacagcccccacccacgtgtggacccggcccctgcccccagccaacctgacagctgcccgggtgacagccaccagcgcccacgtggtgtgggatgcccccaccccaggcagcctgctggaggcctacgtgatcaacgtgaccaccagccagagcaccaagagccgctacgtgcccaacgggaagctggccagctacacagtgcgggacctgctgcccggccgccgctaccagctgtctgtgattgctgtgcagagcacagagctgggcccccagcacagcgagcccgcccacctgtacatcatcaccagccccagagatggagctgaccggcgctggcaccagggcggccaccacccccgggtgctgaagaaccggcccccaccagcccggctgcctgagctgcggctgctgaatgaccacagcgcccctgagacccccacccagcccccacgcttcagcgagctggtggatggccggggccgggtgtctgccaggtttggaggcagccccagcaaggccgccaccgtgcgcagccacgtgcccggcaactgcagcgagaacccctgccagaatggaggcacctgtgtgcctggagcagatgcccacagctgtgactgtggccctggcttcaagggcagaagatgtgagctggcctgcatcaaggtgtcccggccctgcaccaggctcttcagcgagaccaaggccttccctgtgtgggagggcggcgtgtgccaccacgtgaagcagagcaagagccagaccctggagaagagctag

SEQ ID NO: 7788 - DNA, 957 bp, Artificial Sequence; identical to SEQ ID NO: 7094
  Description of Artificial Sequence: Synthetic coding sequence

SEQ ID NO: 7789 - DNA, 816 bp, Artificial Sequence
  Description of Artificial Sequence: Synthetic coding sequence
atgcaggccgcctgctggtacgtgctcttcctgctgcagcccaccgtgtacctggtgacctgtgccaacctgaccaacggcggcaagtctgagctgctgaagagcggcagcagcaagagcaccctgaagcacatctggacagagagcagcaaggacctgagcatcagccggctgctgagccagaccttccggggcaaggaaaatgacacagacctggacctgcgctatgacaccccagagccctacagcgagcaggacctgtgggactggctgaggaacagcacagacctgcaggagccccggccccgggccaagaggcggcccatcgtgaagacaggcaagttcaagaagatgtttggctggggagacttccacagcaacatcaagacagtgaagctgaacctgctgatcaccgggaagatcgtggaccacggcaatggcaccttctctgtgtacttccgccacaacagcacaggccagggcaatgtgtctgtgtccctggtgccccccaccaagatcgtggagtttgacctggcccagcagacagtgattgatgccaaggacagcaagagcttcaactgccgcatcgagtatgagaaggtggacaaggccaccaagaacaccctgtgcaactatgaccccagcaagacctgctaccaggagcagacccagagccacgtgtcctggctgtgcagcaagcccttcaaggtgatctgcatctacatctccttctacagcacagactacaagctggtgcagaaggtgtgcccagactacaactaccacagcgacaccccctacttccccagcggctag

SEQ ID NO: 7790 - DNA, 999 bp, Artificial Sequence
  Description of Artificial Sequence: Synthetic coding sequence
atgctgctgctggccgccgccttcctggtggcctttgtgctgctgctgtacatggtgagccccctcatcagccccaagcccctggccctgcccggggcccacgtggtggtgactggaggcagcagcggcatcggcaagtgcatcgccatcgagtgctacaagcagggcgccttcatcaccctggtggccagaaatgaagacaagctgctgcaggccaagaaggagattgagatgcacagcatcaatgacaagcaggtggtgctgtgcatctctgtggatgtgtcccaggactacaaccaggtggagaatgtcatcaagcaggcccaggagaagctgggccctgtggacatgctggtgaactgtgccggcatggctgtgtctgggaagtttgaggacctggaggtgtccacctttgagcggctgatgagcatcaactacctgggctctgtgtaccccagcagagctgtgatcaccaccatgaaggagaggagagtgggccgcatcgtgtttgtgagcagccaggccggccagctgggcctgtttggcttcaccgcctacagcgccagcaagtttgccatccggggcctggccgaggccctgcagatggaggtgaagccctacaacgtgtacatcaccgtggcctaccccccagacacagacaccccaggctttgctgaagaaaatagaaccaagcccctggagaccaggctcatcagcgagaccacctctgtgtgcaagccagagcaggtggccaagcagatcgtgaaggatgccatccagggcaacttcaacagcagcctgggcagtgatggctacatgctgagcgccctgacctgtggcatggcccctgtgaccagcatcacagagggcctgcagcaggtggtgaccatgggcctcttccgcaccatcgccctcttctacctgggcagctttgacagcatcgtgcggcgctgcatgatgcagcgggagaagtcagaaaatgctgacaagacagcctag

SEQ ID NO: 7791 - DNA, 1497 bp, Artificial Sequence
  Description of Artificial Sequence: Synthetic coding sequence
atgtccttcagcgccaccatcctcttcagccccccatctggcagcgaggcccgctgctgctgctgtgcctgcaagtctgagaccaatggaggcaacacaggcagccagggcggcaaccccccacccagcacccccatcaccgtgactggacatggcctggccgtgcagagcagcgagcagctgctgcacgtgatctaccagagggtggacaaggctgtgggcctggccgaggccgccctgggcctggcccgggccaacaatgagctgctgaagaggctgcaggaggaggtgggggacctgcggcagggcaaggtgtccatcccagatgaagatggagagagccgggcccacagcagccccccagaggagcccggccccctgaaggagagccctggagaggccttcaaggccctgtctgctgtggaggaggagtgtgacagcgtgggcagcggcgtgcaggtggtgattgaggagctgcggcagctgggcgccgcctctgtgggccctggccccctgggcttccctgccacccagagggacatgaggctgcccggctgcaccctggccgccagcgaggccgcccccctgctgaaccccctggtggatgattatgtggccagcgagggcgctgtgcagagggtgctggtgcctgcctatgccaagcagctgagccctgccacccagctggccatccagagggccaccccagagaccggcccagaaaatggcaccaagctgcccccacccaggcctgaggacatgctgaatgctgctgctgccctggacagcgccctggaggagagcggccctggcagcactggagagctgcggcacagcctgggcctgactgtgagcccctgcaggacccggggcagcggccagaagaacagcaggaggaagagggacctggtgctgagcaagctggtgcacaacgtgcacaaccacatcaccaatgacaagcgcttcaatggaagtgagagcatcaagagctcctggaacatctctgtggtgaagttcctgctggagaagctgaagcaggagctggtgaccagcccccacaactacacagacaaggagctgaagggggcctgtgtggcctacttcctgaccaagaggcgggagtacagaaacagcctgaaccccttcaagggcctgaaggagaaggaggagaagaagctgcggagccgccgctaccgcctgtttgccaacagaagcagcatcatgaggcactttggacctgaggaccagaggctgtggaatgatgtgacagaggagctgatgtctgatgaggaggacagcctgaatgaaccagaccggctgcccagcgctgaggcccagctgctgcccccagagctgtacaaccccaacttccaggaggaggaggatgagggcggagatgaaaatgcccctggcagccccagctttgaccagccccacaagacctgctgcccagacctgaacagcttcatcgagatcaaggtggagaaggatgaatag

SEQ ID NO: 7792 - DNA, 966 bp, Artificial Sequence
  Description of Artificial Sequence: Synthetic coding sequence
atgaggctgcccaggagagctgccctgggcctgctgcccctgctgctgctgctgcccccagcccctgaggccgccaagaagcccaccccctgccaccgctgccggggcctggtggacaagttcaaccagggcatggtggacacagccaagaagaactttggaggcggcaacacagcctgggaggagaagaccctgagcaaatatgagagcagcgagatccggctgctggagatcctggagggcctgtgtgagagcagtgactttgagtgcaaccagatgctggaggcccaggaggagcacctggaggcctggtggctgcagctgaagtctgagtacccagacctgtttgagtggttctgtgtgaagaccctgaaggtgtgctgcagccctggcacctacggccctgactgcctggcctgccagggcggcagccagaggccctgcagcggaaatggccactgcagcggagatggcagccggcagggagatggcagctgccgctgccacatgggctaccagggccccctgtgcacagactgcatggatggctacttcagcagcctgagaaatgagacccacagcatctgcacagcctgtgatgagagctgcaagacctgcagcggcctgaccaacagagactgtggggagtgtgaggtgggctgggtgctggatgagggcgcctgtgtggatgtggatgaatgtgccgctgagcccccaccctgcagcgctgcccagttctgcaagaatgccaacggcagctacacctgtgaagatgtggatgaatgttccctggccgagaagacctgtgtgaggaagaatgaaaactgctacaacaccccaggcagctatgtgtgtgtgtgcccagatggctttgaggagacagaagatgcctgtgtgcccccagctgaggccgaggccacagaaggagagagccccacccagctgcccagccgggaggacctgtag

SEQ ID NO: 7793 - DNA, 711 bp, Artificial Sequence
  Description of Artificial Sequence: Synthetic coding sequence
atgatgggcatcttcctggtgtatgtgggctttgtgttcttctctgtgctgtatgtgcagcagggcctgagcagccaggccaagttcacagagttccccagaaatgtgacagccacagagggccagaatgtggagatgagctgtgccttccagagcggcagcgcctctgtgtacctggagatccagtggtggttcctgcggggccctgaggacctggaccccggggctgagggcgctggggcccaggtggagctgctgcctgaccgggaccctgacagtgatggcaccaagatcagcacagtgaaggtgcagggcaatgacatcagccacaagctgcagatcagcaaggtgaggaagaaggatgagggcctgtatgagtgccgggtgacagatgccaactacggggagctgcaggagcacaaggcccaggcctacctgaaggtgaatgccaacagccacgcccggaggatgcaggcctttgaggccagccccatgtggctgcaggacatgaagcccaggaagaatgtgtctgctgccatccccagcagcatccacggcagcgccaaccagaggacccacagcaccagcagcccccaggtggtggccaagatccccaagcagagcccccagagcggggccagaattgccaccagccacggcctgtctgtgctgctgctggtgtgtggctttgtgaagggggccctgctgtag

SEQ ID NO: 7794 - DNA, 273 bp, Artificial Sequence
  Description of Artificial Sequence: Synthetic coding sequence
atgaacatgaagccagccacagccagcgccctgctgctgctgctgctgggcctggcctggacccagggcagccacggctggggcgcagatgccagcagcctgcagaagagagctggaagagatgaccagaactacaactacaaccagcacgcctaccccacagcctacggcggcaagtacagcgtgaagaccccagccaagggcggcgtgagccccagcagcagcgccagccgggtgcagcccggcctgctgcagtgggtgaagttctggtag

SEQ ID NO: 7795 - DNA, 360 bp, Artificial Sequence
  Description of Artificial Sequence: Synthetic coding sequence
atgcctgctgtgttcatgctggccagcagcagcgccctgcagtgtggccggggcgtgccccgcttccccaggacagaggtgggcgccggccacagcgtgaatgaggagaccaaggccgagaaggtgggcaaccagaccagcgtcatcccagccaccagccggcaggccgccctgggcacctcctggacccagaggaggacccagcccctgcaggagaggagccactggcacccccggggcaacaatgccagcggcatgggcggccacaggatgtttcctggccccctgcggggccctgctgcccaggtgctggagaatgaatgtggcagcctgggccgggctgctgagggccgctcctag

SEQ ID NO: 7796 - DNA, 639 bp, Artificial Sequence; identical to SEQ ID NO: 7183
  Description of Artificial Sequence: Synthetic coding sequence

SEQ ID NO: 7797 - DNA, 387 bp, Artificial Sequence
  Description of Artificial Sequence: Synthetic coding sequence
atgagggtggcccggaggaccagaaatgtgtgccgctgccccagggctgctggccctggggtgcctgagccccgggccgcccccctgcccctgctggccatggcccctcctccagcctgccgcagccccatgagccccccacctccacccctgctgctgctgctgctgagcctggccctgctgggcgcccgggcccgggcagagcccgccggcagcgctgtgcctgcccagagccggccctgtgtggactgccacgcctttgagttcatgcagagggccctgcaggacctgaggaagacagcctgcagcctggatgccaggacagagaccctgctgctgcaggccgagcggcgggccctgtgtgcctgctggccagctggccactag

SEQ ID NO: 7798 - DNA, 399 bp, Artificial Sequence
  Description of Artificial Sequence: Synthetic coding sequence
atgggcccccgggtgctgcagccccccctgctgctgctgctgctggccctgctgctggccgccctgccctgtggggctgaggaggccagccccctgcggcctgcccaggtgaccctgagccccccacctgctgtgaccaacggcagccagcccggggccccccacaacagcacccacacccggcccccaggggccagcggcagcgccctgaccaggagcttctacgtgatcctgggcttctgtggcctgacagccctgtacttcctgatccgggccttccggctgaagaagccccagaggagaagatatggcctgctggccaacacagaggaccccacagagatggccagcctggacagtgatgaggagaccgtgtttgagagcaggaacctgaggtag

SEQ ID NO: 7799 - DNA, 585 bp, Artificial Sequence; identical to SEQ ID NO: 7079
  Description of Artificial Sequence: Synthetic coding sequence

SEQ ID NO: 7800 - DNA, 441 bp, Artificial Sequence
  Description of Artificial Sequence: Synthetic coding sequence
atggtgatcaccatctactatgatgtgaaggtgcgcttcatcgtgcggggctgcggccagtacatctcctaccgctgccaggagaagaggaacacctactttgctgagtactggtaccaggcccagtgctgccagtatgactactgcaacagctggagcagcccccagctgcagagcagcctgcctgagccccatgaccggcccctggccctgcccctgagtgacagccagatccagtggttctaccaggccctgaacctgagcctgcccctgcccaacttccacgccggcacagagccagatggcctggaccccatggtgaccctgagcctgaacctgggcctgagctttgctgagctgcggaggatgtacctgttcctgaacagcagcggcctgctggtgctgccccaggccggcctgctgaccccccaccccagctag

SEQ ID NO: 7801 - DNA, 234 bp, Artificial Sequence
  Description of Artificial Sequence: Synthetic coding sequence
atgggcagcagcggcctgctgagcctgctggtgctgtttgtgctgctggccaacgtgcagggccctggcctgacagactggctgttcccccggcgctgccccaagatccgggaggagtgtgagttccaggagagagatgtgtgcaccaaggaccggcagtgccaggacaacaagaagtgctgcgtgttcagctgtgggaagaagtgcctggacctgaagcagggcaagcagtag

SEQ ID NO: 7802 - DNA, 444 bp, Artificial Sequence
  Description of Artificial Sequence: Synthetic coding sequence
atgggccaggaggtgcacggcagctgctgggccctgggcgctgggggcggccagaggcagtgggtgggccgctccatgccacccctggccccccagctgtgcagagctgtgttcctggtgcccatcctgctgctgctgcaggtgaagcccctgaatggcagccctggccccaaggatggcagccagacagagaagacccccagcgctgaccagaaccaggagcagtttgaggagcactttgtggccagctctgtgggggagatgtggcaggtggtggacatggcccagcaggaggaggaccagagcagcaagacagctgctgtgcacaagcacagcttccacctgtccttctgcttcagcctggcctctgtgatggtgttcagcggcggccccctgcggaggaccttccccaacatccagctgtgcttcatgctgacccactag

SEQ ID NO: 7803 - DNA, 1695 bp, Artificial Sequence; identical to SEQ ID NO: 7305
  Description of Artificial Sequence: Synthetic coding sequence

SEQ ID NO: 7804 - DNA, 423 bp, Artificial Sequence; identical to SEQ ID NO: 7077
  Description of Artificial Sequence: Synthetic coding sequence

SEQ ID NO: 7805 - DNA, 528 bp, Artificial Sequence; identical to SEQ ID NO: 7066
  Description of Artificial Sequence: Synthetic coding sequence

SEQ ID NO: 7806 - DNA, 381 bp, Artificial Sequence; identical to SEQ ID NO: 7018
  Description of Artificial Sequence: Synthetic coding sequence

SEQ ID NO: 7807 - DNA, 288 bp, Artificial Sequence
  Description of Artificial Sequence: Synthetic coding sequence
atggcccctcctccagcctgccgcagccccatgagccccccacctccacccctgctgctgctgctgctgagcctggccctgctgggcgcccgggcccgggcagagcctgctggcagcgctgtgcctgcccagagccggccctgtgtggactgccacgcctttgagttcatgcagagggccctgcaggacctgaggaagacagcctgcagcctggatgccaggacagagaccctgctgctgcaggccgagcggcgggccctgtgtgcctgctggccagctggccactag

SEQ ID NO: 7808 - DNA, 423 bp, Artificial Sequence; identical to SEQ ID NO: 7077
  Description of Artificial Sequence: Synthetic coding sequence

SEQ ID NO: 7809 - DNA, 291 bp, Artificial Sequence; identical to SEQ ID NO: 7334
  Description of Artificial Sequence: Synthetic coding sequence

SEQ ID NO: 7810 - DNA, 678 bp, Artificial Sequence
  Description of Artificial Sequence: Synthetic coding sequence
tgagctgacctgcccagctgctggggcgccggcccctgctacacaggccacaaggtgggcgccctgcggcgggacaccgtcatctgctgctgcagacatggagactacagcaccccctgcctcttcacccctgggaagcccagcaggaaccccagcccctggaagaggaccctgtggaccctgagcgccccctgggccggccctgctggctggacaggagaggagcagaatgccaccaagacaggcctcatcacccggcggccccggcccctgcggcggcggccccacccagccccagccagccccctgcctgagatcatccggggcaacatccccaggatgctgggcaagtttgtgcctgtgaactgggagcccccccagcccctgcccttccccaagtacctgcgctgctaccgctgcctgctggagaccaaggagctgggctgcctgctgggcagtgacatctgcctgaccccagctggcagcagctgcatcaccctgcacaagaagaacagcagcggcagtgatgtgatggtgtctgactgccgcagcaaggagcagatgtctgactgcagcaacaccaggaccagccctgtgtctggcttctggatcttcagccagtactgcttcctggacttctgcaatgacccccagaacagaggcctgtacaccccctag

SEQ ID NO: 7811 - DNA, 684 bp, Artificial Sequence
  Description of Artificial Sequence: Synthetic coding sequence
atgggcgctgtgatgggcaccttcagcagcctgcagaccaagcagaggcggcccagcaaggacatcgcctggtggtactaccagtaccagagggacaagattgaagatgagctggagatgaccatggtgtgccacaggcctgagggcctggagcagctggaggcccagaccaacttcaccaagcgggagctgcaggtgctgtaccggggcttcaagaatgaatgtccttctggagtggtgaatgaagacaccttcaagcagatctatgcccagttcttcccccatggagatgccagcacctacgcccactacctgttcaatgcctttgacaccacccagacaggctctgtgaagtttgaggactttgtgacagccctgagcatcctgctgcggggcaccgtgcatgagaagctgcgctggaccttcaacctgtatgacatcaacaaggatggctacatcaacaaggaggagatgatggacatcgtgaaggccatctatgacatgatgggcaagtacacctaccctgtgctgaaggaggacaccccccggcagcacgtggatgtgttcttccagaagatggacaagaacaaggatggcatcgtgaccctggatgagttcctggagagctgccaggaggatgacaacatcatgaggagcctgcagctgttccagaatgtgatgtag

SEQ ID NO: 7812 - DNA, 546 bp, Artificial Sequence
  Description of Artificial Sequence: Synthetic coding sequence
atgcaggtgaactttgtgtcctatgtgcagctgaccagccgggccctgcccagcctgacagacagcaagggcagcctggtggtggtgagcagcctgctgggccgggtgcccaccagcttcagcaccccctacagcgctgccaagtttgccctggatggcttcttcggcagcctgcggcgggagctggatgtgcaggatgtgaatgtggccatcaccatgtgtgtgctgggcctgcgggaccgggccagcgctgctgaggccgtgcgcagcagcaccagccggccccggcagcctgagcaccggggcgtgcccctgcagagccagacagccatgttcctgccccccaccgtgcctggggcccggaccctgacagagacccccctgcggggctggccccagcccaagatgaagagcagccggcagaagagcaagacagagaagaatgatggccacctggagcctgtgacagcctgggaggtgcaggtgccccgggtgcggcggctgtgccggggcctggcccggccccacctgtttggacatgactag

SEQ ID NO: 7813 - DNA, 423 bp, Artificial Sequence
  Description of Artificial Sequence: Synthetic coding sequence
atgtctgacctgctgctgctgggcctcatcggcggcctgaccctgctgctgctgctgaccctgctggcctttgctggctacagcggcctgctggccggcgtggaggtgtctgctggcagcccccccatcagaaatgtgacagtggcctacaagttccacatgggcctgtatggagagaccggccgcctcttcacagagagctgcagcatcagccccaagctgcggagcattgctgtgtactatgacaacccccacatggtgcccccagacaagtgccgctgtgctgtgggcagcatcctgtctgagggggaggagagccccagccctgagctgattgacctgtaccagaagtttggcttcaaggtgttctccttccctgcccccagccacgtggtgacagccaccttcccctacaccacctag

SEQ ID NO: 7814 - DNA, 177 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagcctag

SEQ ID NO: 7815 - DNA, 2742 bp, Artificial Sequence; identical to SEQ ID NO: 7141
  Description of Artificial Sequence: Synthetic coding sequence

SEQ ID NO: 7816 - DNA, 1146 bp, Artificial Sequence
  Description of Artificial Sequence: Synthetic coding sequence
atgaggctgctggcctggctgatcttcctggccaactggggcggggcccgggcagagcccgggaagttctggcacatcgctgacctgcacctggaccctgactacaaggtgtccaaggaccccttccaggtgtgccccagcgctggcagccagcctgtgcctgatgctggcccctggggagactacctgtgtgacagcccctgggccctgatcaacagcagcatctatgccatgaaggagattgagcctgagccagacttcatcctgtggacaggagatgacacccctcatgtgcctgatgagaagctgggggaggccgctgtgctggagatcgtggagcggctgaccaagctgatccgggaggtgtttcctggggccttctactgtgagaagctgcccggccccagcggggccggcagaattgtggtgctgaacaccaacctgtactacaccagcaatgccctgacagctgacatggctgaccccggccagcagttccagtggctggaggatgtgctgacagatgccagcaaggccggggacatggtgtacatcgtgggccacgtgcccccaggcttctttgagaagacccagaacaaggcctggttccgggagggcttcaatgagaagtacctgaaggtggtgaggaagcaccaccgggtgattgctggccagttcttcggccaccaccacacagacagcttcaggatgctgtatgatgatgctggggtgcccatcagcgccatgttcatcaccccaggagtgaccccctggaagaccaccctgcccggggtggtgaatggagccaacaacccagccatccgggtgtttgaatatgaccgggccaccctgagcctgaaggacatggtgacctacttcatgaacctgagccaggccaatgcccagggcaccccccgctgggagctggagtaccagagcaccctgcagcgctactacgtgtacaacagcgtgtcctacagcgctggggtgtgtgatgaggcctgcagcatgcagcacgtgtgtgccatgaggcaggtggacattgatgcctacaccacctgcctgtatgccagcggcaccacccctgtgccccagctgcccctgctgctgatggccctgctgggcctgtgcaccctggtgctgtag

SEQ ID NO: 7817 - DNA, 456 bp, Artificial Sequence
  Description of Artificial Sequence: Synthetic coding sequence
atgagggtggccggggccgccaagctggtggtggccgtggccgtgttcctgctgaccttctacgtgatcagccaggtgtttgagatcaagatggatgccagcctgggcaacctgtttgcccggagcgccctggacacagctgcccggagcaccaagcccccacgctacaagtgtggcatcagcaaggcctgcccagagaagcactttgccttcaagatggccagcggggccgccaacgtggtgggccccaagatctgcctggaggacaacgtgctgatgtctggagtgaagaacaacgtgggccggggcatcaacgtggccctggccaacgggaagacaggagaggtgctggacaccaagtactttgacatgtggggcggagatgtggcccccttcatcgagttcctgaaggccatccaggacggcaccatcgtgctgatgggcacctatgactag

SEQ ID NO: 7818 - DNA, 936 bp, Artificial Sequence
  Description of Artificial Sequence: Synthetic coding sequence
tgagcccccagcccctgcagccacttcaactgtggcagccaggtgacagatggcggcaccatcaagcagaagatcttcacctttgatgccatgttcagcaccaactacagccacatggagaactacaggaagcgggaggacctggtgtaccagagcacagtgcggctgcctgaggtgcgcatcagtgacaatggcccctatgagtgccacgtgggcatctatgaccgggccacccgggagaaggtggtgctggccagcggcaacatcttcctgaatgtgatggccccacccaccagcattgaggtggtggccgctgacaccccagcccccttcagccgctaccaggcccagaacttcaccctggtgtgcatcgtgtctgggggcaagccagcccccatggtgtacttcaagagagatggagagcccattgatgctgtgcccctgtctgagcccccagctgccagcagcggccccctgcaggacagccggcccttccgcagcctgctgcaccgggacctggatgacaccaagatgcagaagagcctgagcctgctggatgctgagaacagaggaggccggccctacacagagcggcccagccggggcctgaccccagaccccaacatcctgctgcagcccaccacagagaacatccctgagaccgtggtgtcccgggagttcccccgctgggtgcacagcgctgagcccacctacttcctgcggcacagcaggacccccagcagtgatggcaccgtggaggtgcgggccctgctgacctggaccctgaacccccagattgacaatgaggccctcttcagctgtgaggtgaagcacccagccctgtccatgcccatgcaggccgaggtgaccctggtggcccccaagggccccaagatcgtgatgacccccagccgggcccgggtgggggacacctag

SEQ ID NO: 7819 - DNA, 978 bp, Artificial Sequence; identical to SEQ ID NO: 6924
  Description of Artificial Sequence: Synthetic coding sequence

SEQ ID NO: 7820 - DNA, 957 bp, Artificial Sequence
  Description of Artificial Sequence: Synthetic coding sequence
atgggcctgcacctgcggccctacagagtgggcctgctgcctgatggcctgctcttcctgctgctgctgctgatgctgctggccgaccctgccctgcctgctggccgccacccccctgtggtgctgggctggttcaccaccaagcaccctggcccccccagcttcctgatggtgtggatgtatgtgtccctggccctgggccggcccagccactggagctcctggaccccagccaaggccgcctgggtgcccatcagcaccccctggtggagggccctgtgggccggggccacccatggagtgaggatgtctgagggcctgcccatgaccggggctgagccccagaggcagccccaggcctggaaggacaagtacatccgggcctttgtgtccctgggcgccccctggggcggcgtggccaagaccctgcgggtgctggccagcggggacaacaaccgcatccctgtgattggccccctgaagatccgggagcagcagaggtctgctgtgtccacctcctggctgctgccctacaactacacctggagccctgagaaggtgtttgtgcagacccccaccatcaactacaccctgcgggactacaggaagttcttccaggacatcggctttgaagatggctggctgatgaggcaggacacagagggcctggtggaggccaccatgcctcctggggtgcagctgcactgcctgtatggcaccggggtgcccaccccagacagcttctactatgagagcttcccagaccgggaccccaagatctgctttggagatggagatggcaccgtgaacctgaagagcgccctgcagtgccaggcctggcagagccggcaggagcaccaggtgctgctgcaggagctgcccggcagcgagcacatcgagatgctggccaatgccaccaccctggcctacctgaagagggtgctgctgggcccctag

SEQ ID NO: 7821 - DNA, 1575 bp, Artificial Sequence
  Description of Artificial Sequence: Synthetic coding sequence
tatgccctgcgggaccggcagggcaatgccatcggcgtgacagcctgtgacattgatggagatggccgggaggagatctacttcctgaacaccaacaatgccttcagcggcgtggccacctacacagacaagctgttcaagttcaggaacaaccgctgggaggacatcctgagtgatgaggtgaatgtggcccggggcgtggccagcctgtttgctggccgctctgtggcctgtgtggacaggaagggcagcggccgctacagcatctacatcgccaactatgcctatggaaatgtgggcccagatgccctgattgagatggaccctgaggccagtgacctgagccggggcatcctggccctgagagatgtggccgctgaggccggcgtgtccaagtacacaggaggccggggcgtgtctgtgggccccatcctgagcagcagcgccagtgacatcttctgtgacaatgaaaatggccccaacttcctgttccacaacagaggagatggcacctttgtggatgctgctgccagcgctggggtggatgacccccaccagcacggccggggcgtggccctggccgacttcaacagagatggcaaggtggacatcgtgtatggcaactggaatggcccccaccggctgtacctgcagatgagcacccacggcaaggtgcgcttccgggacatcgccagccccaagttctccatgcccagccctgtgaggacagtcatcacagctgactttgacaatgaccaggagctggagatcttcttcaacaacatcgcctaccgcagcagcagcgccaacagactcttccgggtcatcagaagagagcacggggaccccctgattgaggagctgaaccctggagatgccctggagcctgagggccggggcactggaggagtggtgacagactttgatggagatggcatgctggacctgatcctgagccacggggagagcatggcccagcccctgtctgtgttccggggcaaccagggcttcaacaacaactggctgcgggtggtgcccaggaccaggtttggagcctttgcccggggggccaaggtggtgctgtacaccaagaagagcggggcccacctgcgcatcattgatggcggcagcggctacctgtgtgagatggagcctgtggcccacttcggcctgggcaaggatgaggccagctctgtggaggtgacctggccagatggcaagatggtgtccagaaatgtggccagcggggagatgaacagcgtgctggagatcctgtaccccagagatgaggacaccctgcaggaccctgcccccctggagacccccatgaatgccagcagcagccacagctgtgccctggagaccagcccctacgtgtccacccccatggaggccaccggggccggccccaccaggtctgctgtgggcgccaccagccccaccaggatggcccagcctgcctggggcctgagcgccagccaccgggccccagcccctcctcctccacccctgctgctgcccctgcccctgctgctgcccctgctggagctgcccctgctgcacaggagcagctag

SEQ ID NO: 7822 - DNA, 636 bp, Artificial Sequence
  Description of Artificial Sequence: Synthetic coding sequence
atggtgtccaggatggtgtccaccatgctgagcggcctgctcttctggctggccagcggctggaccccagcctttgcctacagccccaggaccccagacagagtgtctgaggccgacatccagaggctgctgcatggagtgatggagcagctgggcatcgcccggccccgggtggagtacccagcccaccaggccatgaacctggtgggcccccagagcattgagggcggggcccacgagggcctgcagcacctgggccccttcggcaacatccccaacatcgtggccgagctgactggagacaacatccccaaggacttcagcgaggaccagggctacccagacccccccaacccctgccctgtgggcaagacagatgatggctgcctggagaacaccccagacacagctgagttcagccgggagttccagctgcaccagcacctgtttgatcctgagcatgactacccaggcctgggcaagtggaacaagaagctgctgtatgagaagatgaagggcggggagaggaggaagagaagatctgtgaacccctacctgcagggccagaggctggacaacgtggtggccaagaagtctgtgccccacttcagtgatgaggacaaggaccctgagtag

SEQ ID NO: 7823 - DNA, 465 bp, Artificial Sequence
  Description of Artificial Sequence: Synthetic coding sequence
atggccctgggcgtgcccatctctgtgtacctgctcttcaatgccatgacagccctgacagaggaggccgctgtgacagtgaccccacccatcacagcccagcagggcaactggacagtgaacaagacagaagctgacaacatcgagggccccatcgccctgaagttcagccacctgtgcctggaggaccacaacagctactgcatcaacggggcctgtgccttccaccacgagctggagaaggccatctgccgctgcttcaccggctacacaggagagcgctgtgagcacctgaccctgaccagctatgctgtggacagctatgagaagtacatcgccatcggcatcggcgtgggcctgctgctgagcggcttcctggtgatcttctactgctacatcaggaagcgctgcctgaagctgaagagcccctacaacgtgtgcagcggggagcggcggcccctgtag

SEQ ID NO: 7824 - DNA, 1446 bp, Artificial Sequence
  Description of Artificial Sequence: Synthetic coding sequence
atgggcaagctgcggcccggccgggtggagtggctggccagcggccacacagagcggccccacctgttccagaacctgctgctcttcctgtgggccctgctgaactgtggcctgggcgtgtctgcccagggccctggagagtggaccccctgggtgtcctggacccgctgcagcagcagctgtggccggggcgtgtctgtgcgcagccgccgctgcctgcggctgcccggggaggagccctgctggggagacagccatgagtaccgcctgtgccagctgcctgactgccccccaggagctgtgcccttccgggacctgcagtgtgccctgtacaacggccggcctgtgctgggcacccagaagacctaccagtgggtgcccttccatggagcccccaaccagtgtgacctgaactgcctggccgagggccacgccttctaccacagctttggccgggtgctggatggaacagcctgcagccctggggcccagggcgtgtgtgtggccggccgctgcctgtctgctggctgtgatggcctgctgggcagcggggccctggaggacagatgtggccgctgtggcggggccaatgacagctgcctgtttgtgcagagggtcttcagagatgctggggcctttgctggctactggaatgtgaccctcatccctgagggcgcccggcacatccgggtggagcacaggagcaggaaccacctggccctgatgggaggagatggccgctacgtgctgaatggccactgggtggtgagccccccaggcacctatgaggccgccggcacccacgtggtgtacacccgggacaccggcccccaggagaccctgcaggccgccggccccaccagccatgacctgctgctgcaggtgctgctgcaggagcccaaccctggcatcgagtttgagttctggctgccccgggagcgctacagccccttccaggcccgggtgcaggccctgggctggcccctgcggcagccccagccccggggcgtggagccccagcccccagctgccccagctgtgaccccagcccagacccccaccctggccccagacccctgccccccctgcccagacacccggggccgggcccaccggctgctgcactactgcggcagtgactttgtgttccaggcccgggtgctgggccaccaccaccaggcccaggagaccaggtatgaggtgcgcatccagctggtgtacaagaacagaagccccctgcgggcccgggagtatgtgtgggcccctggccactgcccctgccccatgctggccccccaccgggactacctgatggctgtgcagaggctggtgtccccagatggcacccaggaccagctgctgctgccccacgccggctacgcccggccctggagccctgctgaggacagccgcatccggctgacagcccggcgctgccccggctag

SEQ ID NO: 7825 - DNA, 627 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaggccggggccgccccctacgtgcaggcctttgacagcctgctggccggccctgtggccgagtacctgaagatcagcaaggagattggaggagatgtgcagaagcatgctgagatggtgcacacaggcctgaagctggagcgggccctgctggtgacagccagccagtgccagcagcctgctgagaacaagctgagtgacctgctggcccccatcagcgagcagatcaaggaggtgatcaccttccgggagaagaacagaggcagcaagctgttcaaccacctgtctgctgtgtctgagagcatccaggccctgggctgggtggccatggcccccaagccaggcccctacgtgaaggagatgaatgatgctgccatgttctacaccaacagagtgctgaaggagtacaaggatgtggacaagaagcacgtggactgggtgaaggcctacctgagcatctggacagagctgcaggcctacatcaaggagttccacaccaccggcctggcctggagctag

SEQ ID NO: 7826 - DNA, 1482 bp, Artificial Sequence
  Description of Artificial Sequence: Synthetic coding sequence
tctgaggccgtgtacctgaatgacagcacctatgatggccacacagtgggcggcctgcagtatggaggcctgggccagctggctgatggagtggtgggcctggatgacttcaggaagagccaggagctgcgggtgtggccaggctatgactatgtgggctggagcaaccacagcttcagcagcggctacgtggagatggagtttgaatttgaccggctgcgggccttccaggccatgcaggtgcactgcaacaacatgcacaccctgggcgcccggctgcccggcggcgtggagtgccgcttccggcggggccctgccatggcctgggagggggagcccatgaggcacaacctgggcggcaacctgggggacccccgggcccgggctgtgtctgtgcccctgggcggccgggtggcccgcttcctgcagtgccgcttcctgtttgctggcccctggctgctcttcagcgagatctccttcatcagtgatgtggtgaacaacagcagccctgccctgggcggcaccttccccccagccccctggtggcccccaggccccccacccaccaacttcagcagcctggagctggagccccggggccagcagcctgtggccaaggccgagggcagccccacagccatcctgattggctgcctggtggccatcatcctgctgctgctgctgatcatcgccctgatgctgtggaggctgcactggaggcggctgctgagcaaggtgctggagagccaccccaggaccaggagccctggcctggtgggcatccggcccacccccctgcctgtgagccccatggccctgcgctgctgcagccccatccagcccacagccagcttctggcccctgacccctgtgcccctggaggcccgggccccaccccaccccccaggccccaacccccccaccccccggggcgtgactggaggcaacacctatgctgtgcctgccctgcccccaggagctgtgggagatggccccccccgggtggacttccccaggagccggctgcgcttcaaggagaagctgggggagggccagtttggagaggtgcacctgtgtgaggtggacagcccccaggacctggtgtccctggacttccccctgaatgtgaggaagggccaccccctgctggtggccgtgaagatcctgcggccagatgccaccaagaatgccagaaatgacttcctgaaggaggtgaagatcatgagccggctgaaggaccccaacatcatccggctgctgggcgtgtgtgtgcaggatgaccccctgtgcatgatcacagactacatggagaatggagacctgaaccagttcctgagcgcccaccagctggaggacaaggctgctgagggcgcccctggagatggccaggccgcccagggccccaccatctcctaccccatgctgctgcacgtggccgcccagatcgccagcggcatgagatacctggccaccctgaactag

SEQ ID NO: 7827 - DNA, 2319 bp, Artificial Sequence
  Description of Artificial Sequence: Synthetic coding sequence
atgcagttccagctgaccctcttcctgcacctgggctggctgagctacagcaaggcccaggatgactgcaacagaggagcctgccaccccaccaccggggacctgctggtgggcaggaacacccagctgatggccagcagcacctgtggcctgagccgggcccagaagtactgcatcctgagctacctggagggggagcagaagtgcttcatctgtgacagccgcttcccctatgacccctatgaccagcccaacagccacaccattgaaaatgtgattgtgtcctttgagccagaccgggagaagaagtggtggcagagtgaaaatggcctggaccacgtgtccatccggctggacctggaggccctcttccgcttcagccacctgatcctgaccttcaagaccttccggcctgctgccatgctggtggagaggagcacagattatggccacaactggaaggtgttcaagtactttgccaaggactgtgccaccagcttccccaacatcaccagcggccaggcccagggcgtgggggacatcgtgtgtgacagcaagtacagcgacatcgagcccagcactggaggagaggtggtgctgaaggtgctggaccccagctttgaaattgagaacccctacagcccctacatccaggacctggtgaccctgaccaacctgcgcatcaacttcaccaagctgcacaccctgggagatgccctgctgggccggcggcagaatgacagcctggacaagtactactatgccctgtatgagatgattgtgcggggcagctgcttctgcaatggccacgcctctgaatgtcggcccatgcagaagatgagaggagatgtgttcagccccccaggcatggtgcacggccagtgtgtgtgccagcacaacacagatggccccaactgtgagcgctgcaaggacttcttccaggatgccccctggaggcctgctgctgacctgcaggacaatgcctgccgcagctgcagctgcaacagccacagcagccgctgccactttgacatgaccacctacctggccagcggcggcctgtctggaggagtgtgtgaggactgccagcacaacacagagggccagcactgtgaccgctgccggcccctcttctacagagaccccctgaagaccatcagtgacccctatgcctgcatcccctgtgaatgtgaccctgatggcaccatcagcggcggcatctgtgtgagccacagcgaccctgccctgggctctgtggccggccagtgcctgtgcaaggaaaatgtggagggcgccaagtgtgaccagtgcaagcccaaccactacggcctgagcgccacagaccccctgggctgccagccctgtgactgcaaccccctgggcagcctgcccttcctgacctgtgatgtggacaccggccagtgcctgtgcctgtcctatgtgactggagcccactgtgaggagtgcaccgtgggctactggggcctgggcaaccacctgcacggctgcagcccctgtgactgtgacatcggcggggcctacagcaatgtgtgcagccccaagaatggccagtgtgagtgccggccccacgtgacaggccgcagctgcagcgagcccgcccctggctacttctttgcccccctgaacttctacctgtatgaagctgaggaggccaccaccctgcagggcctggcccccctgggcagcgagaccttcggccagagccctgctgtgcacgtggtgctgggggagcctgtgcccggcaaccctgtgacctggacaggccctggctttgcccgggtgctgcctggagctggcctgcgctttgctgtgaacaacatccccttccctgtggacttcaccatcgccatccactatgagacccagagcgctgctgactggacagtgcagatcgtggtgaaccccccaggcggcagcgagcactgcatccccaagaccctgcagagcaagccccagagctttgccctgcctgctgccacccgcatcatgctgctgcccacccccatctgcctggagccagatgtgcagtacagcattgatgtgtacttcagccagcccctgcagggcgagagccacgcccacagccacgtgctggtggacagcgctgctgtgcagtggcacaacctgggcagcctgcagcccccacctcctgagtgcaagcagttcagctgcttctccttccccagctcctgggactaccgccaccccccaccccacctggccaacttctgcatcttcagcagagatggagtgagcccccactggccaggctggagccagaccccagacctgaggtag

SEQ ID NO: 7828 - DNA, 1371 bp, Artificial Sequence
  Description of Artificial Sequence: Synthetic coding sequence
atgggccgggccggggctgctgctgtgattcctggcctggccctgctgtgggccgtgggcctgggcagcgctgcccccagcccccacctgcggctgtccttccaggagctgcaggcctggcacggcctgcagaccttcagcctggagaggacctgctgctaccaggccctgctggtggatgaggagcggggccgcctgtttgtgggcgcagaaaatcatgtggccagcctgaacctggacaacatcagcaagagggccaagaagctggcctggccagcccctgtggagtggagggaggagtgcaactgggccggcaaggacatcggcacagagtgcatgaactttgtgaagctgctgcacgcctacaacagaacccacctgctggcctgtggcaccggggccttccaccccacctgtgcctttgtggaggtgggccacagagctgaggagcctgtgctgcggctggaccccggcagaattgaagatggcaagggcaagagcccctatgaccccaggcacagagctgcctctgtgctggtgggggaggagctgtacagcggcgtggccgctgacctgatgggccgggacttcaccatcttccgcagcctgggccagaggcccagcctgaggacagagccccatgacagccgctggctgaatgagcccaagtttgtgaaggtgttctggatccctgagagcgagaacccagatgatgacaagatctacttcttcttccgggagacagctgtggaggccgccccagccctgggccgcctgtctgtgtcccgggtgggccagatctgcagaaatgatgtgggcggccagaggagcctggtgaacaagtggaccaccttcctgaaggcccggctggtgtgcagcgtgcctggggtggagggggacacccactttgaccagctgcaggatgtgttcctgctgagcagccgggaccacaggacccccctgctgtatgctgtgttcagcaccagcagcagcatcttccagggcagcgctgtgtgtgtgtacagcatgaatgatgtgagaagagccttcctgggcccctttgcccacaaggagggccccatgcaccagtgggtgtcctaccagggccgggtgccctacccccggcaggcctgtgccccagcccggcccctggcccccagcgtgccccccaggaccagccagaccatgagcagcagcctgcggggcaccacccccagctgcaccaccctgagctgccccctgggcggggccctcttctcctacaagctggagcccatcacccccagcctgaagctgcccaggacaggcctgcagcccctgacagacaccatgaccagcagcagcctggcccagaccctggcccgctgctag

SEQ ID NO: 7829 - DNA, 333 bp, Artificial Sequence
  Description of Artificial Sequence: Synthetic coding sequence
ctcttcatgctgcacaagatcgtgcaggtgtacaacagtgatgtgattgacaagcagagcgcctccatgaccagtgacaatgctgatgacaaggccgtcatcatcctggtgcctgtgcggctgggcggggagaggaccaacacagactacctggagtttgtgaagggcatcctgagcctggagtactgtgtgggcatcattggaggcaagcccaagcagagctactactttgctggcttccaggatgacagcctcatctacatggacccccactactgccagagctttgtggatgtgtccatcaaggacttccccctggaggtgatcctgtag

SEQ ID NO: 7830 - DNA, 420 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggagtag

SEQ ID NO: 7831 - DNA, 570 bp, Artificial Sequence
  Description of Artificial Sequence: Synthetic coding sequence
atgctgggcatcaccagctgcagcgaccagcaggccaaggagggggagggcctggagggcagcagcacaggcagcagcagcggcaaccacggcggcagcggcggcggcaatggccacaagccaggctgtgagaagccaggaaatgaggcccggggcagcggggagagcggcatccagaacagcgagaccagccctggcatgttcaactttgacaccttctggaagaacttcaagagcaagctgggcttcatcaactgggatgccatcaacaagaaccaggtgcccccacccagcacccgggccctgctgtacttcagccggctgtgggaggacttcaagcagaacacccccttcctgaactggaaggccatcattgaaggagcagatgccagcagcctgcagaagagagctggaagagatgaccagaactacaactacaaccagcacgcctaccccacagcctatggaggcaagtacagcgtgaagaccccagccaagggcggcgtgagccccagcagcagcgccagccgggtgcagcccggcctgctgcagtgggtgaagttctggtag

SEQ ID NO: 7832 - DNA, 438 bp, Artificial Sequence; identical to SEQ ID NO: 7449
  Description of Artificial Sequence: Synthetic coding sequence

SEQ ID NO: 7833 - DNA, 264 bp, Artificial Sequence
  Description of Artificial Sequence: Synthetic coding sequence
tgcaagaggaagccctacctgctgcccagcatccgggagggcgcccggctgggcatccaggagtgtggcagccagttcagacatgagcgctggaactgcatgatcacagctgctgccaccacagcccccatgggcgccagccccctgtttggctatgagctgagcagcggctgccggcaggtggatgtgtcccggctgcccctgcccaggagcttccggctgctgtgctgtgagaacatgctggagaaccacgtgttcttctag

SEQ ID NO: 7834 - DNA, 2535 bp, Artificial Sequence; identical to SEQ ID NO: 7302
  Description of Artificial Sequence: Synthetic coding sequence

SEQ ID NO: 7835 - DNA, 2631 bp, Artificial Sequence; identical to SEQ ID NO: 6925
  Description of Artificial Sequence: Synthetic coding sequence

SEQ ID NO: 7836 - DNA, 942 bp, Artificial Sequence; identical to SEQ ID NO: 7248
  Description of Artificial Sequence: Synthetic coding sequence

SEQ ID NO: 7837 - DNA, 843 bp, Artificial Sequence
  Description of Artificial Sequence: Synthetic coding sequence
atgaagaccttcacctggaccctgggcgtgctcttcttcctgctggtggacaccggccactgccggggcggccagttcaagatcaagaagatcaaccagaggcgctaccccaggaccatcaaggacatgatcaccaggatggacctggagaacctgaaggatgtgctgagccggcagaagcgggagattgatgtgctgcagctggtggtggatgtggatggcaacatcgtgaatgaggtgaagctgctgaggaaggagagcaggaacatgaacagccgggtgacccagctgtacatgcagctgctgcacgagatcatcaggaagagggacaacagcctggagctgagccagctggagaacaagatcctgaatgtgaccacagagatgctgaagatggccacccgctaccgggagctggaggtgaagtatgccagcctgacagacctggtgaacaaccagagcgtgatgatcaccctgctggaggagcagtgcctgcgcatcttcagccggcaggacacccacgtgtccccacccctggtgcaggtggtgccccagcacatccccaacagccagcagtacaccccaggcctgctgggcggcaatgagatccagagggaccccggctacccccgggacctgatgcctcctccagacctggccaccagccccaccaagagccccttcaagatcccccctgtgaccttcatcaatgaaggccccttcaaggactgccagcaggccaaggaggccggccacagcgtgaatggcatcttctgggccgagtaccggggcggcagctacagcctgcgggctgtgcagatgatgatcaagcccattgattag

SEQ ID NO: 7838 - DNA, 522 bp, Artificial Sequence; identical to SEQ ID NO: 7221
  Description of Artificial Sequence: Synthetic coding sequence

SEQ ID NO: 7839 - DNA, 309 bp, Artificial Sequence
  Description of Artificial Sequence: Synthetic coding sequence
atggagagaggagctggggccaagctgctgcccctgctgctgctgctgcgggccaccggcttcacctgtgcccagacagatggaagaaatggctacacagctgtgattgaggtgaccagcggcggcccctggggagactgggcctggccagagatgtgcccagatggcttctttgccagcggcttcagcctgaaggtggagcccccccagggcatccctggagatgacacagccctgaatggcatccggctgcactgtgcccggggaaatgtgctgggcaacacccacgtgctgggccgcatggagtag

SEQ ID NO: 7840 - DNA, 351 bp, Artificial Sequence; identical to SEQ ID NO: 7504
  Description of Artificial Sequence: Synthetic coding sequence

SEQ ID NO: 7841 - DNA, 1137 bp, Artificial Sequence
  Description of Artificial Sequence: Synthetic coding sequence
tgatattctggggactacatggagcctgagaagccaggggcccccctgctgcccccaccaccccagaacagcgtgccccactatgcagaggccgacatcgtgaccctgcagggcgtgactggaggcaacacctatgctgtgcctgccctgcccccaggagctgtgggagatggccccccccgggtggacttccccaggagccggctgcgcttcaaggagaagctgggggagggccagtttggagaggtgcacctgtgtgaggtggacagcccccaggacctggtgtccctggacttccccctgaatgtgaggaagggccaccccctgctggtggccgtgaagatcctgcggccagatgccaccaagaatgccagcttcagcctcttcagcagaaatgacttcctgaaggaggtgaagatcatgagccggctgaaggaccccaacatcatccggctgctgggcgtgtgtgtgcaggatgaccccctgtgcatgatcacagactacatggagaatggagacctgaaccagttcctgagcgcccaccagctggaggacaaggctgctgagggcgcccctggagatggccaggccgcccagggccccaccatctcctaccccatgctgctgcacgtggccgcccagatcgccagcggcatgagatacctggccaccctgaactttgtgcaccgggacctggccaccaggaactgcctggtgggggagaacttcaccatcaagattgctgactttggcatgagcaggaacctgtatgctggggactactacagagtgcagggccgggctgtgctgcccatccgctggatggcctgggagtgcatcctgatgggcaagttcaccacagccagtgatgtgtgggccttcggcgtgaccctgtgggaggtgctgatgctgtgccgggcccagcccttcggccagctgacagatgagcaggtgattgaaaatgctggggagttcttccgggaccagggccggcaggtgtacctgagccggcccccagcctgcccccagggcctgtatgagctgatgctgcgctgctggagccgggagagcgagcagaggcctcccttcagccagctgcaccgcttcctggccgaggatgccctgaacacagtgtag

SEQ ID NO: 7842 - DNA, 942 bp, Artificial Sequence; identical to SEQ ID NO: 7248
  Description of Artificial Sequence: Synthetic coding sequence

SEQ ID NO: 7843 - DNA, 420 bp, Artificial Sequence; identical to SEQ ID NO: 7830
  Description of Artificial Sequence: Synthetic coding sequence

SEQ ID NO: 7844 - DNA, 342 bp, Artificial Sequence
  Description of Artificial Sequence: Synthetic coding sequence
atggacaacgtgcagcccaagatcaagcaccggcccttctgcttctctgtgaagggccacgtgaagatgctgcggctggccctgactgtgacctccatgaccttcttcatcatcgcccaggcccctgagccctacatcgtcatcactggatttgaggtgaccgtcatcctcttcttcatcctgctgtatgtgctgcggctggaccggctgatgaagtggctgttctggcccctgctggacatcatcaacagcctggtgaccaccgtcttcatgctgattgtgtctgtgctggccctgatccctgagaccaccaccctgactgtgggcggcggcctcttctag

SEQ ID NO: 7845 - DNA, 465 bp, Artificial Sequence
  Description of Artificial Sequence: Synthetic coding sequence
atgtttggctggggagacttccacagcaacatcaagacagtgaagctgaacctgctgatcaccgggaagatcgtggaccatggaaatggcaccttctctgtgtacttccgccacaacagcacaggccagggcaatgtgtctgtgtccctggtgccccccaccaagatcgtggagtttgacctggcccagcagacagtgattgatgccaaggacagcaagagcttcaactgcagaattgaatatgagaaggtggacaaggccaccaagaacaccctgtgcaactatgaccccagcaagacctgctaccaggagcagacccagagccacgtgtcctggctgtgcagcaagcccttcaaggtgatctgcatctacatctccttctacagcacagactacaagctggtgcagaaggtgtgcccagactacaactaccacagcgacaccccctacttccccagcggctag

SEQ ID NO: 7846 - DNA, 531 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaggccggggccgccccctacgtgcaggcctttgacagcctgctggccggccctgtggccgagtacctgaagatcagcaaggagattggaggagatgtgcagaagcatgctgagatggtgcacacaggcctgaagctggagcgggccctgctggtgacagccagccagtgccagcagcctgctgagaacaagctgagtgacctgctggcccccatcagcgagcagatcaaggaggtgatcaccttccgggagaagaacagaggcagcaagctgttcaaccacctgtctgctgtgtctgagagcatccaggccctgggctgggtggccatggcccccaagccaggcccctacgtgaaggagatgaatgatgctgccatgttctacaccaacagagtgctgaaggagtacaaggatgtggactag

SEQ ID NO: 7847 - DNA, 2535 bp, Artificial Sequence; identical to SEQ ID NO: 7302
  Description of Artificial Sequence: Synthetic coding sequence

SEQ ID NO: 7848 - DNA, 2055 bp, Artificial Sequence
  Description of Artificial Sequence: Synthetic coding sequence
tgacccaggagcagcacccacgtgcccctggtgctgcccctgctggtgctgctgctgctggccccagcccggcaggccgccgcccagcgctgcccccaggcctgcatctgtgacaacagcagaagacatgtggcctgccgctaccagaacctgacagaggtgcctgatgccatccctgagctgacccagaggctggacctgcagggcaacctgctgaaggtgatcccagctgctgccttccagggcgtgccccacctgacccacctggacctgcggcactgtgaggtggagctggtggccgagggcgccttccggggcctgggccgcctgctgctgctgaacctggccagcaaccacctgcgggagctgccccaggaggccctggatggcctgggcagcctgcggcggctggagctggagggcaatgccctggaggagctgcggcccggcaccttcggggccctgggcgccctggccaccctgaacctggcccacaatgccctggtgtacctgcctgccatggccttccagggcctgctgcgggtgcgctggctgcggctgagccacaatgccctgtctgtgctggcccctgaggccctggccggcctgcctgccctgcggcggctgagcctgcaccacaatgagctgcaggccctgcccggccctgtgctgagccaggcccggggcctggcccggctggagctgggccacaaccccctgacctacgccggggaggaggatggcctggccctgcccggcctgcgggagctgctgctggatggaggagccctgcaggccctgggcccccgggcctttgcccactgcccccggctgcacaccctggacctgcggggcaaccagctggacaccctgccccccctgcagggccctggccagctgcggcggctgcggctgcagggcaaccccctgtggtgtggctgccaggcccggcccctgctggagtggctggcccgggcccgggtgcggagtgatggagcctgccagggcccccggcggctgcggggggaggccctggatgccctgcggccctgggacctgcgctgccctggagatgctgcccaggaggaggaggagctggaggagagagctgtggccggcccccgggccccaccccggggccccccccggggccctggagaggagagagctgtggccccctgcccccgggcctgtgtgtgtgtgcctgagagccgccacagcagctgtgagggctgcggcctgcaggccgtgccccggggcttccccagcgacacccagctgctggacctgcggaggaaccacttccccagcgtgcccagggctgccttccctggcctgggccacctggtgtccctgcacctgcagcactgcggcattgctgagctggaggccggggccctggccggcctgggccgcctcatctacctgtacctgagtgacaaccagctggccggcctgtctgctgctgccctggagggcgccccccggctgggctacctgtacctggagaggaaccgcttcctgcaggtgcctggagctgccctgcgggccctgcccagcctcttcagcctgcacctgcaggacaatgctgtggaccggctggcccctggggacctgggccgcacccgggccctgcgctgggtgtacctgagcggcaaccgcatcacagaggtgtccctgggcgccctgggccctgcccgggagctggagaagctgcacctggacaggaaccagctgcgggaggtgcccaccggggccctggagggcctgcctgccctgctggagctgcagctgagcggcaaccccctgcgggccctgagagatggagccttccagcctgtgggccgcagcctgcagcacctgttcctgaacagcagcggcctggagcagatctgccctggggccttcagcggcctgggccctggcctgcagagcctgcacctgcagaagaaccagctgcgggccctgcctgccctgcccagcgcccggaggacccccatcaagggccggcagtgtggggctgacaaggtgggcaaggagaagggccgcctgtag

SEQ ID NO: 7849 - DNA, 2259 bp, Artificial Sequence
  Description of Artificial Sequence: Synthetic coding sequence
atggcccggcacctgctgctgcccctggtgatgctggtgatcagccccatccctggggccttccaggacagcgccctgagccccacccaggaggagcctgaggacctggactgtggccggcctgagcccagcgccagaattgtgggcggcagcaatgcccagcccggcacctggccctggcaggtgtccctgcaccacggcggcggccacatctgtggcggcagcctgattgcccccagctgggtgctgtctgctgcccactgcttcatgaccaacggcaccctggagcctgctgctgagtggagcgtgctgctgggcgtgcacagccaggacggccccctggatggagcccacaccagggctgtggccgccatcgtggtgcctgccaactacagccaggtggagctgggcgctgacctggccctgctgcggctggccagccctgccagcctgggccctgctgtgtggcctgtgtgcctgccccgggccagccacagatttgtgcatggaacagcctgctgggccaccggctggggagatgtgcaggaggccgaccccctgcccctgccctgggtgctgcaggaggtggagctgcggctgctgggggaggccacctgccagtgcctgtacagccagcccggccccttcaacctgaccctgcagatcctgcccggcatgctgtgtgccggctacccagagggcagaagagacacctgccagggcgacagcggcggccccctggtgtgtgaggagggcggccgctggttccaggccggcatcaccagctttggatttggctgcggcagaagaaacagacctggggtcttcaccgctgtggccacctatgaggcctggatccgggagcaggtgatgggcagcgagcccggccctgccttccccacccagccccagaagacccagagcgacccccaggagccccgggaggagaactgcaccatcgccctgcctgaatgtgggaaggcccccaggcctggggcctggccctgggaggcccaggtgatggtgcccggcagccggccctgccacggggccctggtgtctgagagctgggtgctggccccagccagctgcttcctggaccccaacagcagtgacagccccccccgggacctggatgcctggagggtgctgctgcccagccggcccagggctgagcgggtggcccggctggtgcagcatgaaaatgcctcctgggacaatgccagtgacctggccctgctgcagctgcggacccctgtgaacctgtctgctgccagcaggcctgtgtgcctgccccaccctgagcactacttcctgcccggcagccgctgccgcctggcccgctggggccgcggggagcccgccctgggccctggggccctgctggaggccgagctgctgggcggctggtggtgccactgcctgtatggccggcagggcgctgctgtgcccctgcccggggacccccctcatgccctgtgcccagcctaccaggagaaggaggaggtgggcagctgctggaatgacagccgctggagcctgctgtgccaggaggagggcacctggttcctggccggcatccgggacttccccagcggctgcctgcggccccgggccttcttccccctgcagacccacggcccctggatcagccacgtgaccaggggggcctacctggaggaccagctggcctgggactggggcccagatggagaggagacagagacccagacctgccccccccacacagaacatggagcctgtggcctgcggctggaggccgcccctgtgggcgtgctgtggccctggctggccgaggtgcacgtggccggggacagagtgtgcaccggcatcctgctggcccctggctgggtgctggccgccacccactgtgtgctgcggcccggcagcaccaccgtgccctacatcgaggtgtacctgggccgggccggggccagcagcctgccccagggccaccagatgaccagcgccccacccctgctgtgccagatgacagagggctcctggatcctggtgggcatggctgtgcagggcagccgggagctgtttgctgccatcggccctgaggaggcctggatcagccagacagtgggggaggccaacttcctgcccccatctggcagcccccactggcccaccggcggcagcaacctgtgccccccagagctggccaaggccagcggcagcccccatgctgtgtacttcctgctgctgctgaccctgctgatccagagctag

SEQ ID NO: 7850 - DNA, 453 bp, Artificial Sequence; identical to SEQ ID NO: 7139
  Description of Artificial Sequence: Synthetic coding sequence

SEQ ID NO: 7851 - DNA, 1161 bp, Artificial Sequence
  Description of Artificial Sequence: Synthetic coding sequence
atgaagttccagggccccctggcctgcctgctgctggccctgtgcctgggcagcggggaggccggccccctgcagagcggggaggagagcacaggcaccaacattggagaggccctgggccacggcctgggagatgccctgtctgagggcgtgggcaaggccatcggcaaggaggccggcggcgctgctggcagcaaggtgtctgaggccctgggccagggcacccgggaggccgtgggcactggagtgcggcaggtgcccggctttggagtggctgatgccctgggcaacagagtgggggaggccgcccacgccctgggcaacacaggccatgaaattggccggcaggccgaggatgtgatcagacatggagcagatgctgtgcggggctcctggcagggcgtgcccggccacaatggagcctgggagaccagcggcggccacggcatcttcggcagccagggcggcctgggcggccagggccagggcaaccctgggggcctgggcaccccctgggtgcacggctacccaggcaacagcgctggcagctttggcatgaacccccagggcgccccctggggccagggcggcaatggaggcccccccaactttggcaccaacacccagggcgctgtggcccagcccggctacggctctgtgcgggccagcaaccagaatgaaggctgcaccaaccccccaccttctggcagcggcggcggcagcagcaacagcggcggcggcagcggcagccagagcggcagcagcggcagcggcagcaatggagacaacaacaacggcagcagcagcggcggcagcagcagcggcagcagcagcggcggcagcagcggcggcagcagcggcggcagcagcggcaacagcggcggcagcagaggagacagcggcagcgagagctcctggggcagcagcacaggcagcagcagcggcaaccacggcggcagcggcggcggcaatggccacaagccaggctgtgagaagccaggaaatgaggcccggggcagcggggagagcggcatccagaacagcgagaccagccctggcatgttcaactttgacaccttctggaagaacttcaagagcaagctgggcttcatcaactgggatgccatcaacaaggaccagaggagcagccgcatcccctag

SEQ ID NO: 7852 - DNA, 1995 bp, Artificial Sequence; identical to SEQ ID NO: 6985
  Description of Artificial Sequence: Synthetic coding sequence

SEQ ID NO: 7853 - DNA, 420 bp, Artificial Sequence; identical to SEQ ID NO: 7830
  Description of Artificial Sequence: Synthetic coding sequence

SEQ ID NO: 7854 - DNA, 285 bp, Artificial Sequence; identical to SEQ ID NO: 7145
  Description of Artificial Sequence: Synthetic coding sequence

SEQ ID NO: 7855 - DNA, 699 bp, Artificial Sequence
  Description of Artificial Sequence: Synthetic coding sequence
atgctgcccaagagccggcgggccctgaccatccaggagattgctgccctggcccggagcagcctgcacggcatcagccaggtggtgaaggaccacgtgaccaagcccacagccatggcccagggccgggtggcccacctgattgagtggaagggctggagcaagcccagcgacagccctgctgccctggagagcgccttcagcagctacagcgacctgtctgagggggagcaggaggccaggtttgctgctggggtggccgagcagtttgccatcgccgaggccaagctgcgggcctggagctctgtggatggagaggacagcacagatgacagctatgatgaagattttgctgggggcatggacacagacatggccggccagctgcccctgggcccccacctgcaggacctcttcaccggccaccgcttcagcaggcctgtgcggcagggctctgtggagcctgagagtgactgcagccagacagtgtccccagacaccctgtgcagcagcctgtgcagcctggaggatggcctgctgggcagccctgcccggctggccagccagctgctgggagatgagctgctgctggccaagctgccccccagccgggagagcgccttccgcagcctgggccccctggaggcccaggacagcctgtacaacagccccctgacagagagctgcctgagcccctag

SEQ ID NO: 7856 - DNA, 2631 bp, Artificial Sequence; identical to SEQ ID NO: 6925
  Description of Artificial Sequence: Synthetic coding sequence

SEQ ID NO: 7857 - DNA, 165 bp, Artificial Sequence
  Description of Artificial Sequence: Synthetic coding sequence
atgtgccgggagacagctggctacggctggctgctggccagcacagagctgctgagcctgctggagcccctgagcccccagctgctgaaggagcacatcagctgcaccagccaggtggccgccggggccaaggtgaccccagattctgctgtgtgggccccctag

SEQ ID NO: 7858 - DNA, 2256 bp, Artificial Sequence; identical to SEQ ID NO: 6948
  Description of Artificial Sequence: Synthetic coding sequence

SEQ ID NO: 7859 - DNA, 630 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagagatggcctgctgagctacacagcccctgtgggccagaccatgtacctgtctgaggccgtgtactag

SEQ ID NO: 7860 - DNA, 315 bp, Artificial Sequence
  Description of Artificial Sequence: Synthetic coding sequence
atgtctgacctgctgctgctgggcctcatcggcggcctgaccctgctgctgctgctgaccctgctggcctttgctggctacagcggcctgctggccggcgtggaggtgtctgctggcagcccccccatcagaaatgtgacagtggcctacaagttccacatgggcctgtatggagagaccggccgcctcttcacagagagctgcagcatcagccccaagctgcggagcattgctgtgtactatgacaacccccacatggtgcccccagacaagtgccgctgtgctgtgggcagcatcctgtctgagggggagtag

SEQ ID NO: 7861 - DNA, 2631 bp, Artificial Sequence; identical to SEQ ID NO: 6925
  Description of Artificial Sequence: Synthetic coding sequence

SEQ ID NO: 7862 - DNA, 1053 bp, Artificial Sequence
  Description of Artificial Sequence: Synthetic coding sequence
atggaggcctttgccctgggccctgcccggcggggcagaagaaggaccagggctgctggcagcctgctgagccgggccgccatcctgctcttcatcagcgccttcctggtgcgggtgcccagctctgtgggccacctggtgcggctgccccgggccttccggctgaccaaggacagcgtgaagatcgtgggcagcaccagcttccctgtgaaggcctacgtgatgctgcaccagaagagcccccacgtgctgtgtgtgacccagcagctgagaaatgctgagctgattgaccccagcttccagtggtacggccccaagggcaaggtggtgtctgagaacagaacagcccagatcaccagcacaggcagcctggtgttccagaactttgaggagagcatgagcggcatctacacctgcttcctggagtacaagcccaccgtggaggagatcgtgaagaggctgcagctgaagtatgccatctatgcctaccgggagccccactactactaccagttcaccgcccgctaccacgccgccccctgcaacagcatctacaacatcagctttgagaagaagctgctgcagatcctgagcaagctgctgctggacctgagctgtgagatcagcctgctgaagtctgagtgccaccgggtgaagatgcagagagctggcctgcagaatgaactcttctttgccttctctgtgagcagcctggacacagagaagggccccaagcgctgcacagaccacaactgtgagccctacaagaggctcttcaaggccaagaacctgattgagcgcttcttcaaccagcaggtggagatcctgggccggcgggcagagcagctgccccagatctactacatcgagggcaccctgcagatggtgtggatcaaccgctgcttccctggctacggcatgaatgtgcagcagcaccccaagtgcccagagtgctgcgtcatctgcagccctggcagctacaaccccagagatggcatccactgcctgcagtgcaacagcagcctggtgtatggagccaagacctgcctgtag

SEQ ID NO: 7863 - DNA, 1392 bp, Artificial Sequence
  Description of Artificial Sequence: Synthetic coding sequence
tgactggccctggtgctgtgcaccgtggacagccggcccccagcccagctggccctgagccacgccggccgcctgctggccagcagcacagctgcctctgtgcccaacaccctgcggctggagctgcggggcccccagcccagagatgagggcttctacagctgcagcgcccggagccccctgggccaggccaacaccagcctggagctgcggctggagggcgtgcgggtcatcctggcccctgaggccgctgtgcctgagggcgcccccatcaccgtgacctgtgccgaccctgctgcccacgcccccaccctgtacacctggtaccacaacggccgctggctgcaggagggccctgctgccagcctgtccttcctggtggccacccgggcccatgctggggcctacagctgccaggcccaggatgcccagggcaccaggagcagcaggcctgctgccctgcaggtgctgtatgccccccaggatgctgtgctgagcagcttccgggacagccgggcccgctccatggctgtgatccagtgcaccgtggacagcgagcccccagctgagctggccctgagccatgatggcaaggtgctggccaccagcagcggcgtgcacagcctggccagcggcactggacatgtgcaggtggccagaaatgccctgcggctgcaggtgcaggatgtgcctgctggagatgacacctacgtgtgcacagcccagaacctgctgggcagcatcagcaccatcggccgcctgcaggtggagggcgcccgggtggtggccgagcccggcctggatgtgcctgagggcgccgccctgaacctgagctgccgcctgctgggcggccctggccctgtgggcaacagcacctttgcctggttctggaatgaccggcggctgcacgccgagcctgtgcccaccctggccttcacccacgtggcccgggcccaggccggcatgtaccactgcctggccgagctgcccactggagctgctgccagcgcccctgtgatgctgcgggtgctgtacccacccaagacccccaccatgatggtgtttgtggagcctgagggcggcctgcggggcatcctggactgccgggtggacagcgagcccctggccagcctgaccctgcacctgggcagccggctggtggccagcagccagccccagggcgccccagctgagccccacatccacgtgctggccagccccaatgccctgcgggtggacatcgaggccctgcggcccagcgaccagggcgagtacatctgcagcgccagcaatgtgctgggcagcgccagcaccagcacctactttggagtgcggggggagggccggggcctgcacctgcccggccacagcgcccagaagcccagcagctag

SEQ ID NO: 7864 - DNA, 1398 bp, Artificial Sequence
  Description of Artificial Sequence: Synthetic coding sequence
atgaagttccagggccccctggcctgcctgctgctggccctgtgcctgggcagcggggaggccggccccctgcagagcggggaggagagcacaggcaccaacattggagaggccctgggccacggcctgggagatgccctgtctgagggcgtgggcaaggccatcggcaaggaggccggcggcgctgctggcagcaaggtgtctgaggccctgggccagggcacccgggaggccgtgggcactggagtgcggcaggtgcccggctttggagtggctgatgccctgggcaacagagtgggggaggccgcccacgccctgggcaacacaggccatgaaattggccggcaggccgaggatgtgatcagacatggagcagatgctgtgcggggctcctggcagggcgtgcccggccacaatggagcctgggagaccagcggcggccacggcatcttcggcagccagggcggcctgggcggccagggccagggcaaccctgggggcctgggcaccccctgggtgcacggctacccaggcaacagcgctggcagctttggcatgaacccccagggcgccccctggggccagggcggcaatggaggcccccccaactttggcaccaacacccagggcgctgtggcccagcccggctacggctctgtgcgggccagcaaccagaatgaaggctgcaccaaccccccaccttctggcagcggcggcggcagcagcaacagcggcggcagcagcacaggcagcagcagcggcaaccacggcggcagcggcggcggcaatggccacaagccaggctgtgagaagccaggaaatgaggcccggggcagcggggagagcggcatccagggcttccggggccagggcgtgagcagcaacatgagggagatcagcaaggagggcaaccggctgctgggcggcagcggggacaactaccggggccagggcagctcctggggcagcggcggcggagatgctgtgggcggcgtgaacacagtgaacagcgagaccagccctggcatgttcaactttgacaccttctggaagaacttcaagagcaagctgggcttcatcaactgggatgccatcaacaagaaccaggtgcccccacccagcacccgggccctgctgtacttcagccggctgtgggaggacttcaagcagaacacccccttcctgaactggaaggccatcattgaaggagcagatgccagcagcctgcagaagagagctggaagagatgaccagaactacaactacaaccagcacgcctaccccacagcctatggaggcaagtacagcgtgaagaccccagccaagggcggcgtgagccccagcagcagcgccagccgggtgcagcccggcctgctgcagtgggtgaagttctggtag

SEQ ID NO: 7865 - DNA, 2700 bp, Artificial Sequence; identical to SEQ ID NO: 7525
  Description of Artificial Sequence: Synthetic coding sequence

SEQ ID NO: 7866 - DNA, 381 bp, Artificial Sequence
  Description of Artificial Sequence: Synthetic coding sequence
atgtggtacgtgtccacccggggcgtggccccccgggtgaactttgaaggagccctcttcagcggctacgccccagatggcggcctcttcatgcctgaggagctgccccagctggaccggggcaccctgtgccagtggagcaccctgagctacccaggcctggtgaaggagctgtgtgccctcttcatcggcagcgagctgctgcccaaggatgagctgaatgacctgattgaccgggccttcagccgcttccgccaccgggaggtggtgcacctgagccggctgagaaatggcctgaatgtgctggagctgtggcacggcgtgacctacgccttcaaggacctgagcctgagctgcaccacccagttcctgcagtactag

SEQ ID NO: 7867 - DNA, 147 bp, Artificial Sequence
  Description of Artificial Sequence: Synthetic coding sequence
atgccacccttcctgatcaccctcttcctgttccacagctgctgcctgcgggccaacggccacctgcgggagggcatgaccctgctgaagacagaatttgccctgcacctgtaccagagcgtggccgcctgcagaaatgagacctag

SEQ ID NO: 7868 - DNA, 390 bp, Artificial Sequence; identical to SEQ ID NO: 7503
  Description of Artificial Sequence: Synthetic coding sequence

SEQ ID NO: 7869 - DNA, 462 bp, Artificial Sequence
  Description of Artificial Sequence: Synthetic coding sequence
atgaccatccacatcctgatcctgctgctgctgctggccttcagcgcccagggcgacctggacacagctgcccggcggggccagcaccaggtgccccagcaccggggccacgtgtgctacctgggcgtgtgcaggacccaccggctggccgagatcatctactggatccgctgcctgcaccagggcgccctgggggagggccagccccgggcccctggccccctgcagctgtgggcccctcctgtggcccggggcggcagccctgcccgcttccctggcttccggcctgctgcccggggcctggcccagtgcccagcccgctgggtgaccagcggcacagcccggcccctgctgggcttcagcctgcccatctgcatgctggagctgctgctgcacatcagcagccccctgaccccagcccctgagaccgtcttccccagccccagccctggctgtgactag

SEQ ID NO: 7870 - DNA, 450 bp, Artificial Sequence
  Description of Artificial Sequence: Synthetic coding sequence
atgggctggctgaccagaattgtgtgcctcttctggggcgtgctgctgacagcccgggccaactaccagaatggcaagaacaacgtgccccggctgaagctgagctacaaggagatgctggagagcaacaacgtcatcaccttcaacggcctggccaacagcagcagctaccacaccttcctgctggatgaggagaggagccggctgtatgtgggcgccaaggaccacatcttctcctttgacctggtgaacatcaaggacttccagaagatcgtgtggcctgtgtcctacaccaggagagatgagtgcaagtgggccggcaaggacatcctgaaggaatgtgccaacttcatcaaggtgctgaaggcctacaaccagacccacctgtatgcctgtggcaccggggccttccaccccatctgcacctacatcgagatcggccaccactag

SEQ ID NO: 7871 - DNA, 543 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaggccggggccgccccctacgtgcaggcctttgacagcctgctggccggccctgtggccgagtacctgaagatcagcaaggagattggaggagatgtgcagaagcatgctgagatggtgcacacaggcctgaagctggagcgggccctgctggtgacagccagccagtgccagcagcctgctgagaacaagctgagtgacctgctggcccccatcagcgagcagatcaaggaggtgatcaccttccgggagaagaacagaggcagcaagctgttcaaccacctgtctgctgtgtctgagagcatccaggccctgggctgggtggccatggcccccaagccaggcccctacgtgaaggagatgaatgatgctgccatgttctacaccaacagagtgctgaaggagtacaaggatgtggacaagaagcacgtgtag

SEQ ID NO: 7872 - DNA, 630 bp, Artificial Sequence; identical to SEQ ID NO: 7859
  Description of Artificial Sequence: Synthetic coding sequence

SEQ ID NO: 7873 - DNA, 630 bp, Artificial Sequence; identical to SEQ ID NO: 7859
  Description of Artificial Sequence: Synthetic coding sequence

SEQ ID NO: 7874 - DNA, 2631 bp, Artificial Sequence; identical to SEQ ID NO: 6925
  Description of Artificial Sequence: Synthetic coding sequence

SEQ ID NO: 7875 - DNA, 2103 bp, Artificial Sequence
  Description of Artificial Sequence: Synthetic coding sequence
atgctggcccccttcctgctgctgctgacccacagccgcagccccctgtccttccggccctgcagccacgtgcctggggccctgattgcccagaagcccatgggcagcagccggctggccgccctgctgctgcccctgctgctgattgtgattgacctgagtgacagcgctggcatcggcttccgccacctgccccactggaacacccgctgccccctggccagccacacagatgacagcttcaccggcagcagcgcctacatcccctgcaggacctggtgggccctcttcagcaccaagccctggtgtgtgcgggtgtggcactgcagccgctgcctgtgccagcacctgctgagcggcggcagcggcctgcagaggggcctcttccacctgctggtgcagaagagcaagaagagcagcaccttcaagttctaccgccgccacaagatgcctgccccagcccagaggaagctgctgcccaggaggcacctgtctgagaagagccaccacatcagcatccccagcccagacatcagccacaagggcctgcggagcaagaggacccagcccagcgaccctgagacctgggagagcctgccccggctggacagccagagacatggaggccctgagttctcctttgacctgctgcctgaggcccgggccatccgggtgaccatcagcagcggccctgaggtgtctgtgcggctgtgccaccagtgggccctggagtgtgaggagctgagcagcccctatgatgtgcagaagatcgtgtctgggggccacacagtggagctgccctatgagttcctgctgccctgcctgtgcatcgaggccagctacctgcaggaggacacagtgcggaggaagaagtgccccttccagagctggccagaggcctacggcagtgacttctggaagtctgtgcacttcacagactacagccagcacacccagatggtgatggccctgaccctgcgctgccccctgaagctggaggccgccctgtgccagagacatgactggcacaccctgtgcaaggacctgcccaatgccacagcccgggagagtgatggctggtacgtgctggagaaggtggacctgcacccccagctgtgcttcaagttctcctttggaaacagcagccacgtggagtgcccccaccagacaggcagcctgacctcctggaatgtgtccatggacacccaggcccagcagctgatcctgcacttcagcagcaggatgcacgccaccttctctgctgcctggagcctgcccggcctgggccaggacaccctggtgccccctgtgtacacagtgtcccaggcccggggcagcagccctgtgtccctggacctgatcatccccttcctgcggcccggctgctgcgtgctggtgtggaggagtgatgtgcagtttgcctggaagcacctgctgtgcccagatgtgtcctaccgccacctgggcctgctgatcctggccctgctggccctgctgaccctgctgggcgtggtgctggccctgacctgcagaagaccccagagcggccctggccctgcccggcctgtgctgctgctgcacgccgctgacagcgaggcccagaggcggctggtgggcgccctggccgagctgctgcgggccgccctgggcggcggcagagatgtgattgtggacctgtgggagggccgccacgtggcccgggtgggccccctgccctggctgtgggccgcccggaccagggtggcccgggagcagggcaccgtgctgctgctgtggagcggggctgacctgcggcctgtgtctggccctgaccccagggctgcccccctgctggccctgctgcacgccgccccccggcccctgctgctgctggcctacttcagccggctgtgtgccaagggggacatccccccacccctgcgggccctgccccgctaccgcctgctgcgggacctgccccggctgctgcgggccctggatgcccggccctttgctgaggccacctcctggggccgcctgggcgcccggcagaggcggcagagccggctggagctgtgcagccggctggagcgggaggccgcccggctggccgacctgggctag

SEQ ID NO: 7876 - DNA, 1194 bp, Artificial Sequence
  Description of Artificial Sequence: Synthetic coding sequence
atgaggagcctgctgctgctgagcgccttctgcctgctggaggccgccctggccgctgaggtgaagaagccagctgctgctgctgcccctggaacagctgagaagctgagccccaaggccgccaccctggccgagaggtctgctggcctggccttcagcctgtaccaggccatggccaaggaccaggccgtggagaacatcctggtgtcccctgtggtggtggccagcagcctgggcctggtgtccctgggcggcaaggccaccacagccagccaggccaaggctgtgctgtctgctgagcagctgagaaatgtgacctggaagctgggcagccggctgtatggccccagctctgtgtcctttgctgatgactttgtgcgcagcagcaagcagcactacaactgtgagcacagcaagatcaacttccgggacaagaggtctgccctgcagagcatcaatgagtgggccgcccagaccacagatggcaagctgcctgaggtgaccaaggatgtggagaggacagatggagccctgctggtgaatgccatgttcttcaagccccactgggatgagaagttccaccacaagatggtggacaacagaggcttcatggtgaccaggagctacacagtgggcgtgatgatgatgcacaggacaggcctgtacaactactatgatgatgagaaggagaagctgcagatcgtggagatgcccctggcccacaagctgagcagcctcatcatcctgatgccccaccacgtggagcccctggagcggctggagaagctgctgaccaaggagcagctgaagatctggatgggcaagatgcagaagaaggctgtggccatcagcctgcccaagggcgtggtggaggtgacccatgacctgcagaagcacctggccggcctgggcctgacagaggccatcgacaagaacaaggctgacctgagcaggatgtctgggaagaaggacctgtacctggcctctgtgttccacgccacagcctttgagctggacacagatggcaacccctttgaccaggacatctacggccgggaggagctgcggagccccaagctgttctatgctgaccaccccttcatcttcctggtgcgggacacccagagcggcagcctgctcttcatcggccgcctggtgcggcccaagggggacaagatgagagatgagctgtag

SEQ ID NO: 7877 - DNA, 612 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaggccggggccgccccctacgtgcaggcctttgacagcctgctggccggccctgtggccgagtacctgaagatcagcaaggagattggaggagatgtgcagaagcatgctgagatggtgcacacaggcctgaagctggagcgggccctgctggtgacagccagccagtgccagcagcctgctgagaacaagctgagtgacctgctggcccccatcagcgagcagatcaaggaggtgatcaccttccgggagaagaacagaggcagcaagctgttcaaccacctgtctgctgtgtctgagagcatccaggccctgggctgggtggccatggcccccaagccaggcccctacgtgaaggagatgaatgatgctgccatgttctacaccaacagagtgctgaaggagtacaaggatgtggacaagaagcacgtggactgggtgaaggcctacctgagcatctggacagagctgcaggcctacatcaaggagttccacaccacctag

SEQ ID NO: 7878 - DNA, 1293 bp, Artificial Sequence
  Description of Artificial Sequence: Synthetic coding sequence
atgaggaagctgatgaagcaggtgcaggagcagtgccccaacatcacccgcatctacagcatcggcaagagctaccagggcctgaagctgtatgtgatggagatgtctgacaagccaggagagcacgagctgggggagcctgaggtgcgctacgtggccggcatgcacggcaatgaggccctgggccgggagctgctgctgctgctgatgcagttcctgtgccacgagttcctgcggggcaacccccgggtgacccggctgctgtctgagatgaggatccacctgctgcccagcatgaacccagatggctatgagatcgcctaccaccggggcagcgagctggtgggctgggccgagggccgctggaacaaccagagcattgacctgaaccacaactttgctgacctgaacacccccctgtgggaggcccaggatgatggcaaggtgccccacatcgtgcccaaccaccacctgcccctgcccacctactacaccctgcccaatgccaccgtggcccctgagaccagggctgtgatcaagtggatgaagaggatcccctttgtgctgagcgccaacctgcacggcggggagctggtggtgtcctacccctttgacatgaccaggaccccctgggccgcccgggagctgacccccaccccagatgatgctgtgttccgctggctgagcacagtgtatgccggcagcaacctggccatgcaggacaccagccggcggccctgccacagccaggacttctctgtgcacggcaacatcatcaacggggctgactggcacacagtgcccggctccatgaatgacttctcctacctgcacaccaactgctttgaggtgacagtggagctgagctgtgacaagttcccccatgaaaatgagctgccccaggagtgggagaacaacaaggatgccctgctgacctacctggagcaggtgaggatgggcattgctggggtggtgcgggacaaggacacagagctgggcattgctgatgctgtgattgctgtggatggcatcaaccatgatgtgaccacagcctggggcggggactactggaggctgctgacccctggggactacatggtgacagccagcgctgagggctaccacagcgtgaccaggaactgccgggtgacctttgaggagggccccttcccctgcaactttgtgctgaccaagacccccaagcagaggctgcgggagctgctggccgccggggccaaggtgcccccagacctgcggcggcggctggagcggctgcggggccagaaggactag

SEQ ID NO: 7879 - DNA, 1680 bp, Artificial Sequence; identical to SEQ ID NO: 6964
  Description of Artificial Sequence: Synthetic coding sequence

SEQ ID NO: 7880 - DNA, 8199 bp, Artificial Sequence
  Description of Artificial Sequence: Synthetic coding sequence
atggagcagacagactgcaagccctaccagcccctgcccaaggtgaagcatgagatggacctggcctacaccagcagcagtgatgaaagtgaagatggcaggaagccccggcagagctacaacagccgggagaccctgcacgagtacaaccaggagctgaggatgaactacaacagccagagcaggaagaggaaggaggtggagaagagcacccaggagatggagttctgtgagaccagccacaccctgtgcagcggctaccagacagacatgcacagcgtgtccagacatggctaccagctggagatgggcagtgatgtggacacagaaacagaaggagctgccagcccagaccacgccctgaggatgtggatccggggcatgaagtctgagcacagcagctgcctgagcagccgggccaacagcgccctgagcctgacagacacagaccacgagaggaagagtgatggagaaaatggcttcaagttcagccctgtgtgctgtgacatggaggcccaggccggcagcacccaggatgtgcagagcagcccccacaaccagttcaccttccggcccctgcccccacctcctcctcctcctcatgcctgcacctgtgccaggaagcccccacctgctgctgacagcctgcagaggaggtccatgaccaccaggagccagcccagccctgctgccccagccccacccaccagcacccaggacagcgtgcacctgcacaacagctgggtgctgaacagcaacatccccctggagaccaggcacttcctgttcaagcacggcagcggcagcagcgccatcttctctgctgccagccagaactaccccctgaccagcaacacagtgtacagccccccaccccggcccctgcccaggagcaccttcagcaggcctgccttcaccttcaacaagccctaccgctgctgcaactggaagtgcacagccctgagcgccacagccatcaccgtgaccctggccctgctgctggcctacgtgattgctgtgcacctgtttggcctgacctggcagctgcagcctgtggagggggagctgtatgccaatggagtgtccaaaggaaacagaggaacagagagcatggacaccacctacagccccatcggcggcaaggtgtctgacaagtctgagaagaaggtgttccagaagggccgggccatcgacacaggagaggtggacatcggggcccaggtgatgcagaccatccccccaggcctcttctggaggttccagatcaccatccaccaccccatctacctgaagttcaacatcagcctggccaaggacagcctgctgggcatctatggaagaagaaacatcccccccacccacacccagtttgattttgtgaagctgatggatggcaagcagctggtgaagcaggacagcaagggcagtgatgacacccagcacagccccaggaacctgatcctgaccagcctgcaggagaccggcttcatcgagtacatggaccagggcccctggtacctggccttctacaatgatggcaagaagatggagcaggtgtttgtgctgaccacagccatcgagatcatggatgactgcagcaccaactgcaatggaaatggagagtgcatcagcggccactgccactgcttccctggcttcctgggccctgactgtgcccgggacagctgccctgtgctgtgtggcggcaatggagaatatgagaagggccactgtgtgtgccgccacggctggaagggcccagaatgtgatgtgcctgaggagcagtgcatcgaccccacctgcttcggccacggcacctgcatcatgggcgtgtgcatctgtgtgcccggctacaagggggagatctgtgaggaggaggactgcctggaccccatgtgcagcaaccacggcatctgtgtgaagggggagtgccactgcagcacaggctggggcggcgtgaactgtgagacccccctgcctgtgtgccaggagcagtgcagcggccacggcaccttcctgctggatgctggggtgtgcagctgtgaccccaagtggacaggcagtgactgcagcacagagctgtgcaccatggagtgtggcagccacggcgtgtgcagccggggcatctgccagtgtgaggagggctgggtgggccccacctgtgaggagaggagctgccacagccactgcacagaacatggccagtgcaaggatggaaaatgtgagtgcagccctggctgggagggggaccactgcaccatcgcccactacctggatgctgtgagagatggctgccccggcctgtgctttggaaatggccgctgcaccctggaccagaatggctggcactgtgtgtgccaggtgggctggagcggcaccggctgcaatgtggtgatggagatgctgtgtggggacaacctggacaatgatggagatggcctgacagactgtgtggaccctgactgctgccagcagagcaactgctacatcagccccctgtgccagggcagcccagaccccctggacctgatccagcagagccagaccctcttcagccagcacaccagccgcctcttctatgaccgcatcaagttcctgattggcaaggacagcacccacgtgatccccccagaggtgtcctttgacagccggcgggcctgtgtgatccggggccaggtggtggccattgatggcacccccctggtgggcgtgaatgtgtccttcctgcaccacagcgactatggcttcaccatcagccggcaggacggcagctttgacctggtggccatcggcggcatcagcgtcatcctgatctttgacaggagccccttcctgcctgagaagaggaccctgtggctgccctggaaccagttcatcgtggtggagaaggtgaccatgcagagggtggtgtctgacccccccagctgtgacatcagcaacttcatcagccccaaccccatcgtgctgcccagccccctgaccagctttggaggcagctgcccagagcggggcaccatcgtgcctgagctgcaggtggtgcaggaggagatccccatccccagcagctttgtgcggctgagctacctgagcagcaggaccccaggctacaagaccctgctgcgcatcctgctgacccacagcaccatccctgtgggcatgatcaaggtgcacctgactgtggccgtggagggccgcctgacccagaagtggttccctgctgccatcaacctggtgtacacctttgcctggaacaagacagacatctacggccagaaggtgtggggcctggccgaggccctggtgtctgtgggctatgaatatgagacctgcccagacttcatcctgtgggagcagaggacagtggtgctgcagggctttgagatggatgccagcaacctgggcggctggagcctgaacaagcaccacatcctgaacccccagagcggcatcatccacaagggaaatggagagaacatgttcatcagccagcagccccctgtgatcagcaccatcatgggaaatggccaccagaggtctgtggcctgcaccaactgcaatggacctgcccacaacaacaagctgtttgcccctgtggccctggccagcggcccagatggctctgtgtatgtgggggacttcaactttgtgcggcgcatcttccccagcggcaacagcgtgtccatcctggagctgaggaacagagacaccaggcacagcaccagccctgcccacaagtactacctggccatggaccctgtgtctgagagcctgtacctgagtgacaccaacaccaggaaggtgtacaagctgaagagcctggtggagaccaaggacctgagcaagaactttgaggtggtggccggcactggagaccagtgcctgccctttgaccagagccactgtggagatggcggccgggccagcgaggccagcctgaacagcccccggggcatcaccgtggacagacatggcttcatctactttgtggatggcaccatgatcaggaagattgatgaaaatgctgtgatcaccaccgtgattggcagcaatggcctgaccagcacccagcccctgagctgtgacagcggcatggacatcacccaggtgcggctggagtggcccacagacctggccgtgaaccccatggacaacagcctgtatgtgctggacaacaacatcgtgctgcagatcagtgaaaatagaagagtgcgcatcatcgccggccggcccatccactgccaggtgcccggcatcgaccacttcctggtgtccaaggtggccatccacagcaccctggagagcgcccgggccatctctgtgagccacagcggcctgctcttcatcgccgagacagatgagaggaaggtgaaccgcatccagcaggtgaccaccaatggagagatctacatcatcgccggggcccccacagactgtgactgcaagattgaccccaactgtgactgcttctctggagatggcggctacgccaaggatgccaagatgaaggcccccagcagcctggccgtgtccccagatggcaccctgtatgtggccgacctgggcaatgtgcgcatccgcaccatcagcaggaaccaggcccacctgaatgacatgaacatctatgaaattgccagccctgctgaccaggagctgtaccagttcaccgtgaatggcacccacctgcacaccctgaacctgatcacccgggactatgtgtacaacttcacctacaacagcgagggggacctgggcgccatcaccagcagcaatggaaattctgtgcacatcagaagagatgctgggggcatgcccctgtggctggtggtgcctgggggccaggtgtactggctgaccatcagcagcaatggagtgctgaagagggtgtctgcccagggctacaacctggccctgatgacctacccaggcaacacaggcctgctggccaccaagagcaatgaaaatggctggaccaccgtgtatgaatatgaccctgagggccacctgaccaatgccaccttccccactggagaggtgagcagcttccacagcgacctggagaagctgaccaaggtggagctggacaccagcaacagagaaaatgtgctgatgagcaccaacctgacagccaccagcaccatctacatcctgaagcaggagaacacccagagcacctacagagtgaacccagatggcagcctgcgggtgacctttgccagcggcatggagatcggcctgagcagcgagccccacatcctggccggggctgtgaaccccaccctgggcaagtgcaacatcagcctgcccggggagcacaatgccaacctgattgagtggaggcagaggaaggagcagaacaagggaaatgtgtctgcctttgagcggcggctgcgggcccacaacagaaacctgctgagcattgactttgaccacatcaccaggacaggcaagatctatgatgaccacaggaagttcaccctgcgcatcctgtatgaccagacaggccggcccatcctgtggagccctgtgagccgctacaatgaggtgaacatcacctacagccccagcggcctggtgaccttcatccagaggggcacctggaatgagaagatggagtatgaccagagcggcaagatcatcagcaggacctgggcagatggcaagatctggagctacacctacctggagaagtctgtgatgctgctgctgcacagccagaggcgctacatctttgaatatgaccagcctgactgcctgctgtctgtgaccatgcccagcatggtgcgccacagcctgcagaccatgctgtctgtgggctactacagaaacatctacaccccaccagacagcagcaccagcttcatccaggactacagcagagatggccgcctgctgcagaccctgcacctgggcactggaagaagagtgctgtacaagtacaccaagcaggcccggctgtctgaggtgctgtatgacaccacccaggtgaccctgacctatgaggagagcagtggagtcatcaagaccatccacctgatgcatgatggcttcatctgcaccatccgctaccggcagacaggccccctgattggccggcagatcttccgcttcagcgaggagggcctggtgaatgccaggtttgactacagctacaacaacttccgggtgacctccatgcaggccgtcatcaatgagacccccctgcccatcgacctgtaccgctacgtggatgtgtctggccgcacagagcagtttgggaagttcagcgtcatcaactatgacctgaaccaggtgatcaccaccaccgtgatgaagcacaccaagatcttcagcgccaacggccaggtgattgaggtgcagtatgagatcctgaaggccatcgcctactggatgaccatccagtatgacaacgtgggccgcatggtgatctgtgacatccgggtgggcgtggatgccaacatcacccgctacttctatgaatatgatgctgatggccagctgcagacagtgtctgtgaatgacaagacccagtggagatacagctatgacctgaatggaaacatcaacctgctgagccacggcaagagcgcccggctgacccccctgcgctatgacctgcgggaccgcatcacccggctgggggagatccagtacaagatggatgaagatggcttcctgcggcagagaggaaatgacatctttgagtacaacagcaatggcctgctgcagaaggcctacaacaaggccagcggctggacagtgcagtactactatgatggcctgggccggcgggtggccagcaagagcagcctgggccagcacctgcagttcttctatgctgacctgaccaaccccatccgggtgacccacctgtacaaccacaccagcagcgagatcaccagcctgtactatgacctgcagggccacctgattgccatggagctgagcagcggggaggagtactacgtggcctgtgacaacacaggcacccccctggccgtgttcagcagccggggccaggtgatcaaggagatcctgtacaccccctatggagacatctaccatgacacctacccagacttccaggtgatcatcggcttccatggaggcctgtatgacttcctgaccaagctggtgcacctgggccagagggactatgatgtggtggccggccgctggaccacccccaaccaccacatctggaagcagctgaacctgctgcccaagcccttcaacctgtacagctttgagaacaactaccctgtgggcaagatccaggatgtggccaagtacaccacagacatccgctcctggctggagctgtttggcttccagctgcacaacgtgctgcccggcttccccaagccagagctggagaacctggagctgacctatgagctgctgcggctgcagaccaagacccaggagtgggaccccgggaagaccatcctgggcatccagtgtgagctgcagaagcagctgaggaacttcatcagcctggaccagctgcccatgaccccccgctacaatgatggccgctgcctggagggcggcaagcagcccaggtttgctgctgtgcccagcgtgtttgggaagggcatcaagtttgccatcaaggatggcatcgtgacagctgacatcattggagtggccaatgaagacagccggcggctggccgccatcctgaacaatgcccactacctggagaacctgcacttcaccatcgagggccgggacacccactacttcatcaagctgggcagcctggaggaggacctggtgctgattggcaacacaggaggaagacgcatcctggagaatggagtgaatgtgacagtgtcccagatgacctctgtgctgaatggccgcaccaggagatttgctgacatccagctgcagcacggggccctgtgcttcaacatccgctatggcaccaccgtggaggaggagaagaaccacgtgctggagatcgcccggcagagagctgtggcccaggcctggaccaaggagcagaggcggctgcaggagggggaggagggcatccgggcctggacagaaggagagaagcagcagctgctgagcacaggccgggtgcagggctatgatggctactttgtgctgtctgtggagcagtacctggagctgagtgacagcgccaacaacatccacttcatgaggcagagcgagattggaagaagatag

SEQ ID NO: 7881 - DNA, 264 bp, Artificial Sequence
  Description of Artificial Sequence: Synthetic coding sequence
atgaaggtgctgctgctgaccggcctgggcgccctcttctttgcctactactgggatgacaactttgatcctgccagcctgcagggcgcccgggtgctgctgactggagccaatgccggcgtgggggaggagctggcctaccactacgcccggctgggcagccacctggtgctgacagcccacacagaggccctgctgcagaaggcccgctggctgaccctggtggtgtccaccctgggcggccggggcaagtggatcacctag

SEQ ID NO: 7882 - DNA, 1233 bp, Artificial Sequence
  Description of Artificial Sequence: Synthetic coding sequence
atgagggcctgcatcagcctggtgctggccgtgctgtgtggcctggcctgggccggcaagattgagagctgtgccagccgctgcaatgagaagttcaacagagatgctgcctgccagtgtgaccggcgctgcctgtggcacggcaactgctgtgaggactatgagcacctgtgcacagaggaccacaaggagagcgagcccctgccccagctggaggaggagacagaggaggccctggccagcaacctgtacagcgcccccaccagctgccagggccgctgctatgaggcctttgacaagcaccaccagtgccactgcaatgcccgctgccaggagtttggaaactgctgcaaggactttgagagcctgtgcagcgaccacgaggtgagccacagcagtgatgccatcaccaaggaggagatccagagcatcagcgagaagatctacagagctgacaccaacaaggcccagaaggaggacatcgtgctgaacagccagaactgcatcagccccagcgagaccaggaaccaggtggaccgctgccccaagcccctcttcacctacgtgaatgagaagctgttcagcaagcccacctacgccgccttcatcaacctgctgaacaactaccagagggccactggacatggagagcacttcagcgcccaggagctggccgagcaggatgccttcctgcgggagatcatgaagacagctgtgatgaaggagctgtacagcttcctgcaccaccagaacagatatggcagcgagcaggagtttgtggatgacctgaagaacatgtggtttggcctgtacagcagaggaaatgaggagggggacagcagcggctttgaacatgtgttcagcggggaggtgaagaagggcaaggtgacaggcttccacaactggatccgcttctacctggaggagaaggagggcctggtggactactacagccacatctatgatggcccctgggacagctacccagatgtgctggccatgcagttcaactgggatggctactacaaggaggtgggcagcgccttcatcggcagcagccctgagtttgaatttgccctgtacagcctgtgcttcatcgcccggcctgggaaggtgtgccagctgagcctgggcggctaccccctggccgtgaggacctacacctgggacaagagcacctatggaaatggcaagaagtacatcgccacagcctacatcgtgagcagcacctag

SEQ ID NO: 7883 - DNA, 351 bp, Artificial Sequence; identical to SEQ ID NO: 7504
  Description of Artificial Sequence: Synthetic coding sequence

SEQ ID NO: 7884 - DNA, 1200 bp, Artificial Sequence
  Description of Artificial Sequence: Synthetic coding sequence
atgtctgcccggggccgctgggagggcggcggccggcgggcctgccggggcagcctgggcctggcccgggcccagggcgctgagcgggtgaccagcagcgagcagaggcctgccatggccagcctgggcctgctgctgctgctgctgctgacagccctgccccccctgtggagcagcagcctgcccggcctggacacagctgagagcaaggccaccatcgctgacctgatcctgagcgccctggagcgggccaccgtcttcctggagcagaggctgcctgagatcaacctggatggcatggtgggcgtgcgggtgctggaggagcagctgaagtctgtgcgggagaagtgggcccaggagcccctgctgcagcccctgagcctgcgggtgggcatgctgggggagaagctggaggccgccatccagaggagcctgcactacctgaagctgagtgaccccaagtacctgcgggagttccagctgaccctgcagcccggcttctggaagctgccccacgcctggatccacacagatgccagcctggtgtaccccaccttcggcccccaggacagcttcagcgaggagaggagtgatgtgtgcctggtgcagctgctgggcactggaacagacagcagcgagccctgtggcctgagtgacctgtgccgcagcctgatgaccaagccaggctgcagcggctactgcctgagccaccagctgctcttcttcctgtgggccaggatgaggggctgcacccagggccccctgcagcagagccaggactacatcaacctcttctgtgccaacatgatggacctgaacagaagagctgaggccatcggctacgcctaccccacccgggacatcttcatggagaacatcatgttctgtggcatgggcggcttcagtgacttctacaagctgcgctggctggaggccatcctgtcctggcagaagcagcaggagggctgcttcggggagccagatgctgaagatgaggagctgagcaaggccatccagtaccagcagcacttcagccggcgggtgaagaggcgggagaagcagttcccagatggctgcagcagccacaacacagccacagctgtggccgccctgggcggcttcctgtacatcctggccgagtaccccccagccaaccgggagccccaccccagcaccccacctccacccagcagcaggtag

SEQ ID NO: 7885 - DNA, 510 bp, Artificial Sequence
  Description of Artificial Sequence: Synthetic coding sequence
atgctgagctctgtggtgttctggggcctgattgccctgattggcaccagccggggcagctaccccttcagccacagcatgaagccccacctgcacccccggctgtaccacggctgctacggggacatcatgaccatgaagaccagcggggccacctgtgatgccaacagcgtgatgaactgtggcatccggggcagcgagatgtttgctgagatggacctgcgggccatcaagccctaccagaccctcatcaaggaggtgggccagaggcactgtgtggaccctgctgtgattgctgccatcatcagccgggagagccatggaggctctgtgctgcaggacggctgggaccaccggggcctgaagtttggcctgatgcagctggacaagcagacctaccaccctgtgggcgcctgggacagcaaggagcacctgagccaggccaccggcatcctgacagagcgcatcaaggccatccagaagaagttccccacctggagcgtggcctag

SEQ ID NO: 7886 - DNA, 300 bp, Artificial Sequence
  Description of Artificial Sequence: Synthetic coding sequence
atggagcgcatcagcgccttcttcagcagcatctgggacaccatcctgaccaagcaccaggagggcatctacaacaccatctgcctgggcgtgctgctgggcctgcccctgctggtgatcatcaccctgctcttcatctgctgccactgctgctggagccccccaggcaagaggggccagcagcctgagaagaacaagaagaagaagaagaagaagaagaagaaggatgaggaggacctgtggatcagcgcccagcccaagctgctgcagatggagaagaggcccagcctgcctgtgtag

SEQ ID NO: 7887 - DNA, 468 bp, Artificial Sequence
  Description of Artificial Sequence: Synthetic coding sequence
atgaccagcctgaagtgtggggagaacctgtacatgagcagcgccagcagctcctggagccaggccatccagagctggtttgatgagtacaatgactttgattttggagtgggccccaagaccccaaatgctgtggtgggccactacacccaggtggtgtggtacagcagctacctggtgggctgtggaaatgcctactgccccaaccagaaggtgctgaagtactactacgtgtgccagtactgcccagctggcaactgggccaaccggctgtatgtgccctatgagcagggcgccccctgtgccagctgcccagacaactgtgatgatggcctgtgcaccaacggctgcaagtatgaggacctgtacagcaactgcaagagcctgaagctgaccctgacctgcaagcaccagctggtgcgggacagctgcaaggccagctgcaactgcagcaacagcatctactag

SEQ ID NO: 7888 - DNA, 2886 bp, Artificial Sequence; identical to SEQ ID NO: 7526
  Description of Artificial Sequence: Synthetic coding sequence

SEQ ID NO: 7889 - DNA, 444 bp, Artificial Sequence
  Description of Artificial Sequence: Synthetic coding sequence
atggccggcccctggaccttcaccctgctgtgtggcctgctggccgccaccctcatccaggccaccctgagccccacagctgtgctgatcctgggccccaaggtgatcaaggagaagctgacccaggagctgaaggaccacaatgccaccagcatcctgcagcagctgcccctgctgagcgccatgagggagaagccagctgggggcatccctgtgctgggcagcctggtgaacacagtgctgaagcacatcatctggctgaaggtgatcacagccaacatcctgcagctgcaggtgaagcccagcgccaatgaccaggagctgctggtgaagatccccctggacatggtggccggcttcaacacccccctggtgaagaccatcgtggagttccacatgaccacagaggcccaggccaccatccgcatggacaccagcgcctag

SEQ ID NO: 7890 - DNA, 948 bp, Artificial Sequence
  Description of Artificial Sequence: Synthetic coding sequence
atgaaggtgctgctgctgaccggcctgggcgccctcttctttgcctactactgggatgacaactttgatcctgccagcctgcagggcgcccgggtgctgctgactggagccaatgccggcgtgggggaggagctggcctaccactacgcccggctgggcagccacctggtgctgacagcccacacagaggccctgctgcagaaggtggtgggcaactgcaggaagctgggcgcccccaaggtgttctacatcgctgctgacatggccagccctgaggcccctgagagcgtggtgcagtttgccctggacaagctgggcggcctggactacctggtgctgaaccacatcggcggggccccagctggcacccgggcccggagcccccaggccacccgctggctgatgcaggtgaactttgtgtcctatgtgcagctgaccagccgggccctgcccagcctgacagacagcaagggcagcctggtggtggtgagcagcctgctgggccgggtgcccaccagcttcagcaccccctacagcgctgccaagtttgccctggatggcttcttcggcagcctgcggcgggagctggatgtgcaggatgtgaatgtggccatcaccatgtgtgtgctgggcctgcgggaccgggccagcgctgctgaggccgtgcgcagcagcaccagccggccccggcagcctgagcaccggggcgtgcccctgcagagccagacagccatgttcctgccccccaccgtgcctggggcccggaccctgacagagacccccctgcggggctggccccagcccaagatgaagagcagccggcagaagagcaagacagagaagaatgatggccacctggagcctgtgacagcctgggaggtgcaggtgccccgggtgcggcggctgtgccggggcctggcccggccccacctgtttggacatgactag

SEQ ID NO: 7891 - DNA, 285 bp, Artificial Sequence; identical to SEQ ID NO: 7145
  Description of Artificial Sequence: Synthetic coding sequence

SEQ ID NO: 7892 - DNA, 783 bp, Artificial Sequence
  Description of Artificial Sequence: Synthetic coding sequence
atggagaagttcaacaccatctctgtgtccaagtgcaacaaggagaccgtggccatgaaggagaagtgcaagtttggcatgaccagcaccatccccagcggccacgtgtggaggaacacctggaaccctgtgtcctgcagcctggccaccgtgaagatgaaggaatgtctgcggggcaagctgatctacctgatgggagacagcaccatccggcagtggatggagtacttcaaggccagcatcaacaccctgaagtctgtggacctgcacgagagcggcaagctgcagcaccagctggccgtggacctggacaggaacatcaacatccagtggcagaagtactgctaccccctgattggctccatgacctacagcgtgaaggagatggagtacctgacccgggccatcgacagaactggaggagagaagaacacagtgattgtcatcagcctgggccagcacttccggcccttccccattgatgtgttcatcagaagagccctgaatgtgcacaaggccatccagcacctgctgctgcggagcccagacaccatggtgatcatcaagacagagaacatccgggagatgtacaatgatgctgagcgcttcagtgacttccacggctacatccagtacctgatcatcaaggacatcttccaggacctgtctgtgtccatcattgatgcctgggacatcaccatcgcctacggcaccaacaacgtgcaccccccccagcacgtggtgggcaaccagatcaacatcctgctgaactacatctgctag

SEQ ID NO: 7893 - DNA, 1644 bp, Artificial Sequence
  Description of Artificial Sequence: Synthetic coding sequence
atgagcagcaacaccatgctgcagaagaccctgctgatcctgatctccttctctgtggtgacctggatgatcttcatcatcagccagaacttcaccaagctgtggagcgccctgaacctgagcatctctgtgcactactggaacaacagcgccaagagcctcttccccaagaccagcctcatccccctgaagcccctgacagaaacagagctgcgcatcaaggagatcatcgagaagctggaccagcagatccccccccggcccttcacccacgtgaacaccaccaccagcgccacccacagcacagccaccatcctgaacccccgggacacctactgccgcggggaccagctggacatcctgctggaggtgcgggaccacctgggccagaggaagcagtatggaggagacttcctgcgggccaggatgagcagccctgccctgacagctggggccagcggcaaggtgatggacttcaacaacggcacctacctggtgtccttcaccctcttctgggagggccaggtgtccctgagcctgctgctgatccaccccagcgagggcgccagcgccctgtggagggccaggaaccagggctatgacaagatcatcttcaagggcaagtttgtgaatggcaccagccacgtgttcacagaatgtggcctgaccctgaacagcaatgctgagctgtgtgagtacctggatgaccgggaccaggaggccttctactgcatgaagccccagcacatgccctgtgaggccctgacctacatgaccaccaggaaccgggaggtgtcctacctgacagacaaggagaacagcctcttccacaggagcaaggtgggcgtggagatgatgaaggacaggaagcacattgatgtgaccaactgcaacaagcgggagaagattgaggagacctgccaggtgggcatgaagccccctgtgcctgggggctacaccctgcagggcaagtggatcaccaccttctgcaaccaggtgcagctggacaccatcaagatcaatggctgcctgaagggcaagctgatctacctgctgggggacagcaccctgcggcagtggatctactacttccccaaggtggtgaagaccctgaagttctttgacctgcatgaaacaggcatcttcaagaagcacctgctgctggatgctgagcggcacacccagatccagtggaagaagcacagctacccctttgtgaccttccagctgtacagcctgattgaccatgactacatcccccgggagattgaccggctgagcggggacaagaacacagccatcgtcatcaccttcggccagcacttccggcccttccccatcgacatcttcatccggcgggccatcggcgtgcagaaggccatcgagcggctcttcctgcggagccctgccaccaaggtgatcatcaagacagagaacatccgggagatgcacattgaaacagaaagatttggagacttccacggctacatccactacctgatcatgaaggacatcttcaaggacctgaatgtgggcatcattgatgcctgggacatgaccatcgcctatggaacagacaccatccaccccccagaccacgtgattggcaaccagatcaacatgttcctgaactacatctgctag

SEQ ID NO: 7894 - DNA, 399 bp, Artificial Sequence
  Description of Artificial Sequence: Synthetic coding sequence
atgctgatgctgtttgtgtttggagtgctgctgcacgaggtgtccctgagcggccagaatgaggccccacccaacacccacagcatccctggagagcccctgtacaactatgccagcatccggctgcctgaggagcacatccccttcttcctgcacaacaacagacacatcgccaccgtgtgcaggaaggacagcctgtgcccctacaagaagcacctggagaagctgaagtactgctggggctatgagaagagctgcaagccagagttccgcttcggctaccctgtgtgcagctatgtggacatgggctggacagacaccctggagagcgctgaggacatcttctggaagcaggccgactttggctacgcccgggagcggctggaggagatgcactag

SEQ ID NO: 7895 - DNA, 861 bp, Artificial Sequence
  Description of Artificial Sequence: Synthetic coding sequence
atgggcagcgccctgtttgtgaagaaggagctgcagctgcaggccaacttcctgggcaatgtgaagaggctgtatgaagctgaggtgttcagcacagacttcagcaaccccagcatcgcccaggcccgcatcaacagccacgtgaagaagaagacccagggcaaggtggtggacatcatccagggcctggacctgctgacagccatggtgctggtgaaccacatcttcttcaaggccaagtgggagaagcccttccaccctgagtacaccaggaagaacttccccttcctggtgggggagcaggtgacagtgcacgtgcccatgatgcaccagaaggagcagtttgcctttggagtggacacagagctgaactgctttgtgctgcagatggactacaagggagatgctgtggccttctttgtgctgcccagcaagggcaagatgaggcagctggagcaggccctgagcgcccggaccctgaggaagtggagccacagcctgcagaagcgctggattgaggtgttcatcccccgcttcagcatcagcgccagctacaacctggagaccatcctgcccaagatgggcatccagaatgtgtttgacaagaatgctgacttctctggaattgccaagagggacagcctgcaggtgtccaaggccacccacaaggctgtgctggatgtgtctgaggagggcacagaggccacagctgccaccaccaccaagttcatcgtgcgcagcaaggatggccccagctacttcaccgtgtccttcaacagaaccttcctgatgatgatcaccaacaaggccacagatggcatcctcttcctgggcaaggtggagaaccccaccaagagctag

SEQ ID NO: 7896 - DNA, 60 bp, Artificial Sequence
  Description of Artificial Sequence: Synthetic coding sequence
atgggctggctgaccagaattgtgtgcctcttctggggcgtgctgctgacagccaggtag

SEQ ID NO: 7897 - DNA, 1197 bp, Artificial Sequence
  Description of Artificial Sequence: Synthetic coding sequence
atgaagttccagggccccctggcctgcctgctgctggccctgtgcctgggcagcggggaggccggccccctgcagagcggggaggagagcacaggcaccaacattggagaggccctgggccacggcctgggagatgccctgtctgagggcgtgggcaaggccatcggcaaggaggccggcggcgctgctggcagcaaggtgtctgaggccctgggccagggcacccgggaggccgtgggcactggagtgcggcaggtgcccggctttggagtggctgatgccctgggcaacagagtgggggaggccgcccacgccctgggcaacacaggccatgaaattggccggcaggccgaggatgtgatcagacatggagcagatgctgtgcggggctcctggcagggcgtgcccggccacaatggagcctgggagaccagcggcggccacggcatcttcggcagccagggcggcctgggcggccagggccagggcaaccctgggggcctgggcaccccctgggtgcacggctacccaggcaacagcgctggcagctttggcatgaacccccagggcgccccctggggccagggcggcaatggaggcccccccaactttggcaccaacacccagggcgctgtggcccagcccggctacggctctgtgcgggccagcaaccagaatgaaggctgcaccaaccccccaccttctggcagcggcggcggcagcagcaacagcggcggcggcagcggcagccagagcggcagcagcggcagcggcagcaatggagacaacaacaacggcagcagcagcggcggcagcagcagcggcagcagcagcggcggcagcagcggcggcagcagcggcggcagcagcggcaacagcggcggcagcagaggagacagcggcagcgagagctcctggggcagcagcacaggcagcagcagcggcaaccacggcggcagcggcggcggcaatggccacaagccaggctgtgagaagccaggaaatgaggcccggggcagcggggagagcggcatccagggcttccggggccagggcgtgagcagcaacatgaggaacagcgagaccagccctggcatgttcaactttgacaccttctggaagaacttcaagagcaagctgggcttcatcaactgggatgccatcaacaaggaccagaggagcagccgcatcccctag

SEQ ID NO: 7898 - DNA, 81 bp, Artificial Sequence
  Description of Artificial Sequence: Synthetic coding sequence
atggcccccaagaagctgagctgcctgcggagcctgctgctgcccctgagcctgaccctgctgctgccccaggccgactag

SEQ ID NO: 7899 - DNA, 696 bp, Artificial Sequence
  Description of Artificial Sequence: Synthetic coding sequence
atggcccagctgttcctgcccctgctggccgccctggtgctggcccaggccccagctgccctggctgatgtgctggagggggacagcagcggcatctaccgctgtgaggtgcagcacggcattgatgacagcagtgatgctgtggaggtgaaggtgaagggcgtggtgttcctgtaccgggagggcagcgcccgctatgccttctccttcagcggggcccaggaggcctgtgcccgcatcggggcccacatcgccaccccagagcagctgtatgctgcctacctgggcggctatgagcagtgtgatgctggctggctgagtgaccagacagtgcgctaccccatccagaccccccgggaggcctgctatggagacatggatggcttccctggggtgagaaattatggagtggtggaccctgatgacctgtatgatgtgtactgctacgccgaggacctgaatggagagctgttcctgggggaccccccagagaagctgaccctggaggaggcccgggcctactgccaggagagaggagctgagatcgccaccaccggccagctgtatgctgcctgggatggcggcctggaccactgcagccctggctggctggctgatggctctgtgcgctaccccatcgtgacccccagccagagatgtggcggcggcctgcccggggtgaagaccctcttctag

SEQ ID NO: 7900 - DNA, 600 bp, Artificial Sequence
  Description of Artificial Sequence: Synthetic coding sequence
atggatgagctgctgcccctcatccctgtgctggagcagtacaagacagatgccaagctgatcacccagttcaaggaggagatccggaacctgtctgctgtgctgaccggcatccaggaggagatcggggcctatgactatgaggagctgcaccagagggtgctgagcctggagacccggctgcgggactgcatgaagaagctgacctgtgggaagctgatgaagatcactggacctgtgacagtgaagaccagcggcaccaggtttggagcctggatgacagaccccctggccagcgagaagaacaacagagtgtggtacatggacagctacaccaacaacaagatcgtgcgggagtacaagagcattgctgactttgtgtctggagctgagagcaggacctacaacctgcccttcaagtgggccggcaccaaccacgtggtgtacaacggcagcctgtacttcaacaagtaccagagcaacatcatcatcaagtacagctttgacatgggccgggtgctggcccagaggagcctggagtatgccggcttccacaacgtgacccccacccatggagtggacagcctgaccagcacctag

SEQ ID NO: 7901 - DNA, 609 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaggccggggccgccccctacgtgcaggcctttgacagcctgctggccggccctgtggccgagtacctgaagatcagcaaggagattggaggagatgtgcagaagcatgctgagatggtgcacacaggcctgaagctggagcgggccctgctggtgacagccagccagtgccagcagcctgctgagaacaagctgagtgacctgctggcccccatcagcgagcagatcaaggaggtgatcaccttccgggagaagaacagaggcagcaagctgttcaaccacctgtctgctgtgtctgagagcatccaggccctgggctgggtggccatggcccccaagccaggcccctacgtgaaggagatgaatgatgctgccatgttctacaccaacagagtgctgaaggagtacaaggatgtggacaagaagcacgtggactgggtgaaggcctacctgagcatctggacagagctgcaggcctacatcaaggagttccacacctag

SEQ ID NO: 7902 - DNA, 2886 bp, Artificial Sequence; identical to SEQ ID NO: 7526
  Description of Artificial Sequence: Synthetic coding sequence

SEQ ID NO: 7903 - DNA, 351 bp, Artificial Sequence; identical to SEQ ID NO: 7504
  Description of Artificial Sequence: Synthetic coding sequence

SEQ ID NO: 7904 - DNA, 2334 bp, Artificial Sequence
  Description of Artificial Sequence: Synthetic coding sequence
atggctgctgctggcctggtggccgtggccgctgctgctgagtacagcggcaccgtggccagcggcggcaacctgcccggggtgcactgcggccccagcagcggggccggccctggcttcggccctggctcctggagccgcagcctggaccgggccctggaggaggccgctgtgactggagtgctgagcctgagcggcaggaagctgcgggagttccccaggggggccgccaaccacgacctgacagacaccaccagggctgacctgagcaggaaccggctgtctgagatccccatcgaggcctgccactttgtgtccctggagaacctgaacctgtaccagaactgcatccgctacatccctgaggccatcctgaacctgcaggccctgaccttcctgaacatcagcaggaaccagctgagcaccctgcctgtgcacctgtgcaacctgcccctgaaggtgctgattgccagcaacaacaagctggtgtccctgcctgaggagatcggccacctgcggcacctgatggagctggatgtgtcctgcaatgagatccagaccatccccagccagatcggcaacctggaggccctgcgggacctgaatgtgagaagaaaccacctggtgcacctgcctgaggagctggccgagctgcccctcatccggctggacttcagctgcaacaagatcaccaccatccctgtgtgctacagaaacctgcggcacctgcagaccatcaccctggacaacaaccccctgcagagccccccagcccagatctgcatcaagggcaaggtgcacatcttcaagtacctgaacatccaggcctgcaagatcgccccagacctgcctgactatgaccggcggcccctgggcttcggcagctgccacgaggagctgtacagcagccggccctacggggccctggacagcggcttcaacagcgtggacagcggggacaagcgctggagcggaaatgagcccacagatgagttcagtgacctgcccctgcgggtggccgagatcaccaaggagcagaggctgcggcgggagagccagtaccaggagaacagaggcagcctggtggtgaccaatggaggagtggagcatgacctggaccagattgactacatcgacagctgcacagctgaggaggaggaggccgaggtgcggcagcccaagggccctgaccctgacagcctgagcagccagttcatggcctacatcgagcagaggcgcatcagccatgagggcagccctgtgaagcctgtggccatccgggagttccagaagacagaggacatgaggcgctacctgcaccagaacagagtgcctgctgagcccagcagcctgctgagcctgagcgccagccacaaccagctgagccacacagacctggagctgcaccagaggcgggagcagctggtggagaggacccggcgggaggcccagctggccgccctgcagtatgaggaggagaagatccgcaccaagcagatccagagagatgctgtgctggactttgtgaagcagaaggccagccagagcccccagaagcagcaccccctgctggatggagtggatggagagtgccccttccccagccgccgcagccagcacacagatgacagcgccctgtgcatgagcctgagcggcctgaaccaggtgggctgtgccgccaccctgccccacagcagcgccttcacccccctgaagagtgatgaccggcccaatgccctgctgagcagccctgccacagagaccgtgcaccacagccctgcctacagcttccctgctgccatccagaggaaccagccccagaggcctgagagcttcctgttccgggccggcgtgcgggcagagaccaacaagggccacgccagccccctgcccccatctgctgcccccaccacagacagcacagacagcatcaccggccagaacagccggcagcgggaggaggagctggagctgattgaccagctgaggaagcacatcgagtaccgcctgaaggtgtccctgccctgtgacctgggcgccgccctgacagatggagtggtgctgtgccacctggccaaccacgtgcggcccaggtctgtgcccagcatccacgtgcccagccctgctgtgcccaagctgaccatggccaagtgcagaagaaatgtggagaacttcctggaggcctgcaggaagattggagtgccccaggagcagctgtgcctgcccctgcacatcctggaggagaagggcctgagccaggtggccgtgacagtgcaggccctgctggagctggccccacccaagcagcagcagcaccagctgtctgctgtgtag

SEQ ID NO: 7905 - DNA, 834 bp, Artificial Sequence
  Description of Artificial Sequence: Synthetic coding sequence
atgctgcaccctgagaccagccctggccggggccacctgctggccgtgctgctggccctgctgggcaccacctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctgctggtgtgggccaccagcagccagctgggctgcggccgccacctgtgcagcgctggccagacagccatcgaggcctttgtgtgtgcctacagccctgggggcaactgggaggtgaatggcaagaccatcatcccctacaagaagggggcctggtgcagcctgtgcacagcctctgtgtctggctgcttcaaggcctgggaccatgctgggggcctgtgtgaggtgcccaggaacccctgcaggatgagctgccagaaccacggccgcctgaacatcagcacctgccactgccactgccccccaggctacacaggccgctactgccagggccacctgcccaacagcaacatgccccacagcgccatgggcaccaagcccaagaccccaggagtgcctgccatcggcagcctggtgcgctgcagcctgcagtgtgtgcacggccgcttccgggaggaggagtgcagctgtgtgtgtgacatcggctacggcggggcccagtgtgccagcgagagctgcccccgggcccccaaggagcccgcccccctgaagacccccctgcagtggggcatcagcagccaggagcctgctgtgtgcctgtccttccagctgatccagtag

SEQ ID NO: 7906 - DNA, 456 bp, Artificial Sequence
  Description of Artificial Sequence: Synthetic coding sequence
atgtctgacctgctgctgctgggcctcatcggcggcctgaccctgctgctgctgctgaccctgctggcctttgctggctacagcggcctgctggccggcgtggaggtgtctgctggcagcccccccatcagaaatgtgacagtggcctacaagttccacatgggcctgtatggagagaccggccgcctcttcacagagagctgcagcatcagccccaagctgcggagcattgctgtgtactatgacaacccccacatggtgcccccagacaagtgccgctgtgctgtgggcagcatcctgtctgagggggaggagagccccagccctgagctgattgacctgtaccagaagtttggcttcaaggtgttctccttccctgcccccagccacgtggtgacagccaccttcccctacaccaccatcctgagcatctggctggccaccaggagagtgtag

SEQ ID NO: 7907 - DNA, 390 bp, Artificial Sequence; identical to SEQ ID NO: 7503
  Description of Artificial Sequence: Synthetic coding sequence

SEQ ID NO: 7908 - DNA, 390 bp, Artificial Sequence; identical to SEQ ID NO: 7503
  Description of Artificial Sequence: Synthetic coding sequence

SEQ ID NO: 7909 - DNA, 891 bp, Artificial Sequence
  Description of Artificial Sequence: Synthetic coding sequence
atggaggccctgctgctgggcgccggcctgctgctgggcgcctacgtgctggtgtactacaacctggtgaaggccccaccctgtggcggcatgggcaacctgcggggccgcacagctgtggtgacaggcatcagcagctgtggccgcacccgggaggccttcaacctgctgctgcgggtgaaccacatcggccccttcctgctgacccacctgctgctgccctgcctgaaggcctgtgcccccagccgggtggtggtggtggccagcgctgcccactgccggggccgcctggacttcaagaggctggacaggcctgtggtgggctggaggcaggagctgcgggcctatgctgacaccaagctggccaacgtgctgtttgcccgggagctggccaaccagctggaggccactggagtgacctgctatgctgcccaccctggccctgtgaacagcgagctgttcctgcggcacgtgcccggctggctgcggcccctgctgcggcccctggcctggctggtgctgcgggccccccggggcggggcccagacccccctgtactgtgccctgcaggagggcatcgagcccctgagcggccgctactttgccaactgccacgtggaggaggtgcccccagctgccagagatgaccgggccgcccaccggctgtgggaggccagcaagaggctggccggcctgggccctggagaagatgctgagccagatgaggacccccagagtgaagattctgaggcccccagcagcctgagcaccccccaccctgaggagcccaccgtgtcccagccctaccccagcccccagagcagcccagacctgagcaagatgacccaccgcatccaggccaaggtggagcctgagatccagctgtcctag

SEQ ID NO: 7910 - DNA, 567 bp, Artificial Sequence; identical to SEQ ID NO: 7502
  Description of Artificial Sequence: Synthetic coding sequence

SEQ ID NO: 7911 - DNA, 978 bp, Artificial Sequence; identical to SEQ ID NO: 6924
  Description of Artificial Sequence: Synthetic coding sequence

SEQ ID NO: 7912 - DNA, 2631 bp, Artificial Sequence; identical to SEQ ID NO: 6925
  Description of Artificial Sequence: Synthetic coding sequence

SEQ ID NO: 7913 - DNA, 1482 bp, Artificial Sequence
  Description of Artificial Sequence: Synthetic coding sequence
atggccctgctggccggcggcctgagccggggcctgggcagccaccctgctgctgctggaagagatgctgtggtgtttgtgtggctgctgctgagcacctggtgcacagccccagcccgggccatccaggtgacagtgagcaacccctaccacgtggtgatcctcttccagcctgtgaccctgccctgcacctaccagatgaccagcacccccacccagcccatcgtcatctggaagtacaagagcttctgccgggacagaattgctgatgccttcagccctgcctctgtggacaaccagctgaatgcccagctggccgccggcaaccctggctacaacccctacgtggagtgccaggacagcgtgaggacagtgcgggtggtggccaccaagcagggcaatgctgtgaccctgggggactactaccagggccgccgcatcaccatcaccggcatgtatgctgctgggaaggccgccaccagcggcgtgcccagcatctatgcccccagcacctacgcccacctgagccctgccaagaccccacctcctccagccatgatccccatgggccctgcctacaacggctacccaggcggctacccaggagatgtggacaggagcagcagcgctgggggccagggcagctatgtgcccctgctgcgggacacagacagctctgtggccagcgaggtgcgcagcggctaccgcatccaggccagccagcaggatgacagcatgagggtgctgtactacatggagaaggagctggccaactttgaccccagccggcccggcccccccagcggccgggtggagcgggccatgtctgaggtgaccagcctgcatgaagatgactggaggagccggcccagccggggccctgccctgacccccatcagagatgaggagtggggcggccacagccccaggagcccccggggctgggaccaggagcccgcccgggagcaggccggcggcggctggagggcccggcggccccgggcccggtctgtggatgccctggatgacctgaccccacccagcacagctgagagcggcagccgcagccccaccagcaatggaggccgcagccgggcctacatgccacccaggagccgcagcagagatgacctgtatgaccaggatgacagccgggacttccccaggagccgggacccccactatgatgacttccgcagccgggagcggcccccagctgaccccaggagccaccaccacaggacccgggacccccgggacaatggcagccgcagcggggacctgccctatgatggccgcctgctggaggaggccgtgaggaagaagggcagcgaggagcggcggcggccccacaaggaggaggaggaggaggcctactaccccccagcccccccaccctacagcgagacagacagccaggccagccgggagcggcggctgaagaagaacctggccctgagccgggagagcctggtggtgtag

SEQ ID NO: 7914 - DNA, 1788 bp, Artificial Sequence
  Description of Artificial Sequence: Synthetic coding sequence
atggacttcctgctggccctggtgctggtgagcagcctgtacctgcaggccgctgctgagtttgatggccgctggccccggcagatcgtgagcagcatcggcctgtgccgctatggaggaagaattgactgctgctggggctgggcccggcagagctggggccagtgccagcctgtgtgccagccccgctgcaagcacggggagtgcatcggccccaacaagtgcaagtgccaccctggctacgccggcaagacctgcaaccaggatgagcacatcccagcccccctggaccagggcagcgagcagcccctcttccagcccctggaccaccaggccaccagcctgcccagccgggacctgaatgaatgtggcctgaagccccggccctgcaagcaccgctgcatgaacacctacggcagctacaagtgctactgcctgaatggctacatgctgatgccagatggcagctgcagcagcgccctgacctgcagcatggccaactgccagtatggctgtgatgtggtgaagggccagatccgctgccagtgccccagccctggcctgcagctggccccagatggccgcacctgtgtggatgtggatgaatgtgccaccggccgggccagctgcccccgcttccggcagtgtgtgaacaccttcggcagctacatctgcaagtgccacaagggctttgacctgatgtacatcggcggcaagtaccagtgccacgacattgatgaatgttccctgggccagtaccagtgcagcagctttgcccgctgctacaacatccggggcagctacaagtgcaagtgcaaggagggctaccagggagatggcctgacctgtgtgtacatccccaaggtgatgattgagcccagcggccccatccacgtgcccaagggaaatggcaccatcctgaagggggacaccggcaacaacaactggatcccagatgtgggcagcacctggtggccacccaagaccccctacatcccccccatcatcaccaaccggcccaccagcaagcccaccacccggcccacccccaagcccacccccatccccaccccacctcctcctccacccctgcccacagagctgcggacccccctgccccccaccaccccagagcggcccaccaccggcctgaccaccatcgccccagctgccagcaccccacctgggggcatcaccgtggacaacagagtgcagacagacccccagaagcccagaggagatgtgttcatcccccggcagcccagcaatgacctgtttgagatctttgaaattgagcggggcgtgtctgcagatgatgaggccaaggatgatcctggggtgctggtgcacagctgcaactttgaccacggcctgtgtggctggatccgggagaaggacaatgacctgcactgggagcccatccgggaccctgctgggggccagtacctgactgtgtctgctgccaaggcccctgggggcaaggccgcccggctggtgctgcccctgggccgcctgatgcacagcggggacctgtgcctgtccttccgccacaaggtgacaggcctgcacagcggcaccctgcaggtgtttgtgaggaagcacggggcccatggagctgccctgtggggcagaaatggaggccacggctggaggcagacccagatcaccctgcggggagctgacatcaagtctgtggtgttcaagggggagaagaggcggggccacactggagaaattggcctggatgatgtgtccctgaagaagggccactgcagcgaggagaggtag

SEQ ID NO: 7915 - DNA, 210 bp, Artificial Sequence
  Description of Artificial Sequence: Synthetic coding sequence
atgaagaaccaggacaagaagaatggagctgccaagcagagcaaccccaagagcagccctggccagcctgaggccggcagctttgacagcctggacctggagaaggtgtccctgggccgggccctggccggccgctctgagctgggcatcagctgcctggagcagggcacctggaggatgttcctgcggggcatgatgtgctggagctag

SEQ ID NO: 7916 - DNA, 483 bp, Artificial Sequence
  Description of Artificial Sequence: Synthetic coding sequence
atggcccgggactatgaccacctgttcaagctgctgatcatcggggacagcggcgtgggcaagagcagcctgctgctgcgctttgctgacaacaccttcagcggcagctacatcaccaccatcggcgtggacttcaagatcagaacagtggagatcaatggagagaaggtgaagctgcagatctgggacacagctggccaggagcgcttccgcaccatcaccagcacagctgagacagccctgcggagcctgccccagcctgaggcccacggcggcagcagcggggacagcctgagctttgtgcccctcttcaaggagttcagcccctgcttctgcatcggccgctgccaccgccacttcctgccccggcccccccgggtgccccggcgctgctggaccagcccccccttccccactggagcccccagcagccctgccaaggcccctggccctggagaagatgctgccaggagagctgactag

SEQ ID NO: 7917 - DNA, 360 bp, Artificial Sequence; identical to SEQ ID NO: 7241
  Description of Artificial Sequence: Synthetic coding sequence

SEQ ID NO: 7918 - DNA, 2514 bp, Artificial Sequence
  Description of Artificial Sequence: Synthetic coding sequence
atgttcaagtgctggagcgtggtgctggtgctgggcttcatcttcctggagagcgagggccggcccaccaaggagggcggctacggcctgaagagctaccagcccctgatgaggctgcggcacaaggagaagaaccaggagagcagccgggtgaagggcttcatgatccaggacggccccttcggcagctgtgagaacaagtactgcggcctgggccgccactgtgtgaccagccgggagaccggccaggctgaatgtgcctgcatggacctgtgcaagaggcactacaagcctgtgtgtggcagtgatggagagttctatgagaaccactgtgaggtgcaccgggccgcctgcctgaagaagcagaagatcaccatcgtgcacaatgaagactgcttcttcaagggggacaagtgcaagaccacagagtacagcaagatgaagaacatgctgctggacctgcagaaccagaagtacatcatgcaggagaatgaaaaccccaatggagatgacatcagcaggaagaagctgctggtggaccagatgttcaagtactttgatgctgacagcaatggcctggtggacatcaatgagctgacccaggtgatcaagcaggaggagctgggcaaggacctgtttgactgcaccctgtatgtgctgctgaagtatgatgacttcaatgctgacaagcacctggccctggaggagttctaccgggccttccaggtgatccagctgagcctgcctgaggaccagaagctgagcatcacagctgccaccgtgggccagagcgctgtgctgagctgtgccatccagggcaccctgcggccccccatcatctggaagaggaacaacatcatcctgaacaacctggacctggaggacatcaatgactttggagatgatggcagcctgtacatcaccaaggtgaccaccacccacgtgggcaactacacctgctacgcagatggctatgagcaggtgtaccagacccacatcttccaggtgaatgtgccccctgtgatccgggtgtacccagagagccaggcccgggagcccggggtgacagccagcctgcgctgccacgccgagggcatccccaagccccagctgggctggctgaagaatggcatcgacatcacccccaagctgagcaagcagctgaccctgcaggccaatggaagtgaggtgcacatcagcaatgtgcgctatgaagatactggagcctacacctgcatcgccaagaatgaggccggcgtggatgaggacatcagcagcctgtttgtggaggacagcgccaggaagacccggctgggcatcggcaacatgttttatgtgttctatgaagatggcatcaaggtgatccagcccattgaatgtgagttccagaggcacatcaagcccagcgagaagctgctgggcttccaggatgaggtgtgccccaaggccgagggagatgaggtgcagagatgtgtgtgggccagcgctgtgaatgtgaaggacaagttcatctacgtggcccagcccaccctggacagagtgctgattgtggatgtgcagagccagaaggtggtgcaggccgtgtccacagatcctgtgcctgtgaagctgcactatgacaagagccatgaccaggtgtgggtgctgtcctggggcaccctggagaagaccagccccaccctgcaggtgatcaccctggccagcggaaatgtgccccaccacaccatccacacccagcctgtgggcaagcagtttgacagagtggatgacttcttcatccccaccaccaccctcatcatcacccacatgagatttggcttcatcctgcacaaggatgaggccgccctgcagaagattgacctggagaccatgagctacatcaagaccatcaacctgaaggactacaagtgtgtgccccagagcctggcctacacccacctgggcggctactacttcatcggctgcaagccagacagcactggagctgtgagcccccaggtgatggtggatggagtgacagattctgtgattggcttcaacagtgatgtgacaggcaccccctacgtgtccccagatggccactacctggtgtccatcaatgatgtgaagggcctggtgcgggtgcagtacatcaccatccggggggagatccaggaggcctttgacatctacaccaacctgcacatcagtgacctggccttccagcccagcttcacagaggcccaccagtacaacatctacggcagcagcagcacccagacagatgtgctgtttgtggagctgagcagcggcaaggtgaagatgatcaagagcctgaaggagcccctgaaggccgaggagtggccctggaacaggaagaaccggcagatccaggacagcggcctgtttggccagtacctgatgacccccagcaaggacagcctcttcatcctggatggccgcctgaacaagctgaactgtgagatcacagaggtggagaagggcaacacagtcatctgggtgggagatgcctag

SEQ ID NO: 7919 - DNA, 648 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaggccggggccgccccctacgtgcaggcctttgacagcctgctggccggccctgtggccgagtacctgaagatcagcaaggagattggaggagatgtgcagaagcatgctgagatggtgcacacaggcctgaagctggagcgggccctgctggtgacagccagccagtgccagcagcctgctgagaacaagctgagtgacctgctggcccccatcagcgagcagatcaaggaggtgatcaccttccgggagaagaacagaggcagcaagctgttcaaccacctgtctgctgtgtctgagagcatccaggccctgggctgggtggccatggcccccaagccaggcccctacgtgaaggagatgaatgatgctgccatgttctacaccaacagagtgctgaaggagtacaaggatgtggacaagaagcacgtggactgggtgaaggcctacctgagcatctggacagagctgcaggcctacatcaaggagttccacaccaccggcctggcctggagcaagacaggccctgtggccaagtag

SEQ ID NO: 7920 - DNA, 3837 bp, Artificial Sequence
  Description of Artificial Sequence: Synthetic coding sequence
atgaggctgctgctgctggtgcccctgctgctggccccagcccctggcagcagcgcccccaaggtgcggcggcagagcgacacctggggcccctggagccagtggagcccctgcagcaggacctgtggcggcggcgtgtccttccgggagcggccctgctacagccagaggagagatggcggcagcagctgtgtgggccctgcccggagccacaggagctgcaggacagagagctgcccagatggagcccgggacttccgggcagagcagtgtgccgagtttgatggagctgagttccagggccgccgctaccgctggctgccctactacagcgcccccaacaagtgtgagctgaactgcatccccaagggggagaacttctactacaagcaccgggaggccgtggtggatggcaccccctgtgagcccgggaagagagatgtgtgtgtggatggcagctgccgggtggtgggctgtgaccacgagctggacagcagcaagcaggaggacaagtgcctgcgctgtggaggagatggcaccacctgctaccctgtggccggcacctttgatgccaatgacctgagccggggctacaaccagatcctgattgtgcccatgggcgccaccagcatcctgattgatgaggccgccgccagcaggaacttcctggccgtgaagaatgtgcggggggagtactacctgaatggccactggaccatcgaggccgcccgggccctgcctgctgccagcaccatcctgcactatgaaagaggagctgagggggacctggcccctgagcggctgcacgcccggggccccaccagcgagcccctggtgattgagctgatcagccaggagcccaaccctggggtgcactatgagtaccacctgcccctgcggcggcccagccctggcttctcctggagccacggctcctggagcgactgcagcgcagaatgtggcggcggccaccagagccggctggtgttctgcaccatcgaccacgaggcctacccagaccacatgtgccagaggcagcccaggcctgctgaccggcgcagctgcaacctgcacccctgcccagagaccaagcgctggaaggccggcccctgggccccctgcagcgccagctgtggcggcggcagccagagccgctctgtgtactgcatcagcagtgatggagctggcatccaggaggccgtggaggaggctgaatgtgccggcctgcccgggaagcccccagccatccaggcctgcaacctgcagagatgtgccgcctggagccctgagccctggggcgagtgcagcgtgtcctgtggggtgggcgtgaggaagaggtctgtgacctgccgcggggagcggggcagcctgctgcacacagctgcctgcagcctggaggacaggcctcccctgacagagccctgtgtgcatgaggactgccccctgctgagtgaccaggcctggcacgtgggcacctggggcctgtgcagcaagagctgcagcagcggcacccggcggcggcaggtgatctgtgccatcggcccccccagccactgcggcagcctgcagcacagcaagcctgtggatgtggagccctgcaacacccagccctgccacctgccccaggaggtgcccagcatgcaggatgtgcacaccccagccagcaacccctggatgcccctgggcccccaggagagccctgccagtgacagccggggccagtggtgggccgcccaggagcaccccagcgcccggggggaccacagaggagagcggggggaccccaggggggaccagggcacccacctgagcgccctgggccctgcccccagcctgcagcagcccccctaccagcagcccctgcggagcggcagcggcccccatgactgccgccacagcccccacggctgctgcccagatggccacacagccagcctgggcccccagtggcagggctgccctggggccccctgccagcagagccgctatggctgctgcccagacagagtgtctgtggccgagggcccccaccacgccggctgcaccaagagctatggaggagacagcactggaggcatgcccaggagcagagctgtggccagcacagtgcacaacacccaccagccccaggcccagcagaatgagcccagcgagtgccggggcagccagtttggctgctgctatgacaacgtggccacagctgctggccccctgggggagggctgtgtgggccagcccagccacgcctaccctgtgcgctgcctgctgcccagcgcccacggcagctgtgccgactgggccgcccgctggtactttgtggcctctgtgggccagtgcaaccgcttctggtacggcggctgccacggcaatgccaacaactttgccagcgagcaggagtgcatgagcagctgccagggcagcctgcacggcccccggcggccccagcccggggccagcggccgcagcacccacacagatggcggcggcagcagccctgctggggagcaggagcccagccagcacaggactggagctgctgtgcagaggaagccctggcccagcggcggcctgtggaggcaggaccagcagcccggccctggagaggccccccacacccaggcctttggagagtggccctggggccaggagctgggcagccgggcccctggcctgggcggagatgctggcagccctgccccacccttccacagcagcagctaccgcatcagcctggccggcgtggagcccagcctggtgcaggccgccctgggccagctggtgcggctgagctgcagtgatgacacagcccctgagagccaggccgcctggcagaaggatggccagcccatcagcagtgacagacaccggctgcagtttgatggcagcctcatcatccaccccctgcaggctgaagatgctggcacctacagctgtggcagcaccaggcctggccgggacagccagaagatccagctgcgcatcattggaggagacatggctgtgctgtctgaggccgagctgagccgcttcccccagccccgggaccctgcccaggactttggccaggccggggccgccggccccctgggcgccatccccagcagccacccccagcctgccaaccggctgcggctggaccagaaccagccccgggtggtggatgccagccctggccagaggatccgcatgacctgcagagctgagggcttccccccaccagccatcgagtggcagagagatggccagcctgtgagcagccccaggcaccagctgcagccagatggcagcctggtgatcagccgggtggccgtggaggatggcggcttctacacctgtgtggccttcaacggccaggaccgggaccagcgctgggtgcagctgcgggtgctgggggagctgaccatcagcggcctgcccccaacagtgacagtgcctgagggggacacagcccggctgctgtgtgtggtggccggggagagcgtgaacatccgctggagcagaaatggcctgcctgtgcaggctgatggccaccgggtgcaccagagcccagatggcaccctgctgatctacaacctgcgggccagagatgagggcagctacacctgcagcgcctaccagggcagccaggccgtgagccgcagcacagaggtgaaggtggtgtccccagcccccacagcccagccccgggaccccggccgggactgtgtggaccagcctgagctggccaactgtgacctgatcctgcaggcccagctgtgtggaaatgagtactacagcagcttctgctgtgccagctgcagccgcttccagccccacgcccagcccatctggcagtag

SEQ ID NO: 7921 - DNA, 546 bp, Artificial Sequence
  Description of Artificial Sequence: Synthetic coding sequence
tgaaaaggccacgccagccccctgcccccatctgctgcccccaccacagacagcacagacagcatcaccggccagaacagccggcagcgggaggaggagctggagctgattgaccagctgaggaagcacatcgagtaccgcctgaaggtgtccctgccctgtgacctgggcgccgccctgacagatggagtggtgctgtgccacctggccaaccacgtgcggcccaggtctgtgcccagcatccacgtgcccagccctgctgtgcccaagctgaccatggccaagtgcagaagaaatgtggagaacttcctggaggcctgcaggaagattggagtgccccaggacaacctgtgcagccccagcgacatcctgcagctgaacctgtctgtgaagaggacagtggagaccctgctgagcctgggcgcccacagcgaggagagcagctttgtgtgcctgagcctgcagctgctgggctttgtggccttctactgcaccgtgatgctgaccctgtgtgtgctgtactactggctgtttcctgccaggtag

SEQ ID NO: 7922 - DNA, 804 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagagatggcctgctgagctacacagcccctgtgggccagaccatgtacctgtctgaggccgtgtacctgaatgacagcacctatgatggccacacagtgggcggcctgcagtatggaggcctgggccagctggctgatggagtggtgggcctggatgacttcaggaagagccaggagctgcgggtgtggccaggctatgactatgtgggctggagcaaccacagcttcagcagcggctactag

SEQ ID NO: 7923 - DNA, 345 bp, Artificial Sequence
  Description of Artificial Sequence: Synthetic coding sequence
atggcccccaagaagctgagctgcctgcggagcctgctgctgcccctgagcctgaccctgctgctgccccaggccgacaccaggagctttgtggtggaccggggccatgaccgcttcctgctggatggagcccccttccgctacgtgtctggcagcctgcactacttccgggtgccccgggtgctgtgggccgaccggctgctgaagatgcgctggagcggcctgaatgccatccagttctacgtgccctggaactaccacgagccccagcccggggtgtacaacttcaacggcagccgggacctgattgccttcctgaatgaagctgccctggccaacctgtag

SEQ ID NO: 7924 - DNA, 507 bp, Artificial Sequence
  Description of Artificial Sequence: Synthetic coding sequence
gcccccaggatggagatgttccagggcctgctgctgctgctgctgctgtccatgggcggcacctgggccagcaaggagcccctgcggccccgctgccggcccatcaatgccaccctggccgtggagaaggagggctgccctgtgtgcatcaccgtgaacaccaccatctgtgccggctactgccccaccatgaccagggtgctgcagggcgtgctgcctgccctgccccaggtggtgtgcaactacagagatgtgcgctttgagagcatccggctgcccggctgcccccggggcgtgaaccctgtggtgtcctatgctgtggccctgagctgccagtgtgccctgtgcagaagaagcaccacagactgtggcggccccaaggaccaccccctgacctgtgatgacccccgcttccaggacagcagcagcagcaaggcccccccacccagcctgcccagccccagccggctgcccggccccagcgacacccccatcctgccccagtag

SEQ ID NO: 7925 - DNA, 1203 bp, Artificial Sequence
  Description of Artificial Sequence: Synthetic coding sequence
atggagacccaggagctgcggggggccctggccctgctgctgctgtgcttcttcaccagcgccagccaggacctgcaggtgattgacctgctgactgtgggggagagccggcagatggtggccgtggccgagaagatcagaacagccctgctgacagctggggacatctacctgctgagcaccttccggctgccccccaagcagggcggcgtgctgtttggcctgtacagccggcaggacaacacccgctggctggaggcctctgtggtgggcaagatcaacaaggtgaccaatgccctgcacagcatcctgggggagggcaatgtgcctgaccccaagcaccactacggcgtgtctggcttccacgagcagaggagccactgcagccccaacccctgcttccggggcgtggactgcatggaggtgtatgagtacccaggctaccgctgtggcccctgccccccaggcctgcagggcaatggcacccactgcagcgacatcaatgaatgtgcccatgctgacccctgcttccctggcagcagctgcatcaacaccatgcctggcttccactgtgaggcctgcccccggggctacaagggcacccaggtgtctggagtgggcatcgactatgcccgggccagcaagcaggtgtgcaatgacattgatgaatgtaatgatggcaacaatggaggctgtgaccccaacagcatctgcaccaacacagtgggcagcttcaagtgtggcccctgccgcctgggcttcctgggcaaccagagccagggctgcctgcctgcccggacctgccacagccctgcccacagcccctgccacatccacgcccactgcctgtttgaaagaaatggagctgtgtcctgccagtgcaatgtgggctgggccggaaatggaaatgtgtgtggcacagacacagacattgatggctacccagaccaggccctgccctgcatggacaacaacaagcactgcaagcaggacaactgcctgctgacccccaacagcggccaggaggatgctgacaatgatggagtgggggaccagtgtgatgatgatgctgatggagatggcatcaagaatgtggaggccagccccatggactggaccatcgccctgaagagccccacccactaccggcagacaggcatgaggacaggctgggagatgctggccacagctgccctgaagtag

SEQ ID NO: 7926 - DNA, 618 bp, Artificial Sequence; identical to SEQ ID NO: 7228
  Description of Artificial Sequence: Synthetic coding sequence

SEQ ID NO: 7927 - DNA, 177 bp, Artificial Sequence
  Description of Artificial Sequence: Synthetic coding sequence
atggacctgctgcagttcctggccttcctgtttgtgctgctgctgagcggcatgggcgccaccggcaccctgcggaccagcctggaccccagcctggagatctacaagaagatgtttgaggtgaagagaagagagcagctgctggccctgaagaacctggcccagctgaatgactag

SEQ ID NO: 7928 - DNA, 450 bp, Artificial Sequence
  Description of Artificial Sequence: Synthetic coding sequence
atgaaggtgattgccatcctgaccctgctgctcttctgcagccccacccacagcagcttctggcagttccagaggagagtgaagcacatcaccggccgcagcgccttcttctcctactacggctacggctgctactgcggcctgggggacaagggcatccctgtggatgacacagacagacacagccccagcagccccagcccctatgagaagctgaaggagttcagctgccagcctgtgctgaacagctaccagttccacatcgtgaatggagctgtggtgtgtggctgcaccctgggccctggggccagctgccactgccgcctgaaggcctgtgaatgtgacaagcagagcgtgcactgcttcaaggagagcctgcccacctatgagaagaacttcaagcagttcagcagccagccccgctgtggccgccacaagccctggtgctag

SEQ ID NO: 7929 - DNA, 237 bp, Artificial Sequence; identical to SEQ ID NO: 7333
  Description of Artificial Sequence: Synthetic coding sequence

SEQ ID NO: 7930 - DNA, 1461 bp, Artificial Sequence
  Description of Artificial Sequence: Synthetic coding sequence
atgatcagccccagccccagccaggaggagctgcagaccaccctggaggagacagaccagagcacccaggagcccttcaccaccaagatccccaggaccacagagctggccaagaccacccaggccccccaccgcttctacaccaccgtgcggcccaggaccagtgacaagccccacatccggcctgtgctgaacagaaccaccacccggcccacccggcccaagcccagcggcatgcccagcggaaatggagtgggcactggagtgaagcaggccccccggcccagcggggctgacagaaatgtgtctgtggacagcacccaccccaccaagaagccaggcacccggcggccccccctgcccccccggcccacccaccccaggaggaagcccctgccccccaacaacgtgacaggcaagccaggcagcgctggcatcatcagcagcggccccatcaccaccccacccctgcggagcaccccccggcccaccggcacccccctggagagaattgaaacagacatcaagcagcccaccgtgcctgccagcggggaggagctggagaacatcacagacttcagcagcagccccacccgggagacagaccccctgggcaagccccgcttcaagggcccccacgtgcgctacatccagaagccagacaacagcccctgcagcatcacagacagcgtgaagcgcttccccaaggaggaggccacagagggcaatgccaccagccccccccagaacccccccaccaacctgactgtggtgacagtggagggctgccccagctttgtgatcctggactgggagaagcccctgaatgacacagtgacagaatatgaggtgatcagccgggagaatggcagcttcagcggcaagaacaagagcatccagatgaccaaccagaccttcagcacagtggagaacctgaagcccaacaccagctatgagttccaggtgaagcccaagaaccccctgggggagggccctgtgagcaacacagtggccttcagcacagaatctgctgacccccgggtgtctgagcctgtgtctgctggaagagatgccatctggacagagcggcccttcaacagcgacagctacagcgagtgcaagggcaagcagtatgtgaagaggacctggtacaagaagtttgtgggcgtgcagctgtgcaacagcctgcgctacaagatctacctgagtgacagcctgaccgggaagttctacaacattggagaccagaggggccatggagaggaccactgccagtttgtggacagcttcctggatggccgcacaggccagcagctgaccagtgaccagctgcccatcaaggagggctacttccgggctgtgcggcaggagcctgtgcagtttggagagatcggcggccacacccagatcaactacgtgcagtggtatgaatgtggcaccaccatccctgggaagtggtag

SEQ ID NO: 7931 - DNA, 243 bp, Artificial Sequence
  Description of Artificial Sequence: Synthetic coding sequence
tgaaatggacctgtgctgtggttcaagggcaccggccccaacaggaagctgatctacaacttcaagcaggagcagaaccccaggcctcccaagaacagacctgctggccgggccggcagccgggcccaccatgatgcccacacctgcctgagcgccctgcctgagaggaacagcaccaactactttgtgcagccctgctgctgcctgcggctgctgggcctgaccggcctgctgagcaagtag

SEQ ID NO: 7932 - DNA, 1341 bp, Artificial Sequence
  Description of Artificial Sequence: Synthetic coding sequence
atgctgcaccctgagaccagccctggccggggccacctgctggccgtgctgctggccctgctgggcaccacctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctggactggagcgacagcctggcccagctggcccaggcccgggccgccctgtgtggcatccccacccccagcctggccagcggcctgtggaggaccctgcaggtgggctggaacatgcagctgctgcctgctggcctggccagctttgtggaggtggtgtccctgtggtttgctgagggccagcgctacagccatgctgctggggagtgtgccagaaatgccacctgcacccactacacccagctggtgtgggccaccagcagccagctgggctgcggccgccacctgtgcagcgctggccagacagccatcgaggcctttgtgtgtgcctacagcccccggggcaactgggaggtgaatggcaagaccatcatcccctacaagaagggggcctggtgcagcctgtgcacagcctctgtgtctggctgcttcaaggcctgggaccatgctgggggcctgtgtgaggtgcccaggaacccctgcaggatgagctgccagaaccacggccgcctgaacatcagcacctgccactgccactgccccccaggctacacaggccgctactgccaggtgcgctgcagcctgcagtgtgtgcacggccgcttccgggaggaggagtgcagctgtgtgtgtgacatcggctacggcggggcccagtgtgccaccaaggtgcacttccccttccacacctgtgacctgagaattgatggagactgcttcatggtgtcctctgaggccgacacctactaccgggccaggatgaagtgccagaggaagggcggcgtgctggcccagatcaagagccagaaggtgcaggacatcctggccttctacctgggccgcctggagaccaccaatgaagtcatcgacagcgactttgagaccaggaacttctggattggcctgacctacaagacagccaaggacagcttccgctgggccaccggggagcaccaggccttcaccagctttgccttcggccagcctgacaaccacggctttggaaactgtgtggagctgcaggccagcgctgccttcaactggaatgaccagcgctgcaagaccaggaaccgctacatctgccagtttgcccaggagcacatcagccgctggggccctggcagctag

SEQ ID NO: 7933 - DNA, 432 bp, Artificial Sequence
  Description of Artificial Sequence: Synthetic coding sequence
atgcaggccgcctgctggtacgtgctcttcctgctgcagcccaccgtgtacctggtgacctgtgccaacctgaccaacggcggcaagtctgagctgctgaagagcggcagcagcaagagcaccctgaagcacatctggacagagagcagcaaggacctgagcatcagccggctgctgagccagaccttccggggcaaggaaaatgacacagacctggacctgcgctatgacaccccagagccctacagcgagcaggacctgtgggactggctgaggaacagcacagacctgcaggagccccggccccgggccaagaggcggcccatcgtgaagacaggcaagttcaagaagatgtttggctggggagacttccacagcaacatcaagacagtgaagctgaacctgctgatcaccgggaagatcgtggactag

SEQ ID NO: 7934 - DNA, 783 bp, Artificial Sequence
  Description of Artificial Sequence: Synthetic coding sequence
atgcagggcgagccctttgcctgcctgacccaccaggagcccctgcccaagatgttcaagctgctgagccgggcctatgcagatgtgcaccccatgatgatggacagaagtgagaacagatgtggcggcaacttcctgaagaggggcagcatcatcaatggagctgactggtacagcttcaccggcggcatgtctgacttcaactacctgcacaccaactgctttgagatcaccgtggagctgggctgtgtgaagtttcctcctgaggaggccctgtacatcctgtggcagcacaacaaggagagcctgctgaactttgtggagaccgtgcaccggggcatcaagggcgtggtgacagacaagtttgggaagcctgtgaagaatgcccgcatctctgtgaagggcatcagacatgacatcaccacagccccagatggagactactggaggctgctgcccccaggcatccacatcgtcatcgcccaggcccctggctacgccaaggtgatcaagaaggtgatcatcccagccaggatgaagagagctggccgggtggacttcatcctgcagcccctgggcatgggccccaagaacttcatccacggcctgcggaggacaggcccccatgaccccctgggcggggccagcagcctgggggaggccacagagccagaccccctgcgggcccggcggcagcccagcgcagatggcagcaagccctggtggtggagctacttcaccagcctgagcacccaccggccccgctggctgctgaagtactag

SEQ ID NO: 7935 - DNA, 882 bp, Artificial Sequence
  Description of Artificial Sequence: Synthetic coding sequence
atgagcagcggcggcggcagccggggcctgctggcctggctgctgctgctgcagccctggccaggccagaactgggccggcatggccgccccccggctgcccagccccctgctgtctgaggagggcggggagaaccctgaggccagccctgcccctggccctgaggccggcccccccctgaacctcttcaccagcttccctggggacagcctgctgtgtggccgcacccccctgcgcatcgtgggcggcgtggatgctgaggagggccgctggccctggcaggtgtctgtgaggaccaagggccgccacatctgtggcggcaccctggtgacagccacctgggtgctgacagctggccactgcatcagcagccgcttccactacagcgtgaagatgggagacagatctgtgtacaatgaaaacacctctgtggtggtgtctgtgcagagggcctttgtgcaccccaagttcagcacagtgaccaccatcagaaatgacctggccctgctgcagctgcagcaccctgtgaacttcaccagcaacatccagcccatctgcatcccccaggagaacttccaggtggagggccgcacccgctgctgggtgacaggctggggcaagaccccagagcgggagaagctggccagcgagatcctgcaggatgtggaccagtacatcatgtgctatgaggagtgcaacaagatcatccagaaggccctgagcagcaccaaggatgtgatcatcaagggcatggtgtgtggctacaaggagcagggcaaggacagctgccagggcgacagcggcggccgcctggcctgtgagtacaatgacacctgggtgcaggtgggcatcgtgtcctggggcatcggctgcggccgctag

SEQ ID NO: 7936 - DNA, 870 bp, Artificial Sequence
  Description of Artificial Sequence: Synthetic coding sequence
atgtttgtgctgctgtatgtgaccagctttgccatctgtgccagcggccagccccggggcaaccagctgaagggggagaactacagcccccgctacatctgcagcatccctggcctgcccggccccccaggccccccaggggccaacggcagccctggcccccacggccgcatcggcctgcccggcagagatggaagagatggcaggaagggggagaagggggagaagggcacagctggcctgcggggcaagacaggccccctgggcctggccggggagaagggggaccagggcgagaccgggaagaagggccccatcggccctgagggggagaagggggaggtgggccccatcggccccccaggccccaagggggacagaggagagcagggcgaccccggcctgcccggggtgtgccgctgtggcagcatcgtgctgaagagcgccttctctgtgggcatcaccaccagctacccagaggagcggctgcccatcatcttcaacaaggtgctcttcaatgaaggagagcactacaacccagccaccgggaagttcatctgtgccttccctggcatctactacttctcctatgacatcaccctggccaacaagcacctggccatcggcctggtgcacaacggccagtaccgcatcaagacctttgatgccaacacaggcaaccatgatgtggccagcggcagcaccgtcatctacctgcagccagaagatgaggtgtggctggagatcttcttcacagaccagaatggcctcttcagtgaccccggctgggccgacagcctcttcagcggcttcctgctgtatgtggacacagactacctggacagcatcagtgaagatgatgagctgtag

SEQ ID NO: 7937 - DNA, 2742 bp, Artificial Sequence; identical to SEQ ID NO: 7141
  Description of Artificial Sequence: Synthetic coding sequence

SEQ ID NO: 7938 - DNA, 1089 bp, Artificial Sequence
  Description of Artificial Sequence: Synthetic coding sequence
atgaggaccctcttcaacctgctgtggctggccctggcctgcagccctgtgcacaccaccctgagcaagagtgatgccaagaaggccgccagcaagaccctgctggagaagagccagttcagtgacaagcctgtgcaggaccggggcctggtggtgacagacctgaaggccgagagcgtggtgctggagcacaggagctactgcagcgccaaggcccgggacagacactttgctggagatgtgctgggctacgtgaccccctggaacagccacggctatgatgtgaccaaggtgtttggcagcaagttcacccagatcagccctgtgtggctgcagctgaagagaagaggccgggagatgtttgaggtgacaggcctgcatgatgtggaccagggctggatgagagctgtgaggaagcacgccaagggcctgcacatcgtgccccggctgctgtttgaggactggacctatgatgacttcagaaatgtgctggacagtgaagatgaaattgaggagctgagcaagacagtggtgcaggtggccaagaaccagcactttgatggctttgtggtggaggtgtggaaccagctgctgagccagaagagggtgacagaccagctgggcatgttcacccacaaggagtttgagcagctggcccctgtgctggatggcttcagcctgatgacctatgactacagcacagcccaccagcccggccccaatgcccccctgtcctgggtgcgggcctgtgtgcaggtgctggaccccaagagcaagtggaggagcaagatcctgctgggcctgaacttctacggcatggactatgccaccagcaaggatgcccgggagcctgtggtgggcgcccgctacatccagaccctgaaggaccaccggcccaggatggtgtgggacagccaggccagcgagcacttctttgagtacaagaagagccgcagcggccgccacgtggtgttctaccccaccctgaagagcctgcaggtgcggctggagctggcccgggagctgggcgtgggcgtgtccatctgggagctgggccagggcctggactacttctatgacctgctgtag

SEQ ID NO: 7939 - DNA, 1350 bp, Artificial Sequence
  Description of Artificial Sequence: Synthetic coding sequence
atgaagttccagggccccctggcctgcctgctgctggccctgtgcctgggcagcggggaggccggccccctgcagagcggggaggagagcacaggcaccaacattggagaggccctgggccacggcctgggagatgccctgtctgagggcgtgggcaaggccatcggcaaggaggccggcggcgctgctggcagcaaggtgtctgaggccctgggccagggcacccgggaggccgtgggcactggagtgcggcaggtgcccggctttggagtggctgatgccctgggcaacagagtgggggaggccgcccacgccctgggcaacacaggccatgaaattggccggcaggccgaggatgtgatcagacatggagcagatgctgtgcggggctcctggcagggcgtgcccggccacaatggagcctgggagaccagcggcggccacggcatcttcggcagccagggcggcctgggcggccagggccagggcaaccctgggggcctgggcaccccctgggtgcacggctacccaggcaacagcgctggcagctttggcatgaacccccagggcgccccctggggccagggcggcaatggaggcccccccaactttggcaccaacacccagggcgctgtggcccagcccggctacggctctgtgcgggccagcaaccagaatgaaggctgcaccaaccccccaccttctggcagcggcggcggcagcagcaacagcggcggcagcagcacaggcagcagcagcggcaaccacggcggcagcggcggcggcaatggccacaagccaggctgtgagaagccaggaaatgaggcccggggcagcggggagagcggcatccagggccagggcagctcctggggcagcggcggcggagatgctgtgggcggcgtgaacacagtgaacagcgagaccagccctggcatgttcaactttgacaccttctggaagaacttcaagagcaagctgggcttcatcaactgggatgccatcaacaagaaccaggtgcccccacccagcacccgggccctgctgtacttcagccggctgtgggaggacttcaagcagaacacccccttcctgaactggaaggccatcattgaaggagcagatgccagcagcctgcagaagagagctggaagagatgaccagcctggagctggctggcaggaggtggccgctgtgaccagcaagaactacaactacaaccagcacgcctaccccacagcctatggaggcaagtacagcgtgaagaccccagccaagggcggcgtgagccccagcagcagcgccagccgggtgcagcccggcctgctgcagtgggtgaagttctggtag

SEQ ID NO: 7940 - DNA, 735 bp, Artificial Sequence
  Description of Artificial Sequence: Synthetic coding sequence
atgtggggcgcccccctgccccggcggcctgtgtgggatgtgcgcagcgccagcgctggcccccagccctgcctgggcggcaagatgaagctgaacctggtgcagatcttcttcatgctgctgatgctgctgctgggcctgggcatgggcctgggcctgggcctgcacatggccacagctgtgctggaggagagtgaccagcccctgaatgagttctggagcagtgacagccaggacaaggccgaggccacagaggagggagatggcacccagaccacagagaccctggtgctgagcaacaaggaggtggtgcagcccggctggccagaggaccccatcctgggggaggatgaggtgggcggcaacaagatgctgcgggccagcgccctcttccagagcaacaaggactacctgcggctggaccagacagaccgggagtgcaatgacatgatggcccacaagatgaaggagcccagccagagctgcatcgcccagtatgccttcatccacgaggacctgaacacagtgaaggctgtgtgcaacagccctgtgattgcctgtgagctgaagggcggcaagtgccacaagagcagccggccctttgacctgaccctgtgtgagctgagccagcctgaccaggtgacccccaactgcaactacctgaccagcgtcatcaagaagcacatcatcatcacctgcaatgacatgaagaggcagctgcccaccggccagtag

SEQ ID NO: 7941 - DNA, 1728 bp, Artificial Sequence; identical to SEQ ID NO: 6963
  Description of Artificial Sequence: Synthetic coding sequence

SEQ ID NO: 7942 - DNA, 390 bp, Artificial Sequence; identical to SEQ ID NO: 7503
  Description of Artificial Sequence: Synthetic coding sequence

SEQ ID NO: 7943 - DNA, 567 bp, Artificial Sequence; identical to SEQ ID NO: 7502
  Description of Artificial Sequence: Synthetic coding sequence

SEQ ID NO: 7944 - DNA, 2676 bp, Artificial Sequence; identical to SEQ ID NO: 7495
  Description of Artificial Sequence: Synthetic coding sequence

SEQ ID NO: 7945 - DNA, 2742 bp, Artificial Sequence; identical to SEQ ID NO: 7141
  Description of Artificial Sequence: Synthetic coding sequence

SEQ ID NO: 7946 - DNA, 453 bp, Artificial Sequence; identical to SEQ ID NO: 7139
  Description of Artificial Sequence: Synthetic coding sequence

SEQ ID NO: 7947 - DNA, 192 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagcaggtag

SEQ ID NO: 7948 - DNA, 1212 bp, Artificial Sequence
  Description of Artificial Sequence: Synthetic coding sequence
atgcagggcaccccaggcggcggcaccaggcctggccccagccctgtggacaggaggaccctgctggtgttctccttcatcctggccgccgccctgggccagatgaacttcaccggggaccaggtgctgcgggtgctggccaaggatgagaagcagctgagcctgctgggggacctggagggcctgaagccccagaaggtggacttctggaggggccctgcccggcccagcctgcctgtggacatgagggtgcccttcagcgagctgaaggacatcaaggcctacctggagagccacggcctggcctacagcatcatgatcaaggacatccaggtgctgctggatgaggagcggcaggccatggccaagagccggcggctggagaggagcaccaacagcttctcctacagcagctaccacaccctggaggagatctacagctggattgacaactttgtgatggagcacagcgacatcgtgtccaagatccagatcggcaacagctttgagaaccagagcatcctggtgctgaagttcagcactggaggcagccgccacccagccatctggattgacaccggcatccacagccgggagtggatcacccacgccaccggcatctggacagccaacaagatcgtgtctgactatggcaaggacagagtgctgacagacatcctgaatgccatggacatcttcatcgagctggtgaccaacccagatggctttgccttcacccacagcatgaaccggctgtggaggaagaacaagagcatccggcccggcatcttctgcatcggcgtggacctgaacagaaactggaagagcggctttggaggaaatggcagcaacagcaacccctgcagcgagacctaccacggccccagcccccagagcgagcctgaggtggccgccatcgtgaacttcatcacagcccacggcaacttcaaggccctgatcagcatccacagctacagccagatgctgatgtacccctacggccgcctgctggagcctgtgagcaaccagcgggagctgatgtggcctgtgggcagccccagcacaggccccatgacagtggccagcagcacccccagcgccctgagcagcggcaccctgggctccatggccagctgctgccggccccacaggagcagcccccggcccaggagaagaggctggaggtttggccccagctggagcaccccctag

SEQ ID NO: 7949 - DNA, 1542 bp, Artificial Sequence
  Description of Artificial Sequence: Synthetic coding sequence
atggccccagcccggaccatggcccgggcccggctggccccagctggcatcccagctgtggccctgtggctgctgtgcaccctgggcctgcagggcacccaggccggccccccaccagcccctcctggcctgcctgctggagctgactgcctgaacagcttcaccgctggggtgcccggctttgtgctggacaccaatgcctctgtgtccaatggagccaccttcctggagagccccaccgtgcggcggggctgggactgtgtgcgggcctgctgcaccacccagaactgcaacctggccctggtggagctgcagcctgacagaggagaagatgccatcgccgcctgcttcctgatcaactgcctgtatgagcagaactttgtgtgcaagtttgccccccgggagggcttcatcaactacctgacccgggaggtgtaccgcagctaccggcagctgcggacccagggctttggaggcagcggcatccccaaggcctgggccggcatcgacctgaaggtgcagccccaggagcccctggtgctgaaggatgtggagaacacagactggaggctgctgcggggggacacagatgtgcgggtggagaggaaggaccccaaccaggtggagctgtggggcctgaaggagggcacctacctgttccagctgactgtgaccagcagtgaccaccctgaggacacagccaacgtgacagtgacagtgctgagcaccaagcagacagaggactactgcctggccagcaacaaggtgggccgctgccggggcagcttcccccgctggtactatgaccccacagagcagatctgcaagagctttgtgtatggaggctgcctgggcaacaagaacaactacctgcgggaggaggagtgcatcctggcctgccggggcgtgcagggccccagcatggagcggcggcaccctgtgtgcagcggcacctgccagcccacccagttccgctgcagcaatggctgctgcatcgacagcttcctggagtgtgatgacacccccaactgcccagatgccagtgatgaagctgcctgtgagaagtacaccagcggctttgatgagctgcagaggatccacttccccagcgacaagggccactgtgtggacctgcctgacaccggcctgtgcaaggagagcatcccccgctggtactacaaccccttcagcgagcactgtgcccgcttcacctatggaggctgctacggcaacaagaacaactttgaggaggagcagcagtgcctggagagctgccggggcatcagcaagaaggatgtgtttggcctgcggcgggagatccccatccccagcactggatctgtggagatggctgtggccgtgttcctggtgatctgcatcgtggtggtggtggccatcctgggctactgcttcttcaagaaccagaggaaggacttccacggccaccaccaccaccccccacccaccccagccagcagcacagtgtccaccacagaggacacagagcacctggtgtacaaccacaccacccggcccctgtag

SEQ ID NO: 7950 - DNA, 798 bp, Artificial Sequence
  Description of Artificial Sequence: Synthetic coding sequence
atggccccctggagccaccccagcgcccagctgcagcctgtgggcggagatgctgtgtccccagccctgatggtgctgctgtgcctgggcctgagcctgggccccaggacccacgtgcaggccggcaacctgagcaaggccaccctgtgggccgagcccggcagcgtcatcagccggggcaacagcgtgaccatccgctgccagggcaccctggaggcccaggagtaccgcctggtgaaggagggcagccctgagccctgggacacccagaaccccctggagcccaagaacaaggcccgcttcagcatccccagcatgacagagcaccacgccggccgctaccgctgctactactacagccctgctggctggagcgagcccagcgaccccctggagctggtggtgacaggcttctacaacaagcccaccctgagcgccctgcccagccctgtggtgaccagcggggagaatgtgaccctgcagtgtggcagccggctgcgctttgaccgcttcatcctgacagaggagggggaccacaagctgtcctggaccctggacagccagctgacccccagcggccagttccaggccctcttccctgtgggccctgtgacccccagccaccgctggatgctgcgctgctacggcagccgccgccacatcctgcaggtgtggagcgagcccagcgacctgctggagatccctgtgtctggagaggaggccaccgtcttcagcagcaccatccagggcagccagacaggctgtggggagctgtaccggcagggcagcccctgctag

SEQ ID NO: 7951 - DNA, 795 bp, Artificial Sequence
  Description of Artificial Sequence: Synthetic coding sequence
atggagaagcccatcctgaagaacctgaatgagatgctgtgccccatcatcgccagcgaggtgaaggccctgaatgccaacctgagcaccctggaggtgctgaccaagattgacaactacaccctgctggactacagcctcatcagcagccctgagatcacagagaactacctggacctgaacctgaagggcgtcttctaccccctggagaacctgacagatcctcccttcagccctgtgccctttgtgctgcctgagaggagcaacagcatgctgtacatcggcattgctgagtacttcttcaagagcgccagctttgcccacttcaccgctggggtcttcaacgtgaccctgagcacagaggagatcagcaaccactttgtgcagaacagccagggcctgggcaatgtgctgagccgggtggccagcacctctgtgggcctggtgatcctgggccagaggctggtgtgcagcctgagcctgaaccgcttccggctggccctgcctgagagcaacagaagcaacatcgaggtgctgcgctttgagaacatcctgagcagcatcctgcactttggagtgctgcccctggccaatgccaagctgcagcagggcttccccctgagcaacccccacaagttcctgtttgtgaacagcgacatcgaggtgctggagggcttcctgctgatcagcacagacctgaagtatgagaccagcagcaagcagcagcccagcttccacgtgtgggagggcctgaacctgatcagccggcagtggaggggcaagagcgccccctag

SEQ ID NO: 7952 - DNA, 117 bp, Artificial Sequence
  Description of Artificial Sequence: Synthetic coding sequence
atgaacaagatcctgagcagcacagtgtgcttcggcctgctgaccctgctgtctgtgctgtccttcctgcagagcgtgcacggccggccctacctgacccagggcaatgagatctag

SEQ ID NO: 7953 - DNA, 567 bp, Artificial Sequence; identical to SEQ ID NO: 7502
  Description of Artificial Sequence: Synthetic coding sequence

SEQ ID NO: 7954 - DNA, 600 bp, Artificial Sequence; identical to SEQ ID NO: 7206
  Description of Artificial Sequence: Synthetic coding sequence

SEQ ID NO: 7955 - DNA, 30 bp, Artificial Sequence; identical to SEQ ID NO: 4613
  Description of Artificial Sequence: Synthetic coding sequence

SEQ ID NO: 7956 - DNA, 831 bp, Artificial Sequence
  Description of Artificial Sequence: Synthetic coding sequence
atggcccccagccccctgcagaggctgcactgcggccccagccccagcccccggcccacagaggtgccccggggcaccgtgtctgtgtcctgccgctacctgaagaacagcctgcacgtgtttgtgtctggaggagccatcggcaccagcagccctgccctgctggagtgccaggagggcgtgggccctgcccggcccagcctgctggtgcccccaccaccccggccccggcggctggacctggcccggaccctgcctgctgagaggacagacagccagagcctgtacatcgtgtacatcgccctgcccggccgcacccccaggcctgccctggcctttgccttcctgatgcctgcctgctgcaaccggcccagcccccggcccagccctgcccacctgacagccagctctgtgctgcggcggcagagacatgtgctggccgccagcgctgccagcccctgccagtggagcggcctgcgggtggcccacagcctgcggcaggtggtgtccctgtgcccccgctgcaccggcagctgccccttcagcggggcctgtgccagcagcctgcccagccccctgagctgcccccacagccacagcggctcctggggcacctggagccagggccggccctgcagcagcacagaggtggccggcctggccctgtggcccacagacttcctgagctgcctgctggatgccagcgagctgcagacccagggcagccacggcttctccttcacccccaccggcttcagcagcaacaggaaggtgggcgtgggcagctgcagagatggagctggccgcggggccatgggcggcctcttctag

SEQ ID NO: 7957 - DNA, 678 bp, Artificial Sequence; identical to SEQ ID NO: 7810
  Description of Artificial Sequence: Synthetic coding sequence

SEQ ID NO: 7958 - DNA, 534 bp, Artificial Sequence
  Description of Artificial Sequence: Synthetic coding sequence
atggtgcctgctgctggggccctgctgtgggtgctgctgctgaacctgggccccagggctgctggggcccagggcctgacccagacccccacagagatgcagagggtgtccctgcgctttggaggccccatgaccaggagctaccgcagcacagccaggacaggcctgcccaggaagacccgcatcatcctggaggatgaaaatgatgccatggctgatgctgaccggctggccggccctgctgctgctgagctgctggccgccaccgtgtccacaggcttcagccgcagcagcgccatcaatgaagaagatggcagcagcgaggagggcgtggtgatcaatgccggcaaggacagcaccagccgggagctgcccagcgccacccccaacacagctggcagcagcagcacccgcttcatcgccaacagccaggagcctgagatccggctgaccagcagcctgcccaggagccctggccgcagcacagaggacctgcccccctgccacctgctgcgcatctgtggctggtgctag

SEQ ID NO: 7959 - DNA, 912 bp, Artificial Sequence
  Description of Artificial Sequence: Synthetic coding sequence
atgctgcaccctgagaccagccctggccggggccacctgctggccgtgctgctggccctgctgggcacagcctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctggactggagcgacagcctggcccagctggcccaggcccgggccgccctgtgtggcatccccacccccagcctggccagcggcctgtggaggaccctgcaggtgggctggaacatgcagctgctgcctgctggcctggccagctttgtggaggtggtgtccctgtggtttgctgagggccagcgctacagccatgctgctggggagtgtgccagaaatgccacctgcacccactacacccagctggtgtgggccaccagcagccagctgggctgcggccgccacctgtgcagcgctggccaggccgccatcgaggcctttgtgtgtgcctacagcccccggggcaactgggaggtgaatggcaagaccatcgtgccctacaagaagggggcctggtgcagcctgtgcacagcctctgtgtctggctgcttcaaggcctgggaccatgctgggggcctgtgtgaggtgcccaggaacccctgcaggatgagctgccagaaccacggccgcctgaacatcagcacctgccactgccactgccccccaggctacacaggccgctactgccaggtgcgctgcagcctgcagtgtgtgcacggccgcttccgggaggaggagtgcagctgtgtgtgtgacatcggctacggggagcccagcgtgcccccacgctgcatcttccccagcacccctgtgacctag

SEQ ID NO: 7960 - DNA, 1482 bp, Artificial Sequence; identical to SEQ ID NO: 7826
  Description of Artificial Sequence: Synthetic coding sequence

SEQ ID NO: 7961 - DNA, 807 bp, Artificial Sequence
  Description of Artificial Sequence: Synthetic coding sequence
atgaagcagatcctgcacccagccctggagaccacagacccctgcagcactggatttgtgtttcctgccatgaccctcttccctgtgctgctcttcctggtggccggcctgctgcccagcttccctgccaatgaagacaaggaccctgccttcaccgccctgctgaccacccagacccaggtgcagcgggagatcgtgaacaagcacaatgagctgcggcgggctgtgagccccccagccaggaacatgctgaagatggagtggaacaaggaggccgccgccaatgcccagaagtgggccaaccagtgcaactaccgccacagcaaccccaaggacaggatgaccagcctgaagtgtggagaaaatctctacatgagcagcgccagcagctcctggagccaggccatccagagctggtttgatgagtacaatgactttgattttggagtgggccccaagaccccaaatgctgtggtgggccactacacccaggtggtgtggtacagcagctacctggtgggctgtggaaatgcctactgccccaaccagaaggtgctgaagtactactacgtgtgccagtactgcccagctggcaactgggccaaccggctgtatgtgccctatgagcagggcgccccctgtgccagctgcccagacaactgtgatgatggcctgtgcaccaacggctgcaagtatgaagatctctacagcaactgcaagagcctgaagctgaccctgacctgcaagcaccagctggtgcgggacagctgcaaggccagctgcaactgcagcaacagcatctactag

SEQ ID NO: 7962 - DNA, 372 bp, Artificial Sequence
  Description of Artificial Sequence: Synthetic coding sequence
atgctgcccaagagccggcgggccctgaccatccaggagattgctgccctggcccggagcagcctgcacggcatcagccaggtggtgaaggaccacgtgaccaagcccacagccatggcccagggccgggtggcccacctgattgagtggaagggctggagcaagcccagcgacagccctgctgccctggagagcgccttcagcagctacagcgacctgtctgagggggagcaggaggccaggtttgctgctggggtggccgagcagtttgccatcgccgaggccaagctgcgggcctggagctctgtggatggagaggacagcacagatgacagctatgatgaagattttgctgggggcatggacacctag

SEQ ID NO: 7963 - DNA, 726 bp, Artificial Sequence
  Description of Artificial Sequence: Synthetic coding sequence
atgggcgctgtgatgggcaccttcagcagcctgcagaccaagcagaggcggcccagcaaggacaagattgaagatgagctggagatgaccatggtgtgccacaggcctgagggcctggagcagctggaggcccagaccaacttcaccaagcgggagctgcaggtgctgtaccggggcttcaagaatgaatgtcccagcggcgtggtgaatgaagacaccttcaagcagatctatgcccagttcttcccccacggggccctgccctgcctggagggcagcccctgtgtggagttcctgccccccagccctgccctgctcttctgcctggtggatgccagcacctacgcccactacctgttcaatgcctttgacaccacccagacaggctctgtgaagtttgaggactttgtgacagccctgagcatcctgctgcggggcaccgtgcatgagaagctgcgctggaccttcaacctgtatgacatcaacaaggatggctacatcaacaaggaggagatgatggacatcgtgaaggccatctatgacatgatgggcaagtacacctaccctgtgctgaaggaggacaccccccggcagcacgtggatgtgttcttccagaagatggacaagaacaaggatggcatcgtgaccctggatgagttcctggagagctgccaggaggatgacaacatcatgaggagcctgcagctgttccagaatgtgatgtag

SEQ ID NO: 7964 - DNA, 630 bp, Artificial Sequence; identical to SEQ ID NO: 7859
  Description of Artificial Sequence: Synthetic coding sequence

SEQ ID NO: 7965 - DNA, 312 bp, Artificial Sequence
  Description of Artificial Sequence: Synthetic coding sequence
atgaggcagaggctgctgcccagcgtgaccagcctgctgctggtggccctgctcttccctggcagcagccaggcccggcacgtgaaccacagcgccacagaggccctgggggagctgcgggagcgggcccctggccagggcaccaacggcttccagctgctgcggcatgctgtgaagagggacctgctgccccccaggaccccaccctaccaggtgcacatcagccaccaggaggcccggggccccagcttcaagatctgtgtgggcttcctgggcccccgctgggcccggggctgcagcactggaaattag

SEQ ID NO: 7966 - DNA, 426 bp, Artificial Sequence
  Description of Artificial Sequence: Synthetic coding sequence
atgaagacaggcctcttcttcctgtgcctgctgggcacagctgctgccatccccaccaatgcccggctgctgagtgaccacagcaagcccacagctgagaccgtggccccagacaacacagccatccccagcctgcgggcagaggccgaggagaatgagaaggagacagctgtgtccacagaagatgacagccaccacaaggccgagaagagctctgtgctgaagagcaaggaggagagccatgagcagagcgctgagcagggcaagagcagcagccaggagctgggcctgaaggaccaggaggacagtgatggccacctgtctgtgaacctggagtatgcccccacagagggcaccctggacatcaaggaggacatgtctgagccccaggagaagaagctgtctgagaacacagacttcctgtag

SEQ ID NO: 7967 - DNA, 642 bp, Artificial Sequence
  Description of Artificial Sequence: Synthetic coding sequence
atgaggctggccggccccctgagaattgtggtgctggtggtgtctgtgggcgtgacctggatcgtggtgtccatcctgctgggcggccctggcagcggcttcccccgcatccagcagctgttcaccagccctgagagctctgtgacagctgccccccgggccaggaagtacaagtgtggcctgccccagccctgcccagaggagcacctggccttccgggtggtgtctggggccgccaacgtcatcggccccaagatctgcctggaggacaagatgctgatgagctctgtgaaggacaacgtgggccggggcctgaacatcgccctggtgaatgatgtgaatgacctgctgaagttcatccggcccctgcacgagggcaccctggtgtttgtggccagctatgatgatcctgccaccaagatgaatgaggagaccaggaagctgttcagcgagctgggcagcagaaatgccaaggagctggccttccgggacagctgggtgtttgtgggcgccaagggcgtgcagaacaagagcccctttgagcagcacgtgaagaacagcaagcacagcaacaagtatgagggctggccagaggccctggagatggagggctgcatcccccggcgcagcacagccagctag

SEQ ID NO: 7968 - DNA, 2700 bp, Artificial Sequence; identical to SEQ ID NO: 7525
  Description of Artificial Sequence: Synthetic coding sequence

SEQ ID NO: 7969 - DNA, 192 bp, Artificial Sequence; identical to SEQ ID NO: 7947
  Description of Artificial Sequence: Synthetic coding sequence

SEQ ID NO: 7970 - DNA, 489 bp, Artificial Sequence
  Description of Artificial Sequence: Synthetic coding sequence
gatgaggaccgctacaccacctgctggcccaagacctggctggccaaggactgcccagccctgcgcatcatctctgtggagtatgacaccagcctgagtgactggagggcccgctgccccatggagaggaagagcatcgccttccgcagcaatgagctgctgaggaagctgcgggccgccggcgtgggggacaggcctgtggtgtggatcagccacagcatgggcggcctgctggtgaagaagatgctgctggaggccagcaccaagccagagatgagcaccgtcatcaacaacacccggggcatcatcttctacagcgtgccccaccacggcagccggctggccgagtacagcgtgaacatccgctacctgctcttccccagcctggaggtgaaggagctgagcaagggcaacaccttctgccacaagggcaactggggctacatcaacatctcctacacagagaagaagaagaagttcctgccctag

SEQ ID NO: 7971 - DNA, 1083 bp, Artificial Sequence
  Description of Artificial Sequence: Synthetic coding sequence
atgcctgagctggtggtgacagccctgctggcccccagccggctgagcctgaagctgctgcgggccttcatgtggagcctggtgttttctgtggccctggtggccgctgctgtgtatggctgcatcgccctgacccacgtgctgtgccggccccggcggggctgctgcggcagaagaagaagtgccagccctgcctgcctgagtgaccccagcctgggggagcacggcttcctgaacctgaagagcagcggcctgcggctgcactacgtgtctgctggaagaggaaatggccccctgatgctgttcctgcacggcttccctgagaactggttctcctggagataccagctgcgggagttccagagccgcttccacgtggtggccgtggacctgcggggctacggccccagtgatgcccccagagatgtggactgctacaccatcgacctgctgctggtggacatcaaggatgtgatcctgggcctgggctacagcaagtgcatcctggtggcccatgactggggcgccctgctggcctggcacttcagcatctactaccccagcctggtggagaggatggtggtggtgtctggggcccccatgtctgtgtaccaggactacagcctgcaccacatcagccagttcttccgcagccactacatgttcctgttccagctgccctggctgcctgagaagctgctgtccatgtctgacttccagatcctgaagaccaccctgacccacaggaagacaggcatcccctgcctgaccccatctgagctggaggccttcctgtacaacttcagccagcccggcggcctgaccggccccctgaactactacagaaacctcttcaggaacttccccctggagccccaggagctgaccacccccaccctgctgctgtggggcgagaaggacacctacctggagctgggcctggtggaggccatcggcagcagatttgtgcccggccgcctggaggcccacatcctgcccggcatcggccactggatcccccagagcaacccccaggagatgcaccagtacatgtgggccttcctgcaggacctgctggactag

SEQ ID NO: 7972 - DNA, 678 bp, Artificial Sequence; identical to SEQ ID NO: 7810
  Description of Artificial Sequence: Synthetic coding sequence

SEQ ID NO: 7973 - DNA, 192 bp, Artificial Sequence; identical to SEQ ID NO: 6920
  Description of Artificial Sequence: Synthetic coding sequence

SEQ ID NO: 7974 - DNA, 5235 bp, Artificial Sequence; identical to SEQ ID NO: 7479
  Description of Artificial Sequence: Synthetic coding sequence

SEQ ID NO: 7975 - DNA, 792 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaaggagctgccccctacgtgcaggcctttgacagcctgctggccggccctgtggccgagtacctgaagatcagcaaggagattggaggagatgtgcagaagcacgccgagatggtgcacacaggcctgaagctggagcgggccctgctggtgacagccagccagtgccagcagcctgctgagaacaagctgagtgacctgctggcccccatcagcgagcagatcaaggaggtgatcaccttccgggagaagaacagaggcagcaagctgttcaaccacctgtctgctgtgtctgagagcatccaggccctgggctgggtggccatggcccccaagccaggcccctacgtgaaggagatgaatgatgctgccatgttctacaccaacagagtgctgaaggagtacaaggatgtggacaagaagcacgtggactgggtgaaggcctacctgagcatctggacagagctgcaggcctacatcaaggagttccacaccaccggcctggcctggagcaagacaggccctgtggccaaggagctgagcggcctgcccagcggccccagcgctggcagctgccccccacctcctccaccctgccccccacctcctcctgtgtccaccatcagctgcagctatgagagcgccagccgcagcagcctgtttgcccagatcaaccagggctag

SEQ ID NO: 7976 - DNA, 501 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctag

SEQ ID NO: 7977 - DNA, 2349 bp, Artificial Sequence
  Description of Artificial Sequence: Synthetic coding sequence
tccatcctgcgggtggaggccgtggatgctgactgcagcccccagttcagccagatctgcagctatgagatcatcaccccagatgtgcccttcaccgtggacaaggatggctacatcaagaacacagagaagctgaactacggcaaggagcaccagtacaagctgactgtgacagcctatgactgtgggaagaagagggccacagaagatgtgctggtgaagatcagcatcaagcccacctgcaccccaggctggcagggctggaacaaccgcatcgagtatgagcccggcaccggggccctggccgtgttccccaacatccacctggagacctgtgatgagcctgtggcctctgtgcaggccaccgtggagctggagaccagccacatcggcaagggctgtgaccgggacacctacagcgagaagagcctgcaccggctgtgtggggctgctgctggaacagctgagctgctgcccagccccagcggcagcctgaactggaccatgggcctgcccacagacaatggacatgacagcgaccaggtgtttgagttcaacggcacccaggccgtgcgcatcccagatggagtggtgtctgtgagccccaaggagcccttcaccatctctgtgtggatgagacatggcccctttggaaggaagaaggagaccatcctgtgcagcagtgacaagacagacatgaacagacaccactacagcctgtatgtgcacggctgccgcctcatcttcctgttccggcaggaccccagcgaggagaagaagtacagacctgctgagttccactggaagctgaaccaggtgtgtgatgaggagtggcaccactacgtgctgaatgtggagttccccagcgtgaccctgtatgtggatggcaccagccatgagcccttctctgtgacagaggactaccccctgcaccccagcaagattgagacccagctggtggtgggcgcctgctggcagggcggggacctgcacatgacccagttcttccggggcaacctggccggcctgaccctgcggagcggcaagctggccgacaagaaggtgattgactgcctgtacacctgcaaggagggcctggacctgcaggtgctggaggacagcggccggggcgtgcagatccaggcccaccccagccagctggtgctgaccctggagggggaggacctgggggagctggacaaggccatgcagcacatctcctacctgaacagccggcagttccccaccccaggcatccggcggctgaagatcaccagcaccatcaagtgcttcaatgaggccacctgcatctctgtgccccctgtggatggctacgtgatggtgctgcagcctgaggagcccaagatcagcctgtctggagtgcaccactttgcccgggccgccagcgagtttgagagcagcgagggcgtcttcctgtttcctgagctgcgcatcatcagcaccatcacccgggaggtggagccagaaggagatggagctgaggaccccaccgtgcaggagagcctggtgtctgaggagatcgtgcatgacctggacacctgtgaggtgacagtggagggggaggagctgaaccacgagcaggagagcctggaggtggacatggcccggctgcagcagaagggcatcgaggtgagcagcagcgagctgggcatgaccttcaccggggtggacaccatggccagctatgaggaggtgctgcacctgctgcgctacagaaactggcacgcccggagcctgctggacaggaagttcaagctgatctgcagcgagctgaatggccgctacatcagcaatgagttcaaggtggaggtgaatgtcatccacacagccaaccccatggagcacgccaaccacatggccgcccagccccagtttgtgcaccctgagcacaggagctttgtggacctgagcggccacaacctggccaacccccacccctttgctgtggtgcccagcacagccaccgtggtgattgtggtgtgtgtgtccttcctggtgttcatgatcatcctgggcgtcttccgcatccgggccgcccacaggaggaccatgagggaccaggacaccgggaaggaaaatgagatggactgggatgattctgccctgaccatcaccgtgaaccccatggagacctatgaggaccagcacagcagcgaggaggaggaggaggaggaggaggaggaggagagtgaagatggagaggaggaggatgacatcaccagcgctgagagcgagagcagcgaggaggaggagggggagcagggcgacccccagaatgccacccggcagcagcagctggagtgggatgacagcaccctgagctactag

SEQ ID NO: 7978 - DNA, 531 bp, Artificial Sequence
  Description of Artificial Sequence: Synthetic coding sequence
atggcccggcggcactgcttctcctactggctgctggtgtgctggctggtggtgacagtggccgaggccctgagcaccttctacctgcagcagcacatcaacctgcacatggacaagaagcgctacctgcggctgctggagatccacaagatcatgaggaccctgcccacagcccggagcctgcacagccccctgcacctgccccggggcgtgcgcagccagggccccagccccagccagaggcaccctggggtgcccagcatcttcttccacgagggccctgagagcatcctgggcttccagacagacctgagcagcctgcagggcgtgaccaccgtcttccacagcagccacttcatcggccacacagtgaccctgctgattggcatcagccctgaggaggacagccgggaggaggcccacctgaggaaggccgagcgggaggagaagcccaagcacacagaggccaagaagagcctgtccttcaggaagaagcagcagaaggacttctgcttcatcttcagaaattag

SEQ ID NO: 7979 - DNA, 1182 bp, Artificial Sequence; identical to SEQ ID NO: 7135
  Description of Artificial Sequence: Synthetic coding sequence

SEQ ID NO: 7980 - DNA, 324 bp, Artificial Sequence
  Description of Artificial Sequence: Synthetic coding sequence
atgctgccctgcctggccctgctgctgctgatggagctgtctgtgtgcaccgtggccggagatggaggagaggagcagaccctgagcacagaggccgagacctgggagggcgccggccccagcatccagctgcagctgcaggaggtgaagacaggcaaggccagccagttcttcggcctgatgggcaagagggtgggcggccggcccctcatccagcccaggaggaagaaggcctaccagctggagcacaccttccagggcctgctgggcaagaggagcctcttcacagagggccgggaggatgaggcccagggcagcgagtag

SEQ ID NO: 7981 - DNA, 1086 bp, Artificial Sequence
  Description of Artificial Sequence: Synthetic coding sequence
atgggcatcatccagagcatcctggccaccagccgggactgctacagcttcaagaagaagcccatccccaagaagcccaccatgctggccctggccaagatcctgctgatcagcaccctcttctacagcctgctgagcggcagccacggcaaggagaaccaggacatcaacaccacccagaacattgctgaggtgttcaagaccatggagaacaagcccatcagcctggagagcgaggccaacctgaacagcgacaaggagaacatcaccaccagcaacctgaaggccagccacagcccccccctgaacctgcccaacaacagccacggcatcacagacttcagcagcaacagcagcgctgagcacagcctgggcagcctgaagcccaccagcaccatcagcaccagccccccactcatccacagctttgtgtccaaggtgccctggaatgcccccatcgcagatgaggacctgctgcccatcagcgcccaccccaatgccaccccagccctgagcagcgagaacttcacctggagcctggtgaatgacacagtgaagaccccagacaacagcagcatcaccgtgtccatcctgagcagcgagcccaccagccccagcgtgacccccctgattgtggagcccagcggctggctgaccaccaacagcgacagcttcaccggcttcaccccctaccaggagaagaccaccctgcagcccaccctgaagttcaccaacaacagcaagctgttccccaacaccagtgacccccagaaggaaaatagaaatactggaattgtgtttggagccatcctgggcgccatcctgggcgtgtccctgctgaccctggtgggctacctgctgtgtgggaagaggaagacagacagcttcagccaccggcggctgtatgatgacagaaatgaacctgtgctgcggctggacaatgcccctgagccctatgatgtgtcctttggaaacagcagctactacaaccccaccctgaatgacagcgccatgcctgagagtgaagaaaatgccagagatggcatccccatggatgacatcccccccctgcggacctctgtgtag

SEQ ID NO: 7982 - DNA, 279 bp, Artificial Sequence
  Description of Artificial Sequence: Synthetic coding sequence
atgaggggccctggccaccccctgctgctgggcctgctgctggtgctgggccccagccctgagcagagggtggagatcgtgccccgggacctgaggatgaaggacaagttcctgaagcacctgaccggccccctgtacttcagccccaagtgcagcaagcacttccaccggctgtaccacaacacccgggactgcaccatcccagcctactacaagagatgtgcccggctgctgacccggctggccgtgtcccctgtgtgcatggaggacaagcagtag

SEQ ID NO: 7983 - DNA, 1125 bp, Artificial Sequence
  Description of Artificial Sequence: Synthetic coding sequence
tgaagagtgcggcggggccccctgcctgctgaccggccccgggccctgggccctgcccggcgctgcagccgccacccccacccagcccccttccgggtgtgcagcgagggcgccgcccaccggctgcggcggcctgagcggctgcccctgcccagccgggccctgcggcccaggcctgcccacacccccatcctgggccctgccccccgggcctgccctggggccccccgggccagtgacagccccacctgtgccgctgctgctgccacagcctggcccaggaccagggctgtggagaggaagggctgccaggtggccgctgctgctggggtgcggggcaccggctgccccagcagagctgacctggagaaggacagctggaatgacaccaaggaggatgtgtttgtgcaccagacagccatcaagaagaacaaccccaggaagtacctgcggtctgtgggagatggagagaccgtggagtttgatgtggtggagggggagaagggagctgaggccgccaacgtgacaggccctgggggcgtgcctgtgcagggcagcaaatatgctgctgacaggaaccactaccgccgctaccccaggagaagaggcccccccaggaactaccagcagaactaccagaacagcgagagcggggagaagaatgaaggcagcgagagcgcccctgagggccaggcccagcagaggcggccctacagaagaagacgcttccccccctactacatgagaagaccctacggccggcggccccagtacagcaacccccctgtgcagggcgaggtgatggagggcgctgacaaccagggcgctggggagcagggccggcctgtgcggcagaacatgtaccggggctaccggccccgcttccggcggggccccccccggcagaggcagcccagagaagatggaaatgaggaggacaaggagaaccagggagatgagacccagggccagcagcccccccagaggcgctacagaagaaacttcaactacagaagaagaagacctgagaaccccaagccccaggacggcaaggagaccaaggctgctgaccccccagctgagaacagcagcgcccctgaggccgagcagggcggcgctgagtag

SEQ ID NO: 7984 - DNA, 420 bp, Artificial Sequence
  Description of Artificial Sequence: Synthetic coding sequence
atggccctgaggatgctgtgggccggccaggccaagggcatcctgggcggctggggcatcatctgcctggtgatgagcctgctgctgcagcaccctggggtgtacagcaagtgctacttccaggcccaggccccctgccactatgagggcaagtacttcaccctgggggagagctggctgaggaaggactgcttccactgcacctgcctgcaccctgtgggcgtgggctgctgtgacaccagccagcaccccatcgacttccctgctggctgtgaggtgcggcaggaggccggcacctgccagttcagcctggtgcagaagagtgacccccggctgccctgcaagggcggcggccctgaccctgagtggggcagcgccaacacccctgtgcctggggccccagccccccacagcagctag

SEQ ID NO: 7985 - DNA, 462 bp, Artificial Sequence
  Description of Artificial Sequence: Synthetic coding sequence
cactactgcaaggagggctactacagagacatgggcaagcccatcacccacaggaaggcctgcaaggcctgtgactgccaccctgtgggcgccgccggcaagacctgcaaccagaccaccggccagtgcccctgcaaggatggagtgacaggcatcacctgcaacagatgtgccaagggctaccagcagagccgcagccccatcgccccctgcatcaagatccctgtggccccacccaccacagctgccagctctgtggaggagcctgaggccgcccggcagcccaacaccttccaggccgagggcctgagcctgctgcctggagctgctgagaaggagggcgcccgctgctggggctacagaagaaggctgggccaccgggtggcccaggccgagtgccggggccccaggtcctgggcctggggccgcatcaccagcagcttctcctttgccagcaactag

SEQ ID NO: 7986 - DNA, 213 bp, Artificial Sequence
  Description of Artificial Sequence: Synthetic coding sequence
atgctggtgctcttcctgctgggcaccgtcttcctgctgtgcccctactggggcgagctgcatgaccccatcaagggccagagcatgtaccactacagcaagctgagctgcatgaccagctgtgaggacatcaacttcctgggcttcaccaagagggtggagctgatctgctgtgaccacagcaactactgcaacctgcctgagggcgtgtag

SEQ ID NO: 7987 - DNA, 567 bp, Artificial Sequence; identical to SEQ ID NO: 7502
  Description of Artificial Sequence: Synthetic coding sequence

SEQ ID NO: 7988 - DNA, 2316 bp, Artificial Sequence; identical to SEQ ID NO: 6949
  Description of Artificial Sequence: Synthetic coding sequence

SEQ ID NO: 7989 - DNA, 1014 bp, Artificial Sequence
  Description of Artificial Sequence: Synthetic coding sequence
atggcccggcccatgatcaaggaggccaggatggccagcctgctgctggagaacccctactacggctgcaggaagcccaaggaccaggtgcgcagcagcctgaagaatgtgtctgacctgtttgtgatgggcggggccctggtgctggagagcgctgccctgctgcactggctggagcgggagggctacggccccctgggcatgacaggcatctccatgggcggccacatggccagcctggccgtgagcaactggcccaagcccatgcccctcatcccctgcctgtcctggagcacagccagcggggtcttcaccaccggggtgctgagcaagagcatcaactggagggagctggagaagcagtactacacccagacagtgtatgaggaggagatcatccacatgctggagtactgcggcacagacagcttcaagatgggccaggagtttgtgaagcacttcaccagcagcgctgacaagctgaccaacctgaacctggtgtccaggaccctgaacctggacatcagcaaccaggtggtgtcccagaagccagctgactgccacaacagcagcaagacctctgtgtctgccaccagcgagggcctgctgctgcaggacaccagcaagatgaagcgcttcaaccagaccctgagcaccaacaagagcggctacaccagcaggaacccccagagctaccacctgctgagcaaggagcagagcaggaacagcctgaggaaggagagcctcatcttcatgaagggcgtgatggatgagtgcacccacgtggccaacttctctgtgcctgtggaccccagcctcatcatcgtggtgcaggccaaggaggatgcctacatccccaggactggagtgcgcagcctgcaggagatctggccaggctgtgagatccgctacctggagggcggccacatcagcgcctacctgttcaagcagggcctcttccggcaggccatctatgatgcctttgaccgcttcctgcacaagtatgccaactag

SEQ ID NO: 7990 - DNA, 462 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaagtag

SEQ ID NO: 7991 - DNA, 345 bp, Artificial Sequence
  Description of Artificial Sequence: Synthetic coding sequence
atggacaagagcctgctgctggagctgcccatcctgctgtgctgcttccgggccctgagcggcagcctgtccatgagaaatgatgctgtgattgaaattgtgcagtgcaggatgtgccacctgcagtttcctggagagaagtgcagccggggccggggcatctgcacagccaccacagaggaggcctgcatggtgggccgcatgttcaagagagatggcaacccctggctgaccttcatgggctgcctgaagaactgtgctgatgtgaagggcatccgctggagcgtgtacctggtgaacttccgctgctgccgcagccatgacctgtgcaatgaagacctgtag

SEQ ID NO: 7992 - DNA, 630 bp, Artificial Sequence; identical to SEQ ID NO: 7859
  Description of Artificial Sequence: Synthetic coding sequence

SEQ ID NO: 7993 - DNA, 639 bp, Artificial Sequence
  Description of Artificial Sequence: Synthetic coding sequence
gactttggctactgcccccgggtgtactgtgagaaccagcccatgctgcccatcggcgtgctggtgatggtgggcttcaccgtgggcaaggtgcctgtgcctgacatccgcacctgccacttctgcctggtggaggaccccagcgtgggctgcatcagcggcagcgagaagtgcaccatcagcagcagcagcctgtgcatggtgatcaccatctactatgatgtgaaggtgcgcttcatcgtgcggggctgcggccagtacatctcctaccgctgccaggagaagaggaacacctactttgctgagtactggtaccaggcccagtgctgccagtatgactactgcaacagctggagcagcccccagctgcagagcagcctgcctgagccccatgaccggcccctggccctgcccctgagtgacagccagatccagtggttctaccaggccctgaacctgagcctgcccctgcccaacttccacgccggcacagagccagatggcctggaccccatggtgaccctgagcctgaacctgggcctgagctttgctgagctgcggaggatgtacctgttcctgaacagcagcggcctgctggtgctgccccaggccggcctgctgaccccccaccccagctag

SEQ ID NO: 7994 - DNA, 240 bp, Artificial Sequence; identical to SEQ ID NO: 7750
  Description of Artificial Sequence: Synthetic coding sequence

SEQ ID NO: 7995 - DNA, 1620 bp, Artificial Sequence
  Description of Artificial Sequence: Synthetic coding sequence
atgtctgagccccaggagaagaagctgtctgaaaatacagacttcctggcccctggggtgagcagcttcacagacagcaaccagcaggagagcatcaccaagcgggaggagaaccaggagcagcccaggaactacagccaccaccagctgaacagaagcagcaagcacagccagggcctgcgggaccagggcaaccaggagcaggaccccaacatcagcaatggagaggaggaggaggagaaggagcctggagaggtgggcacccacaatgacaaccaggagaggaagacagagctgccccgggagcacgccaacagcaagcaggaggaggacaacacccagagtgatgacatcctggaggagagtgaccagcccacccaggtgtccaagatgcaggaggatgaatttgaccagggcaaccaggagcaggaggacaacagcaatgctgagatggaggaggagaatgccagcaatgtgaacaagcacatccaggagacagagtggcagagccaggagggcaagacaggcctggaggccatcagcaaccacaaggagacagaggagaagacagtgtctgaggccctgctgatggagcccacagatgatggcaacaccacccccaggaaccacggcgtggatgatgatggagatgatgatggagatgatggcggcacagatggccccaggcacagcgccagtgatgactacttcatccccagccaggccttcctggaggccgagcgggcccagagcatcgcctaccacctgaagattgaggagcagcgggagaaggtgcatgaaaatgaaaatattggcaccacagagcccggggagcaccaggaggccaagaaggccgagaacagcagcaatgaggaggagaccagcagcgagggcaacatgagggtgcatgctgtggacagctgcatgtccttccagtgcaagaggggccacatctgcaaggctgaccagcagggcaagccccactgtgtgtgccaggaccctgtgacctgcccccccaccaagcccctggaccaggtgtgtggcacagacaaccagacctacgccagcagctgccacctgtttgccaccaagtgccgcctggagggcaccaagaagggccaccagctgcagctggactactttggagcctgcaagagcatccccacctgcacagactttgaagtcatccagttccccctgaggatgagggactggctgaagaacatcctgatgcagctgtatgaggccaacagcgagcacgccggctacctgaatgagaagcagaggaacaaggtgaagaagatctacctggatgagaagaggctgctggccggggaccaccccatcgacctgctgctgcgggacttcaagaagaactaccacatgtatgtgtaccctgtgcactggcagttcagcgagctggaccagcaccccatggacagagtgctgacccacagcgagctggcccccctgcgggccagcctggtgcccatggagcactgcatcacccgcttctttgaggagtgtgaccccaacaaggacaagcacatcaccctgaaggagtggggccactgcttcggcatcaaggaggaggacattgatgagaacctgctcttctag

SEQ ID NO: 7996 - DNA, 2535 bp, Artificial Sequence; identical to SEQ ID NO: 7302
  Description of Artificial Sequence: Synthetic coding sequence

SEQ ID NO: 7997 - DNA, 993 bp, Artificial Sequence
  Description of Artificial Sequence: Synthetic coding sequence
atgcagctgttcctgctgctgtgcctggtgctgctgagcccccagggcgccagcctgcaccgccaccacccccgggagatgaagaagagggtggaggacctgcacgtgggcgccaccgtggcccccagcagcagaagagacttcacctttgacctgctgggcaatgccctcttcacagacctggtggtggacctgcaggacacctttgtgtctgccatgaagaccctgtacctggccgacaccttccccaccaacttccgggacagcgctggggccatgaagcagatcaatgactatgtggccaagcagaccaagggcaagatcgtggacctgctgaagaacctggacagcaatgctgtggtgatcatggtgaactacatcttcttcaaggccaagtgggagaccagcttcaaccacaagggcacccaggagcaggacttctacgtgaccagcgagaccgtggtgcgggtgcccatgatgagccgggaggaccagtaccactacctgctggacaggaacctgagctgccgggtggtgggcgtgccctaccagggcaatgccacagccctcttcatcctgcccagcgagggcaagatgcagcaggtggagaatggcctgtctgagaagaccctgaggaagtggctgaagatgttcaagaagaggcagctggagctgtacctgcccaagttcagcattgagggcagctaccagctggagaaggtgctgcccagcctgggcatcagcaatgtgttcaccagccatgctgacctgagcggcatcagcaaccacagcaacatccaggtgtctgagatggtgcacaaggctgtggtggaggtggatgagagcggcaccagggctgctgctgccaccggcaccatcttcaccttccgcagcgcccggctgaacagccagaggctggtgttcaaccggcccttcctgatgttcatcgtggacaacaacatcctcttcctgggcaaggtgaaccggccctag

SEQ ID NO: 7998 - DNA, 2676 bp, Artificial Sequence; identical to SEQ ID NO: 7495
  Description of Artificial Sequence: Synthetic coding sequence

SEQ ID NO: 7999 - DNA, 708 bp, Artificial Sequence; identical to SEQ ID NO: 7281
  Description of Artificial Sequence: Synthetic coding sequence

SEQ ID NO: 8000 - DNA, 1386 bp, Artificial Sequence; identical to SEQ ID NO: 7292
  Description of Artificial Sequence: Synthetic coding sequence

SEQ ID NO: 8001 - DNA, 2676 bp, Artificial Sequence; identical to SEQ ID NO: 7495
  Description of Artificial Sequence: Synthetic coding sequence

SEQ ID NO: 8002 - DNA, 501 bp, Artificial Sequence; identical to SEQ ID NO: 7976
  Description of Artificial Sequence: Synthetic coding sequence

SEQ ID NO: 8003 - DNA, 420 bp, Artificial Sequence
  Description of Artificial Sequence: Synthetic coding sequence
atgcaggccgcctgctggtacgtgctcttcctgctgcagcccaccgtgtacctggtgacctgtgccaacctgaccaacggcggcaagtctgagctgctgaagagcggcagcagcaagagcaccctgaagcacatctggacagagagcagcaaggacctgagcatcagccggctgctgagccagaccttccggggcaaggaaaatgacacagacctggacctgcgctatgacaccccagagccctacagcgagcaggacctgtgggactggctgaggaacagcacagacctgcaggagccccggccccgggccaagaggcggcccatcgtgaagacaggcaagttcaagaagatgtttggctggggagacttccacagcaacatcaagacagtgaagctgaacctgctgatcaccggctag

SEQ ID NO: 8004 - DNA, 2412 bp, Artificial Sequence
  Description of Artificial Sequence: Synthetic coding sequence
atggctgctgctggcctggtggccgtggccgctgctgctgagtacagcggcaccgtggccagcggcggcaacctgcccggggtgcactgcggccccagcagcggggccggccctggcttcggccctggctcctggagccgcagcctggaccgggccctggaggaggccgctgtgactggagtgctgagcctgagcggcaggaagctgcgggagttccccaggggggccgccaaccacgacctgacagacaccaccagggctgacctgagcaggaaccggctgtctgagatccccatcgaggcctgccactttgtgtccctggagaacctgaacctgtaccagaactgcatccgctacatccctgaggccatcctgaacctgcaggccctgaccttcctgaacatcagcaggaaccagctgagcaccctgcctgtgcacctgtgcaacctgcccctgaaggtgctgattgccagcaacaacaagctggtgtccctgcctgaggagatcggccacctgcggcacctgatggagctggatgtgtcctgcaatgagatccagaccatccccagccagatcggcaacctggaggccctgcgggacctgaatgtgagaagaaaccacctggtgcacctgcctgaggagctggccgagctgcccctcatccggctggacttcagctgcaacaagatcaccaccatccctgtgtgctacagaaacctgcggcacctgcagaccatcaccctggacaacaaccccctgcagagccccccagcccagatctgcatcaagggcaaggtgcacatcttcaagtacctgaacatccaggcctgcaagatcgccccagacctgcctgactatgaccggcggcccctgggcttcggcagctgccacgaggagctgtacagcagccggccctacggggccctggacagcggcttcaacagcgtggacagcggggacaagcgctggagcggaaatgagcccacagatgagttcagtgacctgcccctgcgggtggccgagatcaccaaggagcagaggctgcggcgggagagccagtaccaggagaacagaggcagcctggtggtgaccaatggaggagtggagcatgacctggaccagattgactacatcgacagctgcacagctgaggaggaggaggccgaggtgcggcagcccaagggccctgaccctgacagcctgagcagccagttcatggcctacatcgagcagaggcgcatcagccatgagggcagccctgtgaagcctgtggccatccgggagttccagaagacagaggacatgaggcgctacctgcaccagaacagagtgcctgctgagcccagcagcctgctgagcctgagcgccagccacaaccagctgagccacacagacctggagctgcaccagaggcgggagcagctggtggagaggacccggcgggaggcccagctggccgccctgcagtatgaggaggagaagatccgcaccaagcagatccagagagatgctgtgctggactttgtgaagcagaaggccagccagagcccccagaagcagcaccccctgctggatggagtggatggagagtgccccttccccagccgccgcagccagcacacagatgacagcgccctgtgcatgagcctgagcggcctgaaccaggtgggctgtgccgccaccctgccccacagcagcgccttcacccccctgaagagtgatgaccggcccaatgccctgctgagcagccctgccacagagaccgtgcaccacagccctgcctacagcttccctgctgccatccagaggaaccagccccagaggcctgagagcttcctgttccgggccggcgtgcgggcagagaccaacaagggccacgccagccccctgcccccatctgctgcccccaccacagacagcacagacagcatcaccggccagaacagccggcagcgggaggaggagctggagctgattgaccagctgaggaagcacatcgagtaccgcctgaaggtgtccctgccctgtgacctgggcgccgccctgacagatggagtggtgctgtgccacctggccaaccacgtgcggcccaggtctgtgcccagcatccacgtgcccagccctgctgtgcccaagctgaccatggccaagtgcagaagaaatgtggagaacttcctggaggcctgcaggaagattggagtgccccaggacaacctgtgcagccccagcgacatcctgcagctgaacctgtctgtgaagaggacagtggagaccctgctgagcctgggcgcccacagcgaggagagcagctttgtgtgcctgagcctgcagctgctgggctttgtggccttctactgcaccgtgatgctgaccctgtgtgtgctgtactactggctgtttcctgccaggtag

SEQ ID NO: 8005 - DNA, 633 bp, Artificial Sequence
  Description of Artificial Sequence: Synthetic coding sequence
atgtacaaggcccggcccccagctggcagcggcggccctggagctgagcccccagccatggccgccccccggggccgggccgccccctggaccacagccctgctgctgctgctggccagccaggtgctgagccctggcagctgtgctgatgaggaggaggtgcctgaggagtgggtgctgctgcacgtggtgcagggccagatcggggccggcaactacagctacctgcggctgaaccacgagggcaagatcgtgctgaggatgaggagcctgaagggagatgctgacctgtatgtgtctgccagcagcctgcaccccagctttgatgattatgagctgcagagcgccacctgtggcccagatgctgtgtccatcccagcccacttccggcggcctgtgggcattggagtgtatggccaccccagccacctggagagcgagtttgagatgaaggtgtactatgatggcaccgtggagcagcacccctttggagaggccgcctacccagcagatggagcagatgctggccagaagcacgccggggccccagaagatgccagccaggaggaggagagcgtgctgtggaccatcctgatcagcatcctgaagctggtgctggagatcctcttctag

SEQ ID NO: 8006 - DNA, 486 bp, Artificial Sequence
  Description of Artificial Sequence: Synthetic coding sequence
tgatgccccacagagatcatcgcctttggagaccggctggaggagttccgcagcatcaacacagaggtggtggcctgcagcgtggacagccagttcacccacctggcctggatcaacaccccccggcggcagggcggcctgggccccatccgcatccccctgctgagtgacctgacccaccagatcagcaaggactatggagtgtacctggaggacagcggccacaccctgcggggcctcttcatcattgatgacaagggcatcctgcggcagatcaccctgaatgacctgcctgtgggccgctctgtggatgagaccctgcggctggtgcaggccttccagtacacagacaagcatggagaggtgtgcccagctggctggaagccaggcagcgagaccatcaagccagaggacaccatgaaggcctggtggccccgggagagctacaaccccaggagctcctggaaggccgaggtgttcagatag

SEQ ID NO: 8007 - DNA, 2886 bp, Artificial Sequence; identical to SEQ ID NO: 7526
  Description of Artificial Sequence: Synthetic coding sequence

SEQ ID NO: 8008 - DNA, 2853 bp, Artificial Sequence
  Description of Artificial Sequence: Synthetic coding sequence
atgacctggaggatgggcccccgcttcaccatgctgctggccatgtggctggtgtgtggcagcgagccccacccccacgccaccatccggggcagccatggaggcaggaaggtgcccctggtgtccccagacagcagcaggcctgcccgcttcctgcggcacacaggccgcagccggggcatcgagaggagcaccctggaggagcccaacctgcagcccctgcagaggagaagatctgtgcctgtgctgcggctggcccggcccacagagcccccagcccggagtgacatcaacggggctgctgtgcggcctgagcagaggcctgctgcccggggcagcccccgggagatgatcagagatgagggcagcagcgcccggagcaggatgctgcgcttccccagcggcagcagcagccccaacatcctggccagctttgctgggaagaacagagtgtgggtgatcagcgccccccacgccagcgagggctactaccgcctgatgatgagcctgctgaaggatgatgtgtactgtgagctggccgagcggcacatccagcagatcgtgctcttccaccaggccggggaggagggcggcaaggtgcggcgcatcaccagcgagggccagatcctggagcagcccctggaccccagcctcatccccaagctgatgtccttcctgaagctggagaagggcaagtttggcatggtgctgctgaagaagaccctgcaggtggaggagcgctacccctaccctgtgcggctggaggccatgtatgaggtgattgaccagggccccatcagaagaattgagaagatccggcagaagggctttgtgcagaagtgcaaggccagcggcgtggagggccaggtggtggccgagggcaatgatggcggcggcggggccggccggcccagcctgggcagcgagaagaagaaggaggacccccggcgggcccaggtgccccccacccgggagagccgggtgaaggtgctgaggaagctggccgccacagccccagccctgccccagccccccagcaccccccgggccaccaccctgcccccagccccagccaccaccgtgaccaggagcaccagcagagctgtgacagtggccgcccggcccatgaccaccacagccttccccaccacccagaggccctggacccccagccccagccaccggccccccaccaccacagaggtgatcacagcccggcggcccagcgtgtctgagaacctgtacccacccagcaggaaggaccagcaccgggagcggccccagaccacccggcggcccagcaaggccaccagcctggagagcttcaccaatgccccacccaccaccatcagcgagcccagcaccagggctgctggccctggccgcttccgggacaacaggatggaccggcgggagcacggccaccgggaccccaacgtggtgcccggcccccccaagccagccaaggagaagccacccaagaagaaggcccaggacaagatcctgagcaatgaatatgaggagaagtatgacctgagccggcccacagccagccagctggaggatgagctgcaggtgggcaatgtgcccctgaagaaggccaaggagagcaagaagcatgagaagctggagaagccagagaaggagaagaagaagaagatgaagaatgaaaatgctgacaagctgctgaagtctgagaagcagatgaagaagtctgagaagaagagcaagcaggagaaggagaagagcaagaagaagaagggcggcaagacagagcaggacggctaccagaagcccaccaacaagcacttcacccagagccccaagaagtctgtggccgacctgctgggcagctttgagggcaagaggcggctgctgctgatcacagcccccaaggccgagaacaacatgtatgtgcagcagagagatgagtacctggagagcttctgcaagatggccaccaggaagatcagcgtcatcaccatctttggacctgtgaacaacagcaccatgaagattgaccacttccagctggacaatgagaagcccatgagggtggtggatgatgaggacctggtggaccagaggctcatcagcgagctgaggaaggagtatggcatgacctacaatgacttcttcatggtgctgacagatgtggacctgcgggtgaagcagtactatgaggtgcccatcaccatgaagtctgtgtttgacctgattgacaccttccagagccgcatcaaggacatggagaagcagaagaaggagggcatcgtgtgcaaggaggacaagaagcagagcctggagaacttcctgagccgcttccgctggaggcggcggctgctggtgatcagcgccccaaatgatgaggactgggcctacagccagcagctgagcgccctgagcggccaggcctgcaactttggcctgcggcacatcaccatcctgaagctgctgggcgtgggggaggaggtgggcggcgtgctggagctgttccccatcaatggcagctctgtggtggagagagaagatgtgcctgcccacctggtgaaggacatccggaactacttccaggtgtccccagagtacttctccatgctgctggtgggcaaggatggaaatgtgaagtcctggtaccccagccccatgtggagcatggtgattgtgtatgacctgattgacagcatgcagctgcggcggcaggagatggccatccagcagagcctgggcatgcgctgcccagaagatgaatatgccggctacggctaccacagctaccaccagggctaccaggacggctaccaggatgactaccgccaccacgagagctaccaccacggctacccctactag

SEQ ID NO: 8009 - DNA, 351 bp, Artificial Sequence; identical to SEQ ID NO: 7504
  Description of Artificial Sequence: Synthetic coding sequence

SEQ ID NO: 8010 - DNA, 1251 bp, Artificial Sequence
  Description of Artificial Sequence: Synthetic coding sequence
atgaagttccagggccccctggcctgcctgctgctggccctgtgcctgggcagcggggaggccggccccctgcagagcggggaggagagcacaggcaccaacattggagaggccctgggccacggcctgggagatgccctgtctgagggcgtgggcaaggccatcggcaaggaggccggcggcgctgctggcagcaaggtgtctgaggccctgggccagggcacccgggaggccgtgggcactggagtgcggcaggtgcccggctttggagtggctgatgccctgggcaacagagtgggggaggccgcccacgccctgggcaacacaggccatgaaattggccggcaggccgaggatgtgatcagacatggagcagatgctgtgcggggctcctggcagggcgtgcccggccacaatggagcctgggagaccagcggcggccacggcatcttcggcagccagggcggcctgggcggccagggccagggcaaccctgggggcctgggcaccccctgggtgcacggctacccaggcaacagcgctggcagctttggcatgaacccccagggcgccccctggggccagggcggcaatggaggcccccccaactttggcaccaacacccagggcgctgtggcccagcccggctacggctctgtgcgggccagcaaccagaatgaaggctgcaccaaccccccaccttctggcagcggcggcggcagcagcaacagcggcggcggcagcggcagccagagcggcagcagcggcagcggcagcaatggagacaacaacaacggcagcagcagcggcggcagcagcagcggcagcagcagcggcggcagcagcggcggcagcagcggcggcagcagcggcaacagcggcggcagcagaggagacagcggcagcgagagctcctggggcagcagcacaggcagcagcagcggcaaccacggcggcagcggcggcggcaatggccacaagccaggctgtgagaagccaggaaatgaggcccggggcagcggggagagcggcatccagggcttccggggccagggcgtgagcagcaacatgagggagatcagcaaggagggcaaccggctgctgggcggcagcggggacaactacagaaacagcgagaccagccctggcatgttcaactttgacaccttctggaagaacttcaagagcaagctgggcttcatcaactgggatgccatcaacaaggaccagaggagcagccgcatcccctag

SEQ ID NO: 8011 - DNA, 933 bp, Artificial Sequence
  Description of Artificial Sequence: Synthetic coding sequence
atggtggacaaggacacagagcgggacatcgagatgaagaggcagctgcggcggctgcgggagctgcacctgtacagcacctggaagaagtaccaggaggccatgaagaccagcctgggcgtgccccagtgtgaaagagatgagggcagcctgggcaagcccctgtgccccccagagatcctgtctgagaccctgcccggctctgtgaagaagagggtgtgcttccccagcgaggaccacctggaggagttcatcgccgagcacctgcctgaggccagcaaccagagcctgctgactgtggcccatgctgatgctggcacccagaccaacggggacctggaggacctggaggagcacggccctggccagacagtgtctgaggaggccacagaggtgcacaccatggagggggaccctgacaccctggccgagttcctgatcagagatgtgctgcaggagctgagcagctacaacggggaggaggaggaccctgaggaggtgaagaccagcctgggcgtgccccagagaggagacctggaggacctggaggagcacgtgcccggccagacagtgtctgaggaggccaccggggtgcacatgatgcaggtggaccctgccaccctggccaagagtgacctggaggacctggaggagcacgtgcctgagcagacagtgtctgaggaggccaccggggtgcacatgatgcaggtggaccctgccaccctggccaagcagctggaggacagcaccatcaccggcagccaccagcagatgtctgccagccccagcagcgccccagctgaggaggccacagagaagaccaaggtggaggaggaggtgaagaccaggaagcccaagaagaagaccaggaagcccagcaagaagagccgctggaatgtgctgaagtgctgggacatcttcaacatcttctag

SEQ ID NO: 8012 - DNA, 150 bp, Artificial Sequence
  Description of Artificial Sequence: Synthetic coding sequence
atggcccctccttctgtgcccctggtgctgctgctggtgctgctgctgagcctggccgagaccccagccagcgccccagcccacaggagcagcaccttccccaagtgggtgaccaagacagagcggggccggcagcccctgcggagctag

SEQ ID NO: 8013 - DNA, 978 bp, Artificial Sequence; identical to SEQ ID NO: 6924
  Description of Artificial Sequence: Synthetic coding sequence

SEQ ID NO: 8014 - DNA, 390 bp, Artificial Sequence; identical to SEQ ID NO: 7503
  Description of Artificial Sequence: Synthetic coding sequence

SEQ ID NO: 8015 - DNA, 1056 bp, Artificial Sequence
  Description of Artificial Sequence: Synthetic coding sequence
atggccggcatccctggcctgctcttcctgctcttcttcctgctgtgtgctgtgggccaggtgagcccctacagcgccccctggaagcccacctggccagcctaccgcctgcctgtggtgctgccccagagcaccctgaacctggccaagcagtacctgtcctatgagaccctgtatgccaacggcagcaggacagagacccaggtgggcatctacatcctgagcagcagtggagatggagcccagcaccgggacagcggcagcagcggcaagagcaggaggaagaggcagatctacggctatgacagccgcttcagcatctttgggaaggacttcctgctgaactaccccttcagcacctctgtgaagctgagcacaggctgcaccggcaccctggtggccgagaagcacgtgctgacagctgcccactgcatccatgatggcaagacctacgtgaagggcacccagaagctgcgggtgggcttcctgaagcccaagttcaaggatggcggccgcggggccaatgacagcaccagcgccatgcctgagcagatgaagttccagtggatccgggtgaagaggacccacgtgcccaagggctggatcaagggaaatgccaatgacatcggcatggactatgactatgccctgctggagctgaagaagccccacaagaggaagttcatgaagattggagtgtccccaccagccaagcagctgcccggcggccgcatccacttcagcggctatgacaatgacaggcctggcaacctggtgtaccgcttctgtgatgtgaaggatgagacctatgacctgctgtaccagcagtgtgatgcccagcccggggccagcggcagcggcgtgtatgtgaggatgtggaagaggcagcagcagaagtgggagaggaagatcatcggcatcttcagcggccaccagtgggtggacatgaatggcagcccccaggacttcaacgtggccgtgcgcatcacccccctgaagtatgcccagatctgctactggatcaagggcaactacctggactgccgggagggctag

SEQ ID NO: 8016 - DNA, 345 bp, Artificial Sequence
  Description of Artificial Sequence: Synthetic coding sequence
atggagagaggagctggggccaagctgctgcccctgctgctgctgctgcgggccaccggcttcacctgtgcccagacagatggaagaaatggctacacagctgtgattgaggtgaccagcggcggcccctggggagactgggcctggccagagatgtgcccagatggcttctttgccagcggcttcagcctgaaggtggagcccccccagggcatccctggagatgacacagccctgaatggcatccggctgcactgtgcccggggaaatgtgctgggcaacacccacgtggtggagagccagagcggccgctggggcgccggcgtggaggaccccctgggctag

SEQ ID NO: 8017 - DNA, 825 bp, Artificial Sequence
  Description of Artificial Sequence: Synthetic coding sequence
atgtggcgctgccccctgggcctgctgctgctgctgcccctggccggccacctggccctgggcgcccagcagggccggggccggcgggagctggcccctggcctgcacctgcggggcatcagagatgctgggggccgctactgccaggagcaggacctgtgctgccggggccgggcagatgactgtgccctgccctacctgggcgccatctgctactgtgacctcttctgcaacagaacagtgtctgactgctgcccagacttctgggacttctgcctgggcgtgcccccacccttcccccccatccagggctgcatgcatggaggccgcatctaccctgtgctgggcacctactgggacaactgcaaccgctggccacccctggagtgctgggacctgctgcccccagccctgcccggccctgtgtgggccgccctgggcgccaaggaggagatggccggcaaggacagaacagtgtactgccccctgctgatgaaggccctgggcgcccgggtgggggagtgccccggctgccagagcccccagaggatgctgcctgagagcagccgggtgctgctgccccgctgtgccgagggggagcagcccggggtgcagaggggcaagggccgcatgaggaaggccttccctgccctgcagacccccctggccctgcccagcagcgccccagccagccctggggccggcaagcccagccacacaggctcctggctgcccctgcggctgctgaagaggcagcactggcgctgggagccctggacagcctgcaaggaggccgtgcagcacctggtgatcacagagctgtag

SEQ ID NO: 8018 - DNA, 438 bp, Artificial Sequence
  Description of Artificial Sequence: Synthetic coding sequence
atggcccagctgttcctgcccctgctggccgccctggtgctggcccaggccccagctgccctggctgatgtgctggagggggacagcagtgaagatcgggccttccgggtgagaattgctggagatgcccccctgcagggcgtgctgggcggggccctgaccatcccctgccacgtgcactacctgcggcccccacccagccggcgggctgtgctgggcagcccccgggtgaagtggaccttcctgagccggggccgggaggccgaggtgctggtggcccggggcgtgcgggtgaaggtgaatgaggcctaccgcttccgggtggccctgcctgcctacccagccagcctgacagatgtgtccctggccctgtctgagctgcggcccaatgacagcggcatctaccgctgtgaggtgcagcacggcattgatgactag

SEQ ID NO: 8019 - DNA, 567 bp, Artificial Sequence; identical to SEQ ID NO: 7502
  Description of Artificial Sequence: Synthetic coding sequence

SEQ ID NO: 8020 - DNA, 558 bp, Artificial Sequence
  Description of Artificial Sequence: Synthetic coding sequence
atgggccctgctggctgtgccttcaccctgctgctgctgctgggcatcagtgaccgggactaccacagcgccctgcaggaggccgaggtgcccatcatcgaccggcaggcctgtgagcagctgtacaaccccatcggcatcttcctgcctgccctggagcccgtcatcaaggaggacaagatctgtgccggggacacccagaacatgaaggacagctgcaagggggacagcggcggccccctgagctgccacattgatggagtgtggatccagacaggagtggtgtcctggggcctggagtgtgggaagagcctgcccggggtgtacaccaacgtcatctactaccagaagtggatcaatgccaccatcagccgggccaacaacctggacttcagtgacttcctgttccccatcgtgctgctgagcctggccctgctgcggcccagctgtgccttcggccccaacaccatccaccgggtgggcaccgtggccgaggccgtggcctgcatccagggctgggaggagaatgcctggaggttcagcccccggggccgctag

SEQ ID NO: 8021 - DNA, 1653 bp, Artificial Sequence
  Description of Artificial Sequence: Synthetic coding sequence
ccagccccagccagcaggaagctgctgcccaggaggcacctgtctgagaagagccaccacatcagcatccccagcccagacatcagccacaagggcctgcggagcaagaggacccagcccagcgaccctgagacctgggagagcctgccccggctggacagccagagacatggaggccctgagttctcctttgacctgctgcctgaggcccgggccatccgggtgaccatcagcagcggccctgaggtgtctgtgcggctgtgccaccagtgggccctggagtgtgaggagctgagcagcccctatgatgtgcagaagatcgtgtctgggggccacacagtggagctgccctatgagttcctgctgccctgcctgtgcatcgaggccagctacctgcaggaggacacagtgcggaggaagaagtgccccttccagagctggccagaggcctacggcagtgacttctggaagtctgtgcacttcacagactacagccagcacacccagatggtgatggccctgaccctgcgctgccccctgaagctggaggccgccctgtgccagagacatgactggcacaccctgtgcaaggacctgcccaatgccacagcccgggagagtgatggctggtacgtgctggagaaggtggacctgcacccccagctgtgcttcaagttctcctttggaaacagcagccacgtggagtgcccccaccagacaggcagcctgacctcctggaatgtgtccatggacacccaggcccagcagctgatcctgcacttcagcagcaggatgcacgccaccttctctgctgcctggagcctgcccggcctgggccaggacaccctggtgccccctgtgtacacagtgtcccaggcccggggcagcagccctgtgtccctggacctgatcatccccttcctgcggcccggctgctgcgtgctggtgtggaggagtgatgtgcagtttgcctggaagcacctgctgtgcccagatgtgtcctaccgccacctgggcctgctgatcctggccctgctggccctgctgaccctgctgggcgtggtgctggccctgacctgcagaagaccccagagcggccctggccctgcccggcctgtgctgctgctgcacgccgctgacagcgaggcccagaggcggctggtgggcgccctggccgagctgctgcgggccgccctgggcggcggcagagatgtgattgtggacctgtgggagggccgccacgtggcccgggtgggccccctgccctggctgtgggccgcccggaccagggtggcccgggagcagggcaccgtgctgctgctgtggagcggggctgacctgcggcctgtgtctggccctgaccccagggctgcccccctgctggccctgctgcacgccgccccccggcccctgctgctgctggcctacttcagccggctgtgtgccaagggggacatccccccacccctgcgggccctgccccgctaccgcctgctgcgggacctgccccggctgctgcgggccctggatgcccggccctttgctgaggccacctcctggggccgcctgggcgcccggcagaggcggcagagccggctggagctgtgcagccggctggagcgggaggccgcccggctggccgacctgggctag

SEQ ID NO: 8022 - DNA, 816 bp, Artificial Sequence
  Description of Artificial Sequence: Synthetic coding sequence
atgggcatcgtgtgtgcccagtgcagcttcatcctgctgctgagcatcatccgggcccggcccccacccttcctgttctgccccctgagcagccagaggacagagagcccctacaagcctgtgcacctgggcctgggccccacagacaaggtggccgccatcgccatggcccgcatcatcgacctggtgccctgggatgatggcagcacccacgtgtatgccagccctgccatcctgctgcccatggagcggcagaggaaccagctggccggcgtgaagcagcagctgtaccacccagccctgcccaccctgcggcacatggaccgggacacagtgaaggcctgcctgcctgatgagcactgccagagcaccacctactgcaggaaggatgaatttgacaatgcccacttcaccctgctgggcgtgcccaacaagcccctgcagtgcctggacatcacagccaccggccagaagctgaggaaccgctaccacgagggcaagctggcccccatcgcccctggcatcaacagagtggactggccctgcttcacccgggccatcgaggactggagccactttgtgagcagcgctggggagttcaagctgccctgcctgaggaagagagctgagggcctgagcggctatgctgtgcgctacctgaagccagatgtgacccagacctggagatactgcctgagccagaaccccagcctggacagatatggccagaagcccctgccctttgacagcctgaacaccttccgcagctttggcagcagctacagccgggtgaactacctgaccccctggcactag

SEQ ID NO: 8023 - DNA, 1743 bp, Artificial Sequence; identical to SEQ ID NO: 7266
  Description of Artificial Sequence: Synthetic coding sequence

SEQ ID NO: 8024 - DNA, 513 bp, Artificial Sequence
  Description of Artificial Sequence: Synthetic coding sequence
atggagtttgtggatgtgacagagagcaatgcccgctgggtgcaggacttccggctgaaggcctatgccagccctgccaagctggagagcattgatggagcccgctaccacgccctgctgatccccagctgccctggggccctgacagacctggccagcagcggcagcctggcccgcatcctgcagcacttccacagcgagagcaagcccatctgtgctgtgggccacggcgtggccgccctgtgctgtgccaccaatgaagatcgctcctgggtgtttgacagctacagcctgaccggccccagcgtgtgtgagctggtgcgggcccctggctttgcccggctgcccctggtggtggaggactttgtgaaggacagcggggcctgcttcagcgccagcgagccagatgctgtgcacgtggtgctggacagacacctggtgacaggccagaatgccagcagcacagtgcctgctgtgcagaacctgctcttcctgtgtggcagcaggaagtag

SEQ ID NO: 8025 - DNA, 1041 bp, Artificial Sequence
  Description of Artificial Sequence: Synthetic coding sequence
atgaggctgctcttcctggccgtgctgcggccccacactggaaatgctgtgacagcccagagggtgcgggcccacctggaggccgccggccacgtgtgtgtgctgaaggatgcctttgattttgagagccgctcagaaattgccaacctgatcctggccgagaactgtgaggccgccctggccctgcacctgtacagaggaggccgcctgctgcagggccaccgcatcccctttggagtcatctttggaggaacagatgtgaatgaagatgccaaccaggccgagaagaacacagtgatgggccgggtgctggaggaggccaggtttgctgtggccttcacagagagcatgaaggagatggcccaggcccagtggccccacgccaagggcaaggtgtatgtgcagagccagggcatcgccaccaccccaaatgctgccttcaactggaacaccttcctgcagaggtctgagatcaaccagagcgctgacaacctgcacatcttcctgctgatctgtggcctgcggcaggtgaaggaccccctgtacctggtggatgccttcagcgcctggcaccaggaggagcccaacgtgcacctggtgattgtgggccctgaggtggaccccgtcttcacccgggaggtgaaggccaaggtgaagagagctgctggggtgcggctgattggagagatgccccaggaggacctgcatgctgtggtgaagaactgctttgctgtggtgaacagctctgtgtctgagggcatgtctgctgccatcctggaggccatggacctggaggtgcctgtgctggccaggaacatccctggaaatgctgctgtggtgaagcatgaggtgacaggcctgctcttcagcaacccccaggagtttgtgcacctggccaagaggctggtgtctgaccctgccctggagaaggagatcgtggtgaatggccgggagtatgtgaggatgtaccacagctggcaggtggagcgggacacctaccagcagctgatcaggaagctggagggcagcacagaagattag

SEQ ID NO: 8026 - DNA, 1482 bp, Artificial Sequence; identical to SEQ ID NO: 7826
  Description of Artificial Sequence: Synthetic coding sequence

SEQ ID NO: 8027 - DNA, 354 bp, Artificial Sequence
  Description of Artificial Sequence: Synthetic coding sequence
atgctgatcttctggaccatcaccctcttcctgctgggcgccgccaagggcaaggaggtgtgctatgaggacctgggctgcttcagtgacacagagccctggggcggcacagccatccggcccctgaagatcctgccctggagccctgagaagattggcacccgcttcctgctgtacaccaatgaaaaccccaacaacttccagatcctgctgctgagtgaccccagcaccatcgaggccagcaacttccagatggacaggaagacccgcttcatcatccacggcttcatcgacaagggagatgagagctgggtgacagacatgtgcaagccaggggccagcccccgggcctag

SEQ ID NO: 8028 - DNA, 1581 bp, Artificial Sequence
  Description of Artificial Sequence: Synthetic coding sequence
atgcagggccccctgctgctgcccggcctgtgcttcctgctgagcctgtttggagctgtgacccagaagaccaagaccagctgtgccaagtgccccccaaatgccagctgtgtgaacaacacccactgcacctgcaaccacggctacaccagcggcagcggccagaagctgttcaccttccccctggagacctgcaatgccatcgagacccaggccatcacagacaactgcagcgaggagaggaagaccttcaacctgaatgtgcagatgaacagcatggacatccgctgcagcgacatcatccagggcgacacccagggccccagcgccatcgccttcatctcctacagcagcctgggcaacatcatcaatgccaccttctttgaggagatggacaagaaggaccaggtgtacctgaacagccaggtggtgtctgctgccatcggccccaagagaaatgtgtccctgagcaagtctgtgaccctgaccttccagcacgtgaagatgacccccagcaccaagaaggtgttctgtgtgtactggaagagcacaggccagggcagccagtggagcagagatggctgcttcctgattcatgtgaacaagagccacaccatgtgcaactgcagccacctgagcagctttgctgtgctgatggccctgaccagccaggaggaggaccctgtgctgaccgtcatcacctacgtgggcctgtctgtgtccctgctgtgcctgctgctggccgccctgaccttcctgctgtgcaaggccatccggaacaccagcaccagcctgcacctgcagctgagcctgtgcctcttcctggcccacctgctcttcctggtgggcatcgacagaacagagcccaaggtgctgtgcagcatcatcgccggggccctgcactacctgtacctggccgccttcacctggatgctgctggagggcgtgcacctgttcctgacagccaggaacctgactgtggtgaactacagcagcatcaaccggctgatgaagtggatcatgtttcctgtgggctacggcgtgcctgctgtgacagtggccatctctgctgcctcctggccccacctgtatggaacagctgaccgctgctggctgcacctggaccagggcttcatgtggagcttcctgggccctgtgtgtgccatcttcagcgccaacctggtgctcttcatcctggtgttctggatcctgaagaggaagctgagcagcctgaacagcgaggtgtccaccatccagaacaccaggatgctggccttcaaggccacagcccagctgttcatcctgggctgcacctggtgcctgggcctgctgcaggtgggccctgctgcccaggtgatggcctacctgttcaccatcatcaacagcctgcagggcttcttcatcttcctggtgtactgcctgctgagccagcaggtgcagaagcagtaccagaagtggttccgggagatcgtgaagagcaagtctgagagcgagacctacaccctgagcagcaagatgggccctgacagcaagcccagtgaaggagatgtgtttcctggccaggtgaagaggaagtactag

SEQ ID NO: 8029 - DNA, 5832 bp, Artificial Sequence
  Description of Artificial Sequence: Synthetic coding sequence
tgacccagcctggccggcagaggagctggccgcatggcccctggggccctgcggggcggctgtgagcagagggcccctgggggcggggccaggacagctgccctgggcccctggccctggcccagccctggccctgcccccagccctggagctgccccacccaggagcaggaagatgtctggggccctgctgtggcccctgctgcccctgctgctgctgctgctgagcgccagagatggagtgcgggccgcccagccccaggcccctggctacctgattgctgcccccagcgtcttccgggccggcgtggaggaggtgatctctgtgaccatcttcaacagcccccgggaggtgacagtgcaggcccagctggtggcccagggcgagcctgtggtgcagagccagggcgccatcctggacaagggcaccatcaagctgaaggtgcccaccggcctgcggggccaggccctgctgaaggtgtggggccggggctggcaggccgaggagggccccctcttccacaaccagacctctgtgacagtggatggccgcggggcctctgtgttcatccagacagacaagcctgtgtaccggccccagcaccgggtgctgatcagcatcttcaccgtgagccccaacctgcggcctgtgaatgagaagctggaggcctacatcctggacccccggggcagcaggatgattgagtggaggcacctgaagcccttctgctgcggcatcaccaacatgtccttccccctgagtgaccagcctgtgctgggggagtggttcatctttgtggagatgcagggccacgcctacaacaagagctttgaggtgcagaagtatgtgctgcccaagtttgagctgctgattgatcctccccgctacatccaggacctggatgcctgtgaaacaggaacagtgcgggcccgctacaccttcggcaagcctgtggccggggccctgatgatcaacatgacagtgaatggagtgggctactacagccatgaggtgggccggcctgtgctgcggaccaccaagatcctgggcagccgggactttgacatctgtgtgcgggacatgatcccagcagatgtgcctgagcacttccggggccgggtgtccatctgggccatggtgacctctgtggatggcagccagcaggtggcctttgatgacagcacccctgtgcagaggcagctggtggacatccgctacagcaaggacaccaggaagcagttcaagccaggcctggcctacgtgggcaaggtggagctgagctacccagatggcagccctgctgagggcgtgacagtgcagatcaaggccgagctgacccccaaggacaacatctacaccagcgaggtggtgtcccagaggggcctggtgggctttgagatccccagcatccccaccagcgcccagcacgtgtggctggagaccaaggtgatggccctgaatggcaagcctgtgggcgcccagtacctgcccagctacctgagcctgggctcctggtacagccccagccagtgctacctgcagctgcagccccccagccaccccctgcaggtgggggaggaggcctacttctctgtgaagagcacctgcccctgcaacttcaccctgtactatgaggtggccgcccggggcaacatcgtgctgagcggccagcagcctgcccacaccacccagcagaggagcaagagagctgccccagccctggagaagcccatccggctgacccacctgtctgaaacagagcccccaccagcccctgaggccgaggtggatgtgtgtgtgaccagcctgcacctggccgtgacccccagcatggtgcccctgggccgcctgctggtgttctacgtgcgggagaatggagagggcgtggccgacagcctgcagtttgctgtggagaccttctttgagaaccaggtgtctgtgacctacagcgccaatgagacccagcccggggaggtggtggacctgcgcatccgggccgcccggggcagctgtgtgtgtgtggccgctgtggacaagtctgtgtacctgctgcggagcggcttccggctgaccccagcccaggtgttccaggagctggaggactatgatgtgtctgacagctttggagtgtccagagaagatggccccttctggtgggccggcctgacagcccagaggagaagaagaagctctgtgttcccctggccctggggcatcaccaaggacagcggctttgccttcacagagaccggcctggtggtgatgacagacagagtgtccctgaaccaccggcaggacggcggcctgtacacagatgaggccgtgcctgccttccagccccacacaggcagcctggtggccgtggcccccagccgccacccccccaggacagagaagaggaagaggaccttcttccctgagacctggatctggcactgcctgaacatcagtgaccccagcggggagggcaccctgtctgtgaaggtgcctgacagcatcacctcctgggtgggggaggccgtggccctgagcaccagccagggcctgggcattgctgagcccagcctgctgaagaccttcaagcccttctttgtggacttcatgctgcctgccctgatcatccggggggagcaggtgaagatccccctgtctgtgtacaactacatgggcacctgtgccgaggtgtacatgaagctgtctgtgcccaagggcatccagtttgtgggccaccctgggaagagacatgtgaccaagaagatgtgtgtggcccctggagaggccgagcccatctgggtggtgctgtccttcagtgacctgggcctgaacaacatcacagccaaggccctggcctatggagacaccaactgctgcagagatggccgcagcagcaagcaccctgaggagaaccacgccgacagaagagtgcccatcggcgtggaccacgtgagaagatctgtgatggtggaggccgagggcgtgccccgggcctacacctacagcgccttcttctgccccagcgagcgggtgcacatcagcacccccaacaagtatgagttccagtatgtgcagaggcccctgcggctgaccaggtttgatgtggccgtgcgggcccacaatgatgcccgggtggccctgagcagcggcccccaggacacagctggcatgattgagatcgtgctgggcggccaccagaacaccaggtcctggatcagcaccagcaagatgggagagcctgtggccagcgcccacacagccaagatcctgtcctgggatgagttccgcaccttctggatctcctggaggggcggcctcatccaggtgggccacggccctgagcccagcaatgaatctgtgattgtggcctggaccctgcccaggcctcctgaggtgcagttcatcggcttcagcacaggctggggctccatgggagagttccgcatctggaggaagatggaggtggatgagagctacagcgaggccttcaccctgggcgtgccccatggagccatccctggcagcgagcgggccacagccagcatcattggagatgtgatgggccccaccctgaaccacctgaacaacctgctgcggctgcccttcggctgtggggagcagaacatgatccactttgccccaaatgtgtttgtgctgaagtacctgcagaagacccagcagctgagccctgaggtggagcgggagaccacagactacctggtgcagggctaccagaggcagctgacctacaagaggcaggacggcagctacagcgccttcggggagagagatgccagcggctccatgtggctgacagcctttgtgctgaagagctttgcccaggcccggagcttcatctttgtggacccccgggagctggccgccgccaagtcctggatcatccagcagcagcaggctgatggcagcttcctggccgtgggccgggtgctgaacaaggacatccagggcggcatccacggcaccgtgcccctgacagcctacgtggtggtggccctgctggagaccggcacagccagcgaggaggagcggggcagcacagacaaggcccggcacttcctggagagcgctgcccccctggccatggacccctacagctgtgccctgaccacctacgccctgaccctgctgcggagccctgctgcccctgaggccctgaggaagctgcggagcctggccatcatgagagatggagtgacccactggagcctgagcaacagctgggatgtggacaagggcaccttcctgtccttcagtgacagagtgtcccagagcgtggtgtctgctgaggtggagatgacagcctatgccctgctgacctacaccctgctgggagatgtggccgccgccctgcctgtggtgaagtggctgagccagcagagaaatgccctgggcggcttcagcagcacccaggacacctgtgtggccctgcaggccctggccgagtatgccatcctgtcctatgccggcggcatcaacctgactgtgtccctggccagcaccaacctggactaccaggagacctttgagctgcacaggaccaaccagaaggtgctgcagacagctgccatccccagcctgcccaccggcctgtttgtgtctgccaagggagatggctgctgcctgatgcagattgatgtgacctacaacgtgcctgaccctgtggccaagccagccttccagctgctggtgtccctgcaggagcctgaggcccagggccggcccccacccatgcctgccagcgctgctgagggcagcagaggagactggcccccagcagatgatgatgatcctgctgctgaccagcaccaccaggagtacaaggtgatgctggaggtgtgcacccgctggctgcacgccggcagcagcaacatggctgtgctggaggtgcccctgctgagcggcttccgggctgacatcgagagcctggagcagctgctgctggacaagcacatgggcatgaagagatatgaggtggccggccggcgggtgctcttctactttgatgagatccccagccgctgcctgacctgtgtgcgcttccgggccctgcgggagtgtgtggtgggccgcaccagcgccctgcctgtgtctgtgtatgactactatgagcccgcctttgaggccacccgcttctacaacgtgtccacccacagccccctggcccgggagctgtgtgccggccctgcctgcaatgaggtggagcgggccccagcccggggccctggctggttccctggagagagcggccctgctgtggcccctgaggagggcgccgccatcgcccgctgtggctgtgaccatgactgtggggcccagggcaaccctgtgtgtggcagtgatggagtggtgtatgccagcgcctgccgcctgcgggaggccgcctgccggcaggccgcccccctggagcccgccccacccagctgctgtgccctggagcagaggctgcctgccagcagcagcagcacctatggagatgacctggcctctgtggcccctggccccctgcagcaggatgtgaagctgaatggagctggcctggaggtggaggacagcgaccctgagcctgagggggaggctgaagatagagtgacagctggcccccggccccctgtgagcagcggcaacctggagagcagcacccagagcgccagccccttccaccgctggggccagaccccagccccccagaggcacagcggccgggtggtgggcgcccacaggcctggcctgctgagccctgtgtttgtgtacagccctgccttccagagcggcggggaggagggcctgtggatgagcaacacctgcaccctgaggtag

SEQ ID NO: 8030 - DNA, 456 bp, Artificial Sequence
  Description of Artificial Sequence: Synthetic coding sequence
atggaggccaccggcacagatgaggtggacaagctgaagaccaagttcatcagcgcctggaacaacatgaagtacagctgggtgctgaagaccaagacctacttcagcaggaacagccctgtgctgctgctgggcaagtgctaccacttcaagtatgaagatgaggacaagaccctgcctgctgagagcggctgcaccatcgaggaccacgtgattgctggaaatgtggaggagttcaggaaggacttcatcagccgcatctggctgacctaccgggaggagttcccccagatcgagggcagcgccctgaccacagactgtggctggggctgcaccctgaggacaggccagatgctgctggcccagggcctcatcctgcacttcctgggccgggcctggacctggccagatgccctgaacatcgagaacagcgacagcgagagctggaccagctag

SEQ ID NO: 8031 - DNA, 2616 bp, Artificial Sequence
  Description of Artificial Sequence: Synthetic coding sequence
atgaggaagcccaggaggaagagccggcagaatgctgagggcagaagaagccccagcccctacagcctgaagtgcagccccacccgggagaccctgacctacgcccaggcccagagaattgtggaggtggacattgatggccgcctgcaccgcatcagcatctatgaccccctgaagatcatcacagaagatgagctgacagcccaggacatcacagagtgcaacagcaacaaggaaaattctgagcagccccagtttcctgggaagagcaagaagcccagcagcaagggcaagaagaaggagagctgcagcaagcacgccagcggcaccagcttccacctgccccagcccagcttcaggatggtggacagcggcatccagcctgaggccccacccctgcctgctgcctactaccgctacatcgagaagcccccagaggacctggatgctgaggtggagtatgacatggatgaggaggacctggcctggctggacatggtgaatgagaagagaagagtggatggccacagcctggtgtctgctgacacctttgagctgctggtggaccggctggagaaggagagctacctggagagccgcagcagcggggcccagcagagcctgattgatgaagatgccttctgctgcgtgtgcctggatgatgagtgccacaacagcaatgtcatcctcttctgtgacatctgcaacctggccgtgcaccaggagtgctacggcgtgccctacatccctgagggccagtggctgtgccgctgctgcctgcagagccccagcaggcctgtggactgcatcctgtgccccaacaagggcggggccttcaagcagaccagtgatggccactgggcccacgtggtgtgtgccatctggatccctgaggtgtgctttgccaacacagtgttcctggagcccatcgagggcatcgacaacatccccccagcccgctggaagctgacctgctacatctgcaagcagaagggcctgggcgccgccatccagtgccacaaggtgaactgctacacagccttccacgtgacctgtgcccagagagctggcctcttcatgaagattgagcccatgagggagaccagcctgaatggcaccatcttcaccgtgaggaagacagcctactgtgaggcccacagccccccaggagctgccacagcccggaggaaaggagacagccccaggagcatcagcgagactggagatgaggagggcctgaaggagggagatggagaggaggaggaggaggaggaggtggaggaggaggagcaggaggcccagggcggcgtgtctggcagcctgaagggcgtgcccaagaagagcaagatgagcctgaagcagaagatcaagaaggagcctgaggaggccggccaggacacccccagcaccctgcccatgctggccgtgccccagatccccagctaccgcctgaacaagatctgcagcggcctgtccttccagaggaagaaccagttcatgcagaggctgcacaactactggctgctgaagaggcaggccagaaatggagtgcccctcatccggcggctgcacagccacctgcagagccagagaaatgctgagcagcgggagcaggatgagaagaccagcgctgtgaaggaggagctgaagtactggcagaagctgcggcatgacctggagcgggcccggctgctgattgagctgatcaggaagcgggagaagctgaagcgggagcaggtgaaggtgcagcaggccgccatggagctggagctgatgcccttcaacgtgctgctgcggaccaccctggacctgctgcaggagaaggaccctgcccacatctttgctgagcctgtgaacctgtctgaggtgcctgactacctggagttcatcagcaagcccatggacttcagcaccatgaggaggaagctggagagccacctgtaccgcaccctggaggagtttgaggaggacttcaacctgattgtgaccaactgcatgaagtacaatgccaaggacaccatcttccacagagctgctgtgcggctgcgggacctgggcggggccatcctgcggcatgcccggcggcaggccgagaacatcggctatgaccctgagcggggcacccacctgcctgagagccccaagctggaggacttctaccgcttctcctgggaggatggccgcagcctgctgctgccctttgaagatagaggagacctggagcccctggagctggtgtgggccaagtgccggggctaccccagctacccagccctgatcatcgaccccaagatgccccgggagggcctgctgcacaatggagtgcccatccctgtgccccccctggatgtgctgaagctgggggagcagaagcaggccgaggccggggagaagctgttcctggtgctcttctttgacaacaagaggacctggcagtggctgccccgggacaaggtgctgcccctgggcgtggaggacacagtggacaagctgaagatgctggagggcaggaagaccagcatcaggaagtctgtgcaggtggcctatgaccgggccatgatccacctgagccgggtgcggggcccccacagctttgtgaccagcagctacctgtag

SEQ ID NO: 8032 - DNA, 2700 bp, Artificial Sequence; identical to SEQ ID NO: 7525
  Description of Artificial Sequence: Synthetic coding sequence

SEQ ID NO: 8033 - DNA, 537 bp, Artificial Sequence
  Description of Artificial Sequence: Synthetic coding sequence
atggagaccttccccctgctgctgctgagcctgggcctggtgctggccgaggccagcgagagcaccatgaagatcatcaaggaggagttcacagatgaggagatgcagtatgacatggccaagagcggccaggagaagcagaccatcgagatcctgatgaaccccatcctgctggtgaagaacaccagcctgtccatgagcaaggatgacatgagcagcaccctgctgaccttccgcagcctgcactacaatgaccccaagggcaacagcagtggaaatgacaaggagtgctgcaatgacatgacagtgtggaggaaggtgtctgaggccaacggcagctgcaagtggagcaacaacttcatccgcagcagcacagaggtgatgagaagagtgcaccgggcccccagctgcaagtttgtgcagaaccctggcatcagctgctgtgagagcctggagctggagaacacagtgtgccagttcaccaccgggaagcagttcccccgctgccagtaccacagcgtgaccagcctggagtag

SEQ ID NO: 8034 - DNA, 2184 bp, Artificial Sequence
  Description of Artificial Sequence: Synthetic coding sequence
atgatcctgagcctgctcttcagcctgggcggccccctgggctggggcctgctgggcgcctgggcccaggccagcagcaccagcctgagtgacctgcagagcagcaggaccccaggagtgtggaaggccgaggccgaggacaccgggaaggaccctgtgggcaggaactggtgcccctaccccatgagcaagctggtgaccctgctggccctgtgcaagacagagaagttcctgatccacagccagcagccctgcccccagggcgccccagactgccagaaggtgaaggtgatgtacaggatggcccacaagcctgtgtaccaggtgaagcagaaggtgctgaccagcctggcctggcgctgctgccccggctacacaggccccaactgtgagcaccacggccccatggctgtgtggtgctggccagagccagacagcctgcaggcccggctgggccagctgcagaggaacctgtctgagctgcacatgaccacagcccggcgggaggaggagctgcagtacaccctggaggacatgagggccaccctgaccaggcatgtggatgagatcaaggagctgtacagcgagagtgatgagacctttgaccagatcagcaaggtggagcggcaggtggaggagctgcaggtgaaccacacagccctgcgggagctgcgggtcatcctgatggagaagagcctcatcatggaggagaacaaggaggaggtggagcggcagctgctggagctgaacctgaccctgcagcacctgcagggcggccatgctgacctgatcaagtatgtgaaggactgcaactgccagaagctgtacctggacctggatgtgatccgggagggccagagagatgccacccgggccctggaggagacccaggtgtccctggatgaaagacggcagctggatggcagcagcctgcaggccctgcagaatgctgtggatgctgtgtccctggccgtggatgcccacaaggccgagggggagcgggcccgggccgccaccagccggctgcggagccaggtgcaggccctggatgatgaggtgggcgccctgaaggctgctgctgctgaggcccggcatgaggtgcggcagctgcacagcgcctttgctgccctgctggaggatgccctgcggcatgaggccgtgctggccgccctgtttggagaggaggtgctggaggagatgtctgagcagaccccaggccccctgcccctgtcctatgagcagatccgggtggccctgcaggatgctgccagcggcctgcaggagcaggccctgggctgggatgagctggccgcccgggtgacagccctggagcaggccagcgagccccccaggcctgctgagcacctggagcccagccatgatgctggccgggaggaggccgccaccacagccctggccggcctggcccgggagctgcagagcctgagcaatgatgtgaagaatgtgggccgctgctgtgaggccgaggccggggccggggccgccagcctgaatgccagcctgcacggcctgcacaatgccctgtttgccacccagaggagcctggagcagcaccagaggctcttccacagcctgtttggaaacttccagggcctgatggaggccaacgtgtccctggacctgggcaagctgcagaccatgctgagcaggaagggcaagaagcagcagaaggacctggaggcccccaggaagagggacaagaaggaggccgagcccctggtggacatccgggtgacaggccctgtgcctggggccctgggcgccgccctgtgggaggccggcagccctgtggccttctacgccagcttcagcgagggcacagctgccctgcagacagtgaagttcaacaccacctacatcaacatcggcagcagctacttccctgagcacggctacttccgggcccctgagcggggcgtgtacctgtttgctgtgtctgtggagtttggacctggccctggcaccggccagctggtgtttggaggccaccacaggacccctgtgtgcaccaccggccagggcagcggcagcacagccaccgtgtttgccatggccgagctgcagaagggggagcgggtgtggtttgagctgacccagggcagcatcaccaagaggagcctgtctggaacagcctttggaggcttcctgatgttcaagacctag

SEQ ID NO: 8035 - DNA, 828 bp, Artificial Sequence
  Description of Artificial Sequence: Synthetic coding sequence
atgggcagcgccccctgggcccctgtgctgctgctggccctgggcctgcggggcctgcaggccggcggggagtggaggcggcccccagcccacagccctgtgcctgccccacccctgcgctttgccagcccccacagcccccagggccctggcccccggctgcccggggccctgctgcctgctgccagcggccccctgcagctgcgggccctgcggcagcaggacctgcccagcgccctgcccggggtgggccaggtgctgggccctggccgcggggcccacctgctgctgcactgggagcggggcagaagagtgggcctgcggcagcagctgggcctgcggagaggagctgggggccgggccggcggcagcacaggcctgcggggggcccccctgctgcgggaggtggccgctgtgcgctgtgctgtgcatgctgcccgggcccatggagctgctgatggaggagctggccctggccgcctgcggcgggccgccccccgggccaccacccggccccggggccctggctgccccaggcaccggctgcgctggaagctgtggggagatgcccagtgcctgcctgaagatgaggtgagccccccaggcggcggcggggccggcggccagagggcccggagcagctgtggccggccccggcggctgcagcctgtgctgcccggcagacatggaggcagcctgcggcacggccccctgggcgtgcgccacctgcctgctgctgtgcggcgggagggccctgaccctgccctgcacgtgcggccagaatgtctgcaccgggccggccatgatggcctgcccctgccccactag

SEQ ID NO: 8036 - DNA, 351 bp, Artificial Sequence; identical to SEQ ID NO: 7504
  Description of Artificial Sequence: Synthetic coding sequence

SEQ ID NO: 8037 - DNA, 522 bp, Artificial Sequence; identical to SEQ ID NO: 7221
  Description of Artificial Sequence: Synthetic coding sequence

SEQ ID NO: 8038 - DNA, 1482 bp, Artificial Sequence
  Description of Artificial Sequence: Synthetic coding sequence
tctgaggccgtgtacctgaatgacagcacctatgatggccacacagtgggcggcctgcagtatggaggcctgggccagctggctgatggagtggtgggcctggatgacttcaggaagagccaggagctgcgggtgtggccaggctatgactatgtgggctggagcaaccacagcttcagcagcggctacgtggagatggagtttgaatttgaccggctgcgggccttccaggccatgcaggtgcactgcaacaacatgcacaccctgggcgcccggctgcccggcggcgtggagtgccgcttccggcggggccctgccatggcctgggagggggagcccatgaggcacaacctgggcggcaacctgggggacccccgggcccgggctgtgtctgtgcccctgggcggccgggtggcccgcttcctgcagtgccgcttcctgtttgctggcccctggctgctcttcagcgagatctccttcatcagtgatgtggtgaacaacagcagccctgccctgggcggcaccttccccccagccccctggtggcccccaggccccccacccaccaacttcagcagcctggagctggagccccggggccagcagcctgtggccaaggccgagggcagccccacagccatcctgattggctgcctggtggccatcatcctgctgctgctgctgatcatcgccctgatgctgtggaggctgcactggaggcggctgctgagcaaggtgctggagagccaccccaggaccaggagccctggcctggtgggcatccggcccaccctgctgcctgtgagccccatggccctgcgctgctgcagccccatccagcccacagccagcttctggcccctgacccctgtgcccctggaggcccgggccccaccccaccccccaggccccaacccccccaccccccggggcgtgactggaggcaacacctatgctgtgcctgccctgcccccaggagctgtgggagatggccccccccgggtggacttccccaggagccggctgcgcttcaaggagaagctgggggagggccagtttggagaggtgcacctgtgtgaggtggacagcccccaggacctggtgtccctggacttccccctgaatgtgaggaagggccaccccctgctggtggccgtgaagatcctgcggccagatgccaccaagaatgccagaaatgacttcctgaaggaggtgaagatcatgagccggctgaaggaccccaacatcatccggctgctgggcgtgtgtgtgcaggatgaccccctgtgcatgatcacagactacatggagaatggagacctgaaccagttcctgagcgcccaccagctggaggacaaggctgctgagggcgcccctggagatggccaggccgcccagggccccaccatctcctaccccatgctgctgcacgtggccgcccagatcgccagcggcatgagatacctggccaccctgaactag

SEQ ID NO: 8039 - DNA, 639 bp, Artificial Sequence
  Description of Artificial Sequence: Synthetic coding sequence
atgggcctgcacctgcggccctacagagtgggcctgctgcctgatggcctgctcttcctgctgctgctgctgatgctgctggccgaccctgccctgcctgctggccgccacccccctgtggtgctgggggacaacaaccgcatccctgtgattggccccctgaagatccgggagcagcagaggtctgctgtgtccacctcctggctgctgccctacaactacacctggagccctgagaaggtgtttgtgcagacccccaccatcaactacaccctgcgggactacaggaagttcttccaggacatcggctttgaagatggctggctgatgaggcaggacacagagggcctggtggaggccaccatgcctcctggggtgcagctgcactgcctgtatggcaccggggtgcccaccccagacagcttctactatgagagcttcccagaccgggaccccaagatctgctttggagatggagatggcaccgtgaacctgaagagcgccctgcagtgccaggcctggcagagccggcaggagcaccaggtgctgctgcaggagctgcccggcagcgagcacatcgagatgctggccaatgccaccaccctggcctacctgaagagggtgctgctgggcccctag

SEQ ID NO: 8040 - DNA, 654 bp, Artificial Sequence
  Description of Artificial Sequence: Synthetic coding sequence
atgtctgacctgctgctgctgggcctcatcggcggcctgaccctgctgctgctgctgaccctgctggcctttgctggctacagcggcctgctggccggcgtggaggtgtctgctggcagcccccccatcagaaatgtgacagtggcctacaagttccacatgggcctgtatggagagaccggccgcctcttcacagagagctgcagcatcagccccaagctgcggagcattgctgtgtactatgacaacccccacatggtgcccccagacaagtgccgctgtgctgtgggcagcatcctgtctgagggggaggagagccccagccctgagctgattgacctgtaccagaagtttggcttcaaggtgttctccttccctgcccccagccacgtggtgacagccaccttcccctacaccaccatcctgagcatctggctggccaccaggagagtgcacccagccctggacacctacatcaaggagaggaagctgtgtgcctacccccggctggagatctaccaggaggaccagatccacttcatgtgccccctggcccggcagggcgacttctacgtgcctgagatgaaggagacagagtggaagtggaggggcctggtggaggccatcgacacccaggtggatggcaccggctag

SEQ ID NO: 8041 - DNA, 345 bp, Artificial Sequence
  Description of Artificial Sequence: Synthetic coding sequence
atgaagaccttcacctggaccctgggcgtgctcttcttcctgctggtggacaccggccactgccggggcggccagttcaagatcaagaagatcaaccagaggcgctacccccgggccacagatggcaaggaggaggccaagaagtgtgcctacaccttcctggtgcctgagcagaggatcaccggccccatctgtgtgaacaccaagggccaggatgccagcaccatcaaggacatgatcaccaggatggacctggagaacctgaaggatgtgctgagccggcagaagcgggagattgatgtgctgcagctggtggtggatgtggatggcaacatcgtgaactag

SEQ ID NO: 8042 - DNA, 870 bp, Artificial Sequence; identical to SEQ ID NO: 7936
  Description of Artificial Sequence: Synthetic coding sequence

SEQ ID NO: 8043 - DNA, 1002 bp, Artificial Sequence; identical to SEQ ID NO: 7654
  Description of Artificial Sequence: Synthetic coding sequence

SEQ ID NO: 8044 - DNA, 531 bp, Artificial Sequence
  Description of Artificial Sequence: Synthetic coding sequence
atgaggctgctgatcctgacctgcctggtggccgtggccctggcccggcccaagctgcccctgcgctacccagagcggctgcagaaccccagcgagagcagcgagcccatccccctggagagccgggaggagtacatgaatggcatgaacagaagaaacatcctgcgggagaagcagacagatgagatcaaggacaccagaaatgaaagcacccagaactgtgtggtggccgagcctgagaagatggagagcagcatcagcagcagcagcgaggagcagttctgccgcctgaatgagtacaaccagctgcagctgcaggccgcccacgcccaggagcagatccggaggatgaatgaaaacagccacgtgcaggtgcccttccagcagctgaaccagctggccgcctacccctatgctgtgtggtactacccccagatcatgcagtatgtgcccttcccccccttcagtgacatcagcaaccccacagcccatgaaaattatgagaagaacaacgtgatgctgcagtggtag

SEQ ID NO: 8045 - DNA, 279 bp, Artificial Sequence
  Description of Artificial Sequence: Synthetic coding sequence
atgaagctgtgtgtgacagtgctgagcctgctggtgctggtggccgccttctgcagcctggccctgagcgcccccatgggcagtgaccccccaacagcctgctgcttctcctacacagccaggaagctgcccaggaactttgtggtggactactatgagaccagcagcctgtgcagccagcctgctgtggtgttccagaccaagaggggcaagcaggtgtgtgccgaccccagcgagagctgggtgcaggagtatgtgtatgacctggagctgaactag

SEQ ID NO: 8046 - DNA, 1656 bp, Artificial Sequence
  Description of Artificial Sequence: Synthetic coding sequence
atgacctggaggatgggcccccgcttcaccatgctgctggccatgtggctggtgtgtggcagcgagccccacccccacgccaccatccggggcagccatggaggcaggaaggtgcccctggtgtccccagacagcagcaggcctgcccgcttcctgcggcacacaggccgcagccggggcatcgagaggagcaccctggaggagcccaacctgcagcccctgcagaggagaagatctgtgcctgtgctgcggctggcccggcccagccgcttccgggacaacaggatggaccggcgggagcacggccaccgggaccccaacgtggtgcccggcccccccaagccagccaaggagaagccacccaagaagaaggcccaggacaagatcctgagcaatgaatatgaggagaagtatgacctgagccggcccacagccagccagctggaggatgagctgcaggtgggcaatgtgcccctgaagaaggccaaggagagcaagaagcatgagaagctggagaagccagagaaggagaagaagaagaagatgaagaatgaaaatgctgacaagctgctgaagtctgagaagcagatgaagaagtctgagaagaagagcaagcaggagaaggagaagagcaagaagaagaagggcggcaagacagagcaggacggctaccagaagcccaccaacaagcacttcacccagagccccaagaagtctgtggccgacctgctgggcagctttgagggcaagaggcggctgctgctgatcacagcccccaaggccgagaacaacatgtatgtgcagcagagagatgagtacctggagagcttctgcaagatggccaccaggaagatcagcgtcatcaccatctttggacctgtgaacaacagcaccatgaagattgaccacttccagctggacaatgagaagcccatgagggtggtggatgatgaggacctggtggaccagaggctcatcagcgagctgaggaaggagtatggcatgacctacaatgacttcttcatggtgctgacagatgtggacctgcgggtgaagcagtactatgaggtgcccatcaccatgaagtctgtgtttgacctgattgacaccttccagagccgcatcaaggacatggagaagcagaagaaggagggcatcgtgtgcaaggaggacaagaagcagagcctggagaacttcctgagccgcttccgctggaggcggcggctgctggtgatcagcgccccaaatgatgaggactgggcctacagccagcagctgagcgccctgagcggccaggcctgcaactttggcagctctgtggtggagcgggaggatgtgcctgcccacctggtgaaggacatccggaactacttccaggtgtccccagagtacttctccatgctgctggtgggcaaggatggaaatgtgaagtcctggtaccccagccccatgtggagcatggtgattgtgtatgacctgattgacagcatgcagctgcggcggcaggagatggccatccagcagagcctgggcatgcgctgcccagaagatgaatatgccggctacggctaccacagctaccaccagggctaccaggacggctaccaggatgactaccgccaccacgagagctaccaccacggctacccctactag

SEQ ID NO: 8047 - DNA, 1245 bp, Artificial Sequence; identical to SEQ ID NO: 7745
  Description of Artificial Sequence: Synthetic coding sequence

SEQ ID NO: 8048 - DNA, 300 bp, Artificial Sequence; identical to SEQ ID NO: 7886
  Description of Artificial Sequence: Synthetic coding sequence

SEQ ID NO: 8049 - DNA, 912 bp, Artificial Sequence; identical to SEQ ID NO: 7035
  Description of Artificial Sequence: Synthetic coding sequence

SEQ ID NO: 8050 - DNA, 444 bp, Artificial Sequence; identical to SEQ ID NO: 7701
  Description of Artificial Sequence: Synthetic coding sequence

SEQ ID NO: 8051 - DNA, 1173 bp, Artificial Sequence; identical to SEQ ID NO: 7414
  Description of Artificial Sequence: Synthetic coding sequence

SEQ ID NO: 8052 - DNA, 297 bp, Artificial Sequence
  Description of Artificial Sequence: Synthetic coding sequence
atgaacaagcacttcctgttcctgttcctgctgtactgcctgattgtggccgtgaccagcctgcagtgcatcacctgccacctgcggaccaggacagaccgctgccggcggggctttggagtgtgcacagcccagaagggggaggcctgcatgctgctgcgcatctaccagaggaacaccctgcagatctcctacatggtgtgccagaagttctgccgggacatgacctttgacctgaggaacagaacctacgtgcacacctgctgcaactacaactactgcaacttcaagctgtag

SEQ ID NO: 8053 - DNA, 600 bp, Artificial Sequence
  Description of Artificial Sequence: Synthetic coding sequence
atggcctggggcggcgtgcacacctgctgcttccacctgtgctgctgctgctcctggccccagggcgctgtgcctgaggagctgcacaagcaccctggccagaccctgctgctgcagtgccagtacagccccaagaggggcccctaccagcccaagtcctggtgccagcagaccagccccagccgctgcaccctgctggtgaccagcagcaagccctggacagctgtgcagaagagccactacaccatctgggacaagcccaatgccggcttcttcaacatcaccatgatccagctgacccagaatgacagcggcttctactggtgtggcatctacaatgccagcgagaacatcatcaccgtgctgaggaacatcagcctggtggtgtccccagcccccaccaccagccccatgtggaccctgccctggctgcccaccagcacagcctgggagccccagatccaggagatcaagttccgggcccccacagacagcaccctgtggaagagccgggccccagcctgcctgggcagcggcggcccccgcttcctggtgctggtgctgtgtggcctgctgctggccaagggcctgatgctgtag

SEQ ID NO: 8054 - DNA, 2025 bp, Artificial Sequence
  Description of Artificial Sequence: Synthetic coding sequence
atgaccacagatgacacagaggtgcctgccatgaccctggcccctggccacgccgccctggagacccagaccctgtctgctgagaccagcagccgggccagcaccccagctggccccatccctgaggccgagaccaggggggccaagaggatcagccctgcccgggagaccaggagcttcaccaagaccagccccaacttcatggtgctgattgccacctctgtggagaccagcgctgccagcggcagccctgagggcgccggcatgaccaccgtgcagaccatcaccggcagtgacccccgggaggccatctttgacaccctgtgcacagatgacagcagcgaggaggccaagaccctgaccatggacatcctgaccctggcccacaccagcacagaggccaagggcctgagcagcgagagcagcgccagcagtgacagcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcctgcaccctgtgatcacccccagccgggccagcgagagcagcgccagcagtgatggcccccaccctgtgatcacccccagccgggccagcgagagcagcgccagcagtgatggcccccaccctgtgatcacccccagctggagccctggcagtgatgtgaccctgctggccgaggccctggtgacagtgaccaacatcgaggtgatcaactgcagcatcacagaaattgagaccaccaccagcagcatccctggggccagtgacacagacctgatccccacagagggcgtgaaggccagcagcaccagtgaccccccagccctgcctgacagcacagaggccaagccccacatcacagaggtgacagccagcgctgagaccctgagcacagctggcaccacagagagcgctgccccagatgccaccgtgggcacccccctgcccaccaacagcgccacagagcgggaggtgacagcccctggggccaccaccctgagcggggccctggtgacagtgtccaggaaccccctggaggagaccagcgccctgtctgtggagacccccagctatgtgaaggtgtctggggccgcccctgtgtccattgaagctggcagcgctgtgggcaagaccaccagctttgctggcagcagcgccagcagctacagccccagcgaggccgccctgaagaacttcacccccagcgagacccccaccatggacatcgccaccaagggccccttccccaccagccgggaccccctgcccagcgtgccccccaccaccaccaacagcagccggggcaccaacagcaccctggccaagatcaccaccagcgccaagaccaccatgaagcccccaacagccacccccaccacagcccggacccggcccaccacagatgtgtctgctggagaaaatggaggcttcctgctgctgcggctgtctgtggccagccctgaggacctgacagacccccgggtggccgagcggctgatgcagcagctgcaccgggagctgcacgcccacgccccccacttccaggtgtccctgctgcgggtgcggcggggctag

SEQ ID NO: 8055 - DNA, 738 bp, Artificial Sequence
  Description of Artificial Sequence: Synthetic coding sequence
atgcaggccgcctggctgctgggcgccctggtggtgccccagctgctgggcttcggccacggggcccggggagctgagcgggagtgggagggcggctggggcggggcccaggaggaggagcgggagcgggaggccctgatgctgaagcacctgcaggaggccctgggcctgcctgctggaagaggagatgagaacccagctggcaccgtggagggcaaggaggactgggagatggaggaggaccagggcgaggaggaggaggaggaggccacccccacccccagcagcggccccagccccagccccaccccagaagatattgtgacctacatcctgggccgcctggccggcctggatgctggcctgcaccagctgcacgtgcggctgcacgccctggacaccagggtggtggagctgacccagggcctgcggcagctgagaaatgctgctggggacaccagagatgctgtgcaggccctgcaggaggcccagggccgggcagagcgggagcacggccgcctggagggctgcctgaagggcctgcggctgggccacaagtgcttcctgctgagccgggactttgaggcccagcccagcgccagcccccaccccctgagcccagaccagcccaatggaggcaccctggagaactgtgtggcccaggccagtgatgatggctcctggtgggaccatgactgccagaggcggctgtactacgtgtgtgagttccccttctag

SEQ ID NO: 8056 - DNA, 279 bp, Artificial Sequence
  Description of Artificial Sequence: Synthetic coding sequence
atgatctggaggagcagagctggagctgagctgttcagcctgatggccctgtgggagtggatcgccctgagcctgcactgctgggtgctggccgtggccgctgtgtctgaccagcacgccaccagcccctttgactggctgctgagtgacaagggccccttccacaggagccaggagtacacagactttgtggacaggagccggcagggcttcagcacccgctacaagatctacagaaacatgggccacatcagctgctacctgctgctgtgggagtag

SEQ ID NO: 8057 - DNA, 177 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaggccggggccgccccctacgtgcaggcctttgacagcctgctggccggccctgtggccgagtactag

SEQ ID NO: 8058 - DNA, 732 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagggactgcagcatgggcgtgtgggcctcctggcagatggtgtggtggggctggatgaccctgggccgggtgcgcagctgtggcagcggccaggccatgaccatgtgggatggagccaccacagccagccctgtggccatgtggcgctggagcctgagcctgaccggctag

SEQ ID NO: 8059 - DNA, 2535 bp, Artificial Sequence; identical to SEQ ID NO: 7302
  Description of Artificial Sequence: Synthetic coding sequence

SEQ ID NO: 8060 - DNA, 921 bp, Artificial Sequence
  Description of Artificial Sequence: Synthetic coding sequence
agaaggacctgtgccggccctggccgggccggcggggcccggagcgcctcctggatgagccggctgcgggccctgctgggcctgggcctgctggtggccggcagccgggtgccccgcatcaagagccagaccatcgcctgccgcagcggccccacctggtggggcccccagaggctgaacagcggcggccgctgggacagcgaggtgatggccagcacagtggtgaagtacctgagccaggaggaggcccaggccgtggaccaggagctgttcaatgagtaccagttctctgtggaccagctgatggagctggccggcctgagctgtgccacagccatcgccaaggcctacccacccacctccatgagccgcagcccccccaccgtgctggtgatctgtggccctggcaacaatggaggagatggcctggtgtgtgcccggcacctgaagctgtttggctatgagcccaccatctactaccccaagaggcccaacaagcccctcttcaccgccctggtgacccagtgccagaagatggacatccccttcctgggggagatgcctgctgagcccatgaccattgatgagctgtatgagctggtggtggatgccatcttcggcttctccttcaagggagatgtgcgggagcccttccacagcatcctgtctgtgctgaagggcctgactgtgcccatcgccagcattgacatccccagcggctgggatgtggagaagggaaatgctgggggcatccagcctgacctgctgatcagcctgacagcccccaagaagagcgccacccagttcaccggccgctaccactacctgggcggccgctttgtgcccccagccctggagaagaagtaccagctgaacctgcccccctacccagacacagaatgtgtgtaccgcctgcagtag

SEQ ID NO: 8061 - DNA, 1137 bp, Artificial Sequence; identical to SEQ ID NO: 7841
  Description of Artificial Sequence: Synthetic coding sequence

SEQ ID NO: 8062 - DNA, 762 bp, Artificial Sequence
  Description of Artificial Sequence: Synthetic coding sequence
atggccccctggagccaccccagcgcccagctgcagcctgtgggcggagatgctgtgtccccagccctgatggtgctgctgtgcctgggcaacctgagcaaggccaccctgtgggccgagcccggcagcgtcatcagccggggcaacagcgtgaccatccgctgccagggcaccctggaggcccaggagtaccgcctggtgaaggagggcagccctgagccctgggacacccagaaccccctggagcccaagaacaaggcccgcttcagcatccccagcatgacagagcaccacgccggccgctaccgctgctactactacagccctgctggctggagcgagcccagcgaccccctggagctggtggtgacaggcttctacaacaagcccaccctgagcgccctgcccagccctgtggtgaccagcggggagaatgtgaccctgcagtgtggcagccggctgcgctttgaccgcttcatcctgacagaggagggggaccacaagctgtcctggaccctggacagccagctgacccccagcggccagttccaggccctcttccctgtgggccctgtgacccccagccaccgctggatgctgcgctgctacggcagccgccgccacatcctgcaggtgtggagcgagcccagcgacctgctggagatccctgtgtctggagaggaggccaccgtcttcagcagcaccatccagggcagccagacaggctgtggggagctgtaccggcagggcagcccctgctag

SEQ ID NO: 8063 - DNA, 288 bp, Artificial Sequence
  Description of Artificial Sequence: Synthetic coding sequence
atgaggaagcccaggaggaagagccggcagaatgctgagggcagaagaagccccagcccctacagcctgaagtgcagccccacccgggagaccctgacctacgcccaggcccagagaattgtggaggtggacattgatggccgcctgcaccgcatcagcatctatgaccccctgaagatcatcacagaagatgagctgacagcccaggacatcacagagtgcaacagcaacaaggaaaattctgagcagccccagtttcctgggaagagcaagaagcccagcagctag

SEQ ID NO: 8064 - DNA, 1311 bp, Artificial Sequence
  Description of Artificial Sequence: Synthetic coding sequence
atgaagttccagggccccctggcctgcctgctgctggccctgtgcctgggcagcggggaggccggccccctgcagagcggggaggagagcacaggcaccaacattggagaggccctgggccacggcctgggagatgccctgtctgagggcgtgggcaaggccatcggcaaggaggccggcggcgctgctggcagcaaggtgtctgaggccctgggccagggcacccgggaggccgtgggcactggagtgcggcaggtgcccggctttggagtggctgatgccctgggcaacagagtgggggaggccgcccacgccctgggcaacacaggccatgaaattggccggcaggccgaggatgtgatcagacatggagcagatgctgtgcggggctcctggcagggcgtgcccggccacaatggagcctgggagaccagcggcggccacggcatcttcggcagccagggcggcctgggcggccagggccagggcaaccctgggggcctgggcaccccctgggtgcacggctacccaggcaacagcgctggcagctttggcatgaacccccagggcgccccctggggccagggcggcaatggaggcccccccaactttggcaccaacacccagggcgctgtggcccagcccggctacggctctgtgcgggccagcaaccagaatgaaggctgcaccaaccccccaccttctggcagcggcggcggcagcagcaacagcggcggcggcagcggcagccagagcggcagcagcggcagcggcagcaatggagacaacaacaacggcagcagcagcggcggcagcagcagcggcagcagcagcggcggcagcagcggcggcagcagcggcggcagcagcggcaacagcggcggcagcagaggagacagcggcagcgagagctcctggggcagcagcacaggcagcagcagcggcaaccacggcggcagcggcggcggcaatggccacaagccaggctgtgagaagccaggaaatgaggcccggggcagcggggagagcggcatccagggcttccggggccagggcgtgagcagcaacatgagggagatcagcaaggagggcaaccggctgctgggcggcagcggggacaactaccggggccagggcagctcctggggcagcggcggcggagatgctgtgggcggcgtgaacacagtgaacagcgagaccagccctggcatgttcaactttgacaccttctggaagaacttcaagagcaagctgggcttcatcaactgggatgccatcaacaaggaccagaggagcagccgcatcccctag

SEQ ID NO: 8065 - DNA, 240 bp, Artificial Sequence
  Description of Artificial Sequence: Synthetic coding sequence
atgcctgcctgccgcctgggccccctggccgccgccctgctgctgagcctgctgctgtttggcttcaccctggtgtctggcaccggggctgagaagacaggagtgtgcccagagctgcaggccgaccagaactgcacccaggagtgtgtgtctgattctgaatgtgccgacaacctgaagtgctgcagcgctggctgtgccaccttctgcagcctgcccaacggccagctggccgagtag

SEQ ID NO: 8066 - DNA, 2130 bp, Artificial Sequence
  Description of Artificial Sequence: Synthetic coding sequence
atgggctgcctgtggggcctggccctgcccctcttcttcttctgctgggaggtgggcgtgtctggcagcagcgctggccccagcacccggcgggctgacacagccatgaccacagatgacacagaggtgcctgccatgaccctggcccctggccatgctgccctggagacccagaccctgtctgctgagaccagcagccgggccagcaccccagctggccccatccctgaggccgagaccaggggggccaagaggatcagccctgcccgggagaccaggagcttcaccaagaccagccccaacttcatggtgctgattgccacctctgtggagaccagcgctgccagcggcagccctgagggcgccggcatgaccaccgtgcagaccatcactggaagtgacccccgggaggccatctttgacaccctgtgcacagatgacagcagcgaggaggccaagaccctgaccatggacatcctgaccctggcccacaccagcacagaggccaagggcctgagcagcgagagcagcgccagcagtgacagcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcccccaccctgtgatcacccccagccgggccagcgagagcagcgccagcagtgatggcctgcaccctgtgatcacccccagccgggccagcgagagcagcgccagcagtgatggcccccaccctgtgatcacccccagccgggccagcgagagcagcgccagcagtgatggcccccaccctgtgatcacccccagctggagccctggcagtgatgtgaccctgctggccgaggccctggtgacagtgaccaacattgaagtcatcaactgcagcatcacagaaattgagaccaccaccagcagcatccctggggccagtgacacagacctgatccccacagaaggagtgaaggccagcagcaccagtgaccccccagccctgcctgacagcacagaggccaagccccacatcacagaggtgacagccagcgctgagaccctgagcacagctggcaccacagaatctgctgccccagatgccaccgtgggcacccccctgcccaccaacagcgccacagagcgggaggtgacagcccctggggccaccaccctgagcggggccctggtgacagtgtccaggaaccccctggaggagaccagcgccctgtctgtggagacccccagctatgtgaaggtgtctggagctgcccctgtgtccattgaggccggcagcgctgtgggcaagaccaccagctttgctggcagcagcgccagcagctacagccccagcgaggccgccctgaagaacttcaccccatctgagacccccaccatggacatcgccaccaagggccccttccccaccagccgggaccccctgcccagcgtgccccccaccaccaccaacagcagccggggcaccaacagcaccctggccaagatcaccaccagcgccaagaccaccatgaagccacccacagccacccccaccacagcccggacccggcccaccacagatgtgtctgctggggagaatggaggcttcctgctgctgcggctgtctgtggccagccctgaggacctgacagacccccgggtggccgagcggctgatgcagcagctgcaccgggagctgcacgcccacgccccccacttccaggtgtccctgctgcgggtgagaagaggatag

SEQ ID NO: 8067 - DNA, 2067 bp, Artificial Sequence
  Description of Artificial Sequence: Synthetic coding sequence
atgctgcccacagaggtgccccagagccaccctggccccagcgccctgctgctgctgcagctgctgctgccccccaccagcgccttcttccccaacatctggagcctgctggccgcccctggcagcatcacccaccaggacctgacagaggaggccgccctgaatgtgaccctgcagctgttcctggagcagcccccacctggccggccccccctgcggctggaggacttcctgggccgcaccctgctggctgatgacctgtttgctgcctacttcggccctggcagcagccgccgcttccgggccgccctgggggaggtgtcccgggccaatgctgcccaggacttcctgcccaccagcagaaatgaccctgacctgcactttgatgctgagcggctgggccagggccgggcccggctggtgggcgccctgcgggagaccgtggtggccgcccgggccctggaccacaccctggcccggcagaggctgggcgccgccctgcacgccctgcaggacttctacagccacagcaactgggtggagctgggggagcagcagccccacccccacctgctgtggccccggcaggagctgcagaacctggcccaggtggccgaccccacctgcagcgactgtgaggagctgagctgccccaggaactggctgggcttcaccctgctgaccagcggctacttcggcacccacccccccaagcccccaggcaagtgcagccatggaggccactttgacaggagcagcagccagcccccccggggcggcatcaacaaggacagcaccagccctggcttcagcccccaccacatgctgcacctgcaggccgccaagctggccctgctggccagcatccaggccttcagcctgctgcggagccggctgggggaccgggacttcagccggctgctggacatcaccccagccagcagcctgagctttgtgctggacaccaccggctccatgggagaggagatcaatgctgccaagatccaggcccggcacctggtggagcagaggcggggcagccccatggagcctgtgcactacgtgctggtgcccttccatgaccccggcttcggccctgtgttcaccaccagtgaccctgacagcttctggcagcagctgaatgagatccacgccctgggcggcggagatgagcctgagatgtgcctgagcgccctgcagctggccctgctgcacaccccacccctgagtgacatctttgtgttcacagatgccagccccaaggatgccttcctgaccaaccaggtggagagcctgacccaggagcggcgctgccgggtgaccttcctggtgacagaggacaccagccgggtgcagggccgggcccggcgggagatcctgagccccctgcgctttgagccctacaaggctgtggccctggccagcggcggggaggtgatcttcaccaaggaccagcacatcagagatgtggccgccatcgtgggggagagcatggccgccctggtgaccctgcccctggacccccctgtggtggtgcccggccagcccctggtgttttctgtggatggcctgctgcagaagatcaccgtgcgcatccatggagacatcagcagcttctggatcaagaacccagctggggtgtcccagggccaggaggagggcggcggccccctgggccacacccggcgcttcggccagttctggatggtgaccatggatgatcctccccagacaggcacctgggagatccaggtgacagctgaggacaccccaggagtgcgggtgcaggcccagaccagcctggacttcctgttccacttcggcatccccatggaggatggcccccaccctggcctgtaccccctgacccagcctgtggccggcctgcagacccagctgctggtggagagccagagctggggcagcagcgctgccttcctgcccaggcaccccagccggggcccccggggctgcaggaccaggcctggggccctgggcgcccggggcaccagcggggcccggagccccaggagcctggccgtggcccacgccgctgtgcacccctag

SEQ ID NO: 8068 - DNA, 1257 bp, Artificial Sequence
  Description of Artificial Sequence: Synthetic coding sequence
aacaacctgaatgtgggcagtgacaccaccagcgagaccagcttcagcctgagcaaggaggccccccgggagcacctggaccaccaggccgcccaccagcccttcccccggccccgcttccggcaggagaccggccaccccagcctgcagagggacttccccaggagcttcctgctggacctgcccaacttcccagacctgagcaaggctgacatcaatggccagaaccccaacatccaggtgaccatcgaggtggtggatggcccagattctgaggccgacaaggaccagcaccctgagaacaagcccagctggagcgtgcccagcccagactggagggcctggtggcagaggagcctgagcctggcccgggccaacagcggggaccaggactacaagtatgacagcaccagtgatgacagcaacttcctgaaccccccccggggctgggaccacacagcccctggccacaggacctttgagaccaaggaccagccagaatatgacagcacagatggagagggggactggagcctgtggagcgtgtgcagcgtgacctgtggaaatggaaaccagaagaggaccaggagctgtggctacgcctgcacagccacagagagcaggacctgtgaccggcccaactgccccggcatcgaggacaccttcagaacagctgccacagaggtgtccctgctggccggcagcgaggagttcaatgccaccaagctgtttgaggtggacacagacagctgtgagcgctggatgagctgcaagtctgagttcctgaagaagtacatgcacaaggtgatgaatgacctgcccagctgcccctgcagctaccccacagaggtggcctacagcacagctgacatctttgaccgcatcaagaggaaggacttccgctggaaggatgccagcggccccaaggagaagctggagatctacaagcccacagcccgctactgcatccgctccatgctgagcctggagagcaccaccctggccgcccagcactgctgctatggagacaacatgcagctgatcacccggggcaagggggccggcacccccaacctgatcagcacagagttctctgctgagctgcactacaaggtggatgtgctgccctggatcatctgcaagggggactggagccgctacaatgaggcccggccccccaacaacggccagaagtgcacagagagccccagtgatgaggactacatcaagcagttccaggaggcccgggagtactag

SEQ ID NO: 8069 - DNA, 693 bp, Artificial Sequence; identical to SEQ ID NO: 7341
  Description of Artificial Sequence: Synthetic coding sequence

SEQ ID NO: 8070 - DNA, 192 bp, Artificial Sequence; identical to SEQ ID NO: 7947
  Description of Artificial Sequence: Synthetic coding sequence

SEQ ID NO: 8071 - DNA, 1014 bp, Artificial Sequence
  Description of Artificial Sequence: Synthetic coding sequence
atgctgagcctgggcgcccacagcgtgaccaagacccagatcctgcagggcctgggcttcaacctgacccacaccccagagagcgccatccaccagggcttccagcacctggtgcacagcctgactgtgcccagcaaggacctgaccctgaagatgggcagcgccctgtttgtgaagaaggagctgcagctgcaggccaacttcctgggcaatgtgaagaggctgtatgaggccgaggtgttcagcacagacttcagcaaccccagcatcgcccaggcccgcatcaacagccacgtgaagaagaagacccagggcaaggtggtggacatcatccagggcctggacctgctgacagccatggtgctggtgaaccacatcttcttcaaggccaagtgggagaagcccttccaccctgagtacaccaggaagaacttccccttcctggtgggggagcaggtgacagtgcacgtgcccatgatgcaccagaaggagcagtttgccttcggcgtggacacagagctgaactgctttgtgctgcagatggactacaagggagatgctgtggccttctttgtgctgcccagcaagggcaagatgaggcagctggagcaggccctgagcgcccggaccctgaggaagtggagccacagcctgcagaagcgctggattgaggtgttcatcccccgcttcagcatcagcgccagctacaacctggagaccatcctgcccaagatgggcatccagaatgtgtttgacaagaatgctgacttcagcggcatcgccaagagggacagcctgcaggtgtccaaggccacccacaaggctgtgctggatgtgtctgaggagggcacagaggccacagctgccaccaccaccaagttcatcgtgcgcagcaaggatggccccagctacttcaccgtgtccttcaacagaaccttcctgatgatgatcaccaacaaggccacagatggcatcctcttcctgggcaaggtggagaaccccaccaagagctag

SEQ ID NO: 8072 - DNA, 336 bp, Artificial Sequence
  Description of Artificial Sequence: Synthetic coding sequence
atgttcttcaccatcagcaggaagaacatgagccagaagctgagcctgctgctgctggtgtttggcctcatctggggcctgatgctgctgcactacaccttccagcagcccaggcaccagagctctgtgaagctgcgggagcagatcctggacctgagcaagcgctacgtgaaggccctggccgaggagaacaagaacacagtggatgtggagaatggagcctccatggccggctacgccgacctgaagaggaccatcgctgtgctgctggatgacatcctgcagaggctggtgaagctggagaacaaggtggactacatcgtggtgaatggatag

SEQ ID NO: 8073 - DNA, 498 bp, Artificial Sequence; identical to SEQ ID NO: 7058
  Description of Artificial Sequence: Synthetic coding sequence

SEQ ID NO: 8074 - DNA, 699 bp, Artificial Sequence
  Description of Artificial Sequence: Synthetic coding sequence
atggtgctgctgctggtgatcctgatccctgtgctggtgtcctctgctggcaccagcgcccactatgagatgctgggcacctgcaggatggtgtgtgacccctatggaggcaccaaggcccccagcacagctgccaccccagaccggggcctgatgcagagcctgcccaccttcatccagggcccccccatgggccccccaggagagaagggggagcccggccggcagggcctgcccggccccccaggggcccctggcctgaatgctgctggggccatctctgctgccacctacagcacagtgcccaagatcgccttctacgccggcctgaagaggcagcacgagggctatgaggtgctgaagtttgatgatgtggtgaccaacctgggcaaccactatgaccccaccaccgggaagttcacctgcagcatccctggcatctacttcttcacctaccacgtgctgatgagaggaggagatggcacctccatgtgggccgacctgtgcaagaacaaccaggtgcgggccagcgccatcgcccaggatgctgaccagaactatgactatgccagcaacagcgtggtgctgcacctggagcctggagatgaggtgtacatcaagctggatggcggcaaggcccacggcggcaacaacaacaagtacagcaccttcagcggcttcatcatctatgctgactag

SEQ ID NO: 8075 - DNA, 501 bp, Artificial Sequence; identical to SEQ ID NO: 7976
  Description of Artificial Sequence: Synthetic coding sequence

SEQ ID NO: 8076 - DNA, 627 bp, Artificial Sequence
  Description of Artificial Sequence: Synthetic coding sequence
atgatcatcaagcacttctttggaacagtgctggtgctgctggccagcaccaccatcttcagcctggacctgaagctgatcatcttccagcagaggcaggtgaaccaggagagcctgaagctgctgaacaagctgcagaccctgagcatccagcagtgcctgccccacaggaagaacttcctgctgccccagaagagcctgagcccccagcagtaccagaagggccacaccctggccatcctgcacgagatgctgcagcagatcttcagcctcttccgggccaacatcagcctggatggctgggaggagaaccacacagagaagttcctgatccagctgcaccagcagctggagtacctggaggccctgatgggcctggaggccgagaagctgagcggcaccctgggcagtgacaacctgcggctgcaggtgaagatgtacttccgccgcatccatgactacctggagaaccaggactacagcacctgtgcctgggccatcgtgcaggtggagatcagccgctgcctcttctttgtgttcagcctgacagagaagctgagcaagcagggccggcccctgaatgacatgaagcaggagctgaccacagagttccgcagccccaggtag

SEQ ID NO: 8077 - DNA, 2241 bp, Artificial Sequence
  Description of Artificial Sequence: Synthetic coding sequence
atgcccttccgccacaagccaggctctgtgttttctgtggagggggagaacctggacctggccatgagcaaggaggaggtggtggccatgattggagatggcccctgtgtggtgaagaccctgaccaggcaccacctgtactgtgagccccctgtggagcagcccctgcccaggcaccacgccctgcgggaggccccagacagcctgcctgagttcaccgtgcagatgggcaacctgcgcttcagcctgggccacgtgcagtatgatggagagagccctggggccttccctgtggccgcccaggtgggcctgggcgtgggcaccagcctgctggccctgggcgtcatcatcatcgtgctgatgtacagaaggaagagcaagcaggccctgcgggactacaagaaggtgcagatccagctggagaacctggagagctctgtgcgggaccgctgcaagaaggagttcacagacctgatgacagagatgacagacctgaccagtgacctgctgggcagcggcatccccttcctggactacaaggtgtatgcagagcgcatcttcttccctggccaccgggagagccccctgcaccgggacctgggcgtgcctgagagccggcggcccaccgtggagcagggcctgggccagctgagcaacctgctgaacagcaagctgttcctgaccaagttcatccacaccctggagagccagaggaccttcagcgcccgggaccgggcctacgtggccagcctgctgactgtggccctgcacggcaagctggagtacttcacagacatcctgcggaccctgctgagtgacctggtggcccagtatgtggccaagaaccccaagctgatgctgcggaggacagagaccgtggtggagaagctgctgaccaactggatgagcatctgcctgtacacctttgtgcgggacagcgtgggggagcccctgtacatgctgttccggggcatcaagcaccaggtggacaagggccctgtggacagcgtgacaggcaaggccaagtacaccctgaatgacaaccggctgctgagagaagatgtggagtaccggcccctgaccctgaatgccctgctggccgtgggccctggggccggggaggcccagggcgtgcctgtgaaggtgctggactgtgacaccatcagccaggccaaggagaagatgctggaccagctgtacaagggcgtgcccctgacccagaggccagaccccaggaccctggatgtggagtggaggtctggagtggccggccacctgatcctgagtgatgaagatgtgaccagcgaggtgcagggcctgtggaggcggctgaacaccctgcagcactacaaggtgcctgatggagccaccgtggccctggtgccctgcctgaccaagcacgtgctgcgggagaaccaggactatgtgcctggagagaggacccccatgctggaggatgtggatgagggcggcatccggccctggcacctggtgaagcccagtgatgagcctgagcccccccggccccggcggggcagcctgcggggcggggagcgggagcgggccaaggccatccctgagatctacctgacccggctgctgtccatgaagggcaccctgcagaagtttgtggatgacctcttccaggtgatcctgagcaccagcaggcctgtgcccctggccgtgaagtacttctttgacctgctggatgagcaggcccagcagcacggcatcagtgaccaggacaccatccacatctggaagaccaacagcctgcccctgcgcttctggatcaacatcatcaagaacccccagtttgtgtttgatgtgcagaccagtgacaacatggatgctgtgctgctggtgattgcccagaccttcatggatgcctgcaccctggccgaccacaagctgggccgggacagccccatcaacaagctgctgtatgcccgggacatcccccgctacaagaggatggtggagcgctactatgctgacatccggcagacagtgcctgccagtgaccaggagatgaacagcgtgctggccgagctgtcctggaactacagcggggacctgggcgcccgggtggccctgcacgagctgtacaagtacatcaacaagtactatgaccagatcatcacagccctggaggaggatggaacagcccagaagatgcagctgggctaccgcctgcagcagattgctgctgctgtggagaacaaggtgacagacctgtag

SEQ ID NO: 8078 - DNA, 603 bp, Artificial Sequence; identical to SEQ ID NO: 7249
  Description of Artificial Sequence: Synthetic coding sequence

SEQ ID NO: 8079 - DNA, 114 bp, Artificial Sequence
  Description of Artificial Sequence: Synthetic coding sequence
atgggctggctgaccagaattgtgtgcctcttctggggcgtgctgctgacagcccgggccaactaccagaatggcaagaacaacgtgccccggctgaagctgagctacaagtag

SEQ ID NO: 8080 - DNA, 525 bp, Artificial Sequence
  Description of Artificial Sequence: Synthetic coding sequence
atgaggctgctggccttcctgagcctgctggccctggtgctgcaggagactggaacagccagcctgcccaggaaggagaggaagagaagagaggagcagatgccccgggagggggacagctttgaggtgctgcccctgagaaatgatgtgctgaacccagacaactacggggaggtgattgacctgagcaactatgaggagctgacagattatggagaccagctgcctgaggtgaaggtgaccagcctggccccagccaccagcatcagccctgccaagagcaccacagcccctggcacccccagcagcaaccccaccatgacccggcccaccacagctggcctgctgctgagcagccagcccaaccacgaggacatcccccccctgcccaggagaacagcctacctgtatgcccgcttcaaccgcatcagccgcatccgggcagaggacttcaagggcctgaccaagctgaagagaattgacctgagcaacaacctgatcagcagcattgacaatgatgcctag

SEQ ID NO: 8081 - DNA, 657 bp, Artificial Sequence; identical to SEQ ID NO: 7550
  Description of Artificial Sequence: Synthetic coding sequence

SEQ ID NO: 8082 - DNA, 2535 bp, Artificial Sequence; identical to SEQ ID NO: 7302
  Description of Artificial Sequence: Synthetic coding sequence

SEQ ID NO: 8083 - DNA, 2007 bp, Artificial Sequence
  Description of Artificial Sequence: Synthetic coding sequence
atggacctggtgctgaagcgctgcctgctgcacctggccgtgattggagccctgctggccgtgggcgccaccaaggtgcccaggaaccaggactggctgggcgtgtcccggcagctgcggaccaaggcctggaaccggcagctgtacccagagtggacagaggcccagaggctggactgctggaggggcggccaggtgtccctgaaggtgtccaatgatggccccaccctcatcggggccaatgccagcttcagcatcgccctgaacttccctggcagccagaaggtgctgcctgatggccaggtgatctgggtgaacaacaccatcatcaatggcagccaggtgtggggcggccagcctgtgtacccccaggagacagatgatgcctgcatcttcccagatggcggcccctgccccagcggctcctggagccagaagaggagctttgtgtatgtgtggaagacctggggccagtactggcaggtgctgggcggccctgtgtctggcctgagcatcggcaccggccgggccatgctgggcacccacaccatggaggtgacagtgtaccacagaagaggcagccgctcctatgtgcccctggcccacagcagcagcgccttcaccatcacagaccaggtgcccttctctgtgtctgtgtcccagctgcgggccctggatggcggcaacaagcacttcctgaggaaccagcccctgacctttgccctgcagctgcatgaccccagcggctacctggccgaggccgacctgagctacacctgggactttggagacagcagcggcaccctcatcagccgggccctggtggtgacccacacctacctggagcccggccctgtgacagcccaggtggtgctgcaggccgccatccccctgaccagctgtggcagcagccctgtgcccggcaccacagatggccaccggcccacagctgaggcccccaacaccacagctggccaggtgcccaccacagaggtggtgggcaccaccccaggccaggcccccacagctgagcccagcggcaccacctctgtgcaggtgcccaccacagaggtgatcagcacagcccctgtgcagatgcccacagctgagagcacaggcatgaccccagagaaggtgcctgtgtctgaggtgatgggcaccaccctggccgagatgagcaccccagaggccaccggcatgaccccagctgaggtgtccatcgtggtgctgagcggcaccacagctgcccaggtgaccaccacagagtgggtggagaccacagcccgggagctgcccatccctgagcctgagggcccagatgccagcagcatcatgagcacagagagcatcaccggcagcctgggccccctgctggatggaacagccaccctgcggctggtgaagaggcaggtgcccctggactgtgtgctgtaccgctatggcagcttctctgtgaccctggacatcgtgcagggcattgaatctgctgagatcctgcaggccgtgcccagcggggagggagatgcctttgagctgactgtgtcctgccagggcggcctgcccaaggaggcctgcatggagatcagcagccctggctgccagcccccagcccagaggctgtgccagcctgtgctgcccagccctgcctgccagctggtgctgcaccagatcctgaagggcggcagcggcacctactgcctgaatgtgtccctggccgacaccaacagcctggccgtggtgtccacccagctgatcatgcctgtgcccggcatcctgctgaccggccaggaggccggcctgggccaggtgcccctcatcgtgggcatcctgctggtgctgatggctgtggtgctggccagcctcatctacagaagaaggctgatgaagcaggacttctctgtgccccagctgccccacagcagcagccactggctgcggctgccccgcatcttctgcagctgccccatcggggagaacagccccctgctgagcggccagcaggtgtag

SEQ ID NO: 8084 - DNA, 525 bp, Artificial Sequence
  Description of Artificial Sequence: Synthetic coding sequence
atggctgacatgcagaacctggtggagcggctggagagagctgtgggccgcctggaggccgtgagccacaccagtgacatgcaccggggctacgccgacagccccagcaaggccggggccgccccctacgtgcaggcctttgacagcctgctggccggccctgtggccgagtacctgaagatcagcaaggagattggaggagatgtgcagaagcatgctgagatggtgcacacaggcctgaagctggagcgggccctgctggtgacagccagccagtgccagcagcctgctgagaacaagctgagtgacctgctggcccccatcagcgagcagatcaaggaggtgatcaccttccgggagaagaacagaggcagcaagctgttcaaccacctgtctgctgtgtctgagagcatccaggccctgggctgggtggccatggcccccaagccaggcccctacgtgaaggagatgaatgatgctgccatgttctacaccaacagagtgctgaaggagtacaaggactag

SEQ ID NO: 8085 - DNA, 1368 bp, Artificial Sequence
  Description of Artificial Sequence: Synthetic coding sequence
atgctgcaccctgagaccagccctggccggggccacctgctggccgtgctgctggccctgctgggcacagcctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctggactggagcgacagcctggcccagctggcccaggcccgggccgccctgtgtggcacccccacccccagcctggccagcggcctgtggaggaccctgcaggtgggctggaacatgcagctgctgcctgctggcctggtgtcctttgtggaggtggtgtccctgtggtttgctgagggccagcgctacagccatgctgctggggagtgtgccagaaatgccacctgcacccactacacccagctggtgtgggccaccagcagccagctgggctgcggccgccacctgtgcagcgctggccaggccgccatcgaggcctttgtgtgtgcctacagcccccggggcaactgggaggtgaatggcaagaccatcgtgccctacaagaagggggcctggtgcagcctgtgcacagcctctgtgtctggctgcttcaaggcctgggaccatgctgggggcctgtgtgaggtgcccaggaacccctgcaggatgagctgccagaaccacggccgcctgaacatcagcacctgccactgccactgccccccaggctacacaggccgctactgccaggtgcgctgcagcctgcagtgtgtgcacggccgcttccgggaggaggagtgcagctgtgtgtgtgacatcggctacggcggggcccagtgtgccaccaaggtgcacttccccttccacacctgtgacctgagaattgatggagactgcttcatggtgtcctctgaggccgacacctactaccgggccaggatgaagtgccagaggaagggcggcgtgctggcccagatcaagagccagaaggtgcaggacatcctggccttctacctgggccgcctggagaccaccaatgaagtcatcgacagcgactttgagaccaggaacttctggattggcctgacctacaagacagccaaggacagcttccgctgggccaccggggagcaccaggccttcaccagctttgccttcggccagcctgacaaccacggcctggtgtggctgtctgctgccatgggcttcggcaactgtgtggagctgcaggccagcgctgccttcaactggaatgaccagcgctgcaagaccaggaaccgctacatctgccagtttgcccaggagcacatcagccgctggggccctggcagctag

SEQ ID NO: 8086 - DNA, 297 bp, Artificial Sequence
  Description of Artificial Sequence: Synthetic coding sequence
atggtgctggccatgctgggcgccctgcaccccagggctggcctgagcctcttcctgcacctgatcctggccgtggccctgctgcggagccagcccctgcggagccagaggtctgtgcctgaggccttcagcgcccccctggagctgagccagcccctgagcggcctggtggatgattatggcatcctgcccaagcacccccggccccggggcccccggcccctgctgagccgggcccagcagaggaagagagatggccctgacctggccgagtactactatgatgcccacctgtag

SEQ ID NO: 8087 - DNA, 2742 bp, Artificial Sequence; identical to SEQ ID NO: 7141
  Description of Artificial Sequence: Synthetic coding sequence

SEQ ID NO: 8088 - DNA, 678 bp, Artificial Sequence; identical to SEQ ID NO: 7810
  Description of Artificial Sequence: Synthetic coding sequence

SEQ ID NO: 8089 - DNA, 405 bp, Artificial Sequence
  Description of Artificial Sequence: Synthetic coding sequence
atgccccgctgccgctggctgagcctcatcctgctgaccatccccctggccctggtggccaggaaggaccccaagaagaatgaaacaggagtgctgaggaagctgaagcctgtgaatgccagcaatgccaacgtgaagcagtgcctgtggtttgccatgcaggagtacaacaaggagagcgaggacaagtatgtgttcctggtggtgaagaccctgcaggcccagctgcaggtgaccaacctgctggagtacctgattgatgtggagatcgcccggagtgactgcaggaagcccctgagcaccaatgagatctgtgccatccaggagaacagcaagctgaagaggaagctgagctgcagcttcctggtgggcgccctgccctggaatggagagttcaccgtgtag

SEQ ID NO: 8090 - DNA, 1182 bp, Artificial Sequence; identical to SEQ ID NO: 7135
  Description of Artificial Sequence: Synthetic coding sequence

SEQ ID NO: 8091 - DNA, 678 bp, Artificial Sequence; identical to SEQ ID NO: 7810
  Description of Artificial Sequence: Synthetic coding sequence

SEQ ID NO: 8092 - DNA, 1410 bp, Artificial Sequence
  Description of Artificial Sequence: Synthetic coding sequence
atgatgaggctgggcggccgcctggtgctgaacaccaaggaggagctggccaatgaaaggctgatgaccctgaagattgctgagatgaaggaggccatgaggaccctcatcttccccccatccatgcacttcttccaggccaagcacctgattgaaagaagccaggtgttcaacatcctgaggatgatgcccaagggagctgccctgcacctgcatgacatcggcatcgtgaccatggactggctggtgagaaatgtgacctaccggccccactgccacatctgcttcaccccccggggcatcatgcagttccgctttgcccaccccaccccccggcccagcgagaagtgcagcaagtggatcctgctggaggactacaggaagagggtgcagaatgtgacagaatttgatgacagcctgctgaggaacttcaccctggtgacccagcaccctgaggtgatctacaccaaccagaatgtggtgtggagcaagtttgagaccatcttcttcaccatcagcggcctcatccactacgcccctgtgttccgggactatgtgttccgctccatgcaggagttctatgaagataatgtgctgtacatggagatccgggcccggctgctgcctgtgtatgagctgagcggggagcaccatgatgaggagtggagcgtgaagacctaccaggaggtggcccagaagtttgtggagacccaccctgagttcatcggcatcaagatcatctacagcgaccacaggagcaaggatgtggccgtgattgctgagagcatccgcatggccatgggcctgcgcatcaagttccccaccgtggtggccggctttgacctggtgggccacgaggacaccggccacagcctgcatgactacaaggaggccctgatgatcccagccaaggatggagtgaagctgccctacttcttccacgccggggagacagactggcagggcaccagcattgacaggaacatcctggatgccctgatgctgaacaccacccgcatcggccacggctttgccctgagcaagcaccctgctgtgaggacctacagctggaagaaggacatccccatcgaggtgtgccccatcagcaaccaggtgctgaagctggtgtctgacctgaggaaccaccctgtggccaccctgatggccaccggccaccccatggtgatcagcagtgatgatcctgccatgtttggagccaagggcctgtcctatgacttctatgaggtgttcatgggcatcggcggcatgaaggctgacctgcggaccctgaagcagctggccatgaacagcatcaagtacagcaccctgctggagagcgagaagaacaccttcatggagatctggaagaagcgctgggacaagttcatcgcagatgtggccaccaagtag

SEQ ID NO: 8093 - DNA, 1137 bp, Artificial Sequence; identical to SEQ ID NO: 7841
  Description of Artificial Sequence: Synthetic coding sequence

SEQ ID NO: 8094 - DNA, 678 bp, Artificial Sequence; identical to SEQ ID NO: 7810
  Description of Artificial Sequence: Synthetic coding sequence

SEQ ID NO: 8095 - DNA, 846 bp, Artificial Sequence; identical to SEQ ID NO: 7244
  Description of Artificial Sequence: Synthetic coding sequence

SEQ ID NO: 8096 - DNA, 1110 bp, Artificial Sequence
  Description of Artificial Sequence: Synthetic coding sequence
atgaagttccagggccccctggcctgcctgctgctggccctgtgcctgggcagcggggaggccggccccctgcagagcggggaggagagcacaggcaccaacattggagaggccctgggccacggcctgggagatgccctgtctgagggcgtgggcaaggccatcggcaaggaggccggcggcgctgctggcagcaaggtgtctgaggccctgggccagggcacccgggaggccgtgggcactggagtgcggcaggtgcccggctttggagtggctgatgccctgggcaacagagtgggggaggccgcccacgccctgggcaacacaggccatgaaattggccggcaggccgaggatgtgatcagacatggagcagatgctgtgcggggctcctggcagggcgtgcccggccacaatggagcctgggagaccagcggcggccacggcatcttcggcagccagggcggcctgggcggccagggccagggcaaccctgggggcctgggcaccccctgggtgcacggctacccaggcaacagcgctggcagctttggcatgaacccccagggcgccccctggggccagggcggcaatggaggcccccccaactttggcaccaacacccagggcgctgtggcccagcccggctacggctctgtgcgggccagcaaccagaatgaaggctgcaccaaccccccaccttctggcagcggcggcggcagcagcaacagcggcggcggcagcggcagccagagcggcagcagcggcagcggcagcaatggagacaacaacaacggcagcagcagcggcggcagcagcagcggcagcagcagcggcggcagcagcggcggcagcagcggcggcagcagcggcaacagcggcggcagcagaggagacagcggcagcgagagctcctggggcagcagcacaggcagcagcagcggcaaccacggcggcagcggcggcggcaatggccacaagccaggcaacagcgagaccagccctggcatgttcaactttgacaccttctggaagaacttcaagagcaagctgggcttcatcaactgggatgccatcaacaaggaccagaggagcagccgcatcccctag

SEQ ID NO: 8097 - DNA, 420 bp, Artificial Sequence; identical to SEQ ID NO: 7830
  Description of Artificial Sequence: Synthetic coding sequence

SEQ ID NO: 8098 - DNA, 516 bp, Artificial Sequence
  Description of Artificial Sequence: Synthetic coding sequence
atgaggcacaacctgggcggcaacctgggggacccccgggcccgggctgtgtctgtgcccctgggcggccgggtggcccgcttcctgcagtgccgcttcctgtttgctggcccctggctgctcttcagcgagatctccttcatcagtgatgtggtgaacaacagcagccctgccctgggcggcaccttccccccagccccctggtggcccccaggccccccacccaccaacttcagcagcctggagctggagccccggggccagcagcctgtggccaaggccgagggcagccccacagccatcctgattggctgcctggtggccatcatcctgctgctgctgctgatcatcgccctgatgctgtggaggctgcactggaggcggctgctgagcaaggtgctggagagccaccccaggaccaggagccctggcctggtgggcatccggcccacccccctgcctgtgagccccatggccctggtgcacctgtgtgaggtggacagcccccaggactag

SEQ ID NO: 8099 - DNA, 192 bp, Artificial Sequence; identical to SEQ ID NO: 7947
  Description of Artificial Sequence: Synthetic coding sequence

SEQ ID NO: 8100 - DNA, 1137 bp, Artificial Sequence; identical to SEQ ID NO: 7841
  Description of Artificial Sequence: Synthetic coding sequence

SEQ ID NO: 8101 - DNA, 2535 bp, Artificial Sequence; identical to SEQ ID NO: 7302
  Description of Artificial Sequence: Synthetic coding sequence

SEQ ID NO: 8102 - DNA, 339 bp, Artificial Sequence
  Description of Artificial Sequence: Synthetic coding sequence
atgctgacagctgccctggcccctggggccgccaacagccccaccaccaaccctgtgatcctgattgtggacaaggtgctggagacccaggacctgaatggagatggcctgatgaccccagctgagctgatcaacttccctggggtggccctgcggccctacccaccctacatcggcgtgggccccaacagcaacatgtgcagcagaagtgacctgcctgaggacagcaacaccctgtacccaggcagccacctgtggctgcggcatgccctgaacagcaagggcaacctggatgcccggctggatggaggagagaaggccatgcagccccagtggtag

SEQ ID NO: 8103 - DNA, 2676 bp, Artificial Sequence; identical to SEQ ID NO: 7495
  Description of Artificial Sequence: Synthetic coding sequence

SEQ ID NO: 8104 - DNA, 2742 bp, Artificial Sequence; identical to SEQ ID NO: 7141
  Description of Artificial Sequence: Synthetic coding sequence

SEQ ID NO: 8105 - DNA, 390 bp, Artificial Sequence; identical to SEQ ID NO: 7503
  Description of Artificial Sequence: Synthetic coding sequence

SEQ ID NO: 8106 - DNA, 846 bp, Artificial Sequence; identical to SEQ ID NO: 7244
  Description of Artificial Sequence: Synthetic coding sequence

SEQ ID NO: 8107 - DNA, 444 bp, Artificial Sequence; identical to SEQ ID NO: 7701
  Description of Artificial Sequence: Synthetic coding sequence

SEQ ID NO: 8108 - DNA, 2631 bp, Artificial Sequence; identical to SEQ ID NO: 6925
  Description of Artificial Sequence: Synthetic coding sequence

SEQ ID NO: 8109 - DNA, 1749 bp, Artificial Sequence
  Description of Artificial Sequence: Synthetic coding sequence
atggacttcctgctggccctggtgctggtgagcagcctgtacctgcaggccgctgctgagtttgatggccgctggccccggcagatcgtgagcagcatcggcctgtgccgctatggaggaagaattgactgctgctggggctgggcccggcagagctggggccagtgccagcccttctacgtgctgcggcagagaattgcccgcatccgctgccagctgaaggctgtgtgccagccccgctgcaagcatggagaatgtattggccccaacaagtgcaagtgccaccctggctacgccggcaagacctgcaaccaggacctgaatgaatgtggcctgaagccccggccctgcaagcaccgctgcatgaacacctacggcagctacaagtgctactgcctgaatggctacatgctgatgccagatggcagctgcagcagcgccctgacctgcagcatggccaactgccagtatggctgtgatgtggtgaagggccagatccgctgccagtgccccagccctggcctgcagctggccccagatggccgcacctgtgtggatgtggatgaatgtgccaccggccgggccagctgcccccgcttccggcagtgtgtgaacaccttcggcagctacatctgcaagtgccacaagggctttgacctgatgtacatcggcggcaagtaccagtgccacgacattgatgagtgcagcctgggccagtaccagtgcagcagctttgcccgctgctacaacatccggggcagctacaagtgcaagtgcaaggagggctaccagggagatggcctgacctgtgtgtacatccccaaggtgatgattgagcccagcggccccatccacgtgcccaagggaaatggcaccatcctgaagggggacaccggcaacaacaactggatcccagatgtgggcagcacctggtggccacccaagaccccctacatcccccccatcatcaccaaccggcccaccagcaagcccaccacccggcccacccccaagcccacccccatccccaccccacctcctcctccacccctgcccacagagctgcggacccccctgccccccaccaccccagagcggcccaccaccggcctgaccaccatcgccccagctgccagcaccccacctgggggcatcaccgtggacaacagagtgcagacagacccccagaagcccagaggagatgtgttcatcccccggcagcccagcaatgacctgtttgagatctttgaaattgaaagaggagtgtctgcagatgatgaggccaaggatgaccccggggtgctggtgcacagctgcaactttgaccacggcctgtgtggctggatccgggagaaggacaatgacctgcactgggagcccatccgggaccctgctgggggccagtacctgactgtgtctgctgccaaggcccctgggggcaaggccgcccggctggtgctgcccctgggccgcctgatgcacagcggggacctgtgcctgtccttccgccacaaggtgacaggcctgcacagcggcaccctgcaggtgtttgtgaggaagcatggagcccacggggccgccctgtggggcagaaatggaggccacggctggaggcagacccagatcaccctgcggggagctgacatcaagtctgtggtgttcaagggggagaagagaagaggccacactggagagatcggcctggatgatgtgtccctgaagaagggccactgcagcgaggagaggtag

SEQ ID NO: 8110 - DNA, 1602 bp, Artificial Sequence
  Description of Artificial Sequence: Synthetic coding sequence
atgggcagcagccggctggccgccctgctgctgcccctgctgctgattgtcatcgacctgagtgacagcgctggcatcggcttccgccacctgccccactggaacacccgctgccccctggccagccacacagatgacagcttcaccggcagcagcgcctacatcccctgcaggacctggtgggccctcttcagcaccaagccctggtgtgtgcgggtgtggcactgcagccgctgcctgtgccagcacctgctgagcggcggcagcggcctgcagaggggcctcttccacctgctggtgcagaagagcaagaagagcagcaccttcaagttctacagaagacacaagatgcctgccccagcccagaggaagctgctgccccggcggcacctgtctgagaagagccaccacatcagcatccccagcccagacatcagccacaagggcctgcggagcaagaggacccagcccagcgaccctgagacctgggagagcctgccccggctggacagccagagacatggaggccctgagttctcctttgacctgctgcctgaggcccgggccatccgggtgaccatcagcagcggccctgaggtgtctgtgcggctgtgccaccagtgggccctggagtgtgaggagctgagcagcccctatgatgtgcagaagatcgtgtctgggggccacacagtggagctgccctatgagttcctgctgccctgcctgtgcatcgaggccagctacctgcaggaggacacagtgcggaggaagaagtgccccttccagagctggccagaggcctacggcagtgacttctggaagtctgtgcacttcacagactacagccagcacacccagatggtgatggccctgaccctgcgctgccccctgaagctggaggccgccctgtgccagagacatgactggcacaccctgtgcaaggacctgcccaatgccacagcccgggagagtgatggctggtacgtgctggagaaggtggacctgcacccccagctgtgcttcaagttctcctttggaaacagcagccacgtggagtgcccccaccagacaggcagcctgacctcctggaatgtgtccatggacacccaggcccagcagctgatcctgcacttcagcagcaggatgcacgccaccttctctgctgcctggagcctgcccggcctgggccaggacaccctggtgccccctgtgtacacagtgtcccaggcccggggcagcagccctgtgtccctggacctgatcatccccttcctgcggcccggctgctgcgtgctgctgcacgccagcctgagcagccctggaggagaagatgcctggctgattggagtgggcggctctgtgcccagcggcgtggccgtgcgctgccctgtgtgcctggaggcccccctggtgtctggctgcctgctgcagacccctggggccctggaccccggcacagctggccccccccaccccaccggctgctgcagcggcccccacctgcctgcccccaccgtgcggcccggccccagcgctgccagcgcccccccagcccggggcggcctgggcggggccgccgcccctgggggcagcgctggatag

SEQ ID NO: 8111 - DNA, 1293 bp, Artificial Sequence
  Description of Artificial Sequence: Synthetic coding sequence
atgggcgtgtccaagctggacatcctgtacagaaggctgctgctgaccaagctgttcatccggggctggggccggcctgaggacctgaagaggctgtttgagttcaggaagatgattggcaaccgggagcgctgccagaacctggtgtccagtgactaccctgtgcacatcgacaagattgaggagcagagcgactgcaagatcctggatggccactttgtgagccccatggcccactacgtgcctgacatcatgcccattgaatctgtgattgcccgcttccagttcatcgtgcccaaggagtggaacagcaagtacagacctgtgtgcatccacctggccggcaccggggaccaccactactggaggaggaggaccctgatggcccggcccatgatcaaggaggccaggatggccagcctgctgctggagaacccctactacggctgcaggaagcccaaggaccaggtgcgcagcagcctgaagaatgtgtctgacctgtttgtgatgggcggggccctggtgctggagagcgctgccctgctgcactggctggagcgggagggctacggccccctgggcatgacaggcatctccatgggcggccacatggccagcctggccgtgagcaactggcccaagcccatgcccctcatcccctgcctgtcctggagcacagccagcggggtcttcaccaccacagacagcttcaagatgggccaggagtttgtgaagcacttcaccagcagcgctgacaagctgaccaacctgaacctggtgtccaggaccctgaacctggacatcagcaaccaggtggtgtcccagaagccagctgactgccacaacagcagcaagacctctgtgtctgccaccagcgagggcctgctgctgcaggacaccagcaagatgaagcgcttcaaccagaccctgagcaccaacaagagcggctacaccagcaggaacccccagagctaccacctgctgagcaaggagcagagcaggaacagcctgaggaaggagagcctcatcttcatgaagggcgtgatggatgaatgtacccacgtggccaacttctctgtgcctgtggaccccagcctcatcatcgtggtgcaggccaaggaggatgcctacatccccaggactggagtgcgcagcctgcaggagatctggccaggctgtgagatccgctacctggagggcggccacatcagcgcctacctgttcaagcagggcctcttccggcaggccatctatgatgcctttgaccgcttcctgcacaagtatgccaactag

SEQ ID NO: 8112 - DNA, 2631 bp, Artificial Sequence; identical to SEQ ID NO: 6925
  Description of Artificial Sequence: Synthetic coding sequence

SEQ ID NO: 8113 - DNA, 237 bp, Artificial Sequence; identical to SEQ ID NO: 7333
  Description of Artificial Sequence: Synthetic coding sequence

SEQ ID NO: 8114 - DNA, 2631 bp, Artificial Sequence; identical to SEQ ID NO: 6925
  Description of Artificial Sequence: Synthetic coding sequence

SEQ ID NO: 8115 - DNA, 1257 bp, Artificial Sequence; identical to SEQ ID NO: 7212
  Description of Artificial Sequence: Synthetic coding sequence

SEQ ID NO: 8116 - DNA, 390 bp, Artificial Sequence
  Description of Artificial Sequence: Synthetic coding sequence
atgaggaagcccaggaggaagagccggcagaatgctgagggcagaagaagccccagcccctacagcctgaagtgcagccccacccgggagaccctgacctacgcccaggcccagagaattgtggaggtggacattgatggccgcctgcaccgcatcagcatctatgaccccctgaagatcatcacagaagatgagctgacagcccaggacatcacagagtgcaacagcaacaaggaaaattctgagcagccccagtttcctgggaagagcaagaagcccagcagcaagggcaagaagaaggagagctgcagcaagcacgccagcggcaccagcttccacctgccccagcccagcttcaggatggtggacagcggcatccagcctgagtag

SEQ ID NO: 8117 - DNA, 315 bp, Artificial Sequence
  Description of Artificial Sequence: Synthetic coding sequence
atgagggtggtgaccatcgtcatcctgctgtgcttctgcaaggctgctgagctgaggaaggccagccctggctctgtgcgcagccgggtgaaccacggccgggccggcggcggcagaagaggcagcaaccctgtgaagagatatgcccctggcctgccctgtgatgtgtacacctacctgcacgagaagtacctggactgccaggagaggaagctggtgtatgtgctgcccggctggccccaggacctgctgcacatgctgctggccaggaacaagatccgcaccctgaagaacaacatgttcagcaagttctag

SEQ ID NO: 8118 - DNA, 639 bp, Artificial Sequence; identical to SEQ ID NO: 7993
  Description of Artificial Sequence: Synthetic coding sequence

SEQ ID NO: 8119 - DNA, 1005 bp, Artificial Sequence
  Description of Artificial Sequence: Synthetic coding sequence
atgctggccctggccaagatcctgctgatcagcaccctcttctacagcctgctgagcggcagccacggcaaggagaaccaggacatcaacaccacccagaacattgctgaggtgttcaagaccatggagaacaagcccatcagcctggagagcgaggccaacctgaacagcgacaaggagaacatcaccaccagcaacctgaaggccagccacagcccccccctgaacctgcccaacaacagccacggcatcacagacttcagcagcaacagcagcgctgagcacagcctgggcagcctgaagcccaccagcaccatcagcaccagccccccactcatccacagctttgtgtccaaggtgccctggaatgcccccatcgcagatgaggacctgctgcccatcagcgcccaccccaatgccaccccagccctgagcagcgagaacttcacctggagcctggtgaatgacacagtgaagaccccagacaacagcagcatcaccgtgtccatcctgagcagcgagcccaccagccccagcgtgacccccctcatcgtggagcccagcggctggctgaccaccaacagcgacagcttcaccggcttcaccccctaccaggagaagaccaccctgcagcccaccctgaagttcaccaacaacagcaagctgttccccaacaccagtgacccccagaaggagaacagaaacacaggcatcgtgtttggagccatcctgggcgccatcctgggcgtgtccctgctgaccctggtgggctacctgctgtgtgggaagaggaagacagacagcttcagccaccggcggctgtatgatgacagaaatgaacctgtgctgcggctggacaatgcccctgagccctatgatgtgtcctttggaaacagcagctactacaaccccaccctgaatgattctgccatgcctgagagcgaggagaatgccagagatggcatccccatggatgacatcccccccctgcggacctctgtgtag

SEQ ID NO: 8120 - DNA, 987 bp, Artificial Sequence
  Description of Artificial Sequence: Synthetic coding sequence
atgggccctgctggctgtgccttcaccctgctgctgctgctgggcatctctgtgtgtggccagcctgtgtacagcagccgggtggtgggcggccaggatgctgctgctggccgctggccctggcaggtgtccctgcactttgaccacaacttcatctgtggcggcagcctggtgtctgagcggctcatcctgacagctgcccactgcatccagcccacctggaccaccttctcctacacagtgtggctgggcagcatcaccgtgggggacagcaggaagagggtgaagtactacgtgtccaagatcgtcatccaccccaagtaccaggacaccacagcagatgtggccctgctgaagctgagcagccaggtgaccttcaccagcgccatcctgcccatctgcctgcccagcgtgaccaagcagctggccatcccccccttctgctgggtgacaggctggggcaaggtgaaggagagcagtgaccgggactaccacagcgccctgcaggaggccgaggtgcccatcatcgaccggcaggcctgtgagcagctgtacaaccccatcggcatcttcctgcctgccctggagcctgtgatcaaggaggacaagatctgtgccggggacacccagaacatgaaggacagctgcaagggggacagcggcggccccctgagctgccacattgatggagtgtggatccagacaggagtggtgtcctggggcctggagtgtgggaagagcctgcccggggtgtacaccaacgtcatctactaccagaagtggatcaatgccaccatcagccgggccaacaacctggacttcagtgacttcctgttccccatcgtgctgctgagcctggccctgctgcggcccagctgtgccttcggccccaacaccatccaccgggtgggcaccgtggccgaggccgtggcctgcatccagggctgggaggagaatgcctggaggttcagcccccggggccgctag

SEQ ID NO: 8121 - DNA, 453 bp, Artificial Sequence; identical to SEQ ID NO: 7139
  Description of Artificial Sequence: Synthetic coding sequence

SEQ ID NO: 8122 - DNA, 234 bp, Artificial Sequence
  Description of Artificial Sequence: Synthetic coding sequence
atgagggtggccggggccgccaagctggtggtggccgtggccgtgttcctgctgaccttctacgtgatcagccaggtgtttgagatcaagatggatgccagcctgggcaacctgtttgcccggagcgccctggacacagctgcccggagcaccaagcccccacgctacaagtgtggcatcagcaaggcctgcccagagaagcactttgccttcaagatggccagcggggcctag

SEQ ID NO: 8123 - DNA, 1143 bp, Artificial Sequence; identical to SEQ ID NO: 7426
  Description of Artificial Sequence: Synthetic coding sequence

SEQ ID NO: 8124 - DNA, 558 bp, Artificial Sequence
  Description of Artificial Sequence: Synthetic coding sequence
atgcctggctggctgaccctgcccaccctgtgccgcttcctgctgtgggccttcaccatcttccacaaggcccagggcgaccctgccagccaccctggcccccactacctgctgccccccatccacgaggtgatccacagccacagaggagccacagccaccctgccctgtgtgctgggcaccaccccacccagctacaaggtgcgctggagcaaggtggagcctggagagctgcgggagaccctcatcctgatcaccaacggcctgcacgcccggggctacggccccctgggcggccgggccaggatgaggcggggccaccggctggatgccagcctggtgattgctggggtgcggctggaggatgagggccgctaccgctgtgagctgatcaatggaattgaagatgagagcgtggccctgaccctgagcctggagggcgtggtgttcccctaccagcccagccggggccgctaccagttcaactactatgaggccaagcaggcctgtgaggagcaggacggccgcctggccacctacagccagctgtaccagtag

SEQ ID NO: 8125 - DNA, 375 bp, Artificial Sequence
  Description of Artificial Sequence: Synthetic coding sequence
atgctgatgctgtttgtgtttggagtgctgctgcacgaggtgtccctgagcggccagaatgaggccccacccaacacccacagcatccctggagagcccctgtacaactatgccagcatccggctgcctgaggagcacatccccttcttcctgcacaacaacagacacatcgccaccgtgtgcaggaaggacagcctgtgcccctacaagaagcacctggagaagctgaagtactgctggggctatgagaagagctgcaagccagagttccgcttcggctaccctgtgtgcagctatgtggacatgggctggacagacaccctggagagcgctgaggacatcttctggaagcaggccgactttggctacgcctag

SEQ ID NO: 8126 - DNA, 5859 bp, Artificial Sequence; identical to SEQ ID NO: 7324
  Description of Artificial Sequence: Synthetic coding sequence

SEQ ID NO: 8127 - DNA, 612 bp, Artificial Sequence
  Description of Artificial Sequence: Synthetic coding sequence
atgaggacagtggtgctgaccatgaaggcctctgtgattgagatgttcctggtgctgctggtgactggagtgcacagcaacaaggagacagccaagaagatcaagaggcccaagttcaccgtgccccagatcaactgtgatgtgaaggccggcaagatcatcgaccctgagttcatcgtgaagtgcccagctggctgccaggaccccaagtaccacgtgtatggaacagatgtgtatgccagctacagctctgtgtgtggggctgctgtgcacagcggcgtgctggacaacagcggcggcaagatcctggtgaggaaggtggccggccagagcggctacaagggcagctacagcaatggagtgcagagcctgagcctgccccgctggagggagagcttcatcgtgctggagagcaagcccaagaagggcgtgacctaccccagcgccctgacctacagcagcagcaagagccctgctgcccaggccggcaagtgcagccgggtgattgagagcaagcccagcgagagcatgaacacccggcgggtgctgggggacagcggggagatcaacatcctgaccggccaggcccccctggccctggccatcttctag

SEQ ID NO: 8128 - DNA, 2511 bp, Artificial Sequence
  Description of Artificial Sequence: Synthetic coding sequence
atggagacccaggagctgcggggggccctggccctgctgctgctgtgcttcttcaccagcgccagccaggacctgcaggtgattgacctgctgactgtgggggagagccggcagatggtggccgtggccgagaagatcagaacagccctgctgacagctggggacatctacctgctgagcaccttccggctgccccccaagcagggcggcgtgctgtttggcctgtacagccggcaggacaacacccgctggctggaggcctctgtggtgggcaagatcaacaaggtgaccaatgccctgcacagcatcctgggggagcagaccaaggccctggtgacccagctgaccctcttcaaccagatcctggtggagctgagagatgacatccgggaccaggtgaaggagatgagcctcatccggaacaccatcatggagtgccaggtgtgtggcttccacgagcagaggagccactgcagccccaacccctgcttccggggcgtggactgcatggaggtgtatgagtacccaggctaccgctgtggcccctgccccccaggcctgcagggcaatggcacccactgcagcgacatcaatgaatgtgcccatgctgacccctgcttccctggcagcagctgcatcaacaccatgcctggcttccactgtgaggcctgcccccggggctacaagggcacccaggtgtctggagtgggcatcgactatgcccgggccagcaagcaggtgtgcaatgacattgatgaatgtaatgatggcaacaatggaggctgtgaccccaacagcatctgcaccaacacagtgggcagcttcaagtgtggcccctgccgcctgggcttcctgggcaaccagagccagggctgcctgcctgcccggacctgccacagccctgcccacagcccctgccacatccacgcccactgcctgtttgaaagaaatggagctgtgtcctgccagtgcaatgtgggctgggccggaaatggaaatgtgtgtggcacagacacagacattgatggctacccagaccaggccctgccctgcatggacaacaacaagcactgcaagcaggacaactgcctgctgacccccaacagcggccaggaggatgctgacaatgatggagtgggggaccagtgtgatgatgatgctgatggagatggcatcaagaatgtggaggacaactgccgcctcttccccaacaaggaccagcagaacagcgacacagacagctttggagatgcctgtgacaactgccccaacgtgcccaacaatgaccagaaggacacagatggaaatggagaaggagatgcctgtgacaatgatgtggatggagatggcatccccaacggcctggacaactgccccaaggtgcccaaccccctgcagacagacagagatgaagatggagtgggagatgcctgtgacagctgcccagagatgagcaaccccacccagacagatgctgacagcgacctggtgggagatgtgtgtgacaccaatgaagattctgatggagatggccaccaggacaccaaggacaactgcccccagctgcccaacagcagccagctggacagcgacaatgatggcctgggagatgaatgtgatggagatgatgacaatgatggcatcccagactatgtgcccccaggccctgacaactgccgcctggtgcccaaccccaaccagaaggacagtgatggaaatggagtgggagatgtgtgtgaagatgactttgacaatgatgctgtggtggaccccctggatgtgtgcccagagagcgctgaggtgaccctgacagacttccgggcctaccagacagtggtgctggaccctgaaggagatgcccagattgaccccaactgggtggtgctgaaccagggcatggagatcgtgcagaccatgaacagcgaccccggcctggccgtgggctacacagccttcaatggagtggactttgagggcaccttccacgtgaacacagtgacagatgatgattatgccggcttcctgttctcctaccaggacagcggccgcttctacgtggtgatgtggaagcagacagagcagacctactggcaggccacccccttccgggctgtggcccagcccggcctgcagctgaaggctgtgacctctgtgtctggccctggagagcacctgagaaatgccctgtggcacacaggccacaccccagaccaggtgcggctgctgtggacagaccccagaaatgtgggctggagggacaagaccagctaccgctggcagctgctgcaccggccccaggtgggctacatccgggtgaagctgtatgagggcccccagctggtggccgacagcggggtcatcatcgacacctccatgaggggcggccgcctgggcgtcttctgcttcagccaggagaacatcatctggagcaacctgcagtaccgctgcaatgacacagtgcctgaggactttgagcccttccggcggcagctgctgcagggccgggtgtag

SEQ ID NO: 8129 - DNA, 1311 bp, Artificial Sequence
  Description of Artificial Sequence: Synthetic coding sequence
atgtggcgctgccccctgggcctgctgctgctgctgcccctggccggccacctggccctgggcgcccagcagggccggggccggcgggagctggcccctggcctgcacctgcggggcatcagagatgctgggggccgctactgccaggagcaggacctgtgctgccggggccgggcagatgactgtgccctgccctacctgggcgccatctgctactgtgacctcttctgcaacagaacagtgtctgactgctgcccagacttctgggacttctgcctgggcgtgcccccacccttcccccccatccagggctgcatgcatggaggccgcatctaccctgtgctgggcacctactgggacaactgcaaccgctgctggcaggccggcaaccacagcgccttctggggcatgaccctggatgagggcatccgctaccgcctgggcaccatccggcccagcagctctgtgatgaacatgcatgagatctacacagtgctgaaccctggagaggtgctgcccacagcctttgaggccagcgagaagtggcccaacctgattcatgagcccctggaccagggcaactgtgccggctcctgggccttcagcacagctgctgtggccagtgacagagtgtccatccacagcctgggccacatgacccctgtgctgagcccccagaacctgctgagctgtgacacccaccagcagcagggctgccggggcggccgcctggatggagcctggtggttcctgcggaggagaggagtggtgtctgaccactgctaccccttcagcggccgggagagagatgaggccggccctgccccaccctgcatgatgcacagccgggccatgggccggggcaagaggcaggccacagcccactgccccaacagctatgtgaacaacaatgacatctaccaggtgacccctgtgtaccgcctgggcagcaatgacaaggagatcatgaaggagctgatggagaatggacctgtgcaggccctgatggaggtgcatgaggacttcttcctgtacaagggcggcatctacagccacacccctgtgtccctgggccggcctgagcgctaccgccgccacggcacccacagcgtgaagatcaccggctggggcgaggagaccctgcctgatggccgcaccctgaagtactggacagctgccaacagctggggccctgcctggggcgagcggggccacttccgcatcgtgcggggcgtgaatgaatgtgacatcgagagctttgtgctgggcgtgtggggccgggtgggcatggaggacatgggccaccactag

SEQ ID NO: 8130 - DNA, 942 bp, Artificial Sequence; identical to SEQ ID NO: 7248
  Description of Artificial Sequence: Synthetic coding sequence

SEQ ID NO: 8131 - DNA, 213 bp, Artificial Sequence
  Description of Artificial Sequence: Synthetic coding sequence
atggtggccccagctgcccgggtcttcctgcgggctgtgcgggccgccctgaccagcacagtgcctgacctgctgtgcctgctggcccggggcagcccccggggcctggccagcggccgcctgcccctggccgtgcacagcgcccagcacggccctggcagcggggccccctggctgagaattgcccggcgggccctgagccagaggatctag

SEQ ID NO: 8132 - DNA, 642 bp, Artificial Sequence
  Description of Artificial Sequence: Synthetic coding sequence
atggcccagctgttcctgcccctgctggccgccctggtgctggcccaggccccagctgccctggctgatgtgctggagggggacagcagtgaagatcgggccttccgggtgagaattgctggagatgcccccctgcagggcgtgctgggcggggccctgaccatcccctgccacgtgcactacctgcggcccccacccagccggcgggctgtgctgggcagcccccgggtgaagtggaccttcctgagccggggccgggaggccgaggtgctggtggcccggggcgtgcgggtgaaggtgaatgaggcctaccgcttccgggtggccctgcctgcctacccagccagcctgacagatgtgtccctggccctgtctgagctgcggcccaatgacagcggcatctaccgctgtgaggtgcagcacggcattgatgacagcagtgatgctgtggaggtgaaggtgaagggcgtggtgttcctgtaccgggagggcagcgcccgctatgccttctccttcagcggggcccaggaggcctgtgcccgcatcggggcccacatcgccaccccagagcagctgtatgctgcctacctgggcggctatgagcagtgtgatgctggctggctgagtgaccagacagtgtag

SEQ ID NO: 8133 - DNA, 237 bp, Artificial Sequence; identical to SEQ ID NO: 7333
  Description of Artificial Sequence: Synthetic coding sequence

SEQ ID NO: 8134 - DNA, 651 bp, Artificial Sequence
  Description of Artificial Sequence: Synthetic coding sequence
atgtctgacctgctgctgctgggcctcatcggcggcctgaccctgctgctgctgctgaccctgctggcctttgctggctacagcggcctgctggccggcgtggaggtgtctgctggcagcccccccatcagaaatgtgacagtggcctacaagttccacatgggcctgtatggagagaccggccgcctcttcacagagagctgcagcatcagccccaagctgcggagcattgctgtgtactatgacaacccccacatggtgcccccagacaagtgccgctgtgctgtgggcagcatcctgtctgagggggaggagagccccagccctgagctgattgacctgtaccagaagtttggcttcaaggtgttctccttccctgcccccagccacgtggtgacagccaccttcccctacaccaccatcctgagcatctggctggccaccaggagagtgcacccagccctggacacctacatcaaggagaggaagctgtgtgcctacccccggctggagatctaccaggaggaccagatccacttcatgtgccccctggcccggcagggcgacttctacgtgcctgagatgaaggagacagagtggaagtggaggggcctggtggaggccatcgacacccaggtggatggcacctag

SEQ ID NO: 8135 - DNA, 453 bp, Artificial Sequence; identical to SEQ ID NO: 7139
  Description of Artificial Sequence: Synthetic coding sequence

SEQ ID NO: 8136 - DNA, 171 bp, Artificial Sequence
  Description of Artificial Sequence: Synthetic coding sequence
atgaagacaggcctcttcttcctgtgcctgctgggcacagctgctgccatccccaccaatgcccggctgctgagtgaccacagcaagcccacagctgagaccgtggccccagacaacacagccatccccagcctgcgggcagaggccgaggagaatgagaaggagacctag

SEQ ID NO: 8137 - DNA, 2346 bp, Artificial Sequence
  Description of Artificial Sequence: Synthetic coding sequence
atggctgtggccgaggtgtccaggacctgcctgctgactgtgcgggtgctgcaggcccaccggctgcccagcaaggacctggtgacccccagcgactgctacgtgaccctgtggctgcccacagcctgcagccaccggctgcagaccaggacagtgaagaacagcagcagccctgtgtggaaccagagcttccacttccgcatccaccggcagctgaagaatgtgatggagctgaaggtgtttgaccaggacctggtgactggagatgatcctgtgctgtctgtgctgtttgatgctggcaccctgcgggccggggagttccggcgggagagcttcagcctgagcccccagggcgagggccgcctggaggtggagttccggctgcagagcctggccgacagaggagagtggctggtgtccaatggagtgctggtggcccgggagctgagctgcctgcacgtgcagctggaggagactggagaccagaagagcagcgagcaccgggtgcagctggtggtgcccggcagctgtgagggcccccaggaggcctctgtgggcaccggcaccttccgcttccactgcccagcctgctgggagcaggagctgagcatccggctgcaggatgcccctgaggagcagctgaaggcccccctgagcgccctgcccagcggccaggtggtgcggctggtgttccccaccagccaggagcccctgatgagggtggagctgaagaaggaggccggcctgcgggagctggccgtgcggctgggcttcggcccctgtgccgaggagcaggccttcctgagcaggaggaagcaggtggtggccgccgccctgcggcaggccctgcagctggatggagacctgcaggaggatgagatccctgtggtggccatcatggccaccggcggcggcatccgggccatgaccagcctgtatggccagctggccggcctgaaggagctgggcctgctggactgtgtgtcctacatcaccggggccagcggcagcacctgggccctggccaacctgtatgaggaccctgagtggagccagaaggacctggccggccccacagagctgctgaagacccaggtgaccaagaacaagctgggcgtgctggcccccagccagctgcagcgctaccggcaggagctggccgagcgggcccggctgggctaccccagctgcttcaccaacctgtgggccctgatcaatgaggccctgctgcatgatgagccccatgaccacaagctgagtgaccagcgggaggccctgagccacggccagaaccccctgcccatctactgtgccctgaacaccaagggccagagcctgaccacctttgaatttggagagtggtgtgagttcagcccctatgaggtgggcttccccaagtatggagccttcatccccagcgagctgtttggcagcgagttcttcatgggccagctgatgaagaggctgcctgagagccgcatctgcttcctggagggcatctggagcaacctgtatgctgccaacctgcaggacagcctgtactgggccagcgagcccagccagttctgggaccgctgggtgaggaaccaggccaacctggacaaggagcaggtgcccctgctgaagattgaggagccccccagcacagctggaagaattgctgagttcttcacagacctgctgacctggaggcccctggcccaggccacccacaacttcctgcggggcctgcacttccacaaggactacttccagcacccccacttcagcacctggaaggccaccaccctggatggcctgcccaaccagctgaccccatctgagccccacctgtgcctgctggatgtgggctacctgatcaacaccagctgcctgcccctgctgcagcccaccagagatgtggacctgatcctgagcctggactacaacctgcatggagccttccagcagctgcagctgctgggccgcttctgccaggagcagggcatccccttcccccccatcagccccagccctgaggagcagctgcagccccgggagtgccacaccttcagtgaccccacctgccctggggccccagctgtgctgcacttccccctggtgtctgacagcttccgggagtacagcgcccctggggtgcggaggaccccagaggaggccgccgccggggaggtgaacctgagcagcagtgacagcccctaccactacaccaaggtgacctacagccaggaggatgtggacaagctgctgcacctgacccactacaacgtgtgcaacaaccaggagcagctgctggaggccctgcggcaggccgtgcagaggcggcggcagaggcggccccactag

SEQ ID NO: 8138 - DNA, 219 bp, Artificial Sequence
  Description of Artificial Sequence: Synthetic coding sequence
atggctgctgccacccggggctgccggccctggggcagcctgctgggcctgctgggcctggtgtctgctgctgctgctgcctgggacctggccagcctgcgctgcaccctgggcgccttctgtgaatgtgacttccggccagacctgcctgagggcagcgaggagctgggcccccgggagccccactgcctgtggcccctgcccctgcccctgaggtag

SEQ ID NO: 8139 - DNA, 243 bp, Artificial Sequence
  Description of Artificial Sequence: Synthetic coding sequence
atgaaggtgttcttcctgtttgctgtgctcttctgcctggtgcagaccaacagcggagatgtgcccccaggcatccggaacaccatctgccacatgcagcagggcatctgccgcctcttcttctgccacagcggggagaagaagagggacatctgcagcgacccctggaaccgctgctgcgtgagcaacacagatgaggagggcaaggagaagccagagatggatggccgcagcggcatctag

SEQ ID NO: 8140 - DNA, 861 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagagatggcctgctgagctacacagcccctgtgggccagaccatgtacctgtctgaggccgtgtacctgaatgacagcacctatgatggccacacagtgggcggcctgcagtatggaggcctgggccagctggctgatggagtggtgggcctggatgacttcaggaagagccaggagctgcgggtgtggccaggctatgactatgtgggctggagcaaccacagcttcagcagcggctacgtggagatggagtttgaatttgaccggctgcgggccttccaggccatgcaggtgcactag

SEQ ID NO: 8141 - DNA, 858 bp, Artificial Sequence
  Description of Artificial Sequence: Synthetic coding sequence
atgaggggccagggcaggaaggagagcctgagtgacagccgggacctggatggcagctatgaccagctgaccggccaccccccaggccccaccaagaaggccctgaagcagcgcttcctgaagctgctgccctgctgcggcccccaggccctgcccagcgtgtctgaaattggccgggtcttccgcttcctgggggacagcagcctgcccagcgccctggccgccccagccagcctgcggccccaccggccccggctgctggaccctgattctgtggatgatgaatttgagctgagcacagtgtgccacaggcctgagggcctggagcagctgcaggagcagaccaagttcaccaggaaggagctgcaggtgctgtaccggggcttcaagaatgaatgtccttctggaattgtgaatgaggagaacttcaagcagatctacagccagttcttcccccagggcgacagcagcacctacgccaccttcctgttcaatgcctttgacaccaaccatgatggctctgtgtcctttgaggactttgtggccggcctgagcgtcatcctgcggggcaccgtggatgaccggctgaactgggccttcaacctgtatgacctgaacaaggatggctgcatcaccaaggaggagatgctggacatcatgaagagcatctatgacatgatgggcaagtacacctacccagccctgcgggaggaggccccccgggagcacgtggagagcttcttccagaagatggacaggaacaaggatggagtggtgaccatcgaggagttcatcgagagctgccagaaggatgagaacatcatgaggtccatgcagctgtttgacaacgtcatctag

SEQ ID NO: 8142 - DNA, 1311 bp, Artificial Sequence; identical to SEQ ID NO: 7298
  Description of Artificial Sequence: Synthetic coding sequence

SEQ ID NO: 8143 - DNA, 1218 bp, Artificial Sequence; identical to SEQ ID NO: 6943
  Description of Artificial Sequence: Synthetic coding sequence

SEQ ID NO: 8144 - DNA, 300 bp, Artificial Sequence
  Description of Artificial Sequence: Synthetic coding sequence
atgctggccctgctggtgctggtgacagtggccctggccagcgcccaccacggcggggagcactttgaaggagagaaggtgttccgggtgaatgtggaggatgagaaccacatcaacatcatccgggagctggccagcaccacccagattgacttctggaagccagattctgtgacccagatcaagccccacagcacagtggacttccgggtgaaggccgaggacacagtgacagtggagaatgtgctgaagcagaatgagctgcagtacaaggtgctgatcagcaacctgaggaactag

SEQ ID NO: 8145 - DNA, 471 bp, Artificial Sequence
  Description of Artificial Sequence: Synthetic coding sequence
atgctgctgctgctgctgctggcccccctcttcctgcggcccccaggagctggaggagcccagaccccaaatgccaccagcgagggctgccagatcatccaccccccctgggagggcggcatccgctaccggggcctgacccgggaccaggtgaaggccatcaacttcctgcctgtggactatgaaattgaatatgtgtgccgcggggagcgggaggtggtgggccccaaggtgaggaagtgcctggccaacggctcctggacagacatggacacccccagccgctgtgtgcgcatctgcagcaagagctacctgaccctggagaatggcaaggtgttcctgactggaggagacctgcctgccctggatggagcccgggtggacttccgctgtgaccctgacttccacctggtgggcagcagccgcagcatctgcagccagggccagtggagcacccccaagccccactag

SEQ ID NO: 8146 - DNA, 249 bp, Artificial Sequence
  Description of Artificial Sequence: Synthetic coding sequence
atgggccgggtcttcctgactggagagaaggccaacagcatcctgaagcgctacccccgggccaacggcttctttgaggagatccggcagggcaacatcgagcgggagtgcaaggaggagttctgcacctttgaggaggcccgggaggcctttgagaacaatgagaagacaggcctggtgctgctgccccggctggagtgcagctgtgaacatggcagcctgcagccccagctgcctgtgcccaagtag

SEQ ID NO: 8147 - DNA, 372 bp, Artificial Sequence
  Description of Artificial Sequence: Synthetic coding sequence
atgcagggcaccccaggcggcggcaccaggcctggccccagccctgtggacaggaggaccctgctggtgttctccttcatcctggccgccgccctgggccagatgaacttcaccggggaccaggtgctgcgggtgctggccaaggatgagaagcagctgagcctgctgggggacctggagggcctgaagccccagaaggtggacttctggaggggccctgcccggcccagcctgcctgtggacatgagggtgcccttcagcgagctgaaggacatcaaggcctacctggagagccacggcctggcctacagcatcatgatcaaggacatccaggtgctgctggatgaggagcggcaggccatggccaagtag

SEQ ID NO: 8148 - DNA, 840 bp, Artificial Sequence
  Description of Artificial Sequence: Synthetic coding sequence
atgggccgggtcttcctgactggagagaaggccaacagcatcctgaagcgctacccccgggccaacggcttctttgaggagatccggcagggcaacatcgagcgggagtgcaaggaggagttctgcacctttgaggaggcccgggaggcctttgagaacaatgagaagaccatcactggagtcatcctgctggccgtgggcgtgtggggcaagctgaccctgggcacctacatcagcctgattgctgagaacagcaccaatgccccctacgtgctgattggaacaggcaccaccatcgtggtgtttggcctgtttggctgctttgccacctgccggggcagcccctggatgctgaagctgtatgccatgttcctgagcctggtgttcctggccgagctggtggccggcatcagcggctttgtgttcagacatgagatcaaggacaccttcctgcggacctacacagatgccatgcagacctacaatggaaatgatgagaggagcagagctgtggaccacgtgcagaggagcctgagctgctgcggcgtgcagaactacaccaactggagcaccagcccctacttcctggagcacggcatcccccccagctgctgcatgaatgaaacagactgcaacccccaggacctgcacaacctgactgtggccgccaccaaggtgaaccagaagggctgctatgacctggtgaccagcttcatggagaccaacatgggcatcatcgccggcgtggcctttggaattgccttcagccagctgattggcatgctgctggcctgctgcctgagccgcttcatcacagccaaccagtatgagatggtgtag

SEQ ID NO: 8149 - DNA, 564 bp, Artificial Sequence
  Description of Artificial Sequence: Synthetic coding sequence
atgtggtgtgccagccctgtggccgtggtggccttctgtgccggcctgctggtgagccaccctgtgctgacccagggccaggaggccggcggccggcctggagctgactgtgaggtgtgcaaggagttcctgaaccgcttctacaagagcctgattgacagaggagtgaacttcagcctggacaccatcgagaaggagctgatctccttctgcctggacaccaagggcaaggagaaccggctgtgctactacctgggcgccaccaaggatgctgccaccaagatcctgtctgaggtgacccggcccatgtctgtgcacatgcctgccatgaagatctgtgagaagctgaagaagctggacagccagatctgtgagctgaagtatgagaagaccctggacctggcctctgtggacctgaggaagatgagggtggccgagctgaagcagatcctgcacagctggggcgaggagtgccgggcctgtgccgagaagacagattatgtgaacctgatccaggagctggcccccaagtatgctgccacccaccccaagacagagctgtag

SEQ ID NO: 8150 - DNA, 1311 bp, Artificial Sequence; identical to SEQ ID NO: 7298
  Description of Artificial Sequence: Synthetic coding sequence

SEQ ID NO: 8151 - DNA, 450 bp, Artificial Sequence
  Description of Artificial Sequence: Synthetic coding sequence
atgggccgggtcttcctgactggagagaaggccaacagcatcctgaagcgctacccccgggccaacggcttctttgaggagatccggcagggcaacatcgagcgggagtgcaaggaggagttctgcacctttgaggaggcccgggaggcctttgagaacaatgagaagaccaaggagttctggagcacctacaccaaggcccagcagggcgagagcaacagaggaagtgactggttccagttctacctgaccttccccctcatcttcggcctcttcatcatcctgctggtgatcttcctgatctggcgctgcttcctgaggaacaagacccggcggcagacagtgacagagggccacatccccttcccccagcacctgaacatcatcaccccacctcctcctccagatgaggtgtttgacagcagcggcctgagccctggcttcctgtag

SEQ ID NO: 8152 - DNA, 936 bp, Artificial Sequence
  Description of Artificial Sequence: Synthetic coding sequence
atgctgtaccagaccatcaacagcctgaagaccaagaaccccaagctgaagatcctgctgagcatcggcggctacctgtttggcagcaagggcttccaccccatggtggacagcagcaccagccggctggagttcatcaacagcatcatcctcttcctgaggaaccacaactttgatggcctggatgtgtcctggatctacccagaccagaaggagaacacccacttcaccgtgctgattcatgagctggccgaggccttccagaaggacttcaccaagagcaccaaggagcggctgctgctgacagctggggtgtctgctggccggcagatgattgacaacagctaccaggtggagaagctggccaaggacctggacttcatcaacctgctgagctttgacttccacggctcctgggagaagcccctcatcaccggccacaacagccccctgagcaagggctggcaggaccggggccccagcagctactacaacgtggagtatgctgtgggctactggatccacaagggcatgcccagcgagaaggtggtgatgggcatccccacctacggccacagcttcaccctggccagcgctgagaccaccgtgggcgccccagccagcggccctggagctgctggccccatcacagagagcagcggcttcctggcctactatgagatctgccagttcctgaagggggccaagatcacccggctgcaggaccagcaggtgccctatgctgtgaagggcaaccagtgggtgggctatgatgatgtgaagtccatggagaccaaggtgcagttcctgaagaacctgaacctgggcggggccatgatctggagcattgacatggatgacttcaccgggaagagctgcaaccagggcccctaccccctggtgcaggccgtgaagaggagcctgggcagcctgtag

SEQ ID NO: 8153 - DNA, 621 bp, Artificial Sequence
  Description of Artificial Sequence: Synthetic coding sequence
atggacaccatcttcctgtggagcctgctgctgctcttcttcggcagccaggccagccgctgcagcgcccagaagaacacagaatttgctgtggacctgtaccaggaggtgtccctgagccacaaggacaacatcatcttcagccccctgggcatcaccctggtgctggagatggtgcagctgggcgccaagggcaaggcccagcagcagatccggcagaccctgaagcagcaggagaccagcgctggggaggagttctttgtgctgaagagcttcttcagcgccatcagcgagaagaagcaggagttcaccttcaacctggccaatgccctgtacctgcaggagggcttcaccgtgaaggagcagtacctgcacggcaacaaggagttcttccagagcgccatcaagctggtggacttccaggatgccaaggcctgtgccgagatgatcagcacctgggtggagaggaagacagatggcaagatcaaggacatgttttctggagaggagtttggccccctgacccggctggtgctggtgaatgccatctacttcaagggggactggaagcagaagttcaggaaggaggacacccagctgatcaacttcaccaagaagtag

SEQ ID NO: 8154 - DNA, 1218 bp, Artificial Sequence; identical to SEQ ID NO: 6943
  Description of Artificial Sequence: Synthetic coding sequence

SEQ ID NO: 8155 - DNA, 399 bp, Artificial Sequence
  Description of Artificial Sequence: Synthetic coding sequence
atgctgatcttctggaccatcaccctcttcctgctgggcgccgccaagggcaaggaggtgtgctatgaggacctgggctgcttcagtgacacagagccctggggcggcacagccatccggcccctgaagatcctgccctggagccctgagaagattggcacccgcttcctgctgtacaccaatgaaaaccccaacaacttccagatcctgctgctgagtgaccccagcaccatcgaggccagcaacttccagatggacaggaagacccgcttcatcatccacggcttcatcgacaagggagatgagagctgggtgacagacatgtgcaagaagctgtttgaggtggaggaggtgaactgcatctgtgtggactggaagaagggcagccaggccacctag

SEQ ID NO: 8156 - DNA, 606 bp, Artificial Sequence; identical to SEQ ID NO: 7499
  Description of Artificial Sequence: Synthetic coding sequence

SEQ ID NO: 8157 - DNA, 1086 bp, Artificial Sequence
  Description of Artificial Sequence: Synthetic coding sequence
atggccagcctgggcctgctgctgctgctgctgctgacagccctgccccccctgtggagcagcagcctgcccggcctggacacagctgagagcaaggccaccatcgctgacctgatcctgagcgccctggagcgggccaccgtcttcctggagcagaggctgcctgagatcaacctggatggcatggtgggcgtgcgggtgctggaggagcagctgaagtctgtgcgggagaagtgggcccaggagcccctgctgcagcccctgagcctgcgggtgggcatgctgggggagaagctggaggccgccatccagaggagcctgcactacctgaagctgagtgaccccaagtacctgcgggagttccagctgaccctgcagcccggcttctggaagctgccccacgcctggatccacacagatgccagcctggtgtaccccaccttcggcccccaggacagcttcagcgaggagaggagtgatgtgtgcctggtgcagctgctgggcactggaacagacagcagcgagccctgtggcctgagtgacctgtgccgcagcctgatgaccaagccaggctgcagcggctactgcctgagccaccagctgctcttcttcctgtgggccaggatgaggggctgcacccagggccccctgcagcagagccaggactacatcaacctcttctgtgccaacatgatggacctgaacagaagagctgaggccatcggctacgcctaccccacccgggacatcttcatggagaacatcatgttctgtggcatgggcggcttcagtgacttctacaagctgcgctggctggaggccatcctgtcctggcagaagcagcaggagggctgcttcggggagccagatgctgaagatgaggagctgagcaaggccatccagtaccagcagcacttcagccggcgggtgaagaggcgggagaagcagttcccagatggctgcagcagccacaacacagccacagctgtggccgccctgggcggcttcctgtacatcctggccgagtaccccccagccaaccgggagccccaccccagcaccccacctccacccagcagcaggtag

SEQ ID NO: 8158 - DNA, 162 bp, Artificial Sequence
  Description of Artificial Sequence: Synthetic coding sequence
atgtggaccaacttcttcaagctgcggctcttctgctgcctgctggccgtgctgatggtggtggtgctggtgatcaacgtgacccaggtggagtacctggaccatgaaacagtgtctgccaccttcatcgacagcagcggccagtttgtgagcagccagtag

SEQ ID NO: 8159 - DNA, 1305 bp, Artificial Sequence
  Description of Artificial Sequence: Synthetic coding sequence
atggccagcctgggcctgctgctgctgctgctgctgacagccctgccccccctgtggagcagcagcctgcccggcctggacacagctgagagcaaggccaccatcgctgacctgatcctgagcgccctggagcgggccaccgtcttcctggagcagaggctgcctgagatcaacctggatggcatggtgggcgtgcgggtgctggaggagcagctgaagtctgtgcgggagaagtgggcccaggagcccctgctgcagcccctgagcctgcgggtgggcatgctgggggagaagctggaggccgccatccagaggagcctgcactacctgaagctgagtgaccccaagtacctgcgggagttccagctgaccctgcagcccggcttctggaagctgccccacgcctggatccacacagatgccagcctggtgtaccccaccttcggcccccaggacagcttcagcgaggagaggagtgatgtgtgcctggtgcagctgctgggcactggaacagacagcagcgagccctgtggcctgagtgacctgtgccgcagcctgatgaccaagccaggctgcagcggctactgcctgagccaccagctgctcttcttcctgtgggccaggatgaggggctgcacccagggccccctgcagcagagccaggactacatcaacctcttctgtgccaacatgatggacctgaacagaagagctgaggccatcggctacgcctaccccacccgggacatcttcatggagaacagcgtgacaggccaccctgtgttctacctgcccctgtgtgacagcttcctgccccccaaggccgcccctgtgacagagctgtacacagatggccctgtgatgttctgtggcatgggcggcttcagtgacttctacaagctgcgctggctggaggccatcctgtcctggcagaagcagcaggagggctgcttcggggagccagatgctgaagatgaggagctgagcaaggccatccagtaccagcagcacttcagccggcgggtgaagaggcgggagaagcagttcccagacagccgctctgtggcccaggccggcgtgcagtggaggaacctgggcagcctgcagcccctgcccccaggcttcaagcagttcagctgcctgatcctgcccagctcctgggactacagatctgtgcccccctacctggccaacttctacatcttcctggtggagaccggcttccaccacgtggcccacgccggcctggagctgctgatcagccgggacccccccaccagcggcagccagagcgtgggcctgtag

SEQ ID NO: 8160 - DNA, 1311 bp, Artificial Sequence; identical to SEQ ID NO: 7298
  Description of Artificial Sequence: Synthetic coding sequence

SEQ ID NO: 8161 - DNA, 1218 bp, Artificial Sequence; identical to SEQ ID NO: 6943
  Description of Artificial Sequence: Synthetic coding sequence

SEQ ID NO: 8162 - DNA, 510 bp, Artificial Sequence
  Description of Artificial Sequence: Synthetic coding sequence
atgctgtaccagaccatcaacagcctgaagaccaagaaccccaagctgaagatcctgctgagcatcggcggctacctgtttggcagcaagggcttccaccccatggtggacagcagcaccagccggctggagttcatcaacagcatcatcctcttcctgaggaaccacaactttgatggcctggatgtgtcctggatctacccagaccagaaggagaacacccacttcaccgtgctgattcatgagctggccgaggccttccagaaggacttcaccaagagcaccaaggagcggctgctgctgacagctggggtgtctgctggccggcagatgattgacaacagctaccaggtggagaagctggccaaggacctggacttcatcaacctgctgagctttgacttccacggctcctgggagaagcccctcatcaccggccacaacagccccctgagcaagggctggcaggaccggggccccagcagctactacaacgtggagtatgcctag

SEQ ID NO: 8163 - DNA, 1209 bp, Artificial Sequence
  Description of Artificial Sequence: Synthetic coding sequence
atggccagcctgggcctgctgctgctgctgctgctgacagccctgccccccctgtggagcagcagcctgcccggcctggacacagctgagagcaaggccaccatcgctgacctgatcctgagcgccctggagcgggccaccgtcttcctggagcagaggctgcctgagatcaacctggatggcatggtgggcgtgcgggtgctggaggagcagctgaagtctgtgcgggagaagtgggcccaggagcccctgctgcagcccctgagcctgcgggtgggcatgctgggggagaagctggaggccgccatccagaggagcctgcactacctgaagctgagtgaccccaagtacctgcgggagttccagctgaccctgcagcccggcttctggaagctgccccacgcctggatccacacagatgccagcctggtgtaccccaccttcggcccccaggacagcttcagcgaggagaggagtgatgtgtgcctggtgcagctgctgggcactggaacagacagcagcgagccctgtggcctgagtgacctgtgccgcagcctgatgaccaagccaggctgcagcggctactgcctgagccaccagctgctcttcttcctgtgggccaggatgaggggctgcacccagggccccctgcagcagagccaggactacatcaacctcttctgtgccaacatgatggacctgaacagaagagctgaggccatcggctacgcctaccccacccgggacatcttcatggagaacatcatgttctgtggcatgggcggcttcagtgacttctacaagctgcgctggctggaggccatcctgtcctggcagaagcagcaggagggctgcttcggggagccagatgctgaagatgaggagctgagcaaggccatccagtaccagcagcacttcagccggcgggtgaagaggcgggagaagcagttcccagacagccgctctgtggcccaggccggcgtgcagtggaggaacctgggcagcctgcagcccctgcccccaggcttcaagcagttcagctgcctgatcctgcccagctcctgggactacagatctgtgcccccctacctggccaacttctacatcttcctggtggagaccggcttccaccacgtggcccacgccggcctggagctgctgatcagccgggacccccccaccagcggcagccagagcgtgggcctgtag

SEQ ID NO: 8164 - DNA, 1680 bp, Artificial Sequence; identical to SEQ ID NO: 6964
  Description of Artificial Sequence: Synthetic coding sequence

SEQ ID NO: 8165 - DNA, 402 bp, Artificial Sequence
  Description of Artificial Sequence: Synthetic coding sequence
atggccatggtgtctgccatgtcctgggtgctgtacctgtggatcagcgcctgtgccatgctgctgtgccacggcagcctgcagcacaccttccagcagcaccacctgcacaggcctgagggcggcacctgtgaggtgattgctgcccaccgctgctgcaacaagaaccgcatcgaggagaggagccagacagtgaagtgcagctgcctgcccgggaaggtggccggcaccaccaggaaccggcccagctgtgtggatgccagcatcgtgattggcaagtggtggtgtgagatggagccctgcctggagggggaggagtgcaagaccctgcctgacaacagcggctggatgtgtgccaccggcaacaagatcaagaccacccgcatccaccccaggacatag

SEQ ID NO: 8166 - DNA, 606 bp, Artificial Sequence; identical to SEQ ID NO: 7499
  Description of Artificial Sequence: Synthetic coding sequence

SEQ ID NO: 8167 - DNA, 606 bp, Artificial Sequence; identical to SEQ ID NO: 7499
  Description of Artificial Sequence: Synthetic coding sequence

SEQ ID NO: 8168 - DNA, 732 bp, Artificial Sequence; identical to SEQ ID NO: 8058
  Description of Artificial Sequence: Synthetic coding sequence

SEQ ID NO: 8169 - DNA, 258 bp, Artificial Sequence
  Description of Artificial Sequence: Synthetic coding sequence
atgaagatccctgtgctgcctgctgtggtgctgctgagcctgctggtgctgcacagcgcccagggcgccaccctgggcggccctgaggaggagagcaccattgaaaattatgccagcaggcctgaggccttcaaggcagatgagttcctgaactggcacgccctgtttgagagcatcaagaggaagctgcccttcctgaactgggatgccttccccaagctgaagggcctgcggagcgccaccccagatgcccagtag

SEQ ID NO: 8170 - DNA, 348 bp, Artificial Sequence
  Description of Artificial Sequence: Synthetic coding sequence
atgggccgggtcttcctgactggagagaaggccaacagcatcctgaagcgctacccccgggccaacggcttctttgaggagatccggcagggcaacatcgagcgggagtgcaaggaggagttctgcacctttgaggaggcccgggaggcctttgagaacaatgagaagaccaaggagttctggagcacctacaccaaggcccagcagggcgagagcaacagaggaagtgactggttccagttctacctgaccttccccctcatcttcggcctcttcatcatcctgctggtgatcttcctgatctggcgctgcttcctgaggaacaagacccggcggcagacagtgtag

SEQ ID NO: 8171 - DNA, 606 bp, Artificial Sequence; identical to SEQ ID NO: 7499
  Description of Artificial Sequence: Synthetic coding sequence

SEQ ID NO: 8172 - DNA, 1311 bp, Artificial Sequence; identical to SEQ ID NO: 7298
  Description of Artificial Sequence: Synthetic coding sequence

SEQ ID NO: 8173 - DNA, 606 bp, Artificial Sequence
  Description of Artificial Sequence: Synthetic coding sequence
atgggcgccaccaccatggaccagaagagcctgtgggccggcgtggtggtgctgctgctgctgcagggcggcagcgcctacaagctggtgtgctacttcaccaactggagccaggaccggcaggagcccgggaagttcaccccagaaaatattgaccccttcctgtgcagccacctgatctacagctttgccagcattgagaacaacaaggtgatcatcaaggacaagtctgaggtgatgctgtaccagaccatcaacagcctgaagaccaagaaccccaagctgaagatcctgctgagcattggaggctacctgtttggcagcaagggcttccaccccatggtggacagcagcaccagccggctggagttcatcaacagcatcatcctcttcctgaggaaccacaactttgatggcctggatgtgtcctggatctacccagaccagaaggagaacacccacttcaccgtgctgatccacgagctggccgaggccttccagaaggacttcaccaagagcaccaaggagcggctgctgctgacagctggggtgtctgctggccggcagatgattgacaacagctaccaggtggagaagctggcctag

SEQ ID NO: 8174 - DNA, 75 bp, Artificial Sequence; identical to SEQ ID NO: 7364
  Description of Artificial Sequence: Synthetic coding sequence

SEQ ID NO: 8175 - DNA, 252 bp, Artificial Sequence
  Description of Artificial Sequence: Synthetic coding sequence
atgaggccccggggcctgccccccctgctggtggtgctgctgggctgctgggcctctgtgtctgcccagacagatgccaccccagctgtgaccacagagggcctgaacagcacagaggccgccctggccaccttcggcaccttccccagcaccaggcctcctggcaccccccgggcccctggccccagcagcggcccccggcccacccctgtgacagatggcagccacagcgtgacccaggccggcgtgtag

SEQ ID NO: 8176 - DNA, 1254 bp, Artificial Sequence; identical to SEQ ID NO: 6986
  Description of Artificial Sequence: Synthetic coding sequence

SEQ ID NO: 8177 - DNA, 1680 bp, Artificial Sequence; identical to SEQ ID NO: 6964
  Description of Artificial Sequence: Synthetic coding sequence

SEQ ID NO: 8178 - DNA, 99 bp, Artificial Sequence
  Description of Artificial Sequence: Synthetic coding sequence
atgcagggcaccccaggcggcggcaccaggcctggccccagccctgtggacaggaggaccctgctggtgttctccttcatcctggccgccgccctgtag

SEQ ID NO: 8179 - DNA, 180 bp, Artificial Sequence
  Description of Artificial Sequence: Synthetic coding sequence
atgctggccctgctggtgctggtgacagtggccctggccagcgcccaccacggcggggagcactttgaaggagagaaggtgttccgggtgaatgtggaggatgagaaccacatcaacatcatccgggagctggccagcaccacccagattgacttctggaagccagattctgtgacctag

SEQ ID NO: 8180 - DNA, 303 bp, Artificial Sequence
  Description of Artificial Sequence: Synthetic coding sequence
atgaggccccggggcctgccccccctgctggtggtgctgctgggctgctgggcctctgtgtctgcccagacagatgccaccccagctgtgaccacagagggcctgaacagcacagaggccgccctggccaccttcggcaccttccccagcaccaggcctcctggcaccccccgggcccctggccccagcagcggcccccggcccacccctgtgacagatggcggctaccacgtgcctgcccctggggtgcacagcgaccccaccagccggggccagccccgctgctgcagcctgtgcctgtag

SEQ ID NO: 8181 - DNA, 234 bp, Artificial Sequence
  Description of Artificial Sequence: Synthetic coding sequence
atgaggagccccaggatgagggtgtgtgccaagtctgtgctgctgagccactggctgttcctggcctacgtgctgatggtgtgctgcaagctgatgtctgccagcagccagcacctgcggggccatgctggccaccaccagatcaagcagggcacctgtgaggtggtggccgtgcaccgctgctgcaacaagaacagaattgaggagaggagccagacagtgaagtgcagctag

SEQ ID NO: 8182 - DNA, 12 bp, Artificial Sequence
  Description of Artificial Sequence: Synthetic coding sequence
atgtggacctag

SEQ ID NO: 8183 - DNA, 402 bp, Artificial Sequence; identical to SEQ ID NO: 8165
  Description of Artificial Sequence: Synthetic coding sequence

SEQ ID NO: 8184 - DNA, 600 bp, Artificial Sequence
  Description of Artificial Sequence: Synthetic coding sequence
atgaccatgaggcacaactggaccccagacctgagccccctgtgggtgctgctgctgtgtgcccacgtggtgaccctgctggtgcgggccacccctgtgtcccagaccaccacagctgccacagcctctgtgcgcagcaccaaggacccctgccccagccagccccctgtgtttcctgctgccaagcagtgcccagccctggaggtgacctggccagaggtggaggtgcccctgaatggcaccctgagcctgagctgtgtggcctgcagccgcttccccaacttcagcatcctgtactggctgggcaatggcagcttcatcgagcacctgcccggccgcctgtgggagggcagcaccagccgggagcggggcagcacaggcacccagctgtgcaaggccctggtgctggagcagctgaccccagccctgcacagcaccaacttcagctgtgtgctggtggaccctgagcaggtggtgcagagacatgtggtgctggcccagctgtgggtgcgcagcccccggcggggcctgcaggagcaggaggagctgtgcttccacatgtggggcggcaaaggaggcctgtgccagagcagcctgtag

SEQ ID NO: 8185 - DNA, 1044 bp, Artificial Sequence
  Description of Artificial Sequence: Synthetic coding sequence
atgggcgtggtgcagtacggggacaacccagccacccacttcaacctgaagacccacaccaacagccgggacctgaagacagccatcgagaagatcacccagaggggcggcctgagcaatgtgggccgggccatcagctttgtgaccaagaacttcttcagcaaggccaatggaaacagaagtggggccccaaatgtggtggtggtgatggtggatggctggcccacagacaaggtggaggaggccagccggctggcccgggagagcggcatcaacatcttcttcatcaccatcgagggcgctgctgaaaatgagaagcagtatgtggtggagcccaactttgccaacaaggctgtgtgcaggaccaacggcttctacagcctgcacgtgcagagctggtttggcctgcacaagaccctgcagcccctggtgaagagggtgtgtgacacagaccggctggcctgcagcaagacctgcctgaacagcgctgacattggatttgtgattgatggcagcagctctgtgggcactggaaacttcagaacagtgctgcagtttgtgaccaacctgaccaaggagtttgagatcagtgacacagacaccagaattggagctgtgcagtacacctatgagcagaggctggagtttggatttgacaagtacagcagcaagccagacatcctgaatgccatcaagagggtgggctactggagcggcggcaccagcactggagctgccatcaactttgccctggagcagctgttcaagaagagcaagcccaacaagaggaagctgatgatcctgatcacagatggccgctcctatgatgatgtgcgcatcccagccatggccgcccacctgaagggcgtcatcacctacgccatcggcgtggcctgggccgcccaggaggagctggaggtgattgccacccacccagcccgggaccacagcttctttgtggatgaatttgacaacctgcaccagtatgtgccccgcatcatccagaacatctgcacagagttcaacagccagcccaggaactag

SEQ ID NO: 8186 - DNA, 27 bp, Artificial Sequence
  Description of Artificial Sequence: Synthetic coding sequence
atgcagggcaccccaggcggcggctag

SEQ ID NO: 8187 - DNA, 369 bp, Artificial Sequence
  Description of Artificial Sequence: Synthetic coding sequence
atgctgtaccagaccatcaacagcctgaagaccaagaaccccaagctgaagatcctgctgagcatcggcggctacctgtttggcagcaagggcttccaccccatggtggacagcagcaccagccggctggagttcatcaacagcatcatcctcttcctgaggaaccacaactttgatggcctggatgtgtcctggatctacccagaccagaaggagaacacccacttcaccgtgctgattcatgagctggccgaggccttccagaaggacttcaccaagagcaccaaggagcggctgctgctgacagctggggtgtctgctggccggcagatgattgacaacagctaccaggtggagaagctggcctag

SEQ ID NO: 8188 - DNA, 309 bp, Artificial Sequence
  Description of Artificial Sequence: Synthetic coding sequence
atgagggtgtctggagtgctgcggctgctggccctgatctttgccatcgtgaccacctggatgttcatccgcagctacatgtccttctccatgaagaccatccggctgccccgctggctggccgccagccccaccaaggagatccaggtgaagaagtacaagtgtggcctcatcaagccctgcccagccaactactttgccttcaagatctgcagcggggccgccaacgtggtgggccccaccatgtgctttgaggacaggatgatcatgagccctgtgaagaacaacgtgggccggggcctgaactag

SEQ ID NO: 8189 - DNA, 660 bp, Artificial Sequence; identical to SEQ ID NO: 7265
  Description of Artificial Sequence: Synthetic coding sequence

SEQ ID NO: 8190 - DNA, 1869 bp, Artificial Sequence
  Description of Artificial Sequence: Synthetic coding sequence
atgggcaagtctgagggccctgtgggcatggtggagagcgctggccgggccggccagaagaggcctggcttcctggagggcggcctgctgctgctgctgctgctggtgacagctgccctggtggccctgggcgtgctgtatgctgaccggcggggcaagcagctgccccggctggccagccggctgtgcttcctgcaggaggagaggacctttgtgaagaggaagccccggggcatccctgaggcccaggaggtgtctgaggtgtgcaccaccccaggctgtgtgattgctgctgcccgcatcctgcagaacatggaccccaccacagagccctgtgatgacttctaccagtttgcctgtggcggctggctgcggagacatgtgattcctgagaccaacagccgctacagcatctttgatgtgctgagagatgagctggaggtgatcctgaaggctgtgctggagaacagcacagccaaggccaccgtgccccaggaggagagacatgatgtgattgccctgtaccacaggatgggcctggaggagctgcagagccagtttggcctgaagggcttcaactggaccctcttcatccagacagtgctgagctctgtgaagatcaagctgctgcctgatgaggaggtggtggtgtatggcatcccctacctgcagaacctggagaacatcatcgacacctacagcgcccggaccatccagaactacctggtgtggaggctggtgctggacagaattggcagcctgagccagcgcttcaaggacaccagggtgaactacaggaaggccctgtttggcaccatggtggaggaggtgcgctggagagaatgtgtgggctacgtgaacagcaacatggagaatgctgtgggcagcctgtatgtgcgggaggccttccctggggacagcaagtccatggtgcgggagctgattgacaaggtgaggacagtgtttgtggagaccctggatgagctgggctggatggatgaggagagcaagaagaaggcccaggagaaggccatgagcatccgggagcagatcggccacccagactacatcctggaggagatgaacagaaggctggatgaggagtacagcaacctgaacttcagcgaggacctgtactttgagaacagcctgcagaacctgaaggtgggcgcccagaggagcctgaggaagctgcgggagaaggtggaccccaacctgtggatcattggagctgctgtggtgaatgccttctacagccccaacagaaaccagatcgtgtttcctgctggcatcctgcagccccccttcttcagcaaggagcagccccaggccctgaactttggaggcatcggcatggtgattggccacgagatcacccacggctttgatgacaatggaagaaactttgacaagaatggaaacatgatggactggtggagcaacttcagcacccagcacttccgggagcagagcgagtgcatgatctaccagtatggcaactacagctgggacctggctgatgagcagaatgtgaatggcttcaacaccctgggagaaaatattgctgacaatggaggagtgcggcaggcctacaaggcctacctgaagtggatggccgagggcggcaaggaccagcagctgcccggcctggacctgacccatgagcagctgttcttcatcaactatgcccaggtgtggtgtggcagctacagacctgagtttgccatccagagcatcaagacagatgtgcacagccccctgaagtacagagtgctgggcagcctgcagaacctggccgcctttgctgacaccttccactgtgcccggggcacccccatgcaccccaaggagcgctgccgggtgtggtag

SEQ ID NO: 8191 - DNA, 168 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgactag

SEQ ID NO: 8192 - DNA, 156 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctag

SEQ ID NO: 8193 - DNA, 1620 bp, Artificial Sequence; identical to SEQ ID NO: 7995
  Description of Artificial Sequence: Synthetic coding sequence

SEQ ID NO: 8194 - DNA, 591 bp, Artificial Sequence
  Description of Artificial Sequence: Synthetic coding sequence
atgccccacctggccagcctcttcaccgccagcagccgctgctgcccccaccccctgcggcctgagggcagcggggccatgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctacccccgggcctag

SEQ ID NO: 8195 - DNA, 162 bp, Artificial Sequence
  Description of Artificial Sequence: Synthetic coding sequence
atgctgccctgcctggccctgctgctgctgatggagctgtctgtgtgcaccgtggccggagatggaggagaggagcagaccctgagcacagaggccgagacctgggtgattgtggccctggaggtgctgctgggccggggcagtgatgagggccggggctag

SEQ ID NO: 8196 - DNA, 126 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacagaacatag

SEQ ID NO: 8197 - DNA, 222 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtag

SEQ ID NO: 8198 - DNA, 369 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctactag

SEQ ID NO: 8199 - DNA, 483 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtgtag

SEQ ID NO: 8200 - DNA, 540 bp, Artificial Sequence
  Description of Artificial Sequence: Synthetic coding sequence
atgggcagcagcggcctgctgagcctgctggtgctgtttgtgctgctggccaacgtgcagggccctggcctgacagactggctgttcccccggcgctgccccaagatccgggaggagtgtgagttccaggagagagatgtgtgcaccaaggaccggcagtgccaggacaacaagaagtgctgcgtgttcagctgtgggaagaagtgcctggacctgaagcaggatgtgtgtgagatgcccaaggagaccggcccctgcctggcctacttcctgcactggtggtatgacaagaaggacaacacctgcagcatgtttgtgtatggaggctgccagggcaacaacaacaacttccagagcaaggccaactgcctgaacacctgcaagaacaagcagccctgccccaagatcaaggtggagtgtgaggtggaggagattgaccagtgcaccaagccccgggactgcccagagaacatgaagtgctgccccttcagccggggcaagaagtgcctggacttcaggaaggccagcctgagcacctag

SEQ ID NO: 8201 - DNA, 438 bp, Artificial Sequence
  Description of Artificial Sequence: Synthetic coding sequence
atgctgttcaggaaccgcttcctgctgctgctggccctggccgccctgctggcctttgtgtccctgagcctgcagttcttccacctgatccctgtgtccacccccaagaatggcatgagcagcaagagcaggaagaggatcatgccagaccctgtgacagagccccctgtgacagatcctgtgtatgaggccctgctgtactgcaacatccccagcgtggccgagaggtccatggagggccacgccccccaccacttcaagctggtgtctgtgcacgtgttcatcagacatggagaccgctaccccctgtatgtgatccccaagaccaagaggcctgagattgactgcaccctggtggccaacaggaagccctaccaccccaagctggaggccttcatcagccacatgagcaagggcagcggggccagctttgaatag

SEQ ID NO: 8202 - DNA, 399 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggtag

SEQ ID NO: 8203 - DNA, 306 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggctag

SEQ ID NO: 8204 - DNA, 393 bp, Artificial Sequence; identical to SEQ ID NO: 7095
  Description of Artificial Sequence: Synthetic coding sequence

SEQ ID NO: 8205 - DNA, 420 bp, Artificial Sequence
  Description of Artificial Sequence: Synthetic coding sequence
atgcctgccatcgctgtgctggccgctgctgctgctgcctggtgcttcctgcaggtggagagccgccacctggatgccctggccggcggggccggccccaaccacggcaacttcctggacaatgaccagtggctgagcacagtgtcccagtatgaccgggacaagtactggaaccgcttcagagatgatgactacttcaggaactggaaccccaacaagccctttgaccaggccctggaccccagcaaggacccctgcctgaaggtgaagtgcagcccccacaaggtgtgtgtgacccaggactaccagacagccctgtgtgtgtccaggaagcacctgctgccccggcagaagaagggaaatgtggcccagaagcactgggtgggccccagcaacctggtgaagtgcaagccctgctag

SEQ ID NO: 8206 - DNA, 510 bp, Artificial Sequence
  Description of Artificial Sequence: Synthetic coding sequence
atgaggctgctgatcctgacctgcctggtggccgtggccctggcccggcccaagctgcccctgcgctacccagagcggctgcagaaccccagcgagagcagcgagcccatccccctggagagccgggaggagtacatgaatggcatgaaccggcagaggaacatcctgcgggagaagcagacagatgagatcaagaactgtgtggtggccgagcctgagaagatggagagcagcatcagcagcagcagcgaggagcagttctgccgcctgaatgagtacaaccagctgcagctgcaggccgcccacgcccaggagcagatccggaggatgaatgaaaacagccacgtgcaggtgcccttccagcagctgaaccagctggccgcctacccctatgctgtgtggtactacccccagatcatgcagtatgtgcccttcccccccttcagtgacatcagcaaccccacagcccacgagaactatgagaagaacaacgtgatgctgcagtggtag

SEQ ID NO: 8207 - DNA, 921 bp, Artificial Sequence
  Description of Artificial Sequence: Synthetic coding sequence
atgaagaaggatgagccccccctggacttcccagacaccctggagggctttgaatatgccttcaatgagaagggccagctgcggcacatcaagacaggagagccctttgtgttcaactaccgggaggacctgcaccgctggaaccagaagagatatgaggccctgggggagatcatcaccaagtatgtgtatgagctgctggagaaggactgcaacctgaagaaggtgtccatccctgagggctacggcgtgattgtgctgaaccccaatgaaaactacatcgaggtggagaagcccaagatccacgtgcagagcagcagtgacagcagtgatgagcctgctgagaagcgggagaggaaggacaaggtgtccaaggagaccaagaagaggcgggacttctatgagaagtacagaaacccccagcgggagaaggagatgatgcagctgtacatcagagaaaatggcagccctgaggagcacgccatctacgtgtgggaccacttcatcgcccaggccgctgctgaaaatgtgttctttgtggcccacagctatggaggcctggcctttgtggagctgatgatccagcgggaggctgatgtgaagaacaaggtgacagctgtggccctgacagacagcgtgcacaacgtgtggcaccaggaggccggcaagaccatccgggagtggatgagggagaactgctgcaactgggtgagcagcagcgagcccctggacacctctgtggagagcatgctgcctgactgcccccgggtgtctgctggaacagacagacatgagctgacctcctggaagagcttccccagcatcttcaagttcttcacagaggccagcgaggccaagaccagcagcctgaagccagctgtgacccggcgcagccaccgcatcaagcatgaggagctgtag

SEQ ID NO: 8208 - DNA, 2862 bp, Artificial Sequence
  Description of Artificial Sequence: Synthetic coding sequence
tgacagctgtgctggctgcccctgctggcccccctgctgctgctgcggcccccaggagtgcagagcgctggccccatccgggcctttgtggtgccccacagccacatggatgtgggctgggtgtacacagtgcaggagagcatgagggcctatgctgccaacgtgtacacctctgtggtggaggagctggcccggggccagcagaggcgcttcatcgctgtggagcaggagttcttccggctgtggtgggatggagtggccagtgaccagcagaagtaccaggtgcggcagctgctggaggagggccgcctggagtttgtgattggaggccaggtgatgcatgatgaagctgtgacccacctggatgaccagatcctgcagctgacagagggccacggcttcctgtatgagaccttcggcatccggccccagttctcctggcacgtggacccctttggagccagcgccaccacccccaccctgtttgccctggccggcttcaatgcccacctgggcagcagaattgattatgacctgaaggccgccatgcaggaggcccggggcctgcagtttgtgtggaggggcagccccagcctgtctgagcggcaggagatcttcacccacatcatggaccagtacagctactgcacccccagccacatccccttcagcaacagaagtggcttctactggaatggagtggccgtgttccccaagccaccccaggatggagtgtaccccaacatgtctgagcctgtgaccccagccaacatcaacctgtatgcagaggccctggtggccaacgtgaagcagagagctgcctggttccgcaccccccacgtgctgtggccctggggctgtgacaagcagttcttcaatgcctctgtgcagtttgccaacatggaccccctgctggaccacatcaacagccacgccgctgagctgggcgtgtctgtgcagtatgccaccctgggggactacttccgggccctgcacgccctgaatgtgacctggagggtgcgggaccaccacgacttcctgccctacagcacagagcccttccaggcctggacaggcttctacaccagccgcagcagcctgaagggcctggcccggcgggccagcgccctgctgtatgctggggagagcatgttcacccgctacctgtggccagccccccggggccacctggaccccacctgggccctgcagcagctgcagcagctgcgctgggccgtgtctgaggtgcagcaccatgatgccatcactggaacagagagccccaaggtgcgggacatgtatgccacccacctggccagcggcatgctgggcatgaggaagctgatggccagcatcgtgctggatgagctgcagccccaggcccccatggccgccagcagtgatgctggccctgctggccactttgcctctgtgtacaaccccctggcctggacagtgaccaccatcgtgaccctgactgtgggcttccctggggtgcgggtgacagatgaagctggccaccctgtgcccagccagatccagaacagcacagagaccccatctgcctatgacctgctgatcctgaccaccatccctggcctgagctaccgccactacaacatccggcccacagctggggcccaggagggcacccaggagcctgctgccaccgtggccagcaccctgcagtttggccggcggctgcggcggaggaccagccatgctggccgctacctggtgcctgtggccaatgactgctacatcgtgctgctggaccaggacaccaacctgatgcacagcatctgggagcggcagagcaacagaacagtgcgggtgacccaggagttcctggagtaccacgtgaatggagatgtgaagcagggccccatcagtgacaactacctgttcacccctgggaaggctgctgtgcctgcctgggaggccgtggagatggagatcgtggccggccagctggtgacagagatccggcagtacttctacagaaacatgacagcccagaactacacctacgccatccgcagccggctgacccacgtgccccagggccatgatggagagctgctgtgccacagaattgagcaggagtaccaggccggccccctggagctgaaccgggaggccgtgctgcggaccagcaccaacctgaacagccagcaggtgatctacagcgacaacaacggctaccagatgcagaggcggccctacgtgtcctatgtgaacaacagcatcgccaggaactactaccccatggtgcagagcgccttcatggaggatggcaagagccggctggtgctgctgtctgagcgggcccacggcatcagcagccagggcaatggccaggtggaggtgatgctgcaccggcggctgtggaacaactttgactgggacctgggctacaacctgaccctgaatgacacctctgtggtgcaccctgtgctgtggctgctgctgggctcctggagcctgaccacagccctgcggcagaggtctgccctggccctgcagcacaggcctgtggtgctgtttggagacctggccggcacagcccccaagctgcccggcccccagcagcaggaggccgtgaccctgccccccaacctgcacctgcagatcctgagcatccctggctggagatacagcagcaaccacacagagcacagccagaacctgaggaagggccacagaggagaggcccaggccgacctgcggcgggtgctgctgcggctgtaccacctgtatgaggtgggggaggaccctgtgctgagccagcctgtgacagtgaacctggaggtgaacttccccacccccatccagaccatcagccagggcagcaagccctag

SEQ ID NO: 8209 - DNA, 459 bp, Artificial Sequence; identical to SEQ ID NO: 7709
  Description of Artificial Sequence: Synthetic coding sequence

SEQ ID NO: 8210 - DNA, 1701 bp, Artificial Sequence
  Description of Artificial Sequence: Synthetic coding sequence
atggacttcctgctggccctggtgctggtgagcagcctgtacctgcaggccgctgctgagtttgatggccgctggccccggcagatcgtgagcagcatcggcctgtgccgctatggaggaagaattgactgctgctggggctgggcccggcagagctggggccagtgccagcctgtgtgccagccccgctgcaagcacggggagtgcatcggccccaacaagtgcaagtgccaccctggctacgccggcaagacctgcaaccaggatgagcacatcccagcccccctggaccagggcagcgagcagcccctcttccagcccctggaccaccaggccaccagcctgcccagccgggacctgaatgaatgtggcctgaagccccggccctgcaagcaccgctgcatgaacacctacggcagctacaagtgctactgcctgaatggctacatgctgatgccagatggcagctgcagcagcgccctgacctgcagcatggccaactgccagtatggctgtgatgtggtgaagggccagatccgctgccagtgccccagccctggcctgcagctggccccagatggccgcacctgtgtggatgtggatgaatgtgccaccggccgggccagctgcccccgcttccggcagtgtgtgaacaccttcggcagctacatctgcaagtgccacaagggctttgacctgatgtacatcggcggcaagtaccagtgccacgacattgatgaatgttccctgggccagtaccagtgcagcagctttgcccgctgctacaacatccggggcagctacaagtgcaagtgcaaggagggctaccagggagatggcctgacctgtgtgtacatccccaaggtgatgattgagcccagcggccccatccacgtgcccaagggaaatggcaccatcctgaagggggacaccggcaacaacaactggatcccagatgtgggcagcacctggtggccacccaagaccccctacatcccccccatcatcaccaaccggcccaccagcaagcccaccacccggcccacccccaagcccacccccatccccaccccacctcctcctccacccctgcccacagagctgcggacccccctgccccccaccaccccagagcggcccaccaccggcctgaccaccatcgccccagctgccagcaccccacctgggggcatcaccgtggacaacagagtgcagacagacccccagaagcccagaggagatgtgttttctgtgctggtgcacagctgcaactttgaccacggcctgtgtggctggatccgggagaaggacaatgacctgcactgggagcccatccgggaccctgctgggggccagtacctgactgtgtctgctgccaaggcccctgggggcaaggccgcccggctggtgctgcccctgggccgcctgatgcacagcggggacctgtgcctgtccttccgccacaaggtgacaggcctgcacagcggcaccctgcaggtgtttgtgaggaagcatggagcccacggggccgccctgtggggcagaaatggaggccacggctggaggcagacccagatcaccctgcggggagctgacatcaagtctgtggtgttcaagggggagaagagaagaggccacactggagagatcggcctggatgatgtgtccctgaagaagggccactgcagcgaggagaggtag

SEQ ID NO: 8211 - DNA, 213 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagactag

SEQ ID NO: 8212 - DNA, 237 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagctag

SEQ ID NO: 8213 - DNA, 339 bp, Artificial Sequence
  Description of Artificial Sequence: Synthetic coding sequence
atgaggttcaagaccacagccaaggatggcctgctgctgtggaggggggacagccccatgaggcccaacagcgacttcatcagcctgggcctgagagatggagccctggtgttctcctacaacctgggcagcggcgtggccagcatcatggtgaatggcagcttcaatgatggccgctggcaccgggtgaaggctgtgagagatggccagagcggcaagatcaccgtggatgattatggagccaggacaggcaagagccctggcatgatgaggcagctgaacatcaacggggccctgtatgtgggcggcatgaaggagatcgccctgcacaccaactag

SEQ ID NO: 8214 - DNA, 2685 bp, Artificial Sequence
  Description of Artificial Sequence: Synthetic coding sequence
atgagcctgccccgctgctgcccccaccccctgcggcctgagggcagcggggccatgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagagatggcctgctgagctacacagcccctgtgggccagaccatgtacctgtctgaggccgtgtacctgaatgacagcacctatgatggccacacagtgggcggcctgcagtatggaggcctgggccagctggctgatggagtggtgggcctggatgacttcaggaagagccaggagctgcgggtgtggccaggctatgactatgtgggctggagcaaccacagcttcagcagcggctacgtggagatggagtttgaatttgaccggctgcgggccttccaggccatgcaggtgcactgcaacaacatgcacaccctgggcgcccggctgcccggcggcgtggagtgccgcttccggcggggccctgccatggcctgggagggggagcccatgaggcacaacctgggcggcaacctgggggacccccgggcccgggctgtgtctgtgcccctgggcggccgggtggcccgcttcctgcagtgccgcttcctgtttgctggcccctggctgctcttcagcgagatctccttcatcagtgatgtggtgaacaacagcagccctgccctgggcggcaccttccccccagccccctggtggcccccaggccccccacccaccaacttcagcagcctggagctggagccccggggccagcagcctgtggccaaggccgagggcagccccacagccatcctgattggctgcctggtggccatcatcctgctgctgctgctgatcatcgccctgatgctgtggaggctgcactggaggcggctgctgagcaaggccgagcggcgggtgctggaggaggagctgactgtgcacctgtctgtgcctggggacaccatcctgatcaacaaccggcccggcccccgggagcccccaccctaccaggagccccggccccggggcaaccccccccacagcgccccctgtgtgcccaacggcagcgcctacagcggggactacatggagcctgagaagccaggggcccccctgctgcccccaccaccccagaacagcgtgccccactatgcagaggccgacatcgtgaccctgcagggcgtgactggaggcaacacctatgctgtgcctgccctgcccccaggagctgtgggagatggccccccccgggtggacttccccaggagccggctgcgcttcaaggagaagctgggggagggccagtttggagaggtgcacctgtgtgaggtggacagcccccaggacctggtgtccctggacttccccctgaatgtgaggaagggccaccccctgctggtggccgtgaagatcctgcggccagatgccaccaagaatgccagaaatgacttcctgaaggaggtgaagatcatgagccggctgaaggaccccaacatcatccggctgctgggcgtgtgtgtgcaggatgaccccctgtgcatgatcacagactacatggagaatggagacctgaaccagttcctgagcgcccaccagctggaggacaaggctgctgagggcgcccctggagatggccaggccgcccagggccccaccatctcctaccccatgctgctgcacgtggccgcccagatcgccagcggcatgagatacctggccaccctgaactttgtgcaccgggacctggccaccaggaactgcctggtgggggagaacttcaccatcaagattgctgactttggcatgagcaggaacctgtatgctggggactactacagagtgcagggccgggctgtgctgcccatccgctggatggcctgggagtgcatcctgatgggcaagttcaccacagccagtgatgtgtgggccttcggcgtgaccctgtgggaggtgctgatgctgtgccgggcccagcccttcggccagctgacagatgagcaggtgattgaaaatgctggggagttcttccgggaccagggccggcaggtgtacctgagccggcccccagcctgcccccagggcctgtatgagctgatgctgcgctgctggagccgggagagcgagcagaggcctcccttcagccagctgcaccgcttcctggccgaggatgccctgaacacagtgtag

SEQ ID NO: 8215 - DNA, 384 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagatag

SEQ ID NO: 8216 - DNA, 1113 bp, Artificial Sequence
  Description of Artificial Sequence: Synthetic coding sequence
atgaagaaggatgagccccccctggacttcccagacaccctggagggctttgaatatgccttcaatgagaagggccagctgcggcacatcaagacaggagagccctttgtgttcaactaccgggaggacctgcaccgctggaaccagaagagatatgaggccctgggggagatcatcaccaagtatgtgtatgagctgctggagaaggactgcaacctgaagaaggtgtccatccctgtggatgccacagaaagtgagcccaagagcttcatcttcatgtctgaagatgccctgaccaacccccagaagctgatggtgctgattcatggcagcggcgtggtgcgggccggccagtgggcccggcggctcatcatcaatgaagacctggacagcggcacccagatccccttcatcaagagagctgtggccgagggctacggcgtgattgtgctgaaccccaatgaaaactacatcgaggtggagaagcccaagatccacgtgcagagcagcagtgacagcagtgatgagcctgctgagaagcgggagaggaaggacaaggtgtccaaggagaccaagaagaggcgggacttctatgagaagtacagaaacccccagcgggagaaggagatgatgcagctgtacatcagagaaaatggcagccctgaggagcacgccatctacgtgtgggaccacttcatcgcccaggccgctgctgaaaatgtgttctttgtggcccacagctatggaggcctggcctttgtggagctgatgatccagcgggaggctgatgtgaagaacaaggtgacagctgtggccctgacagacagcgtgcacaacgtgtggcaccaggaggccggcaagaccatccgggagtggatgagggagaactgctgcaactgggtgagcagcagcgagcccctggacacctctgtggagagcatgctgcctgactgcccccgggtgtctgctggaacagacagacatgagctgacctcctggaagagcttccccagcatcttcaagttcttcacagaggccagcgaggccaagaccagcagcctgaagccagctgtgacccggcgcagccaccgcatcaagcatgaggagctgtag

SEQ ID NO: 8217 - DNA, 435 bp, Artificial Sequence
  Description of Artificial Sequence: Synthetic coding sequence
atgaagacaggcctcttcttcctgtgcctgctgggcacagctgctgccatccccaccaatgcccggctgctgagtgaccacagcaagcccacagctgagaccgtggccccagacaacacagccatccccagcctgcgggcagaggccgaggagaatgagaaggagacagctgtgtccacagaagatgacagccaccacaaggccgagaagagctctgtgctgaagagcaaggaggagagccatgagcagagcgctgagcagggcaagagcagcagccaggagctgggcctgaaggaccaggaggacagtgatggccacctgtctgtgaacctggagtatgcccccacagagggcaccctggacatcaaggaggacatgtctgagccccaggagaagaagctgtctgagaacacagacttcctggcccctggatag

SEQ ID NO: 8218 - DNA, 1341 bp, Artificial Sequence
  Description of Artificial Sequence: Synthetic coding sequence
ctgaccctgcacagcctgacctgctatgaggacctggtgaccttcctgcagcagagcatccaccagtttgaggtgggcccctacggctgcatcctgctgaccctgagcgccatcctgagccgcagcacagagctgatccggcaggactttgatgtgcccaccagccacctgattggagcccacggctactgcacccaggagctggtgaacctgctgctgaccgggaaggctgtgtccaatgtgttcaatgatgtggtggagctggacagcggagatggcaacatcaccctgctgcggggcattgctgcccggagtgacatcggcttcctgagcctgtttgagcactacaacatgtgccaggtgggctgcttcctgaagaccccccgcttccccatctgggtggtgtgcagcgagagccacttcagcatcctcttcagcctgcagcccggcctgctgcgggactggaggacagagcggctgtttgacctgtactactatgatggcctggccaaccagcaggagcagatccggctgaccatcgacaccacccagaccatcagcgaggacacagacaatgacctggtgccccccctggagctgtgcatccgcaccaacatcggcagcgccctgggcttcaagtaccctgtgggcaacaaccagacagctgtgcaggacaacgtgaaggtgtccctggccttcggcctgagcatcgccaccctggcccagagcgtgggccacatcagcggggcccacctgaacccagctgtgaccctgggcctgctgctgagctgccagatcagcatcttccgggccctgatgtacatcatcgcccagtgtgtgggcgccatcgtggccacagccatcctgagcggcatcaccagcagcctgactggaaacagcctgggcagaaatgacctggctgatggagtgaacagcggccagggcctgggcatcgagatcatcggcaccctgcagctggtgctgtgtgtgctggccaccacagacagaagaagaagagacctgggcggcagcgcccccctggccatcggcctgtctgtggccctgggccacctgctggccatcgactacacaggctgcggcatcaacccagcccggagctttggcagcgctgtgatcacccacaacttcagcaaccactggatcttctgggtgggccccttcatcggcggggccctggccgtgctgatctatgacttcatcctggcccccaggagcagtgacctgacagacagagtgaaggtgtggaccagcggccaggtggaggagtatgacctggatgctgatgacatcaacagccgggtggagatgaagcccaagtag

SEQ ID NO: 8219 - DNA, 81 bp, Artificial Sequence
  Description of Artificial Sequence: Synthetic coding sequence
atgaagctgctgctgtgggcctgcatcgtgtgtgtggcctttgccaggaagaatgccggcctgggcttcctgtggctgtag

SEQ ID NO: 8220 - DNA, 348 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttctcctag

SEQ ID NO: 8221 - DNA, 165 bp, Artificial Sequence
  Description of Artificial Sequence: Synthetic coding sequence
atgtacatccccctggaccctgactacaatgctgactgccccaacgtgacagcccctgtgtgtgccagcaatggccacaccttccagaatgaatgcttcttctgtgtggagcagcgggagttccactaccgcatcaagtttgagaagtatggaaaatgtgactag

SEQ ID NO: 8222 - DNA, 351 bp, Artificial Sequence
  Description of Artificial Sequence: Synthetic coding sequence
atggtgctgctgcactggtgcctgctgtggctgctcttccccctgagcagcaggacccagaagctgcccaccagagatgaggagctgttccagatgcagatccgggacaaggccttcttccatgacagcagcgtcatcccagatggagctgagatcagcagctacctgttccgggacacccccaagcgctacttctttgtggtggaggaggacaacacccccctgtctgtgacagtgaccccctgtgatgcccccctggagtggaagctgagcctgcaggagctgcctgaagatagaagtggagagggcagcggggacctggagcccctggagcagcagaagcagcagtag

SEQ ID NO: 8223 - DNA, 432 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatcagcggctag

SEQ ID NO: 8224 - DNA, 747 bp, Artificial Sequence
  Description of Artificial Sequence: Synthetic coding sequence
atggagctgctgcaggtgaccatcctcttcctgctgcccagcatctgcagcagcaacagcactggagtgctggaggccgccaacaacagcctggtggtgaccaccaccaagcccagcatcaccacccccaacacagagagcctgcagaagaatgtggtgacccccaccaccggcaccacccccaagggcaccatcaccaatgagctgctgaagatgagcctgatgagcacagccaccttcctgaccagcaaggatgagggcctgaaggccaccaccacagatgtgaggaagaatgacagcatcatcagcaatgtgacagtgacctctgtgaccctgcccaatgctgtgtccaccctgcagagcagcaagcccaagagctctgtgctgcagccagatgccagccccagcaagacaggcaccctgaccagcatccctgtgaccatccctgagaacaccagccagagccaggtgattggaacagagggcggcaagaatgccagcaccagcgccaccagccgcagctacagcagcatcatcctgcctgtggtgattgccctgattgtcatcaccctgtctgtgtttgtgctggtgggcctgtacaggatgtgctggaaggctgaccccggcaccccagaaaatggaaatgaccagccccagagcgacaaggagagcgtgaagctgctgactgtgaagaccatcagccatgaaagtggagagcacagcgcccagggcaagaccaagaactag

SEQ ID NO: 8225 - DNA, 363 bp, Artificial Sequence
  Description of Artificial Sequence: Synthetic coding sequence
atgaagacaggcctcttcttcctgtgcctgctgggcacagctgctgccatccccaccaatgcccggctgctgagtgaccacagcaagcccacagctgagaccgtggccccagacaacacagccatccccagcctgcgggcagaggccgaggagaatgagaaggagacagctgtgtccacagaagatgacagccaccacaaggccgagaagagctctgtgctgaagagcaaggaggagagccatgagcagagcgctgagcagggcaagagcagcagccaggagctgggcctgaaggaccaggaggacagtgatggccacctgtctgtgaacctggagtatgcccccacagagggcaccctgtag

SEQ ID NO: 8226 - DNA, 339 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaagtag

SEQ ID NO: 8227 - DNA, 513 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctacccccgggcctag

SEQ ID NO: 8228 - DNA, 417 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccagtag

SEQ ID NO: 8229 - DNA, 285 bp, Artificial Sequence; identical to SEQ ID NO: 7736
  Description of Artificial Sequence: Synthetic coding sequence

SEQ ID NO: 8230 - DNA, 156 bp, Artificial Sequence; identical to SEQ ID NO: 8192
  Description of Artificial Sequence: Synthetic coding sequence

SEQ ID NO: 8231 - DNA, 2760 bp, Artificial Sequence; identical to SEQ ID NO: 7514
  Description of Artificial Sequence: Synthetic coding sequence

SEQ ID NO: 8232 - DNA, 318 bp, Artificial Sequence
  Description of Artificial Sequence: Synthetic coding sequence
atgggcgtgtccaagctggacatcctgtacagaaggctgctgctgaccaagctgttcatccggggctggggccggcctgaggacctgaagaggctgtttgagttcaggaagatgattggcaaccgggagcgctgccagaacctggtgtccagtgactaccctgtgcacatcgacaagattgaggagcagagcgactgcaagatcctggatggccactttgtgagccccatggcccactacgtgcctgacatcatgcccattgaatctgtgattgcccgcttccagttcatcgtgcccaaggagtggaacagcaagtag

SEQ ID NO: 8233 - DNA, 126 bp, Artificial Sequence
  Description of Artificial Sequence: Synthetic coding sequence
atgaagctgagcggcatgttcctgctgctgagcctggccctcttctgcttcctgactggagtcttcagccagggcggccaggtggactgtggggagttccaggaccccaaggtgtactgcacctag

SEQ ID NO: 8234 - DNA, 459 bp, Artificial Sequence; identical to SEQ ID NO: 7709
  Description of Artificial Sequence: Synthetic coding sequence

SEQ ID NO: 8235 - DNA, 1611 bp, Artificial Sequence
  Description of Artificial Sequence: Synthetic coding sequence
atggacttcctgctggccctggtgctggtgagcagcctgtacctgcaggccgctgctgagtttgatggccgctggccccggcagatcgtgagcagcatcggcctgtgccgctatggaggaagaattgactgctgctggggctgggcccggcagagctggggccagtgccagcctgtgtgccagccccgctgcaagcacggggagtgcatcggccccaacaagtgcaagtgccaccctggctacgccggcaagacctgcaaccaggacctgaatgaatgtggcctgaagccccggccctgcaagcaccgctgcatgaacacctacggcagctacaagtgctactgcctgaatggctacatgctgatgccagatggcagctgcagcagcgccctgacctgcagcatggccaactgccagtatggctgtgatgtggtgaagggccagatccgctgccagtgccccagccctggcctgcagctggccccagatggccgcacctgtgtggatgtggatgaatgtgccaccggccgggccagctgcccccgcttccggcagtgtgtgaacaccttcggcagctacatctgcaagtgccacaagggctttgacctgatgtacatcggcggcaagtaccagtgccacgacattgatgaatgttccctgggccagtaccagtgcagcagctttgcccgctgctacaacatccggggcagctacaagtgcaagtgcaaggagggctaccagggagatggcctgacctgtgtgtacatccccaaggtgatgattgagcccagcggccccatccacgtgcccaagggaaatggcaccatcctgaagggggacaccggcaacaacaactggatcccagatgtgggcagcacctggtggccacccaagaccccctacatcccccccatcatcaccaaccggcccaccagcaagcccaccacccggcccacccccaagcccacccccatccccaccccacctcctcctccacccctgcccacagagctgcggacccccctgccccccaccaccccagagcggcccaccaccggcctgaccaccatcgccccagctgccagcaccccacctgggggcatcaccgtggacaacagagtgcagacagacccccagaagcccagaggagatgtgttttctgtgctggtgcacagctgcaactttgaccacggcctgtgtggctggatccgggagaaggacaatgacctgcactgggagcccatccgggaccctgctgggggccagtacctgactgtgtctgctgccaaggcccctgggggcaaggccgcccggctggtgctgcccctgggccgcctgatgcacagcggggacctgtgcctgtccttccgccacaaggtgacaggcctgcacagcggcaccctgcaggtgtttgtgaggaagcatggagcccacggggccgccctgtggggcagaaatggaggccacggctggaggcagacccagatcaccctgcggggagctgacatcaagtctgtggtgttcaagggggagaagagaagaggccacactggagagatcggcctggatgatgtgtccctgaagaagggccactgcagcgaggagaggtag

SEQ ID NO: 8236 - DNA, 288 bp, Artificial Sequence
  Description of Artificial Sequence: Synthetic coding sequence
atgctgttcaggaaccgcttcctgctgctgctggccctggccgccctgctggcctttgtgtccctgagcctgcagttcttccacctgatccctgtgtccacccccaagaatggcatgagcagcaagagcaggaagaggatcatgccagaccctgtgacagagccccctgtgacagatcctgtgtatgaggccctgctgtactgcaacatccccagcgtggccgagaggtccatggagggccacgccccccaccacttcaagctggtgtctgtgcacgtgttcatctag

SEQ ID NO: 8237 - DNA, 213 bp, Artificial Sequence
  Description of Artificial Sequence: Synthetic coding sequence
atggccagtgacctgatccgcaccatcctggccgtggccctgatcagcaagctgggcacagctgtggatgctgagctgatgcccagcggggccatcctgcagaacaagcgggagaacctgccccgggtgtgccacgccctggccttcctgggcatggcccgctgccaggacctcttcctggtgcggctgcagggctggaagctgggcacctag

SEQ ID NO: 8238 - DNA, 417 bp, Artificial Sequence; identical to SEQ ID NO: 8228
  Description of Artificial Sequence: Synthetic coding sequence

SEQ ID NO: 8239 - DNA, 219 bp, Artificial Sequence
  Description of Artificial Sequence: Synthetic coding sequence
atggctgtgtctgtgctgcggctgactgtggtgctgggcctgctggtgctcttcctgacctgctacgcagatgacaagccagacaagccagatgacaagccagatgattctgggaaggaccccaagccagacttccccaagttcctgagcctgctgggcacagagatcattgaaaatgctgtggagttcatcctgcgctccatgagccgcagcacctag

SEQ ID NO: 8240 - DNA, 438 bp, Artificial Sequence
  Description of Artificial Sequence: Synthetic coding sequence
atggtgctgctgcactggtgcctgctgtggctgctcttccccctgagcagcaggacccagaagctgcccaccagagatgaggagctgttccagatgcagatccgggacaaggccttcttccatgacagcagcgtcatcccagatggagctgagatcagcagctacctgttccgggacacccccaagcgctacttctttgtggtggaggaggacaacacccccctgtctgtgacagtgaccccctgtgatgcccccctggagtggaagctgagcctgcaggagctgcctgaagatagaagtggagagggcagcggggacctggagcccctggagcagcagaagcagcagatcatcaatgaggagggcacagagctgttctcctacaagggaaatgatgtggagtacttcatcagcagcagcagccccagcggcctgtag

SEQ ID NO: 8241 - DNA, 258 bp, Artificial Sequence
  Description of Artificial Sequence: Synthetic coding sequence
atgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtag

SEQ ID NO: 8242 - DNA, 1410 bp, Artificial Sequence
  Description of Artificial Sequence: Synthetic coding sequence
atgctgaaggtgcactaccccaagtttggagtgtctgaggactgcctgtacctgaacatctatgccccagcccacgccgacaccggcagcaagctgcctgtgctggtgtggttccctggaggagccttcaagacaggcagcgccagcatctttgatggcagcgccctggccgcctatgaagatgtgctggtggtggtggtgcagtaccgcctgggcatcttcggcttcttcaccacctgggaccagcacgcccctggcaactgggccttcaaggaccaggtggccgccctgtcctgggtgcagaagaacatcgagttctttggaggagaccccagctctgtgaccatctttggagagagcgctggggccatctctgtgagcagcctcatcctgagccccatggccaagggcctcttccacaaggccatcatggagagcggcgtggccatcatcccctacctggaggcccatgactatgagaagtctgaggacctgcaggtggtggcccacttctgtggcaacaatgccagtgacagcgaggccctgctgcgctgcctgcggaccaagcccagcaaggagctgctgaccctgagccagaagaccaagagcttcaccagggtggtggatggagccttcttccccaatgagcccctggacctgctgagccagaaggccttcaaggccatccccagcatcattggagtgaacaaccatgaatgtggcttcctgctgcccatgaaggaggcccctgagatcctgagcggcagcaacaagagcctggccctgcacctgatccagaacatcctgcacatccccccccagtacctgcacctggtggccaatgagtacttccatgacaagcacagcctgacagagatccgggacagcctgctggacctgctgggagatgtgttctttgtggtgcctgccctgatcacagcccgctaccacagagatgctggggcccctgtgtacttctatgagttccgccaccggccccagtgctttgaggacaccaagccagcctttgtgaaggctgaccatgctgatgaggtgcgctttgtgtttggaggagccttcctgaagggggacatcgtgatgtttgagggcgccacagaggaggagaagctgctgagcaggaagatgatgaagtactgggccacctttgccaggacaggcaaccccaatggaaatgacctgagcctgtggccagcctacaacctgacagagcagtacctgcagctggacctgaacatgagcctgggccagaggctgaaggagccccgggtggacttctggaccagcaccatccccctcatcctgagcgccagtgacatgctgcacagccccctgagcagcctgaccttcctgagcctgctgcagcccttcttcttcttctgtgccccctag

SEQ ID NO: 8243 - DNA, 393 bp, Artificial Sequence
  Description of Artificial Sequence: Synthetic coding sequence
atgctgcccttcctgttcttcagcaccctcttcagcagcatcttcacagaggcccagaagcagtactgggtgtgcaacagcagtgatgccagcatctcctacacctactgcggccgggacctgaagcagctgtacttcaacctgtacatcaccgtgaacaccatgaacctgcccaagaggaaggaggtgatctgccggggcagtgatgatgactacagcttctgccgggccctgaagggggagaccgtgaacaccaccatctccttctccttcaagggcatcaagttcagcaagggcaagtacaagtgtgtggtggaggccatcagcggcagccctgaggagatgctgttctgcctggagtttgtgatcctgcaccagcccaacagcaactag

SEQ ID NO: 8244 - DNA, 318 bp, Artificial Sequence
  Description of Artificial Sequence: Synthetic coding sequence
atgaagtgcacagcccgggagtggctgcgggtgaccaccgtgctcttcatggcccgggccatcccagccatggtggtgcccaatgccaccctgctggagaagctgctggagaagtacatggatgaagatggagagtggtggatcgccaagcagaggggcaagagggccatcacagacaatgacatgcagagcatcctggacctgcacaacaagctgcggagccaggtgtaccccacagccagcaacatggagtacatgacctgggatgtggagctggagaggtctgctgagagctgggccgagagctgcctgtggtag

SEQ ID NO: 8245 - DNA, 567 bp, Artificial Sequence
  Description of Artificial Sequence: Synthetic coding sequence
atgaccatggtgtgccacaggcctgagggcctggagcagctggaggcccagaccaacttcaccaagcgggagctgcaggtgctgtaccggggcttcaagaatgaatgtcccagcggcgtggtgaatgaagacaccttcaagcagatctatgcccagttcttcccccatggagatgccagcacctacgcccactacctgttcaatgcctttgacaccacccagacaggctctgtgaagtttgaagattttgtgacagccctgagcatcctgctgcggggcaccgtgcatgagaagctgcgctggaccttcaacctgtatgacatcaacaaggatggctacatcaacaaggaggagatgatggacatcgtgaaggccatctatgacatgatgggcaagtacacctaccctgtgctgaaggaggacaccccccggcagcacgtggatgtgttcttccagaagatggacaagaacaaggatggcatcgtgaccctggatgagttcctggagagctgccaggaggatgacaacatcatgaggagcctgcagctgttccagaatgtgatgtag

SEQ ID NO: 8246 - DNA, 1275 bp, Artificial Sequence
  Description of Artificial Sequence: Synthetic coding sequence
atgccacccttcctgatcaccctcttcctgttccacagctgctgcctgcgggccaacggccacctgcgggagggcatgaccctgctgaagacagaatttgccctgcacctgtaccagagcgtggccgcctgcagaaatgagaccaacttcgtcatcagccctgctggggtgtccctgcccctggagatcctgcagtttggagctgagggcagcacaggccagcagctggctgatgccctgggctacacagtgcatgacaagagggtgaaggacttcctgcatgctgtgtatgccaccctgcccaccagcagccagggcacagagatggagctggcctgcagcctgtttgtgcaggtgggcacccccctgagcccctgctttgtggagcacgtgtcctggtgggccaacagcagcctggagcctgctgacctgtctgagcccaacagcacagccatccagaccagcgagggcgccagccgggagacagctgggggcggccccagcgagggccctgggggctggccctgggagcaggtgtctgctgcctttgcccagctggtgctggtgtccaccatgtccttccagggcacctggaggaagcgcttcagcagcacagacacccagatcctgcccttcacctgtgcctacggcctggtgctgcaggtgcccatgatgcaccagaccacagaggtgaactacggccagttccaggacacagctggccaccaggtgggcgtgctggagctgccctacctgggcagcgctgtgtccctcttcctggtgctgccccgggacaaggacacccccctgagccacatcgagccccacctgacagccagcaccatccacctgtggaccaccagcctgcggcgggccaggatggatgtgttcctgccccgcttccgcatccagaaccagttcaacctgaagagcatcctgaacagctggggcgtgacagacctgtttgaccccctgaaggccaacctgaagggcatcagcggccaggacggcttctacgtgtctgaggccatccacaaggccaagattgaggtgctggaggagggcaccaaggccagcggggccacagccctgctgctgctgaagaggagccgcatccccatcttcaaggctgaccggcccttcatctacttcctgcgggagcccaacacaggcatcaccgtcttctttgaccgcatccagatcatctaccagtgcctgagcagcaacaagggcagctttgtgcactaccccctgaagaacaagcacagcttctag

SEQ ID NO: 8247 - DNA, 1815 bp, Artificial Sequence
  Description of Artificial Sequence: Synthetic coding sequence
atggctgtgctggtgtgcccagccagctgccacggcctgaaggagttccgcatcagaagaggcatgtggaggctgtgcctggtgtactacttctacccagccagcagcaccctgtatgtgctgagaattgatgtgctgaactacaccagcaaggatgagggccccagcgctgagggcccccagaggaacacccggctgggctggatccagggcaagcaggtgacagtgctgggcagccctgtgcctgtgaatgtgttcctgggcgtgccctttgctgccccacccctgggcagcctgcgcttcaccaacccccagcctgccagcccctgggacaacctgcgggaggccaccagctaccccaacctgtgcctgcagaacagcgagtggctgctgctggaccagcacatgctgaaggtgcactaccccaagtttggagtgtctgaggactgcctgtacctgaacatctatgccccagcccatgctgacaccggcagcaagctgcctgtgctggtgtggttccctgggggcgccttcaagacaggcagcgccagcatctttgatggcagcgccctggccgcctatgaagatgtgctggtggtggtggtgcagtaccgcctgggcatcttcggcttcttcaccacctgggaccagcacgcccctggcaactgggccttcaaggaccaggtggccgccctgtcctgggtgcagaagaacatcgagttcttcggcggggaccccagctctgtgaccatctttggagagagcgctggggccatctctgtgagcagcctcatcctgagccccatggccaagggcctcttccacaaggccatcatggagagcggcgtggccatcatcccctacctggaggcccatgactatgagaagtctgaggacctgcaggtggtggcccacttctgtggcaacaatgccagtgacagcgaggccctgctgcgctgcctgcggaccaagcccagcaaggagctgctgaccctgagccagaagaccaagagcttcaccagggtggtggatggagccttcttccccaatgagcccctggacctgctgagccagaaggccttcaaggccatccccagcatcatcggcgtgaacaaccatgaatgtggcttcctgctgcccatgaaggaggcccctgagatcctgagcggcagcaacaagagcctggccctgcacctgatccagaacatcctgcacatccccccccagtacctgcacctggtggccaatgagtacttccatgacaagcacagcctgacagagatccgggacagcctgctggacctgctgggagatgtgttctttgtggtgcctgccctgatcacagcccgctaccacagagatgctggggcccctgtgtacttctatgagttccgccaccggccccagtgctttgaggacaccaagccagcctttgtgaaggctgaccacgcagatgaggtgcgctttgtgtttggaggagccttcctgaagggggacatcgtgatgtttgaaggagccacagaggaggagaagctgctgagcaggaagatgatgaagtactgggccacctttgccaggactggaaaccccaatggaaatgacctgagcctgtggccagcctacaacctgacagagcagtacctgcagctggacctgaacatgagcctgggccagaggctgaaggagccccgggtggacttctggaccagcaccatccccctcatcctgagcgccagtgacatgctgcacagccccctgagcagcctgaccttcctgagcctgctgcagcccttcttcttcttctgtgccccctag

SEQ ID NO: 8248 - DNA, 939 bp, Artificial Sequence
  Description of Artificial Sequence: Synthetic coding sequence
atgaacatctggggccagatctggcccaaggctgtgtacctggtgtgcaactacagccccaagggcaactggtggggccacgccccctacaagcacggccggccctgcagcgcctgcccccccagctttggaggcggctgccgggagaacctgtgctacaaggagggcagtgaccgctactacccaccccgggaggaggagaccaatgaaattgagcggcagcagagccaggtgcatgacacccacgtgaggaccaggagtgatgacagcagcagaaatgaagtcatcagcgcccagcagatgagccagatcgtgtcctgtgaggtgcggctgcgggaccagtgcaagggcaccacctgcaacagatatgagtgcccagctggctgcctggacagcaaggccaaggtgattggctctgtgcactatgagatgcagagcagcatctgcagagctgccatccactacggcatcatcgacaatgatggcggctgggtggacatcacccggcagggcaggaagcactacttcatcaagagcaacagaaatggcatccagaccatcggcaagtaccagagcgccaacagcttcaccgtgtccaaggtgacagtgcaggccgtgacctgtgagaccaccgtggagcagctgtgccccttccacaagccagccagccactgcccccgggtgtactgccccaggaactgcatgcaggccaacccccactacgcccgggtgattggcaccagggtgtacagcgacctgagcagcatctgcagagctgctgtgcatgctggggtggtgagaaatcatggaggctacgtggatgtgatgcctgtggacaagaggaagacctacatcgccagcttccagaatggcatcttcagcgagagcctgcagaaccccccaggcggcaaggccttccgggtgtttgctgtggtgtag

SEQ ID NO: 8249 - DNA, 777 bp, Artificial Sequence; identical to SEQ ID NO: 6928
  Description of Artificial Sequence: Synthetic coding sequence

SEQ ID NO: 8250 - DNA, 1215 bp, Artificial Sequence; identical to SEQ ID NO: 7753
  Description of Artificial Sequence: Synthetic coding sequence

SEQ ID NO: 8251 - DNA, 936 bp, Artificial Sequence; identical to SEQ ID NO: 8152
  Description of Artificial Sequence: Synthetic coding sequence

SEQ ID NO: 8252 - DNA, 555 bp, Artificial Sequence
  Description of Artificial Sequence: Synthetic coding sequence
atggccagcgagcggctgcccaacagacctgcctgcctgctggtggccagcggggctgctgagggcgtgtctgcccagagcttcctgcactgcttcaccatggccagcacagccttcaacctgcaggtggccacccctgggggcaaggccatggagtttgtggatgtgacagagagcaatgcccgctgggtgcaggacttccggctgaaggcctatgccagccctgccaagctggagagcattgatgagcccatctgtgctgtgggccacggcgtggccgccctgtgctgtgccaccaatgaagatcgctcctgggtgtttgacagctacagcctgaccggccccagcgtgtgtgagctggtgcgggcccctggctttgcccggctgcccctggtggtggaggactttgtgaaggacagcggggcctgcttcagcgccagcgagccagatgctgtgcacgtggtgctggacagacacctggtgacaggccagaatgccagcagcacagtgcctgctgtgcagaacctgctcttcctgtgtggcagcaggaagtag

SEQ ID NO: 8253 - DNA, 1257 bp, Artificial Sequence; identical to SEQ ID NO: 7322
  Description of Artificial Sequence: Synthetic coding sequence

SEQ ID NO: 8254 - DNA, 1425 bp, Artificial Sequence
  Description of Artificial Sequence: Synthetic coding sequence
atggacaggaaccccagccccccacctcctggccgggacaaggaggaggaggaggaggtggccggcggggactgcatcggcagcacagtgtacagcaagcactggctgtttggagtgctgagcggcctcatccagatcgtgtccccagagaacaccaagagcagcagtgatgatgaggagcagctgacagagctggatgaggagatggagaatgagatctgccgggtgtgggacatgtccatggatgaagatgtggccctcttcctgcaggagttcaatgccccagacatcttcatgggcgtgctggccaagagcaagtgcccccggctgcgggagatctgtgtgggcatcctgggcaacatggcctgcttccaggagatctgtgtgtccatcagcagtgacaagaacctgggccaggtgctgctgcactgcctgtatgacagcgacccccccaccctgctggagaccagccggctgctgctgacctgcctgagccaggccgaggtggcctctgtgtgggtggagcgcatccaggagcacccagccatctatgacagcatctgcttcatcatgagcagcagcaccaacgtggacctgctggtgaaggtgggggaggtggtggacaagctgtttgacctggatgagaagctgatgctggagtgggtgagaaatggagctgcccagcccctggaccagccccaggaggagagcgaggagcagcctgtgttccggctggtgccctgcatcctggaggccgccaagcaggtgcgctcagaaaatcctgagtggctggatgtgtacatgcacatcctgcagctgctgaccaccgtggatgatggcatccaggccatcgtgcactgcccagacaccgggaaggacatctggaacctgctgtttgacctggtgtgccacgagttctgccagagtgatgacccccccatcatcctgcaggagcagaagacagtgctggcctctgtgttttctgtgctgagcgccatctatgccagccagacagagcaggagtacctgaagattgagaaggtggacctgcccctgattgacagcctcatccgggtgctgcagaacatggagcagtgccagaagaagccagaaaattctgctgagagcaacacagaggagaccaagaggacagacctgacccaggatgacttccacctgaagatcctgaaggacatcctgtgtgagttcctgagcaacatcttccaggccctgaccaaggagaccgtggcccagggcgtgaaggagggccagctgagcaagcagaagtgcagcagcgccttccagaacctgctgcccttctacagccctgtggtggaggacttcatcaagatcctgcgggaggtggacaaggccctggctgatgacctggagaagaacttccccagcctgaaggtgcagacctag

SEQ ID NO: 8255 - DNA, 438 bp, Artificial Sequence; identical to SEQ ID NO: 7088
  Description of Artificial Sequence: Synthetic coding sequence

SEQ ID NO: 8256 - DNA, 1728 bp, Artificial Sequence
  Description of Artificial Sequence: Synthetic coding sequence
tgaatttttggaggcagcatccactacttccgggtgccccgggagtactggagggaccggctgctgaagatgaaggcctgtggcctgaacaccctgaccacctacgtgccctggaacctgcacgagcctgagcggggcaagtttgacttcagcggcaacctggacctggaggcctttgtgctgatggctgctgagatcggcctgtgggtgatcctgcggcccggcccctacatctgcagcgagatggacctgggcggcctgcccagctggctgctgcaggaccccggcatgaggctgcggaccacctacaagggcttcacagaagctgtggacctgtactttgaccacctgatgagccgggtggtgcccctgcagtacaagagaggaggccccatcatcgctgtgcaggtggagaatgaatatggcagctacaacaaggaccctgcctacatgccctacgtgaagaaggccctggaggaccggggcatcgtggagctgctgctgaccagtgacaacaaggatggcctgagcaagggcatcgtgcagggcgtgctggccaccatcaacctgcagagcacccatgagctgcagctgctgaccaccttcctgttcaacgtgcagggcacccagcccaagatggtgatggagtactggacaggctggtttgacagctggggcggcccccacaacatcctggacagcagcgaggtgctgaagacagtgtctgccatcgtggatgctggcagcagcatcaacctgtacatgtttcatggaggcaccaactttggcttcatgaatggagccatgcacttccatgactacaagagtgatgtgaccagctatgactatgatgctgtgctgacagaggccggggactacacagccaagtacatgaagctgcgggacttcttcggcagcatcagcggcatccccctgcccccacctccagacctgctgcccaagatgccctatgagcccctgacccctgtgctgtacctgagcctgtgggatgccctgaagtacctgggggagcccatcaagtctgagaagcccatcaacatggagaacctgcctgtgaatggaggaaatggccagagctttggctacatcctgtatgagaccagcatcaccagcagcggcatcctgagcggccacgtgcatgaccggggccaggtgtttgtgaacacagtgtccatcggcttcctggactacaagaccaccaagattgctgtgcccctcatccagggctacacagtgctgcgcatcctggtggagaacagaggccgggtgaactacggggagaacattgatgaccagaggaagggcctcatcggcaacctgtacctgaatgacagccccctgaagaacttccgcatctacagcctggacatgaagaagagcttcttccagcgcttcggcctggacaagtggagcagcctgcctgagacccccaccctgcctgccttcttcctgggcagcctgagcatcagcagcaccccctgtgacaccttcctgaagctggagggctgggagaagggcgtggtgttcatcaatggccagaacctgggccgctactggaacatcggcccccagaagaccctgtacctgcccggcccctggctgagcagcggcatcaaccaggtgattgtgtttgaggagaccatggccggccctgccctgcagttcacagagaccccccacctgggcaggaaccagtacatcaagtag

SEQ ID NO: 8257 - DNA, 255 bp, Artificial Sequence
  Description of Artificial Sequence: Synthetic coding sequence
atgaggaccctcttcaacctgctgtggctggccctggcctgcagccctgtgcacaccaccctgagcaagagtgatgccaagaaggccgccagcaagaccctgctggagaagagccagttcagtgacaagcctgtgcaggaccggggcctggtggtgacagacctgaaggccgagagcgtggtgctggagcacaggagctactgcagcgccaaggcccgggacagacactttgctggagatgtgctgggctactag

SEQ ID NO: 8258 - DNA, 744 bp, Artificial Sequence
  Description of Artificial Sequence: Synthetic coding sequence
atgaggagcctgctgctgctgagcgccttctgcctgctggaggccgccctggccgctgaggtgaagaagccagctgctgctgctgcccctggaacagctgagaagctgagccccaaggccgccaccctggccgagaggtctgctggcctggccttcagcctgtaccaggccatggccaaggaccaggccgtggagaacatcctggtgtcccctgtggtggtggccagcagcctgggcctggtgtccctgggcggcaaggccaccacagccagccaggccaaggctgtgctgtctgctgagcagctgagagatgaggaggtgcatgctggcctgggggagctgctgcggagcctgagcaacagcacagccagaaatgtgacctggaagctgggcagccggctgtatggccccagctctgtgtcctttgctgatgactttgtgcgcagcagcaagcagcactacaactgtgagcacagcaagatcaacttccgggacaagaggtctgccctgcagagcatcaatgagtgggccgcccagaccacagatggcaagctgcctgaggtgaccaaggatgtggagaggacagatggagccctgctggtgaatgccatgttcttcaagccccactgggatgagaagttccaccacaagatggtggacaacagaggcttcatggtgaccaggagctacacagtgggcgtgatgatgatgcacaggacaggcctgtacaactactatgactag

SEQ ID NO: 8259 - DNA, 117 bp, Artificial Sequence
  Description of Artificial Sequence: Synthetic coding sequence
atgaggaccctcttcaacctgctgtggctggccctggcctgcagccctgtgcacaccaccctgagcaagagtgatgccaagaaggccgccagcaagaccctgctggagaaggtgtag

SEQ ID NO: 8260 - DNA, 750 bp, Artificial Sequence
  Description of Artificial Sequence: Synthetic coding sequence
atgaggagcctgctgctgctgagcgccttctgcctgctggaggccgccctggccgctgaggtgaagaagccagctgctgctgctgcccctggaacagctgagaagctgagccccaaggccgccaccctggccgagaggtctgctggcctggccttcagcctgtaccaggccatggccaaggaccaggccgtggagaacatcctggtgtcccctgtggtggtggccagcagcctgggcctggtgtccctgggcggcaaggccaccacagccagccaggccaaggctgtgctgtctgctgagcagctgagagatgaggaggtgcatgctggcctgggggagctgctgcggagcctgagcaacagcacagccagaaatgtgacctggaagctgggcagccggctgtatggccccagctctgtgtcctttgctgatgactttgtgcgcagcagcaagcagcactacaactgtgagcacagcaagatcaacttccgggacaagaggtctgccctgcagagcatcaatgagtgggccgcccagaccacagatggcaagctgcctgaggtgaccaaggatgtggagaggacagatggagccctgctggtgaatgccatgttcttcaagccccactgggatgagaagttccaccacaagatggtggacaacagaggcttcatggtgaccaggagctacacagtgggcgtgatgatgatgcacaggacaggcctgtacaactactatgatgatgaatag

SEQ ID NO: 8261 - DNA, 201 bp, Artificial Sequence
  Description of Artificial Sequence: Synthetic coding sequence
atgaagcccctgctggtggtgtttgtgttcctgttcctgtgggaccctgtgctggccggcatcaacagcctgagcagcgagatgcacaagaagtgctacaagaatggcatctgccgcctggagtgctatgaaagtgagatgctggtggcctactgcatgttccagctggagtgctgcgtgaagggcaacccagccccctag

SEQ ID NO: 8262 - DNA, 1002 bp, Artificial Sequence; identical to SEQ ID NO: 7654
  Description of Artificial Sequence: Synthetic coding sequence

SEQ ID NO: 8263 - DNA, 645 bp, Artificial Sequence
  Description of Artificial Sequence: Synthetic coding sequence
atgaggcccaagacaggccaggtgggctgtgagaccccagaggagctgggccctggcccccggcagcgctggcccctgctgctgctgggcctggccatggtggcccacggcctgctgcggcccatggtggccccccagagcggggaccctgaccccggggcctctgtgggcagcagccgcagcagcctgcggagcctgtggggccgcctgctgctgcagcccagcccccagagagctgacccccgctgctggccccggggcttctggagcgagccccagagcctgtgctacgtgtttggaacaggcaccaaggtgacagtgctgggccagcccaaggccaaccccaccgtgaccctcttcccccccagcagcgaggagctgcaggccaacaaggccaccctggtgtgcctgatcagtgacttctacccaggagctgtgacagtggcctggaaggcagatggcagccctgtgaaggccggcgtggagaccaccaagcccagcaagcagagcaacaacaagtatgctgccagcagctacctgagcctgaccccagagcagtggaagagccacaggagctacagctgccaggtgacccatgagggcagcacagtggagaagacagtggcccccacagagtgcagctag

SEQ ID NO: 8264 - DNA, 1050 bp, Artificial Sequence
  Description of Artificial Sequence: Synthetic coding sequence
tgactctacaagaaccggctgggcagcggcggccggggccgctgcatcaagcagggcgagaactggtacagccccacagaatttgaggccatggccggccgggccagcagcaaggactggaagaggagcatccgctatgccggccggcccctgcagtgcctgatccaggacggcatcctgaacccccacgccgccagctgcacctgtgccgcctgctgtgatgacatgaccctgagcggccctgtgcggctgtttgtgccctacaagaggaggaagaaggaaaatgagctgcccaccacccctgtgaagaaggacagccccaagaacatcaccctgctgcctgccacagctgccaccaccttcaccgtgacccccagcggccagatcaccaccagcggggccctgacctttgaccgggccagcacagtggaggccacagctgtgatcagcgagagccctgcccagggagatgtgtttgctggggccaccgtgcaggaggcctctgtgcagcccccctgccgggccagccaccctgagccccactacccaggctaccaggacagctgccagatcgcccccttccctgaggccgccctgcccaccagccaccccaagatcgtgctgaccagcctgcctgccctggccgtgcccccacccacccccaccaaggccgcccccccagccctggtgaatggcctggagctgtctgagcccaggtcctggctgtacctggaggagatggtgaacagcctgctgaacacagcccagcagctgaagaccctgtttgagcaggccaagcacgccagcacctaccgggaggccgccaccaaccaggccaagatccatgctgatgctgagaggaaggagcagagctgtgtgaactgtggccgggaggccatgtctgagtgcaccggctgccacaaggtgaactactgcagcaccttctgccagaggaagcgctggagcctgaccatgctgaccagcctggtgtccatctcctggctgcgggccatcctgccctgccagccccccaaggtgctgggcctgtag

SEQ ID NO: 8265 - DNA, 600 bp, Artificial Sequence
  Description of Artificial Sequence: Synthetic coding sequence
atgagcctggacatccagagcctggacatccagtgtgaggagctgagtgatgcccgctgggccgagctgctgcccctgctgcagcagtgccaggtggtgcggctggatgactgtggcctgacagaggcccgctgcaaggacatcagcagcgccctgcgggtgaacccagccctggccgagctgaacctgcggagcaatgagctgggagatgtgggcgtgcactgtgtgctgcagggcctgcagacccccagctgcaagatccagaagctgagcctgcagaactgctgcctgaccggggccggctgcggcgtgctgagcagcaccctgcggaccctgcccaccctgcaggagctgcacctgagtgacaacctgctgggagatgctggcctgcagctgctgtgtgagggcctgctggacccccagtgccgcctggagaagctgcagctggagtactgcagcctgtctgctgccagctgtgagcccctggcctctgtgctgcgggccaagccagacttcaaggagctgactgtgagcaacaatgacatcaatgaagctggggtgcgggtgctgtgccagggcctgaaggacagcccctgctag

SEQ ID NO: 8266 - DNA, 465 bp, Artificial Sequence
  Description of Artificial Sequence: Synthetic coding sequence
atggccggcatccctggcctgctcttcctgctcttcttcctgctgtgtgctgtgggccaggtgagcccctacagcgccccctggaagcccacctggccagcctaccgcctgcctgtggtgctgccccagagcaccctgaacctggccaagccagactttggagctgaggccaagctggaggtgagcagcagctgtggcccccagtgccacaagggcacccccctgcccacctatgaggaggccaagcagtacctgtcctatgagaccctgtatgccaacggcagcaggacagagacccaggtgggcatctacatcctgagcagcagtggagatggagcccagcaccgggacagcggcagcagcggcaagagcaggaggaagaggcagatctacggctatgacagccgcttcagcatctttgggaaggacttcctgctgaactaccccttcagcacctctgtgtag

SEQ ID NO: 8267 - DNA, 936 bp, Artificial Sequence; identical to SEQ ID NO: 6978
  Description of Artificial Sequence: Synthetic coding sequence

SEQ ID NO: 8268 - DNA, 1404 bp, Artificial Sequence; identical to SEQ ID NO: 7332
  Description of Artificial Sequence: Synthetic coding sequence

SEQ ID NO: 8269 - DNA, 81 bp, Artificial Sequence
  Description of Artificial Sequence: Synthetic coding sequence
atgaggaccctcttcaacctgctgtggctggccctggcctgcagccctgtgcacaccaccctgagcaagagtgatgcctag

SEQ ID NO: 8270 - DNA, 549 bp, Artificial Sequence
  Description of Artificial Sequence: Synthetic coding sequence
atgaggaggatgtgggccacccagggcctggccgtggccctggccctgtctgtgctgcccggcagccgggccctgcggcctggggactgtgaggtgtgcatctcctacctgggccgcttctaccaggacctgaaggacagagatgtgaccttctccccagccaccattgaaaatgagctgatcaagttctgccgggaggcccggggcaaggaaaatcggctgtgctactacatcggggccacagatgatgctgccaccaagatcatcaatgaggtgtccaagcccctggcccaccacatccctgtggagaagatctgtgagaagctgaagaagaaggacagccagatctgtgagctgaagtatgacaagcagattgacctgagcacagtggacctgaagaagctgcgggtgaaggagctgaagaagatcctggatgactggggcgagacctgcaagggctgtgccgagaagagtgactacatcaggaagatcaatgagctgatgcccaagtatgcccccaaggccgccagcgccaggacagacctgtag

SEQ ID NO: 8271 - DNA, 153 bp, Artificial Sequence
  Description of Artificial Sequence: Synthetic coding sequence
atgaaggtgttcttcctgtttgctgtgctcttctgcctggtgcagaccaacagcgtgcacatcagccaccgggaggcccggggccccagcttccgcatctgtgtggacttcctgggcccccgctgggcccggggctgcagcacaggcaactag

SEQ ID NO: 8272 - DNA, 666 bp, Artificial Sequence
  Description of Artificial Sequence: Synthetic coding sequence
atgggcgccaccaccatggaccagaagagcctgtgggccggcgtggtggtgctgctgctgctgcagggcggcagcgcctacaagctggtgtgctacttcaccaactggagccaggaccggcaggagcccgggaagttcaccccagaaaatattgaccccttcctgtgcagccacctgatctacagctttgccagcattgagaacaacaaggtgatcatcaaggacaagtctgaggtgatgctgtaccagaccatcaacagcctgaagaccaagaaccccaagctgaagatcctgctgagcattggaggctacctgtttggcagcaagggcttccaccccatggtggacagcagcaccagccggctggagttcatcaacagcatcatcctcttcctgaggaaccacaactttgatggcctggatgtgtcctggatctacccagaccagaaggagaacacccacttcaccgtgctgatccacgagctggccgaggccttccagaaggacttcaccaagagcaccaaggagcggctgctgctgacagctggggtgtctgctggccggcagatgattgacaacagctaccaggtggagaagctggccaaggacctggacttcatcaacctgctgagctttgacttccacggctcctgggagaagccctag

SEQ ID NO: 8273 - DNA, 1257 bp, Artificial Sequence; identical to SEQ ID NO: 7212
  Description of Artificial Sequence: Synthetic coding sequence

SEQ ID NO: 8274 - DNA, 612 bp, Artificial Sequence
  Description of Artificial Sequence: Synthetic coding sequence
atgaggagcctgctgctgctgagcgccttctgcctgctggaggccgccctggccgctgaggtgaagaagccagctgctgctgctgcccctggaacagctgagaagctgagccccaaggccgccaccctggccgagaggtctgctggcctggccttcagcctgtaccaggccatggccaaggaccaggccgtggagaacatcctggtgtcccctgtggtggtggccagcagcctgggcctggtgtccctgggcggcaaggccaccacagccagccaggccaaggctgtgctgtctgctgagcagctgagagatgaggaggtgcatgctggcctgggggagctgctgcggagcctgagcaacagcacagccagaaatgtgacctggaagctgggcagccggctgtatggccccagctctgtgtcctttgctgatgactttgtgcgcagcagcaagcagcactacaactgtgagcacagcaagatcaacttccgggacaagaggtctgccctgcagagcatcaatgagtgggccgcccagaccacagatggcaagctgcctgaggtgaccaaggatgtggagaggacagatggagccctgctggtgaatgcctag

SEQ ID NO: 8275 - DNA, 492 bp, Artificial Sequence
  Description of Artificial Sequence: Synthetic coding sequence
atgaggagcctgctgctgctgagcgccttctgcctgctggaggccgccctggccgctgaggtgaagaagccagctgctgctgctgcccctggaacagctgagaagctgagccccaaggccgccaccctggccgagaggtctgctggcctggccttcagcctgtaccaggccatggccaaggaccaggccgtggagaacatcctggtgtcccctgtggtggtggccagcagcctgggcctggtgtccctgggcggcaaggccaccacagccagccaggccaaggctgtgctgtctgctgagcagctgagagatgaggaggtgcatgctggcctgggggagctgctgcggagcctgagcaacagcacagccagaaatgtgacctggaagctgggcagccggctgtatggccccagctctgtgtcctttgctgatgactttgtgcgcagcagcaagcagcactacaactgtgagcacagcaagatcaacttctag

SEQ ID NO: 8276 - DNA, 570 bp, Artificial Sequence
  Description of Artificial Sequence: Synthetic coding sequence
atgagcctggacatccagagcctggacatccagtgtgaggagctgagtgatgcccgctgggccgagctgctgcccctgctgcagcagtgccaggtggtgcggctggatgactgtggcctgacagaggcccgctgcaaggacatcagcagcgccctgcgggtgaacccagccctggccgagctgaacctgcggagcaatgagctgggagatgtgggcgtgcactgtgtgctgcagggcctgcagacccccagctgcaagatccagaagctgagcctgcagaactgctgcctgaccggggccggctgcggcgtgctgagcagcaccctgcggaccctgcccaccctgcaggagctgcacctgagtgacaacctgctgggagatgctggcctgcagctgctgtgtgagggcctgctggacccccagtgccgcctggagaagctgcagctggagtactgcagcctgtctgctgccagctgtgagcccctggcctctgtgctgcgggccaagccagacttcaaggagctgactgtgagcaacaatgacatcaatgaagctggggtgcgggtgtag

SEQ ID NO: 8277 - DNA, 585 bp, Artificial Sequence
  Description of Artificial Sequence: Synthetic coding sequence
atgagcctggacatccagagcctggacatccagtgtgaggagctgagtgatgcccgctgggccgagctgctgcccctgctgcagcagtgccaggtggtgcggctggatgactgtggcctgacagaggcccgctgcaaggacatcagcagcgccctgcgggtgaacccagccctggccgagctgaacctgcggagcaatgagctgggagatgtgggcgtgcactgtgtgctgcagggcctgcagacccccagctgcaagatccagaagctgagcctgcagaactgctgcctgaccggggccggctgcggcgtgctgagcagcaccctgcggaccctgcccaccctgcaggagctgcacctgagtgacaacctgctgggagatgctggcctgcagctgctgtgtgagggcctgctggacccccagtgccgcctggagaagctgcagctggagtactgcagcctgtctgctgccagctgtgagcccctggcctctgtgctgcgggccaagccagacttcaaggagctgactgtgagcaacaatgacatcaatgaagctggggtgcgggtgctgtgccagggcctgtag

SEQ ID NO: 8278 - DNA, 1086 bp, Artificial Sequence; identical to SEQ ID NO: 7981
  Description of Artificial Sequence: Synthetic coding sequence

SEQ ID NO: 8279 - DNA, 327 bp, Artificial Sequence
  Description of Artificial Sequence: Synthetic coding sequence
tgacccaagagcaagtggaggagcaagatcctgctgggcctgaacttctacggcatggactatgccaccagcaaggatgcccgggagcctgtggtgggcgcccgctacatccagaccctgaaggaccaccggcccaggatggtgtgggacagccaggccagcgagcacttctttgagtacaagaagagccgcagcggccgccacgtggtgttctaccccaccctgaagagcctgcaggtgcggctggagctggcccgggagctgggcgtgggcgtgtccatctgggagctgggccagggcctggactacttctatgacctgctgtag

SEQ ID NO: 8280 - DNA, 504 bp, Artificial Sequence
  Description of Artificial Sequence: Synthetic coding sequence
atgaggagcctgctgctgctgagcgccttctgcctgctggaggccgccctggccgctgaggtgaagaagccagctgctgctgctgcccctggaacagctgagaagctgagccccaaggccgccaccctggccgagaggtctgctggcctggccttcagcctgtaccaggccatggccaaggaccaggccgtggagaacatcctggtgtcccctgtggtggtggccagcagcctgggcctggtgtccctgggcggcaaggccaccacagccagccaggccaaggctgtgctgtctgctgagcagctgagagatgaggaggtgcatgctggcctgggggagctgctgcggagcctgagcaacagcacagccagaaatgtgacctggaagctgggcagccggctgtatggccccagctctgtgtcctttgctgatgactttgtgcgcagcagcaagcagcactacaactgtgagcacagcaagatcaacttccgggacaagaggtag

SEQ ID NO: 8281 - DNA, 1209 bp, Artificial Sequence; identical to SEQ ID NO: 7162
  Description of Artificial Sequence: Synthetic coding sequence

SEQ ID NO: 8282 - DNA, 975 bp, Artificial Sequence
  Description of Artificial Sequence: Synthetic coding sequence
atgaggagcctgctgctgctgagcgccttctgcctgctggaggccgccctggccgctgaggtgaagaagccagctgctgctgctgcccctggaacagctgagaagctgagccccaaggccgccaccctggccgagaggtctgctggcctggccttcagcctgtaccaggccatggccaaggaccaggccgtggagaacatcctggtgtcccctgtggtggtggccagcagcctgggcctggtgtccctgggcggcaaggccaccacagccagccaggccaaggctgtgctgtctgctgagcagctgagagatgaggaggtgcatgctggcctgggggagctgctgcggagcctgagcaacagcacagccagaaatgtgacctggaagctgggcagccggctgtatggccccagctctgtgtcctttgctgatgactttgtgcgcagcagcaagcagcactacaactgtgagcacagcaagatcaacttccgggacaagaggtctgccctgcagagcatcaatgagtgggccgcccagaccacagatggcaagctgcctgaggtgaccaaggatgtggagaggacagatggagccctgctggtgaatgccatgttcttcaagccccactgggatgagaagttccaccacaagatggtggacaacagaggcttcatggtgaccaggagctacacagtgggcgtgatgatgatgcacaggacaggcctgtacaactactatgatgatgagaaggagaagctgcagatcgtggagatgcccctggcccacaagctgagcagcctcatcatcctgatgccccaccacgtggagcccctggagcggctggagaagctgctgaccaaggagcagctgaagatctggatgggcaagatgcagaagaaggctgtggccatcagcctgcccaagggcgtggtggaggtgacccatgacctgcaggtgcggggcggccctgcctag

SEQ ID NO: 8283 - DNA, 990 bp, Artificial Sequence
  Description of Artificial Sequence: Synthetic coding sequence
atggtgtccaagagccgctggaagctgctggccatgctggccctggtgctggtggtgatggtgtggtacagcatcagccgggaggacagcttctacttccccatccctgagaagaaggagccctgcctgcagggcgaggccgagagcaaggccagcaagctgtttggaaactacagccgggaccagcccatcttcctgcggctggaggactacttctgggtgaagacccccagcgcctatgagctgccctacggcaccaagggcagcgaggacctgctgctgcgggtgctggccatcaccagcagcagcatccccaagaacatccagagcctgcgctgccgccgctgtgtggtggtgggcaatggccaccggctgaggaacagcagcctgggagatgccatcaacaagtatgatgtggtgatccggctgaacaatgcccctgtggccggctatgaaggagatgtgggcagcaagaccaccatgaggctcttctacccagagagcgcccactttgaccccaaggtggagaacaacccagacaccctgctggtgctggtggccttcaaggccatggacttccactggattgagaccatcctgagtgacaagaagagggtgaggaagggcttctggaagcagcccccactcatctgggatgtgaaccccaagcagatccgcatcctgaaccccttcttcatggagattgctgctgacaagctgctgagcctgcccatgcagcagcccaggaagatcaagcagaagcccaccaccggcctgctggccatcaccctggccctgcacctgtgtgacctggtgcacatcgccggcttcggctacccagatgcctacaacaagaagcagaccatccactactatgagcagatcaccctgaagtccatggccggcagcggccacaacgtgtcccaggaggccctggccatcaagaggatgctggagatgggcgccatcaagaacctgaccagcttctag

SEQ ID NO: 8284 - DNA, 351 bp, Artificial Sequence
  Description of Artificial Sequence: Synthetic coding sequence
atgaggaccctcttcaacctgctgtggctggccctggcctgcagccctgtgcacaccaccctgagcaagagtgatgccaagaaggccgccagcaagaccctgctggagaagagccagttcagtgacaagcctgtgcaggaccggggcctggtggtgacagacctgaaggccgagagcgtggtgctggagcacaggagctactgcagcgccaaggcccgggacagacactttgctggagatgtgctgggctacgtgaccccctggaacagccacggctatgatgtgaccaaggtgtttggcagcaagttcacccagatcagccctgtgtggctgcagctgaagagaagatag

SEQ ID NO: 8285 - DNA, 282 bp, Artificial Sequence; identical to SEQ ID NO: 7538
  Description of Artificial Sequence: Synthetic coding sequence

SEQ ID NO: 8286 - DNA, 255 bp, Artificial Sequence
  Description of Artificial Sequence: Synthetic coding sequence
atgaggcccaagacaggccaggtgggctgtgagaccccagaggagctgggccctggcccccggcagcgctggcccctgctgctgctgggcctggccatggtggcccacggcctgctgcggcccatggtggccccccagagcggggaccctgaccccggggcctctgtgggcagcagccgcagcagcctgcggagcctgtggggccgcagcgcccagggccagccccactgccacagcgtgcctgccctgctgtag

SEQ ID NO: 8287 - DNA, 27 bp, Artificial Sequence
  Description of Artificial Sequence: Synthetic coding sequence
atgagcctggacatccagagcctgtag

SEQ ID NO: 8288 - DNA, 576 bp, Artificial Sequence
  Description of Artificial Sequence: Synthetic coding sequence
atgctgatcttctggaccatcaccctcttcctgctgggcgccgccaagggcaaggaggtgtgctatgaggacctgggctgcttcagtgacacagagccctggggcggcacagccatccggcccctgaagatcctgccctggagccctgagaagattggcacccgcttcctgctgtacaccaatgaaaaccccaacaacttccagatcctgctgctgagtgaccccagcaccatcgaggccagcaacttccagatggacaggaagacccgcttcatcatccacggcttcatcgacaagggagatgagagctgggtgacagacatgtgcaagaagctgtttgaggtggaggaggtgaactgcatctgtgtggactggaagaagggcagccaggccacctacacccaggccgccaacaacgtgcgggtggtgggcgcccaggtggcccagatgctggacatcctgctgacagagtacagctacccacccagcaaggtgcacctgattggccacagcctgggcgcccacgtggccggggaggccggcagcaagaccccaggcctgagccgcatcacctag

SEQ ID NO: 8289 - DNA, 123 bp, Artificial Sequence
  Description of Artificial Sequence: Synthetic coding sequence
atgagcctggacatccagagcctggacatccagtgtgaggagctgagtgatgcccgctgggccgagctgctgcccctgctgcagcagtgccaggtggtgcggctggatgactgtggcctgtag

SEQ ID NO: 8290 - DNA, 648 bp, Artificial Sequence
  Description of Artificial Sequence: Synthetic coding sequence
atgaggcccaagacaggccaggtgggctgtgagaccccagaggagctgggccctggcccccggcagcgctggcccctgctgctgctgggcctggccatggtggcccacggcctgctgcggcccatggtggccccccagagcggggaccctgaccccggggcctctgtgggcagcagccgcagcagcctgcggagcctgtggggcagccggctgctgctgcagcccagcccccagagagctgacccccgctgctggccccggggcttctggagcgagccccagagcctgtgctacgtgtttggcaccggcaccaaggtgacagtgctgggccagcccaaggccaaccccaccgtgaccctcttcccccccagcagcgaggagctgcaggccaacaaggccaccctggtgtgcctgatcagtgacttctacccaggagctgtgacagtggcctggaaggcagatggcagccctgtgaaggccggcgtggagaccaccaagcccagcaagcagagcaacaacaagtatgctgccagcagctacctgagcctgaccccagagcagtggaagagccacaggagctacagctgccaggtgacccatgagggcagcacagtggagaagacagtggcccccacagaatgttcctag

SEQ ID NO: 8291 - DNA, 999 bp, Artificial Sequence
  Description of Artificial Sequence: Synthetic coding sequence
atgtgcccagctggctggaagctgctggccatgctggccctggtgctggtggtgatggtgtggtacagcatcagcagagaagatcgctacatcgagctgttctacttccccatccctgagaagaaggagccctgcctgcagggcgaggccgagagcaaggccagcaagctgtttggaaactacagccgggaccagcccatcttcctgcggctggaggactacttctgggtgaagaccccatctgcctatgagctgccctacggcaccaagggcagcgaggacctgctgctgcgggtgctggccatcaccagcagcagcatccccaagaacatccagagcctgcgctgcagaagatgtgtggtggtgggcaatggccaccggctgaggaacagcagcctgggagatgccatcaacaagtatgatgtggtgatccggctgaacaatgcccctgtggccggctatgaaggagatgtgggcagcaagaccaccatgaggctcttctacccagagagcgcccactttgaccccaaggtggagaacaacccagacaccctgctggtgctggtggccttcaaggccatggacttccactggattgagaccatcctgagtgacaagaagagggtgaggaagggcttctggaagcagcccccactcatctgggatgtgaaccccaagcagatccgcatcctgaaccccttcttcatggagattgctgctgacaagctgctgagcctgcccatgcagcagcccaggaagatcaagcagaagcccaccaccggcctgctggccatcaccctggccctgcacctgtgtgacctggtgcacatcgccggcttcggctacccagatgcctacaacaagaagcagaccatccactactatgagcagatcaccctgaagtccatggccggcagcggccacaacgtgtcccaggaggccctggccatcaagaggatgctggagatgggcgccatcaagaacctgaccagcttctag

SEQ ID NO: 8292 - DNA, 888 bp, Artificial Sequence
  Description of Artificial Sequence: Synthetic coding sequence
atgaggagcctgctgctgctgagcgccttctgcctgctggaggccgccctggccgctgaggtgaagaagccagctgctgctgctgcccctggaacagctgagaagctgagccccaaggccgccaccctggccgagaggtctgctggcctggccttcagcctgtaccaggccatggccaaggaccaggccgtggagaacatcctggtgtcccctgtggtggtggccagcagcctgggcctggtgtccctgggcggcaaggccaccacagccagccaggccaaggctgtgctgtctgctgagcagctgagagatgaggaggtgcatgctggcctgggggagctgctgcggagcctgagcaacagcacagccagaaatgtgacctggaagctgggcagccggctgtatggccccagctctgtgtcctttgctgatgactttgtgcgcagcagcaagcagcactacaactgtgagcacagcaagatcaacttccgggacaagaggtctgccctgcagagcatcaatgagtgggccgcccagaccacagatggcaagctgcctgaggtgaccaaggatgtggagaggacagatggagccctgctggtgaatgccatgttcttcaagccccactgggatgagaagttccaccacaagatggtggacaacagaggcttcatggtgaccaggagctacacagtgggcgtgatgatgatgcacaggacaggcctgtacaactactatgatgatgagaaggagaagctgcagatcgtggagatgcccctggcccacaagctgagcagcctcatcatcctgatgccccaccacgtggagcccctggagcggctggagaagctgctgaccaaggagcagctgaagatctggatgggctag

SEQ ID NO: 8293 - DNA, 399 bp, Artificial Sequence
  Description of Artificial Sequence: Synthetic coding sequence
atgaggaccctcttcaacctgctgtggctggccctggcctgcagccctgtgcacaccaccctgagcaagagtgatgccaagaaggccgccagcaagaccctgctggagaagagccagttcagtgacaagcctgtgcaggaccggggcctggtggtgacagacctgaaggccgagagcgtggtgctggagcacaggagctactgcagcgccaaggcccgggacagacactttgctggagatgtgctgggctacgtgaccccctggaacagccacggctatgatgtgaccaaggtgtttggcagcaagttcacccagatcagccctgtgtggctgcagctgaagagaagaggccgggagatgtttgaggtgacaggcctgcatgatgtggaccagggctag

SEQ ID NO: 8294 - DNA, 360 bp, Artificial Sequence
  Description of Artificial Sequence: Synthetic coding sequence
atgaggaccctcttcaacctgctgtggctggccctggcctgcagccctgtgcacaccaccctgagcaagagtgatgccaagaaggccgccagcaagaccctgctggagaagagccagttcagtgacaagcctgtgcaggaccggggcctggtggtgacagacctgaaggccgagagcgtggtgctggagcacaggagctactgcagcgccaaggcccgggacagacactttgctggagatgtgctgggctacgtgaccccctggaacagccacggctatgatgtgaccaaggtgtttggcagcaagttcacccagatcagccctgtgtggctgcagctgaagagaagaggccgggagtag

SEQ ID NO: 8295 - DNA, 390 bp, Artificial Sequence; identical to SEQ ID NO: 6974
  Description of Artificial Sequence: Synthetic coding sequence

SEQ ID NO: 8296 - DNA, 1386 bp, Artificial Sequence; identical to SEQ ID NO: 7292
  Description of Artificial Sequence: Synthetic coding sequence

SEQ ID NO: 8297 - DNA, 453 bp, Artificial Sequence
  Description of Artificial Sequence: Synthetic coding sequence
atgaggagcctgctgctgctgagcgccttctgcctgctggaggccgccctggccgctgaggtgaagaagccagctgctgctgctgcccctggaacagctgagaagctgagccccaaggccgccaccctggccgagaggtctgctggcctggccttcagcctgtaccaggccatggccaaggaccaggccgtggagaacatcctggtgtcccctgtggtggtggccagcagcctgggcctggtgtccctgggcggcaaggccaccacagccagccaggccaaggctgtgctgtctgctgagcagctgagagatgaggaggtgcatgctggcctgggggagctgctgcggagcctgagcaacagcacagccagaaatgtgacctggaagctgggcagccggctgtatggccccagctctgtgtcctttgctgatgactttgtgcgcagcagctag

SEQ ID NO: 8298 - DNA, 1257 bp, Artificial Sequence; identical to SEQ ID NO: 7322
  Description of Artificial Sequence: Synthetic coding sequence

SEQ ID NO: 8299 - DNA, 1002 bp, Artificial Sequence; identical to SEQ ID NO: 7654
  Description of Artificial Sequence: Synthetic coding sequence

SEQ ID NO: 8300 - DNA, 987 bp, Artificial Sequence
  Description of Artificial Sequence: Synthetic coding sequence
atgtgcccagctggctggaagctgctggccatgctggccctggtgctggtggtgatggtgtggtacagcatcagcagagaagattccttctacttccccatccctgagaagaaggagccctgcctgcagggcgaggccgagagcaaggccagcaagctgtttggaaactacagccgggaccagcccatcttcctgcggctggaggactacttctgggtgaagaccccatctgcctatgagctgccctacggcaccaagggcagcgaggacctgctgctgcgggtgctggccatcaccagcagcagcatccccaagaacatccagagcctgcgctgcagaagatgtgtggtggtgggcaatggccaccggctgaggaacagcagcctgggagatgccatcaacaagtatgatgtggtgatccggctgaacaatgcccctgtggccggctatgaaggagatgtgggcagcaagaccaccatgaggctcttctacccagagagcgcccactttgaccccaaggtggagaacaacccagacaccctgctggtgctggtggccttcaaggccatggacttccactggattgagaccatcctgagtgacaagaagagggtgaggaagggcttctggaagcagcccccactcatctgggatgtgaaccccaagcagatccgcatcctgaaccccttcttcatggagattgctgctgacaagctgctgagcctgcccatgcagcagcccaggaagatcaagcagaagcccaccaccggcctgctggccatcaccctggccctgcacctgtgtgacctggtgcacatcgccggcttcggctacccagatgcctacaacaagaagcagaccatccactactatgagcagatcaccctgaagtccatggccggcagcggccacaacgtgtcccaggaggccctggccatcaagaggatgctggagatgggcgccatcaagaacctgaccagcttctag

SEQ ID NO: 8301 - DNA, 585 bp, Artificial Sequence; identical to SEQ ID NO: 6927
  Description of Artificial Sequence: Synthetic coding sequence

SEQ ID NO: 8302 - DNA, 1386 bp, Artificial Sequence; identical to SEQ ID NO: 7292
  Description of Artificial Sequence: Synthetic coding sequence

SEQ ID NO: 8303 - DNA, 1995 bp, Artificial Sequence
  Description of Artificial Sequence: Synthetic coding sequence
atgccccaggcccccagcacaggcagcagcctcatccgggaccccagcatcgcccacaggaacacccagatcctgtggacagaagctggccgggacctggcccaggacacccgctacaccggggaggagagcctgaccatctttgtggacaagaggaagctgagcaagagagctgagggcagtgacagcaccaccaacagcagctctgtgaccctggagaccctgcaccagctggccgccagctacttcatcgaccgggacagcaccctgcggcggctgcaccacatccagatcgccagcacagccatcaaggtgacagagaccaggacaggccccctgggctgcagcaactatgacaacctggacagcgtgtcctctgtgctggtgcagagccctgagaacaagatccagctgcagggcctgcaggtgctgctgcctgactacctgcaggagagatttgtgcaggccgccctgagctacatcgcctgcaacagcgagggggagttcatctgcaaggaaaatgactgctggtgccactgcggccccaagtttcctgagtgcaactgccccagcatggacatccaggccatggaggagaacctgctgcgcatcacagagacctggaaggcctacaacagcgactttgaggagagtgatgagttcaagctgttcatgaagaggctgcccatgaactacttcctgaacaccagcaccatcatgcacctgtggaccatggacagcaacttccagaggagatatgagcagctggagaacagcatgaagcagctgttcctgaaggcccagaagatcgtgcacaagctgttcagcctgagcaagcgctgccacaagcagcccctcatcagcctgccccggcagaggaccagcacctactggctgacccgcatccagagcttcctgtactgcaatgaaaatggcctgctgggcagcttcagcgaggagacccacagctgcacctgccccaatgaccaggtggtgtgcacagccttcctgccctgcaccgtgggagatgccagcgcctgcctgacctgtgccccagacaacagaacccgctgtggcacctgcaacacaggctacatgctgagccagggcctgtgcaagccagaggtggccgagagcacagaccactacatcggctttgaaacagacctgcaggacctggagatgaagtacctgctgcagaagacagaccggcgcatcgaggtgcacgccatcttcatcagcaatgacatgaggctgaacagctggtttgaccccagctggaggaagaggatgctgctgaccctgaagagcaacaagtacaagagcagcctggtgcacatgatcctgggcctgagcctgcagatctgcctgaccaagaacagcaccctggagcctgtgctggccgtgtatgtgaacccctttggaggcagccacagcgagagctggttcatgcctgtgaatgaaaacagcttcccagactgggagaggaccaagctggacctgcccctgcagtgctacaactggaccctgaccctgggcaacaagtggaagaccttctttgagaccgtgcacatctacctgcggagccgcatcaagagcaatggccccaatggaaatgaaagcatctactatgagcccctggagttcatcgaccccagcaggaacctgggctacatgaagatcaacaacatccaggtgtttggctacagcatgcactttgatcctgaggccatccgggacctgatcctgcagctggactacccctacacccagggcagccaggacagcgccctgctgcagctgctggagatccgggacagagtgaacaagctgagccccccaggccagaggcggctggacctcttcagctgcctgctgcggcaccggctgaagctgagcaccagcgaggtggtgcgcatccagagcgccctgcaggccttcaatgccaagctgcccaacaccatggactatgacaccaccaagctgtgcagctag

SEQ ID NO: 8304 - DNA, 459 bp, Artificial Sequence
  Description of Artificial Sequence: Synthetic coding sequence
atggcccgggactatgaccacctgttcaagctgctgatcatcggggacagcggcgtgggcaagagcagcctgctgctgcgctttgctgacaacaccttcagcggcagctacatcaccaccatcggcgtggacttcaagatcagaacagtggagatcaatggagagaaggtgaagctgcagatctgggacacagctggccaggagcgcttccgcaccatcaccagcacctactaccggggcacccacggcgtgattgtggtgtatgatgtgaccagcgctgagagctttgtgaatgtgaagcgctggctgcacgagatcaaccagaactgtgatgatgtgtgccgcatcctggatgtgcagctgcaccacggggccggcccccccagcaaggagcggcagcccgggaagacagctgctgccaccacagagcgctgtggggaggcccacgaggagcagtag

SEQ ID NO: 8305 - DNA, 696 bp, Artificial Sequence
  Description of Artificial Sequence: Synthetic coding sequence
atgctgtacatcggcattgctgagtacttcttcaagagcgccagctttgcccacttcaccgctggggtcttcaacgtgaccctgagcacagaggagatcagcaaccactttgtgcagaacagccagggcctgggcaatgtgctgagcagaattgctgagatctacatcctgagccagcccttcatggtgcgcatcatggccacagagccccccatcatcaacctgcagcccggcaacttcaccctggacatcccagccagcatcatgatgctgacccagcccaagaacagcacagtggagaccatcgtgtccatggactttgtggccagcacctctgtgggcctggtgatcctgggccagaggctggtgtgcagcctgagcctgaaccgcttccggctggccctgcctgagagcaacagaagcaacatcgaggtgctgcgctttgagaacatcctgagcagcatcctgcactttggagtgctgcccctggccaatgccaagctgcagcagggcttccccctgagcaacccccacaagttcctgtttgtgaacagcgacatcgaggtgctggagggcttcctgctgatcagcacagacctgaagtatgagaccagcagcaagcagcagcccagcttccacgtgtgggagggcctgaacctgatcagccggcagtggaggggcaagagcgccccctag

SEQ ID NO: 8306 - DNA, 1911 bp, Artificial Sequence; identical to SEQ ID NO: 7237
  Description of Artificial Sequence: Synthetic coding sequence

SEQ ID NO: 8307 - DNA, 1374 bp, Artificial Sequence
  Description of Artificial Sequence: Synthetic coding sequence
atgggctgcagcctgcccctgagctgcatcatggtgcgctctgtggcctgggccggcttcatggtgctgctgatgatcccctggggcagcgctgccaagctggtgtgctacttcaccaactgggcccagtaccggcagggcgaggcccgcttcctgcccaaggacctggaccccagcctgtgcacccacctgatctatgcctttgctggcatgaccaaccaccagctgagcaccacagagtggaatgatgagaccctgtaccaggagttcaacggcctgaagaagatgttcacagacatggtggccacagccaacaaccggcagacctttgtgaacagcgccatccgcttcctgaggaagtacagctttgatggcctggacctggactgggagtacccaggcagccagggcagccctgctgtggacaaggagcgcttcaccaccctggtgcaggacctggccaatgccttccagcaggaggcccagaccagcggcaaggagcggctgctgctgtctgctgctgtgcctgctggccagacctacgtggatgctggctatgaggtggacaagatcgcccagaacctggactttgtgaacctgatggcctatgacttccacggctcctgggagaaggtgacaggccacaacagccccctgtacaagaggcaggaggagagcggggctgctgccagcctgaatgtggatgctgctgtgcagcagtggctgcagaagggcaccccagccagcaagctgatcctgggcatgcccacctacggccgctccttcaccctggccagcagcagtgacaccagggtgggcgccccagccactggaagtggcaccccaggccccttcaccaaggagggcggcatgctggcctactatgaggtgtgctcctggaagggggccaccaagcagaggatccaggaccagaaggtgccctacatcttccgggacaaccagtgggtgggctttgatgatgtggagagcttcaagaccaaggtgtcctacctgaagcagaagggcctgggcggggccatggtgtgggccctggacctggatgactttgctggcttcagctgcaaccagggccgctaccccctcatccagaccctgcggcaggagctgagcctgccctacctgcccagcggcaccccagagctggaggtgcccaagccaggccagcccagcgagcctgagcacggccccagccctggccaggacaccttctgccagggcaaggcagatggcctgtaccccaacccccgggagaggagcagcttctacagctgtgccgccggccgcctcttccagcagagctgccccaccggcctggtgttcagcaacagctgcaagtgctgcacctggaactag

SEQ ID NO: 8308 - DNA, 1125 bp, Artificial Sequence
  Description of Artificial Sequence: Synthetic coding sequence
atgtatgtgtccacccgggagcgctacaagtggctgcgcttcagcgaggactgcctgtacctgaatgtgtatgccccagcccgggcccctggggacccccagctgcctgtgatggtgtggttccctgggggcgccttcatcgtgggcgccgccagcagctatgagggcagtgacctggccgcccgggagaaggtggtgctggtgttcctgcagcaccggctgggcatcttcggcttcctgcgctggaggggccgcacagatgacagccacgcccggggcaactggggcctgctggaccagatggccgccctgcgctgggtgcaggagaacattgctgccttcggcggggaccctggaaatgtgaccctgtttggccagagcgctggggccatgagcatcagcggcctgatgatgagccccctggccagcggcctcttccaccgggccatcagccagagcggcacagccctcttccgcctcttcatcaccagcaaccccctgaaggtggccaagaaggtggcccacctggccggctgcaaccacaacagcacccagatcctggtgaactgcctgcgggccctgagcggcaccaaggtgatgagggtgagcaacaagatgaggttcctgcagctgaacttccagagggaccctgaggagatcatctggagcatgagccctgtggtggatggagtggtgatcccagatgaccccctggtgctgctgacccagggcaaggtgtcctctgtgccctacctgctgggcgtgaacaacctggagttcaactggctgctgccctacatcatgaagttccccctgaaccggcaggccatgaggaaggagaccatcaccaagatgctgtggagcaccaggaccctgctgaacatcaccaaggagcaggtgcccctggtggtggaggagtacctggacaacgtgaatgaacatgactggaagatgctgaggaacaggatgatggacatcgtgcaggatgccacctttgtgtatgccaccctgcagacagcccactaccaccgggagacccccatgatgggcatctgcccagctggccacgccaccaccaggatgaagagcacctgctcctggatcctgccccaggagtgggcctag

SEQ ID NO: 8309 - DNA, 384 bp, Artificial Sequence
  Description of Artificial Sequence: Synthetic coding sequence
atgaagacaggcctcttcttcctgtgcctgctgggcacagctgctgccatccccaccaatgcccggctgctgagtgaccacagcaagcccacagctgagaccgtggccccagacaacacagccatccccagcctgcgggcagaggccgaggagaatgagaaggagacagctgtgtccacagaagatgacagccaccacaaggccgagaagagctctgtgctgaagagcaaggaggagagccatgagcagagcgctgagcagggcaagagcagcagccaggagctgggcctgaaggaccaggaggacagtgatggccacctgtctgtgaacctggagtatgcccccacagagggcaccctggacatcaaggaggacatgtcctag

SEQ ID NO: 8310 - DNA, 285 bp, Artificial Sequence; identical to SEQ ID NO: 7606
  Description of Artificial Sequence: Synthetic coding sequence

SEQ ID NO: 8311 - DNA, 414 bp, Artificial Sequence
  Description of Artificial Sequence: Synthetic coding sequence
atggccgccctgagccgggccctgggccccctgcggaccccagccccacccctgtggattggcctcttcctggtggccaccggcagccagcagagcctggcccagcccctgcccggcaacaccacagaggccacccccaggagcctgcgggccagcggcagcctgtgtggcccccacgccaaggccccctacctgtgtgaggccacccatgagcctgctgctgcccgcatccgggcccaggtgcctgacacccgctggagccgggtgggcggccagcgcttctacagccgggtgctgagccccctgcaccggggccccagcggccacacagaggccagcgcccagaggagccacatgggcaagctgaaggagccccagccccaggaccacaagccaggcctgggcgccagctag

SEQ ID NO: 8312 - DNA, 228 bp, Artificial Sequence
  Description of Artificial Sequence: Synthetic coding sequence
atgctgaaggtgcactaccccaagtttggagtgtctgaggactgcctgtacctgaacatctatgccccagcccacgccgacaccggcagcaagctgcctgtgctggtgtggttccctggaggagccttcaagacaggcagcgccagcatctttgatggcagcgccctggccgcctatgaagatgtgctggtggtggtggtgcagtaccgcctgggcatcttcggctag

SEQ ID NO: 8313 - DNA, 1491 bp, Artificial Sequence
  Description of Artificial Sequence: Synthetic coding sequence
atggccccagcccggaccatggcccgggcccggctggccccagctgactgcctgaacagcttcaccgctggggtgcccggctttgtgctggacaccaatgcctctgtgtccaatggagccaccttcctggagagccccaccgtgagaagaggctgggactgtgtgcgggcctgctgcaccacccagaactgcaacctggccctggtggagctgcagcctgacagaggagaagatgccatcgccgcctgcttcctgatcaactgcctgtatgagcagaactttgtgtgcaagtttgccccccgggagggcttcatcaactacctgacccgggaggtgtaccgcagctaccggcagctgcggacccagggctttggaggcagcggcatccccaaggcctgggccggcatcgacctgaaggtgcagccccaggagcccctggtgctgaaggatgtggagaacacagactggaggctgctgcggggggacacagatgtgcgggtggagaggaaggaccccaaccaggtggagctgtggggcctgaaggagggcacctacctgttccagctgactgtgaccagcagtgaccaccctgaggacacagccaacgtgacagtgacagtgctgagcaccaagcagacagaggactactgcctggccagcaacaaggtgggccgctgccggggcagcttcccccgctggtactatgaccccacagagcagatctgcaagagctttgtgtatggaggctgcctgggcaacaagaacaactacctgcgggaggaggagtgcatcctggcctgccggggcgtgcagggcggccccctgcggggcagcagcggggcccaggccaccttcccccagggccccagcatggagaggaggcaccctgtgtgcagcggcacctgccagcccacccagttccgctgcagcaatggctgctgcatcgacagcttcctggagtgtgatgacacccccaactgcccagatgccagtgatgaggccgcctgtgagaagtacaccagcggctttgatgagctgcagaggatccacttccccagcgacaagggccactgtgtggacctgcctgacaccggcctgtgcaaggagagcatcccccgctggtactacaaccccttcagcgagcactgtgcccgcttcacctacggcggctgctacggcaacaagaacaactttgaggaggagcagcagtgcctggagagctgccggggcatcagcaagaaggatgtgtttggcctgcggcgggagatccccatccccagcacaggctctgtggagatggctgtggccgtgttcctggtgatctgcatcgtggtggtggtggccatcctgggctactgcttcttcaagaaccagaggaaggacttccacggccaccaccaccaccccccacccaccccagccagcagcacagtgtccaccacagaggacacagagcacctggtgtacaaccacaccacccggcccctgtag

SEQ ID NO: 8314 - DNA, 528 bp, Artificial Sequence
  Description of Artificial Sequence: Synthetic coding sequence
atgcctcctggcacccgggcctgccgggtgcccaggcctggaagaagagccccccggcccaggagagatggagagcccggcggccatggagtggccccagccagcgctgaggaggtgggcgcccggcccggcctgcgggctgtggcccggctgctgccccagcagcacctgcaggccggctacgtgtgtgagaggaaggacctgctggtgaatggctgctgcaatgtgaatgtgcccagcaccaagcagtactgctgtgatggctgctggcccaacggctgctgcagcgcctatgagtactgtgtgtcctgctgcctgcagcccaacaagcagctgctgctggagcgcttcctgaacagagctgctgtggccttccagaacctcttcatggctgtggaggaccactttgagctgtgcctggccaagtgcaggaccagcagccagagcgtgcagcacgagaacacctacagagaccccatcgccaagtactgctatggagagagccccccagagctgtttcctgcctag

SEQ ID NO: 8315 - DNA, 1881 bp, Artificial Sequence
  Description of Artificial Sequence: Synthetic coding sequence
atggacctggtgctgaagcgctgcctgctgcacctggccgtgattggagccctgctggccgtgggcgccaccaaggtgcccaggaaccaggactggctgggcgtgtcccggcagctgcggaccaaggcctggaaccggcagctgtacccagagtggacagaggcccagaggctggactgctggaggggcggccaggtgtccctgaaggtgtccaatgatggccccaccctcatcggggccaatgccagcttcagcatcgccctgaacttccctggcagccagaaggtgctgcctgatggccaggtgatctgggtgaacaacaccatcatcaatggagaccaggtgtggggcggccagcctgtgtacccccaggagacagatgatgcctgcatcttcccagatggcggcccctgccccagcggctcctggagccagaagaggagctttgtgtatgtgtggaagacctggggccagtactggcaggtgctgggcggccctgtgtctggcctgagcatcggcaccggccgggccatgctgggcacccacaccatggaggtgacagtgtaccacagaagaggcagccgctcctatgtgcccctggcccacagcagcagcgccttcaccatcacagaccaggtgcccttctctgtgtctgtgtcccagctgcgggccctggatggcggcaacaagcacttcctgaggaaccagcccctgacctttgccctgcagctgcatgaccccagcggctacctggccgaggccgacctgagctacacctgggactttggagacagcagcggcaccctcatcagccgggccctggtggtgacccacacctacctggagcccggccctgtgacagcccaggtggtgctgcaggccgccatccccctgaccagctgtggcagcagccctgtgcccggcaccacagatggccaccggcccacagctgaggcccccaacaccacagctggccaggtgcccaccacagaggtggtgggcaccaccccaggccaggcccccacagctgagcccagcggcaccacctctgtgcaggtgcccaccacagaggtgatcagcacagcccctgtgcagatgcccacagctgagagcacagctgcccaggtgaccaccacagagtgggtggagaccacagcccgggagctgcccatccctgagcctgagggcccagatgccagcagcatcatgagcacagagagcatcaccggcagcctgggccccctgctggatggaacagccaccctgcggctggtgaagaggcaggtgcccctggactgtgtgctgtaccgctatggcagcttctctgtgaccctggacatcgtgcagggcattgaatctgctgagatcctgcaggccgtgcccagcggggagggagatgcctttgagctgactgtgtcctgccagggcggcctgcccaaggaggcctgcatggagatcagcagccctggctgccagcccccagcccagaggctgtgccagcctgtgctgcccagccctgcctgccagctggtgctgcaccagatcctgaagggcggcagcggcacctactgcctgaatgtgtccctggccgacaccaacagcctggccgtggtgtccacccagctgatcatgcctgtgcccggcatcctgctgaccggccaggaggccggcctgggccaggtgcccctcatcgtgggcatcctgctggtgctgatggctgtggtgctggccagcctcatctacagaagaaggctgatgaagcaggacttctctgtgccccagctgccccacagcagcagccactggctgcggctgccccgcatcttctgcagctgccccatcggggagaacagccccctgctgagcggccagcaggtgtag

SEQ ID NO: 8316 - DNA, 1611 bp, Artificial Sequence
  Description of Artificial Sequence: Synthetic coding sequence
atgcccaccctgtgcagcagctttggcctgcaggtgctgctgcctgagtacctgcgggagagatttgtggccgccgccctgagctacatcacctgcagcagcgagggggagctggtgtgcaaggaaaatgactgctggtgcaagtgcagccccaccttccctgagtgcaactgcccagatgctgacatccaggccatggaggacagcctgctgcagatccaggacagctgggccacccacaaccggcagtttgaggagagcgaggagttccaggccctgctgaagaggctgcctgatgaccgcttcctgaacagcacagccatcagccagttctgggccatggacaccagcctgcagcaccgctaccagcagctgggcgccggcctgaaggtgctcttcaagaagacccaccgcatcctgcggcggctcttcaacctgtgcaagcgctgccaccggcagccccgcttccggctgcccaaggagagcagccccaggagcctgagctactggtggaaccgcatccagagcctgctgtactgtggggagagcaccttccctggcaccttcctggagcagagccacagctgcacctgcccctatgaccagagcagctgccagggccccatcccctgtgccctgggggagggccctgcctgtgcccactgtgccccagacaacagcacccgctgtggcagctgcaaccctggctacgtgctggcccagggcctgtgcaggcctgaggtggccgagagcctggagaacttcctgggcctggagacagacctgcaggacctggagctgaagtacctgctgcagaagcaggacagccgcatcgaggtgcacagcatcttcatcagcaatgacatgaggctgggctcctggtttgaccccagctggaggaagaggatgctgctgaccctgaagagcaacaagtacaagccaggcctggtgcacgtgatgctggccctgagcctgcagatctgcctgaccaagaacagcaccctggagcctgtgatggccatctacgtgaacccctttggaggcagccacagcgagagctggttcatgcctgtgaatgaaggcagcttcccagactgggagaggaccaacgtggatgctgctgcccagtgccagaactggaccatcaccctgggcaaccgctggaagaccttctttgagaccgtgcacgtgtacctgcggagccgcatcaagagcctggatgacagcagcaatgagaccatctactatgagcccctggagatgacagaccccagcaagaacctgggctacatgaagatcaacaccctgcaggtgtttggctacagcctgccctttgatcctgatgccatccgggacctgatcctgcagctggactacccctacacccagggcagccaggacagcgccctgctgcagctgattgagctgcgggacagagtgaaccagctgagccccccaggcaaggtgcggctggacctcttcagctgcctgctgcggcaccggctgaagctggccaacaatgaggtgggccgcatccagagcagcctgcgggccttcaacagcaagctgcccaaccctgtggagtatgaaacaggcaagctgtgcagctag

SEQ ID NO: 8317 - DNA, 423 bp, Artificial Sequence
  Description of Artificial Sequence: Synthetic coding sequence
atgagccagagcattgaggtgctgaacctgcggacccagagggacttccagtatgtgctgaagatggagacccagatgaagggcctgaaggccaagttccggcagattgaagatgacaggaagaccctgatgaccaagcacttccaggagctgaaggagaagatggatgagctgctgcccctcatccctgtgctggagcagtacaagacagatgccaagctgatcacccagttcaaggaggagatccggaacctgtctgctgtgctgaccggcatccaggaggagatcggggcctatgactatgaggagctgcaccagagggtgctgagcctggagacccggctgcgggactgcatgaagaagctgattgacctgaagaagaggaaggaggaggagaagaggcagcagaagggggaggcctag

SEQ ID NO: 8318 - DNA, 1119 bp, Artificial Sequence
  Description of Artificial Sequence: Synthetic coding sequence
atggcctacatcgagcagaggcgcatcagccatgagggcagccctgtgaagcctgtggccatccgggagttccagaagacagaggacatgaggcgctacctgcaccagaacagagtgcctgctgagcccagcagcctgctgagcctgagcgccagccacaaccagctgagccacacagacctggagctgcaccagaggcgggagcagctggtggagaggacccggcgggaggcccagctggccgccctgcagtatgaggaggagaagatccgcaccaagcagatccagagagatgctgtgctggactttgtgaagcagaaggccagccagagcccccagaagcagcaccccctgctggatggagtggatggagaatgtcccttccccagcagaagaagccagcacacagatgattctgccctgtgcatgagcctgagcggcctgaaccaggtgggctgtgccgccaccctgccccacagcagcgccttcacccccctgaagagtgatgaccggcccaatgccctgctgagcagccctgccacagaaacagtgcaccacagccctgcctacagcttccctgctgccatccagaggaaccagccccagaggcctgagagcttcctgttccgggccggcgtgcgggcagagaccaacaagggccacgccagccccctgccccccagcgctgcccccaccacagacagcacagacagcatcaccggccagaacagccggcagcgggaggaggagctggagctgattgaccagctgaggaagcacatcgagtaccgcctgaaggtgtccctgccctgtgacctgggcgccgccctgacagatggagtggtgctgtgccacctggccaaccacgtgcggcccaggtctgtgcccagcatccacgtgcccagccctgctgtgcccaagctgaccatggccaagtgcagaagaaatgtggagaacttcctggaggcctgcaggaagattggagtgccccaggagcagctgtgcctgcccctgcacatcctggaggagaagggcctgagccaggtggccgtgacagtgcaggccctgctggagctggccccacccaagcagcagcagcaccagctgtctgctgtgtag

SEQ ID NO: 8319 - DNA, 1242 bp, Artificial Sequence; identical to SEQ ID NO: 7412
  Description of Artificial Sequence: Synthetic coding sequence

SEQ ID NO: 8320 - DNA, 2541 bp, Artificial Sequence; identical to SEQ ID NO: 7561
  Description of Artificial Sequence: Synthetic coding sequence

SEQ ID NO: 8321 - DNA, 582 bp, Artificial Sequence
  Description of Artificial Sequence: Synthetic coding sequence
atgctgggcgtgctggagctgctgctgctgggcgccgcctggctggccggccctgcccggggccagaatgaaacagagcccatcgtgctggagggcaagtgcctggtggtgtgtgacagcaaccccaccagtgaccccactggaacagccctgggcatctctgtgcgcagcggcagcgccaaggtggccttcagcgccatccgcagcaccaaccacgagcccagcgagatgagcaacagaaccatgatcatctactttgaccaggtgctggtgaacatcggcaacaactttgattctgagaggagcaccttcatcgcccccaggaagggcatctacagcttcaacttccacgtggtgaaggtgtacaaccggcagaccatccaggtgtccctgatgctgaatggctggcctgtgatcagcgcctttgctggggaccaggatgtgacccgggaggccgccagcaatggagtgctgatccagatggagaagggggaccgggcctacctgaagctggagcggggcaacctgatgggcggctggaagtacagcaccttcagcggcttcctggtgttccccctgtag

SEQ ID NO: 8322 - DNA, 813 bp, Artificial Sequence
  Description of Artificial Sequence: Synthetic coding sequence
atgcacggcagctgcagcttcctgatgctgctgctgcccctgctgctgctgctggtggccaccaccggccctgtgggcgccctgacagatgaggagaagaggctgatggtggagctgcacaacctgtaccgggcccaggtgagccccacagccagtgacatgctgcacatgcgctgggatgaggagctggccgcctttgccaaggcctatgcccggcagtgtgtgtggggccacaacaaggagcggggcagaagaggagagaacctgtttgccatcacagatgagggcatggatgtgcccctggccatggaggagtggcaccacgagcgggagcactacaacctgtctgctgccacctgcagccctggccagatgtgtggccactacacccaggtggtgtgggccaagacagagcgcatcggctgcggcagccacttctgtgagaagctgcagggcgtggaggagaccaacatcgagctgctggtgtgcaactatgagcccccaggaaatgtgaagggcaagaggccctaccaggagggcaccccctgcagccagtgccccagcggctaccactgcaagaacagcctgtgtgagcccatcggcagcccagaagatgcccaggacctgccctacctggtgacagaggcccccagcttccgggccacagaggccagtgacagcaggaagatgggcgctgagggccctgacaagcccagcgtggtgtctggcctgaacagcggccctggccacgtgtggggccccctgctgggcctgctgctgctgccccccctggtgctggccggcatcttctag

SEQ ID NO: 8323 - DNA, 702 bp, Artificial Sequence
  Description of Artificial Sequence: Synthetic coding sequence
atggaccaggtgttcatgattgacagcaaatgtgagagcggcaagggccgctgcagcttcaaccccaacgtgaacacagtgtctgtgatgatcaatgaggagctgttcagcggcatgtacatcgacttcatgggcacagatgctgccatcttccgcagcctgaccaagagaaatgctgtgaggacagaccagcacaacagcaagtggctgtctgagcccatgtttgtggatgcccacgtgatcccagatggaacagaccccaatgatgccaaggtgtacttcttcttcaaggagaagctgacagacaacaacagaagcaccaagcagatccacagcatgattgcccgcatctgccccaatgacaccggcggcctgcggagcctggtgaacaagtggaccaccttcctgaaggcccggctggtgtgcagcgtgacagatgaagatggccctgagacccactttgatgagctggaggatgtgttcctgctggagacagacaaccccaggaccaccctggtgtatggcatcttcaccaccagcagcagcgtcttcaagggcagcgctgtgtgtgtgtaccacctgagtgacatccagacagtgttcaacggcccctttgcccacaaggagggccccaaccaccagctgatctcctaccagggccgcatcccctaccccaggcctggcaccaacacctgtgtgtag

SEQ ID NO: 8324 - DNA, 1368 bp, Artificial Sequence
  Description of Artificial Sequence: Synthetic coding sequence
atgctgcaccctgagaccagccctggccggggccacctgctggccgtgctgctggccctgctgggcacagcctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctggactggagcgacagcctggcccagctggcccaggcccgggccgccctgtgtggcatccccacccccagcctggccagcggcctgtggaggaccctgcaggtgggctggaacatgcagctgctgcctgctggcctggccagctttgtggaggtggtgtccctgtggtttgctgagggccagcgctacagccatgctgctggggagtgtgccagaaatgccacctgcacccactacacccagctggtgtgggccaccagcagccagctgggctgcggccgccacctgtgcagcgctggccaggccgccatcgaggcctttgtgtgtgcctacagcccccggggcaactgggaggtgaatggcaagaccatcgtgccctacaagaagggggcctggtgcagcctgtgcacagcctctgtgtctggctgcttcaaggcctgggaccatgctgggggcctgtgtgaggtgcccaggaacccctgcaggatgagctgccagaaccacggccgcctgaacatcagcacctgccactgccactgccccccaggctacacaggccgctactgccaggtgcgctgcagcctgcagtgtgtgcacggccgcttccgggaggaggagtgcagctgtgtgtgtgacatcggctacggcggggcccagtgtgccaccaaggtgcacttccccttccacacctgtgacctgagaattgatggagactgcttcatggtgtcctctgaggccgacacctactaccgggccaggatgaagtgccagaggaagggcggcgtgctggcccagatcaagagccagaaggtgcaggacatcctggccttctacctgggccgcctggagaccaccaatgaagtcatcgacagcgactttgagaccaggaacttctggattggcctgacctacaagacagccaaggacagcttccgctgggccaccggggagcaccaggccttcaccagctttgccttcggccagcctgacaaccacggcctggtgtggctgtctgctgccatgggcttcggcaactgtgtggagctgcaggccagcgctgccttcaactggaacaaccagcgctgcaagaccaggaaccgctacatctgccagtttgcccaggagcacatcagccgctggggccctggcagctag

SEQ ID NO: 8325 - DNA, 462 bp, Artificial Sequence
  Description of Artificial Sequence: Synthetic coding sequence
atggcccgcttctgggtgtgtgtggccggggccggcttcttcctggccttcctggtgctgcacagccgcttctgtggcagccctgtgctgaggaacttcacctttgctgtgtcctggaggacagagaagatcctgtaccgcctggatgtgggctggcccaagcaccctgagtacttcaccggcaccaccttctgtgtggccgtggacagcctgaatggcctggtgtacatcggccagagaggagacaacatccccaagatcctggtgttcacagaagatggctacttcctgcgggcctggaactacacagtggacaccccccacggcatctttgctgccagcaccctgtatgagcagagcgtgtggatcacagatgtgggcagtgacttcatgatcctgtggctgcacggggagaatggaactggacctgccaagttcaacatcccccacagcgtgacctag

SEQ ID NO: 8326 - DNA, 375 bp, Artificial Sequence
  Description of Artificial Sequence: Synthetic coding sequence
atgtggcgctgccccctgggcctgctgctgctgctgcccctggccggccacctggccctgggcgcccagcagggccggggccggcgggagctggcccctggcctgcacctgcggggcatcagagatgctgggggccgctactgccaggagcaggacctgtgctgccggggccgggcagatgactgtgccctgccctacctgggcgccatctgctactgtgacctcttctgcaacagaacagtgtctgactgctgcccagacttctgggacttctgcctgggcgtgcccccacccttcccccccatccaggccccagccaggagaactggaagtggctctgtgaccaagaaccacgcctggtggatccagacctag

SEQ ID NO: 8327 - DNA, 777 bp, Artificial Sequence
  Description of Artificial Sequence: Synthetic coding sequence
atgaagaccctgtacctggccgacaccttccccaccaacttccgggacagcgctggggccatgaagcagatcaatgactatgtggccaagcagaccaagggcaagatcgtggacctgctgaagaacctggacagcaatgctgtggtgatcatggtgaactacatcttcttcaaggccaagtgggagaccagcttcaaccacaagggcacccaggagcaggacttctacgtgaccagcgagaccgtggtgcgggtgcccatgatgagccgggaggaccagtaccactacctgctggacaggaacctgagctgccgggtggtgggcgtgccctaccagggcaatgccacagccctcttcatcctgcccagcgagggcaagatgcagcaggtggagaatggcctgtctgagaagaccctgaggaagtggctgaagatgttcaagaagaggcagctggagctgtacctgcccaagttcagcattgagggcagctaccagctggagaaggtgctgcccagcctgggcatcagcaatgtgttcaccagccatgctgacctgagcggcatcagcaaccacagcaacatccaggtgtctgagatggtgcacaaggctgtggtggaggtggatgagagcggcaccagggctgctgctgccaccggcaccatcttcaccttccgcagcgcccggctgaacagccagaggctggtgttcaaccggcccttcctgatgttcatcgtggacaacaacatcctcttcctgggcaaggtgaaccggccctag

SEQ ID NO: 8328 - DNA, 1731 bp, Artificial Sequence; identical to SEQ ID NO: 7680
  Description of Artificial Sequence: Synthetic coding sequence

SEQ ID NO: 8329 - DNA, 1359 bp, Artificial Sequence
  Description of Artificial Sequence: Synthetic coding sequence
atggctgacatgcaccggggctatgctgacagccccagcaaggccggggccgccccctacgtgcaggcctttgacagcctgctggccggccctgtggccgagtacctgaagatcagcaaggagattggaggagatgtgcagaagcacgccgagatggtgcacacaggcctgaagctggagcgggccctgctggtgacagccagccagtgccagcagcctgctgagaacaagctgagtgacctgctggcccccatcagcgagcagatcaaggaggtgatcaccttccgggagaagaacagaggcagcaagctgttcaaccacctgtctgctgtgtctgagagcatccaggccctgggctgggtggccatggcccccaagccaggcccctacgtgaaggagatgaatgatgctgccatgttctacaccaacagagtgctgaaggagtacaaggatgtggacaagaagcacgtggactgggtgaaggcctacctgagcatctggacagagctgcaggcctacatcaaggagttccacaccaccggcctggcctggagcaagacaggccctgtggccaaggagctgagcggcctgcccagcggccccagcgctggcagctgccccccacctcctccaccctgccccccacctcctcctgtgtccaccatcagctgcagctatgagagcgccagccgcagcagcctgtttgcccagatcaaccagggcgagagcatcacccacgccctgaagcacgtgtctgatgacatgaagacccacaagaacccagccctgaaggcccagagcggccctgtgcgcagcggccccaagcccttcagcgcccccaagccccagaccagccccagccccaagagggccaccaagaaggagcctgctgtgctggagctggagggcaagaagtggagggtggagaaccaggagaatgtgagcaacctggtgattgaggacacagagctgaagcaggtggcctacatctacaagtgtgtgaacaccaccctgcagatcaagggcaagatcaacagcatcaccgtggacaactgcaagaagctgggcctggtgtttgatgatgtggtgggcatcgtggagatcatcaacagcaaggatgtgaaggtgcaggtgatgggcaaggtgcccaccatcagcatcaacaagacagatggctgccacgcctacctgagcaagaacagcctggactgtgagatcgtgtctgccaagagcagcgagatgaatgtgctgatccccacagagggcggggacttcaatgagttccctgtgcctgagcagttcaagaccctgtggaatggccagaagctggtgaccaccgtgacagaaattgctggatag

SEQ ID NO: 8330 - DNA, 1533 bp, Artificial Sequence
  Description of Artificial Sequence: Synthetic coding sequence
atgggccggcccacccagtggcccagcctgctgctgctgctgctgctgcccggccccccacctgtggccggcctggaggatgctgccttcccccacctgggggagagcctgcagcccctgccccgggcctgccccctgcgctgcagctgcccccgggtggacacagtggactgtgatggcctggacctgcgggtcttcccagacaacatcaccagggctgcccagcacctgagcctgcagaacaaccagctgcaggagctgccctacaatgagctgagccggctgagcggcctgcggaccctgaacctgcacaacaacctgatcagcagcgagggcctgcctgatgaggcctttgagagcctgacccagctgcagcacctgtgtgtggcccacaacaagctgtctgtggccccccagttcctgcccaggagcctgcgggtggccgacctggccgccaaccaggtgatggagatcttccccctgacctttggagagaagccagccctgcggtctgtgtacctgcacaacaaccagctgagcaatgccggcctgcccccagatgccttccggggcagcgaggccatcgccaccctgagcctgagcaacaaccagctgagctacctgccccccagcctgccccccagcctggagcggctgcacctgcagaacaacctgatcagcaaggtgcccaggggggccctgagccggcagacccagctgcgggagctgtacctgcagcacaaccagctgacagattctggcctggatgccaccaccttcagcaagctgcacagcctggagtacctggacctgagccacaaccagctgaccaccgtgcctgctggcctgcccaggaccctggccatcctgcacctgggcaggaaccgcatccggcaggtggaggccgcccggctgcacggggcccggggcctgcgctacctgctgctgcagcacaaccagctgggcagcagcggcctgcctgctggggccctgcggcccctgcggggcctgcacaccctgcacctgtatggaaatggcctggacagagtgcccccagccctgccccggcggctgcgggccctggtgctgccccacaaccacgtggccgccctgggcgcccgggacctggtggccaccccaggcctgacagagctgaacctggcctacaaccggctggccagcgcccgggtgcaccaccgggccttccggcggctgcgggccctgcggagcctggacctggccggcaaccagctgacccggctgcccatgggcctgcccaccggcctgcggaccctgcagctgcagaggaaccagctgaggatgctggagcctgagcccctggccggcctggaccagctgcgggagctgagcctggcccacaaccggctgcgggtgggggacatcggccctggcacctggcatgagctgcaggccctgcaggtgcgccaccggctggtgagccacacagtgccccgggccccacccagcccctgcctgccctgccacgtgcccaacatcctggtgtcctggtag

SEQ ID NO: 8331 - DNA, 114 bp, Artificial Sequence
  Description of Artificial Sequence: Synthetic coding sequence
atgaacagcaccctgaacttcttcatccagagctacaacaatgccagcaatgacacctacctgtacagagtgcagaggctcatccgcagccagatgcagcaggtgcactgctag

SEQ ID NO: 8332 - DNA, 1266 bp, Artificial Sequence
  Description of Artificial Sequence: Synthetic coding sequence
atgggccggcccacccagtggcccagcctgctgctgctgctgctgctgcccggccccccacctgtggccggcctggaggatgctgccttcccccacctgggggagagcctgcagcccctgccccgggcctgccccctgcgctgcagctgcccccgggtggacacagtggactgtgatggcctggacctgcgggtcttcccagacaacatcaccagggctgcccagcacctgagcctgcagaacaaccagctgcaggagctgccctacaatgagctgagccggctgagcggcctgcggaccctgaacctgcacaacaacctgatcagcagcgagggcctgcctgatgaggcctttgagagcctgacccagctgcagcacctgtgtgtggcccacaacaagaacaacctgatcagcaaggtgcccaggggggccctgagccggcagacccagctgcgggagctgtacctgcagcacaaccagctgacagacagcggcctggatgccaccaccttcagcaagctgcacagcctggagtacctggacctgagccacaaccagctgaccaccgtgcctgctggcctgcccaggaccctggccatcctgcacctgggcaggaaccgcatccggcaggtggaggccgcccggctgcatggagcccggggcctgcgctacctgctgctgcagcacaaccagctgggcagcagcggcctgcctgctggggccctgcggcccctgcggggcctgcacaccctgcacctgtatggaaatggcctggacagagtgcccccagccctgccccggcggctgcgggccctggtgctgccccacaaccacgtggccgccctgggcgcccgggacctggtggccaccccaggcctgacagagctgaacctggcctacaaccggctggccagcgcccgggtgcaccaccgggccttccggcggctgcgggccctgcggagcctggacctggccggcaaccagctgacccggctgcccatgggcctgcccaccggcctgcggaccctgcagctgcagaggaaccagctgaggatgctggagcctgagcccctggccggcctggaccagctgcgggagctgagcctggcccacaaccggctgcgggtgggggacatcggccctggcacctggcatgagctgcaggccctgcaggtgcgccaccggctggtgagccacacagtgccccgggccccacccagcccctgcctgccctgccacgtgcccaacatcctggtgtcctggtag

SEQ ID NO: 8333 - DNA, 993 bp, Artificial Sequence
  Description of Artificial Sequence: Synthetic coding sequence
atgagctcctggagccggcagaggcccaagagccctgggggcatccagccccacgtgtccaggaccctcttcctgctgctgctgctggccgccagcgcctggggcgtgaccctgagccccaaggactgccaggtgttcagaagtgaccacggcagcagcatcagctgccagcccccagctgagatccctggctacctgcctgctgacacagtgcacctggccgtggagttcttcaacctgacccacctgcctgccaacctgctgcagggcgccagcaagctgcaggagctgcacctgagcagcaatggcctggagagcctgagccctgagttcctgcggcctgtgccccagctgcgggtgctggacctgaccagaaatgccctggtgctgaaggagaaccagctggaggtgctggaggtgtcctggctgcacggcctgaaggccctgggccacctggacctgagcggcaaccggctgaggaagctgcccccaggcctgctggccaacttcaccctgctgcggaccctggacctgggggagaaccagctggagaccctgcccccagacctgctgcggggccccctgcagctggagcggctgcacctggagggcaacaagctgcaggtgctgggcaaggacctgctgctgccccagcctgacctgcgctacctgttcctgaatggaaacaagctggcccgggtggccgccggggccttccagggcctgcggcagctggacatgctggacctgagcaacaacagcctggcctctgtgcctgagggcctgtgggccagcctgggccagcccaactgggacatgagagatggctttgacatcagcggcaacccctggatctgtgaccagaacctgagtgacctgtaccgctggctgcaggcccagaaggacaagatgttcagccagaatgacacccgctgtgccggccctgaggccgtgaagggccagaccctgctggccgtggccaagagccagtag

SEQ ID NO: 8334 - DNA, 1815 bp, Artificial Sequence; identical to SEQ ID NO: 6847
  Description of Artificial Sequence: Synthetic coding sequence

SEQ ID NO: 8335 - DNA, 948 bp, Artificial Sequence
  Description of Artificial Sequence: Synthetic coding sequence
atgggccaggaccgggaggagaccaacatcgagctgctggtgtgcaactatgagcccccaggaaatgtgaagggcaagaggccctaccaggagggcaccccctgcagccagtgccccagcggctaccactgcaagaacagcctgtgtgagcccatcggcagcccagaagatgcccaggacctgccctacctggtgacagaggcccccagcttccgggccacagaggccagtgacagcaggaagatgggcacccccagcagcctggccaccggcatcccagccttcctggtgacagaggtgtctggcagcctggccaccaaggccctgcctgctgtggagacccaggcccccaccagcctggccaccaaggaccccccatccatggccacagaggccccaccctgtgtgaccacagaggtgcccagcatcctggccgcccacagcctgcccagcctggatgaggagcctgtgaccttccccaagagcacccacgtgcccatccccaagtctgctgacaaggtgacagacaagaccaaggtgcccagccgcagccctgagaacagcctggaccccaagatgagcctgaccggggcccgggagctgctgccccacgcccaggaggaggccgaggccgaggccgagctgccccccagcagcgaggtgctggccagcgtcttccctgcccaggacaagccaggagagctgcaggccaccctggaccacacaggccacaccagcagcaagagcctgcccaacttccccaacaccagcgccacagccaatgccactggaggccgggccctggccctgcagagcagcctgcctggagctgagggccctgacaagcccagcgtggtgtctggcctgaacagcggccctggccacgtgtggggccccctgctgggcctgctgctgctgccccccctggtgctggccggcatcttctag

SEQ ID NO: 8336 - DNA, 207 bp, Artificial Sequence
  Description of Artificial Sequence: Synthetic coding sequence
atgcaggtgtccacagctgccctggccgtgctgctgtgcaccatggccctgtgcaaccaggtgctgagcgcccccctggccgctgacacccccacagcctgctgcttctcctacaccagccggcagatcccccagaacttcatcgctgactactttgagaccagcagccagtgcagcaagcccagcgtgatggccgcccctggatag

SEQ ID NO: 8337 - DNA, 3369 bp, Artificial Sequence
  Description of Artificial Sequence: Synthetic coding sequence
atgagcctgcaggagatgttccgcttccccatgggcctgctgctgggctctgtgctgctggtggccagcgccccagccaccctggagcccccaggctgcagcaacaaggagcagcaggtgacagtgagccacacctacaagattgatgtgcccaagagcgccctggtgcaggtggatgctgacccccagcccctgagtgatgatggagccagcctgctggccctgggggaggcccgggaggagcagaacatcatcttccgccacaacatccggctgcagaccccccagaaggactgtgagctggccggctctgtgcaggacctgctggcccgggtgaagaagctggaggaggagatggtggagatgaaggagcagtgcagcgcccagcgctgctgccagggcgtgacagacctgagccgccactgcagcggccacggcaccttcagcctggagacctgcagctgccactgtgaggagggccgggagggccctgcctgtgagcggctggcctgccctggggcctgcagcggccacggccgctgtgtggatggccgctgcctgtgccacgagccctacgtgggcgctgactgtggctacccagcctgcccagagaactgcagcggccatggagaatgtgtgcggggcgtgtgccagtgccacgaggacttcatgtctgaggactgcagcgagaagcgctgccctggggactgcagcggccacggcttctgtgacacaggagagtgctactgtgaggagggcttcaccggcctggactgtgcccaggtggtgaccccccagggcctgcagctgctgaagaacacagaggacagcctgctggtgtcctgggagcccagcagccaggtggaccactacctgctgagctactaccccctgggcaaggagctgagcggcaagcagatccaggtgcccaaggagcagcacagctatgagatcctgggcctgctgcccggcaccaagtacatcgtgaccctgagaaatgtgaagaatgaggtgagcagcagcccccagcacctgctggccaccacagacctggccgtgctgggcacagcctgggtgacagatgaaacagagaacagcctggatgtggagtgggagaaccccagcacagaggtggactactacaagctgcgctatggccccatgacaggccaggaggtggccgaggtgacagtgcccaagagcagtgaccccaagagccgctatgacatcaccggcctgcaccctggaacagagtacaagatcaccgtggtgcccatgagaggagagctggagggcaagcccatcctgctgaatggccgcacagaaattgacagccccaccaacgtggtgacagacagagtgacagaggacacagccaccgtgtcctgggaccctgtgcaggccgtcatcgacaagtatgtggtgcgctacaccagcgcagatggagacaccaaggagatggctgtgcacaaggatgagagcagcacagtgctgaccggcctgaagccaggagaggcctacaaggtgtatgtgtgggccgagcggggcaaccagggcagcaagaaggctgacaccaatgccctgacagaaattgacagccctgccaacctggtgacagacagagtgacagagaacacagccaccatctcctgggaccctgtgcaggccaccatcgacagatatgtggtgcgctacaccagcgccaaggatggagagacccgggaggtgcctgtgggcaaggagcagagcagcacagtgctgaccggcctgcggcctggggtggagtacacagtgcacgtgtgggcccagaagggggcccaggagagcaagaaggctgacaccaaggcccagacagacatcgacagcccccagaacctggtgacagactgggtgacagaaaatacagccaccgtgtcctgggaccctgtgcaggccaccatcgaccgctacgtggtgcactacaccagcgccaacggggagacccgggaggtgcctgtgggcaaggagcagagcagcacagtgctgaccggcctgcggcccggcatggagtacacagtgcacgtgtgggcccagaagggcaaccaggagagcaagaaggctgacaccaaggcccagacagaaattgatggccccaagaacctggtgacagactgggtgacagagaacatggccaccgtgtcctgggaccctgtgcaggccaccatcgacaagtacatggtgcgctacaccagcgcagatggagagacccgggaggtgcctgtgggcaaggagcacagcagcacagtgctgaccggcctgcggcccggcatggagtacatggtgcacgtgtgggcccagaagggggcccaggagagcaagaaggctgacaccaaggcccagacagagctggacccccccaggaacctgcggcccagcgctgtgacccagagcggcggcatcctgacctggaccccacccagcgcccagatccacggctacatcctgacctaccagttcccagatggcaccgtgaaggagatgcagctgggccgggaggaccagagatttgccctgcagggcctggagcagggcgccacctaccctgtgtccctggtggccttcaagggcggcagaagaagcagaaatgtgtccaccaccctgagcacagtgggcgcccgcttcccccaccccagcgactgcagccaggtgcagcagaacagcaatgctgccagcggcctgtacaccatctacctgcatggagatgccagccggcccctgcaggtgtactgtgacatggagacagatggcggcggctggatcgtgttccagaggaggaacacaggccagctggacttcttcaagcgctggaggagctatgtggagggctttggagaccccatgaaggagttctggctgggcctggacaagctgcacaacctgaccaccggcaccccagcccgctatgaggtgcgggtggacctgcagacagccaatgaaagtgcctatgccatctatgacttcttccaggtggccagcagcaaggagcgctacaagctgactgtgggcaagtaccggggcacagctggagatgccctgacctaccacaacggctggaagttcaccacctttgaccgggacaatgacatcgccctgagcaactgtgccctgacccaccacggcggctggtggtacaagaactgccacctggccaaccccaacggccgctatggagagaccaagcacagcgagggcgtgaactgggagccctggaagggccacgagttcagcatcccctacgtggagctgaagatccggccccacggctacagccgggagcctgtgctgggcaggaagaagaggaccctgcggggccgcctgcggaccttctag

SEQ ID NO: 8338 - DNA, 897 bp, Artificial Sequence
  Description of Artificial Sequence: Synthetic coding sequence
atgctgcaccctgagaccagccctggccggggccacctgctggccgtgctgctggccctgctgggcacagcctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctggactggagcgacagcctgaactggctgaagccaggccccctgtggaaccccaaccctgagcccggggtgcggcctgtggcccacccagccagcggcctggagcacgccgcctgcccccgggcctggaggcccctgctgaagtggagcctgtggtttgctgagggccagcgctacagccatgctgctggggagtgtgccagaaatgccacctgcacccactacacccagctggtgtgggccaccagcagccagctgggctgcggccgccacctgtgcagcgctggccaggccgccatcgaggcctttgtgtgtgcctacagcccccggggcaactgggaggtgaatggcaagaccatcgtgccctacaagaagggggcctggtgcagcctgtgcacagcctctgtgtctggctgcttcaaggcctgggaccatgctgggggcctgtgtgaggtgcccaggaacccctgcaggatgagctgccagaaccacggccgcctgaacatcagcacctgccactgccactgccccccaggctacacaggccgctactgccaggtgcgctgcagcctgcagtgtgtgcacggccgcttccgggaggaggagtgcagctgtgtgtgtgacatcggctatgagcccagcgtgcccccacgctgcatcttccccagcacccctgtgacctag

SEQ ID NO: 8339 - DNA, 1728 bp, Artificial Sequence
  Description of Artificial Sequence: Synthetic coding sequence
atggacctggtgctgaagcgctgcctgctgcacctggccgtgattggagccctgctggccgtgggcgccaccaagggcagccaggtgtggggcggccagcctgtgtacccccaggagacagatgatgcctgcatcttcccagatggcggcccctgccccagcggctcctggagccagaagaggagctttgtgtatgtgtggaagacctggggccagtactggcaggtgctgggcggccctgtgtctggcctgagcatcggcaccggccgggccatgctgggcacccacaccatggaggtgacagtgtaccacagaagaggcagccgctcctatgtgcccctggcccacagcagcagcgccttcaccatcacagaccaggtgcccttctctgtgtctgtgtcccagctgcgggccctggatggcggcaacaagcacttcctgaggaaccagcccctgacctttgccctgcagctgcatgaccccagcggctacctggccgaggccgacctgagctacacctgggactttggagacagcagcggcaccctcatcagccgggccctggtggtgacccacacctacctggagcccggccctgtgacagcccaggtggtgctgcaggccgccatccccctgaccagctgtggcagcagccctgtgcccggcaccacagatggccaccggcccacagctgaggcccccaacaccacagctggccaggtgcccaccacagaggtggtgggcaccaccccaggccaggcccccacagctgagcccagcggcaccacctctgtgcaggtgcccaccacagaggtgatcagcacagcccctgtgcagatgcccacagctgagagcacaggcatgaccccagagaaggtgcctgtgtctgaggtgatgggcaccaccctggccgagatgagcaccccagaggccaccggcatgaccccagctgaggtgtccatcgtggtgctgagcggcaccacagctgcccaggtgaccaccacagagtgggtggagaccacagcccgggagctgcccatccctgagcctgagggcccagatgccagcagcatcatgagcacagagagcatcaccggcagcctgggccccctgctggatggaacagccaccctgcggctggtgaagaggcaggtgcccctggactgtgtgctgtaccgctatggcagcttctctgtgaccctggacatcgtgcagggcattgaatctgctgagatcctgcaggccgtgcccagcggggagggagatgcctttgagctgactgtgtcctgccagggcggcctgcccaaggaggcctgcatggagatcagcagccctggctgccagcccccagcccagaggctgtgccagcctgtgctgcccagccctgcctgccagctggtgctgcaccagatcctgaagggcggcagcggcacctactgcctgaatgtgtccctggccgacaccaacagcctggccgtggtgtccacccagctgatcatgcctggccaggaggccggcctgggccaggtgcccctgattgtgggcatcctgctggtgctgatggctgtggtgctggccagcctcatctacagaagaaggctgatgaagcaggacttctctgtgccccagctgccccacagcagcagccactggctgcggctgccccgcatcttctgcagctgccccatcggggagaacagccccctgctgagcggccagcaggtgtag

SEQ ID NO: 8340 - DNA, 330 bp, Artificial Sequence
  Description of Artificial Sequence: Synthetic coding sequence
tgaagcggccagagcctgaagagcctgaatgccagcagcggccacctggccctgatcctgagcagcatcttcggcctgctgctgctggtgctcttcatcctcttcctgacctggtgccgggtgcagaagcagaagcacctgcccctgcgggtgtccaccaggagaagaggcagcctggaggagaacctcttccacgagatggagacctgcctgaagcgggaggacccccacggcaccaggaccagtgatgacacccccaaccacggctgtgaagatgccagtgacaccagcctgctgggcgtgctgcctgccagcgaggccaccaagtag

SEQ ID NO: 8341 - DNA, 312 bp, Artificial Sequence; identical to SEQ ID NO: 7320
  Description of Artificial Sequence: Synthetic coding sequence

SEQ ID NO: 8342 - DNA, 2889 bp, Artificial Sequence; identical to SEQ ID NO: 7529
  Description of Artificial Sequence: Synthetic coding sequence

SEQ ID NO: 8343 - DNA, 912 bp, Artificial Sequence
  Description of Artificial Sequence: Synthetic coding sequence
atgctgcaccctgagaccagccctggccggggccacctgctggccgtgctgctggccctgctgggcacagcctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctggactggagcgacagcctggcccagctggcccaggcccgggccgccctgtgtggcacccccacccccagcctggccagcggcctgtggaggaccctgcaggtgggctggaacatgcagctgctgcctgctggcctggtgtcctttgtggaggtggtgtccctgtggtttgctgagggccagcgctacagccatgctgctggggagtgtgccagaaatgccacctgcacccactacacccagctggtgtgggccaccagcagccagctgggctgcggccgccacctgtgcagcgctggccaggccgccatcgaggcctttgtgtgtgcctacagcccccggggcaactgggaggtgaatggcaagaccatcgtgccctacaagaagggggcctggtgcagcctgtgcacagcctctgtgtctggctgcttcaaggcctgggaccatgctgggggcctgtgtgaggtgcccaggaacccctgcaggatgagctgccagaaccacggccgcctgaacatcagcacctgccactgccactgccccccaggctacacaggccgctactgccaggtgcgctgcagcctgcagtgtgtgcacggccgcttccgggaggaggagtgcagctgtgtgtgtgacatcggctacggggagcccagcgtgcccccacgctgcatcttccccagcacccctgtgacctag

SEQ ID NO: 8344 - DNA, 1356 bp, Artificial Sequence
  Description of Artificial Sequence: Synthetic coding sequence
atggaggccaccggcacagatgaggtggacaagctgaagaccaagttcatcagcgcctggaacaacatgaagtacagctgggtgctgaagaccaagacctacttcagcaggaacagccctgtgctgctgctgggcaagtgctaccacttcaagtatgaagatgaggacaagaccctgcctgctgagagcggctgcaccatcgaggaccacgtgattgctggaaatgtggaggagttcaggaaggacttcatcagccgcatctggctgacctaccgggaggagttcccccagatcgagggcagcgccctgaccacagactgtggctggggctgcaccctgaggacaggccagatgctgctggcccagggcctcatcctgcacttcctgggccgggcctggacctggccagatgccctgaacatcgagaacagcgacagcgagagctggaccagccacacagtgaagaagttcaccgccagctttgaggccagcctgagcggggagcgggagttcaagacccccaccatcagcctgaaggagaccatcggcaagtacagtgatgaccacgagatgagaaatgaggtgtaccacaggaagatcatctcctggtttggagacagccccctggccctgtttggcctgcaccagctgattgaatatggcaagaagagcggcaagaaggccggggactggtacggccctgctgtggtggcccacatcctgaggaaggctgtggaggaggcccggcacccagacctgcagggcatcaccatctacgtggcccaggactgcaccgtgtacaacagtgatgtgattgacaagcagagcgcctccatgaccagtgacaatgctgatgacaaggccgtcatcatcctggtgcctgtgcggctgggcggggagaggaccaacacagactacctggagtttgtgaagggcatcctgagcctggagtactgtgtgggcatcattggaggcaagcccaagcagagctactactttgctggcttccaggatgacagcctcatctacatggacccccactactgccagagctttgtggatgtgtccatcaaggacttccccctggagaccttccactgccccagccccaagaagatgtccttcaggaagatggaccccagctgcaccatcggcttctactgcagaaatgtgcaggacttcaagagggccagcgaggagatcaccaagatgctgaagttcagcagcaaggagaagtaccccctcttcacctttgtgaatggccacagccgggactatgacttcaccagcaccaccaccaatgaggaggacctcttctctgaagatgagaagaagcagaagaagaagaagaagtag

SEQ ID NO: 8345 - DNA, 1557 bp, Artificial Sequence
  Description of Artificial Sequence: Synthetic coding sequence
atgaggacctgggactaccgctggagcctggccctggtggcccagacaggagtgcactgctgcaacctgagcagcctgcagcccctgcccccacgcttcaagcgcttcagctgcctgagcctgagcagcggctgggactacagcaacagcggcaacatgaagccacccctgctggtgttcatcgtgtgcctgctgtggctgaaggacagccactgtgcccccacctggaaggacaagacagccatcagcgagaacctgaagagcttcagcgaggtgggggagattgatgctgatgaggaggtgaagaaggccctgaccggcatcaagcagatgaagatcatgatggagaggaaggagaaggagcacaccaacctgatgagcaccctgaagaagtgccgggaggagaagcaggaggccctgaagctgctgaatgaggtgcaggagcacctggaggaggaggagcggctgtgccgggagagcctggccgacagctggggagaatgtcgcagctgcctggagaacaactgcatgaggatctacaccacctgccagcccagctggagctctgtgaagaacaagattgagcgcttcttcaggaagatctaccagttcctgttccccttccacgaggacaatgagaaggacctgcccatcagcgagaagctgattgaagaagatgcccagctgacccagatggaggatgtgttcagccagctgactgtggatgtgaacagcctcttcaacagaagcttcaacgtgttccggcagatgcagcaggagtttgaccagaccttccagagccacttcatcagtgacacagacctgacagagccctacttcttccctgccttcagcaaggagcccatgaccaaggctgacctggagcagtgctgggacatccccaacttcttccagctgttctgcaacttctctgtgtccatctatgaatctgtgtctgagaccatcaccaagatgctgaaggccatcgaggacctgcccaagcaggacaaggccccagaccatggaggcctcatcagcaagatgctgcccggccaggaccggggcctgtgtggggagctggaccagaacctgagccgctgcttcaagttccacgagaagtgccagaagtgccaggcccacctgtctgaggactgcccagatgtgcctgccctgcacacagagctggatgaggccatccggctggtgaatgtgagcaaccagcagtatggccagatcctgcagatgaccaggaagcacctggaggacacagcctacctggtggagaagatgaggggccagtttggctgggtgtctgagctggccaaccaggcccctgagacagagatcatcttcaacagcatccaggtggtgccccgcatccacgagggcaacatcagcaagcaggatgagaccatgatgacagacctgagcatcctgcccagcagcaacttcaccctgaagatccccctggaggagagcgctgagagcagcaacttcatcggctacgtggtggccaaggccctgcagcacttcaaggagcacttcaagacctggtag

SEQ ID NO: 8346 - DNA, 1716 bp, Artificial Sequence
  Description of Artificial Sequence: Synthetic coding sequence
gtggagatgaggaagtggagcagcgagcccggccctgagccagacacagtggaggccgtgattgagtacatgtacacaggccgcatccgggtgtccactggatctgtgcatgaggtgctggagctggccgaccgcttcctgctgatccggctgaaggagttctgtggggagttcctgaagaagaagctgcacctgagcaactgtgtggccatccacagcctggcccacatgtacaccctgagccagctggccctgaaggctgctgacatgatcagaagaaacttccacaaggtgatccaggatgaggagttctacaccctgcccttccacctgatccgggactggctgagtgacctggagatcaccgtggacagcgaggaggtgctgtttgagaccgtgctgaagtgggtgcagagaaatgctgaggagcgggagcgctactttgaggagctgttcaagctgctgcggctgagccagatgaagcccacctacctgaccaggcatgtgaagccagagcggctggtggccaacaatgaggtgtgtgtgaagctggtggctgatgctgtggagagacatgccctgcgggcagagaacatccagagcggcacctgccagcaccccaccagccacgtgtccctgctgcccaggtatggccagaacatggatgtgatcatggtgattggaggagtgtctgagggcggggactacctgtctgaatgtgtgggctactttgtggatgaagatcgctgggtgaacctgccccacatccacaaccacctggatggccatgctgtggccgtgacagagagctatgtgtatgtggccggctccatggagcccggctttgccaagacagtggagcgctacaaccccaacctgaacacctgggagcacgtgtgcagcctgatgaccaggaagcacagctttggcctgacagaggtgaagggcaagctgtacagcattggaggccacggcaacttcagccctggcttcaaggatgtgacagtgtacaaccctgagctggacaagtggcacaacctggagagcgcccccaagatcctgagagatgtgaaggccctggccattgaagatagatttgtgtacatcgccgcccggacccctgtggaccgggacacagaagatggcctgaaggctgtgatcacctgctatgacacagagacccggcagtggcaggatgtggagagcctgcccctgattgacaactactgcttcttccagatgtctgtggtgaacagcaacttctaccagacagccagctgctgccccaagagctactgcctggagaatgaggaggccgtgaggaagatcgccagccaggtgtctgatgagatcctggagagcctgcccccagaggtgctgagcattgagggcgccgccatctgctactacaaggatgatgtgttcatcattggaggctggaagaacagtgatgacatcgacaagcagtacaggaaggaggcctaccgctactgtgccgagaggaagcgctggatgctgctgccccccatgccccagccccgctgccgggccacagcctgccacgtgcgcatcccctaccgctacctgcacggcacccagcgctaccccatgccccagaacctgatgtggcagaaggaccgcatccggcagatgcaggagatccacagacatgccctgaacatgagaagagtgcccagcagccagatcgagtgctag

SEQ ID NO: 8347 - DNA, 729 bp, Artificial Sequence
  Description of Artificial Sequence: Synthetic coding sequence
atgctgaagaagatctctgtgggcgtggccggggacctgaacacagtgaccatgaagctgggctgtgtgctgatggcctgggccctgtacctgagcctgggcgtgctgtgggtggcccagatgctgctggccgccggctgccacgccgagctgtttcctgcccccatcctgcgggctgtgcccagcgctgagccccaggccggcagccccatgaccctgagctgccagaccaagctgcccctgcagaggtctgctgcccggctgctcttctccttctacaaggatggccgcatcgtgcagagccggggcctgagcagcgagttccagatccccacagccagcgaggaccacagcggcagctactggtgtgaggccgccacagaggacaaccaggtgtggaagcagagcccccagctggagatccgggtgcagggcgccagcagcagcgctgccccacccaccctgaacccagccccccagaagtctgctgcccctggaacagcccctgaggaggcccctggccccctgcccccaccacccacccccagcagtgaagatcctggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 8348 - DNA, 1392 bp, Artificial Sequence
  Description of Artificial Sequence: Synthetic coding sequence
atgtatgtgtccacccgggagcgctacaagtggctgcgcttcagcgaggactgcctgtacctgaatgtgtatgccccagcccgggcccctggggacccccagctgcctgtgatggtgtggttccctgggggcgccttcatcgtgggcgccgccagcagctatgagggcagtgacctggccgcccgggagaaggtggtgctggtgttcctgcagcaccggctgggcatcttcggcttcctgagcacagatgacagccacgcccggggcaactggggcctgctggaccagatggccgccctgcgctgggtgcaggagaacattgctgccttcggcggggaccctggaaatgtgaccctgtttggccagagcgctggggccatgagcatcagcggcctgatgatgagccccctggccagcggcctcttccaccgggccatcagccagagcggcacagccctcttccgcctcttcatcaccagcaaccccctgaaggtggccaagaaggtggcccacctggccggctgcaaccacaacagcacccagatcctggtgaactgcctgcgggccctgagcggcaccaaggtgatgagggtgagcaacaagatgaggttcctgcagctgaacttccagagggaccctgaggagatcatctggagcatgagccctgtggtggatggagtggtgatcccagatgaccccctggtgctgctgacccagggcaaggtgtcctctgtgccctacctgctgggcgtgaacaacctggagttcaactggctgctgccctacatcatgaagttccccctgaaccggcaggccatgaggaaggagaccatcaccaagatgctgtggagcaccaggaccctgctgaacatcaccaaggagcaggtgcccctggtggtggaggagtacctggacaacgtgaatgaacatgactggaagatgctgaggaacaggatgatggacatcgtgcaggatgccacctttgtgtatgccaccctgcagacagcccactaccacagagatgctggcctgcctgtgtacctgtatgaatttgagcaccacgcccggggcatcatcgtgaagcccaggacagatggagctgaccatggagatgagatgtacttcctgtttggaggcccctttgccaccggcctgtccatgggcaaggagaaggccctgagcctgcagatgatgaagtactgggccaactttgccaggactggaaaccccaatgatggcaacctgccctgctggccccgctacaacaaggatgagaagtacctgcagctggacttcaccaccagggtgggcatgaagctgaaggagaagaagatggccttctggatgagcctgtaccagagccagaggcctgagaagcagaggcagttctag

SEQ ID NO: 8349 - DNA, 1215 bp, Artificial Sequence
  Description of Artificial Sequence: Synthetic coding sequence
atgttctaccacgcctatgacagctacctggagaatgccttcccctttgatgagctgcggcccctgacctgtgatggccatgacacctggggcagcttcagcctgaccctgattgatgccctggacaccctgctgatcctgggcaatgtgtctgagttccagagggtggtggaggtgctgcaggacagcgtggactttgatattgatgtgaatgcctctgtgtttgagaccaacatccgggtggtgggcggcctgctgagcgcccacctgctgagcaagaaggccggcgtggaggtggaggccggctggccctgcagcggccccctgctgaggatggccgaggaggccgccaggaagctgctgcctgccttccagacccccaccggcatgccctacggcaccgtgaacctgctgcatggagtgaaccctggagagacccctgtgacctgcacagctggcatcggcaccttcatcgtggagtttgccaccctgagcagcctgaccggggaccctgtgtttgaagatgtggcccgggtggccctgatgaggctgtgggagagcagaagtgacatcggcctggtgggcaaccacattgatgtgctgaccgggaagtgggtggcccaggatgctggcatcggggccggcgtggacagctactttgagtacctggtgaagggggccatcctgctgcaggacaagaagctgatggccatgttcctggagtacaacaaggccatccggaactacaccaggtttgatgactggtacctgtgggtgcagatgtacaagggcaccgtgtccatgcctgtgttccagagcctggaggcctactggccaggcctgcagagcctgattggagacatcgacaatgccatgaggaccttcctgaactactacacagtgtggaagcagtttggaggcctgcctgagttctacaacatcccccagggctacacagtggagaagcgggagggctaccccctgcggcctgagctgattgaaagtgccatgtacctgtaccgggccactggagaccccaccctgctggagctgggcagagatgctgtggagagcattgagaagatcagcaaggtggagtgtggctttgccaccgtgtctgtgtgcatggcccccaggacaggcaagagcctgcccctgctgctgaagagcctcttcaagggccgggccctgggcgtgctgacctaccagcactag

SEQ ID NO: 8350 - DNA, 1281 bp, Artificial Sequence
  Description of Artificial Sequence: Synthetic coding sequence
atgggctggacagacaccctggagagcgctgaggacatcttctggaagcaggccgactttggctacgcccgggagcggctggaggagatgcacgtgctgtgccagcccaaggagaccagtgacagcagcctggtgtgcagccgctacctgcagtactgccgggccaccaacctgtacctggacctgaggaacatcaagagaaatcatgaccgcttcaaggaggacttcttccagagcggggagatcggcggccactgcaagctggacatccgcaccctgaccagcgagggccagaggaagagccccctgcagagctggtttgctgagctgcagagctacacccagctgaacttccggcccattgaagatgccaagtgtgacatcgtcatcgagaagcccacctacttcatgaagctggatgctggggtgaacatgtaccaccacttctgtgacttcatcaacctgtacatcacccagcacgtgaacaacagcttcagcacagatgtgtacatcgtgatgtgggacaccagcagctatggctatggagacctcttcagtgacacctggaatgccttcacagattatgatgtgatccacctgaagacctatgacagcaagagggtgtgcttcaaggaggccgtgttcagcctgctgcccaggatgagatatggcctcttctacaacacccccctcatcagcggctgccagaacacaggcctcttccgggcctttgcccagcacgtgctgcaccggctgaacatcacccaggagggccccaaggatggcaagatccgggtgaccatcctggcccggagcacagagtacaggaagatcctgaaccagaatgagctggtgaatgccctgaagacagtgtccacctttgaggtgcagatcgtggactacaagtaccgggagctgggcttcctggaccagctgcgcatcacccacaacacagacatcttcatcggcatgcatggagctggcctgacccacctgctcttcctgcctgactgggccgctgtgtttgagctgtacaactgtgaagatgagcgctgctacctggacctggcccggctgcggggcgtgcactacatcacctggaggcggcagaacaaggtgttcccccaggacaagggccaccaccccaccctgggggagcaccccaagttcaccaactacagctttgatgtggaggagttcatgtacctggtgctgcaggccgctgaccacgtgctgcagcaccccaagtggcccttcaagaagaagcatgatgagctgtag

SEQ ID NO: 8351 - DNA, 1098 bp, Artificial Sequence
  Description of Artificial Sequence: Synthetic coding sequence
atgaagctgggctgtgtgctgatggcctgggccctgtacctgagcctgggcgtgctgtgggtggcccagatgctgctggtggccagcagcttctctgctgccagctttgagaccctgcagtgtgagggccctgtgtgcacagaggagagcagctgccacacagaagatgacctgacagatgcccgggaggccggcttccaggtgaaggcctacaccttcagcgagcccttccacctgattgtgtcctatgactggctgatcctgcagggccctgccaagcctgtgtttgaaggagacctgctggtgctgcgctgccaggcctggcaggactggcccctgacccaggtgaccttctacagagatggcagcgccctgggccccccaggccccaaccgggagttcagcatcaccgtggtgcagaaggctgacagcggccactaccactgcagcggcatcttccagagccctggccctggcatccctgagacagcctctgtggtggccatcaccgtgcaggagctgtttcctgcccccatcctgcgggctgtgcccagcgctgagccccaggccggcagccccatgaccctgagctgccagaccaagctgcccctgcagaggtctgctgcccggctgctcttctccttctacaaggatggaagaattgtgcagagccggggcctgagcagcgagttccagatccccacagccagcgaggaccacagcggcagctactggtgtgaggccgccacagaggacaaccaggtgtggaagcagagcccccagctggagatccgggtgcagggcgccagcagcagcgctgccccacccaccctgaacccagccccccagaagtctgctgcccctggaacagcccctgaggaggcccctggccccctgcccccaccacccacccccagcagcgaggaccccggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 8352 - DNA, 1407 bp, Artificial Sequence
  Description of Artificial Sequence: Synthetic coding sequence
atgcgctggatcctgtgctggagcctgaccctgtgcctgatggcccagacagccctgggcgccctgcacaccaagaggccccaggtggtgaccaagtatggcaccctgcagggcaagcagatgcacgtgggcaagacccccatccaggtgttcctgggcgtgcccttcagcaggcctcccctgggcatcctgcgctttgcccctcctgagcccccagagccctggaagggcatcagagatgccaccacctacccacctggctgcctgcaggagagctggggccagctggcctccatgtatgtgtccacccgggagcgctacaagtggctgcgcttcagcgaggactgcctgtacctgaatgtgtatgccccagcccgggcccctggggacccccagctgcctgtgatggtgtggttccctgggggcgccttcatcgtgggcgccgccagcagctatgagggcagtgacctggccgcccgggagaaggtggtgctggtgttcctgcagcaccggctgggcatcttcggcttcctgagcacagatgacagccacgcccggggcaactggggcctgctggaccagatggccgccctgcgctgggtgcaggagaacattgctgccttcggcggggaccctggaaatgtgaccctgtttggccagagcgctggggccatgagcatcagcggcctgatgatgagccccctggccagcggcctcttccaccgggccatcagccagagcggcacagccctcttccgcctcttcatcaccagcaaccccctgaaggtggccaagaaggtggcccacctggccggctgcaaccacaacagcacccagatcctggtgaactgcctgcgggccctgagcggcaccaaggtgatgagggtgagcaacaagatgaggttcctgcagctgaacttccagagggaccctgaggagatcatctggagcatgagccctgtggtggatggagtggtgatcccagatgaccccctggtgctgctgacccagggcaaggtgtcctctgtgccctacctgctgggcgtgaacaacctggagttcaactggctgctgccctacatcatgaagttccccctgaaccggcaggccatgaggaaggagaccatcaccaagatgctgtggagcaccaggaccctgctgaacatcaccaaggagcaggtgcccctggtggtggaggagtacctggacaacgtgaatgaacatgactggaagatgctgaggaacaggatgatggacatcgtgcaggatgccacctttgtgtatgccaccctgcagacagcccactaccaccgggagacccccatgatgggcatctgcccagctggccacgccaccaccaggatgaagagcacctgctcctggatcctgccccaggagtgggcctag

SEQ ID NO: 8353 - DNA, 756 bp, Artificial Sequence
  Description of Artificial Sequence: Synthetic coding sequence
atgagcagctatggctacggggacctcttcagtgacacctggaatgccttcacagattatgatgtgatccacctgaagacctatgacagcaagagggtgtgcttcaaggaggccgtgttcagcctgctgcccaggatgagatatggcctcttctacaacacccccctcatcagcggctgccagaacacaggcctcttccgggcctttgcccagcacgtgctgcaccggctgaacatcacccaggagggccccaaggatggcaagatccgggtgaccatcctggcccggagcacagagtacaggaagatcctgaaccagaatgagctggtgaatgccctgaagacagtgtccacctttgaggtgcagatcgtggactacaagtaccgggagctgggcttcctggaccagctgcgcatcacccacaacacagacatcttcatcggcatgcacggggccggcctgacccacctgctcttcctgcctgactgggccgctgtgtttgagctgtacaactgtgaagatgagcgctgctacctggacctggcccggctgcggggcgtgcactacatcacctggaggcggcagaacaaggtgttcccccaggacaagggccaccaccccaccctgggggagcaccccaagttcaccaactacagctttgatgtggaggagttcatgtacctggtgctgcaggccgctgaccacgtgctgcagcaccccaagtggcccttcaagaagaagcatgatgagctgtag

SEQ ID NO: 8354 - DNA, 927 bp, Artificial Sequence
  Description of Artificial Sequence: Synthetic coding sequence
atgatccctgtggagctgctgctgtgctacctgctgctgcaccctgtggatgccaccagctatggcaagcagaccaacgtgctgatgcacttccccctgagcctggagagccagacccccagcagtgaccccctgagctgccagttcctgcaccccaagagcctgcccggcttcagccacatggcccccctgcccaagttcctggtgtccctggccctgagaaatgccctggaggaggccggctgccaggctgatgtgtgggccctgcagctgcagctgtaccggcagggcggcgtgaatgccacccaggtgctgatccagcacctgcggggcctgcagaagggccgcagcacagaaagaaatgtgtctgtggaggccctggccagcgccctgcagctgctggcccgggagcagcagagcacaggccgggtgggccgcagcctgcccacagaggactgtgaaaatgagaaggagcaggccgtgcacaacgtggtgcagctgctgcccggggtgggcaccttctacaacctgggcacagccctgtactatgccacccagaactgcctgggcaaggcccgggagcggggcagagatggagccatcgacctgggctatgacctgctgatgaccatggccggcatgtctgggggccccatgggcctggccatctctgctgccctgaagccagccctgcggtctggagtgcagcagctgatccagtactaccaggaccagaaggatgccaacatcagccagcctgagaccaccaaggagggcctgcgggccatcagtgatgtgtctgacctggaggagaccaccaccctggccagcttcatcagcgaggtggtgtcctctgccccctactggggctgggccatcatcaagagctatgacctggaccctggagctggcagcctggagatctag

SEQ ID NO: 8355 - DNA, 2862 bp, Artificial Sequence
  Description of Artificial Sequence: Synthetic coding sequence
atgagggtgctggcctgcctgctggccgccctggtgggcatccaggccgtggagcggctgcggctggctgatggcccccacggctgtgccggccgcctggaggtgtggcatggaggccgctggggcaccgtgtgtgatgatggctgggacctgagagatgctgctgtggcctgccggcagctgggctgcggcggggccctggccgcccctgggggcgccttctttggagagggcgccggccctgtgtggctgtctgagctggcctgcagaggaaatgaaggccagctgggcctgtgccaccaccggggctggaaggcccacatctgcagccatgaagaagatgctggggtggtgtgtgccggccagagggtggccaacagcagagatgacagcaccagccccctggatggagccccctggccaggcctgctgctggagctgagccccagcacagaggagcccctggtgacccacgcccccaggcctgctggcaacccccagaatgccagcaggaagaagagcccccggcccaagcaggccaagagcacccgggcccccctgctgaccaccggggccccccggcaggagcggctgcggctggtgtctggcccccaccgctgtgccggccgcctggaggtgtggcatggaggccgctggggcaccgtgtgtgatgatggctgggacctgagagatgctgctgtggcctgccgggagctgggctgcggcggggccctggccgcccctgggggcgccaggtttggacctggagctggccctgtgtggatggatgatgtgggctgcggcggcggggagcaggccctgcgggactgccccaggagcccctggggccgcagcaactgtgaccacagtgaagatgctggcctggtgtgcaccggccctgccccccggctgcggctggctgatggcccccacggctgtgccggccgcctggaggtgtggcatggaggccgctggggctctgtgtgtgatgatgcctgggacctgagagatgctgctgtggcctgccgggagctgggctgcggcggggccctggccgcccctgggggcgccttctttggagagggcagcggccccatcatcctggatgacctgcgctgcagaggaaatgaaacagccctgcgcttctgcccagcccggccctggggccagcacgactgccaccacagagaagatgctggagctgtgtgtgatggcatgcccctgggctacgtgcccccaacagcccccacagacagcaacaacagcaccccccgggaggccgccagcaggcctcccagcaccatgaccagccaggcccctggaacagctggggtgtccccacctccagccagccccaccgtgctgtgggagcccggccctgaggccggcagcccccagctgcggctggtggccggccccagcaaatgttctggccgcctggaggtgtggcatgaccagcgctggggcaccgtgtgtgatgacagctgggacatgagggacagcgctgtggtgtgccgggagctgggctgcggcggcccccagcagcctgaccctgctgctggccgcttcggctggggcgccggccccatctggctggatgatgtgggctgtgtgggcacagaggccagcctgagtgactgcccagctgccccctggggcaagcacaactgtgcccacaatgaagatgtgggcgtgacctgcaccggccccccaggcctggacagcatcagtgaccccttctcctggagctggatccctggcctgggccgggacagagatgcctggctgcctggagagctggccaccaagcccagcgcctctgtgacagcctctgtgctggagaagaccaccaccaaggcccctgggaagatgcccaagagcaccaagaagtgggtgaccaagaatgccaagaggcccaccacccagccccctgtgatgcccaccaccaagcacagccgggcccagagccccccagacctgaccagccagaccacagctgccctgaccacagaggccagccggcggcccaccagcgagttcacccggcggcccaccacagaggccccccagcgctggaccagccacaccacagccaccctgaccccccaggccccccgggagaggaccaccaagaccatggccatgctgaccacccagggcccccaggagatgaccagcgagagcaccatcaagagcatcccccaggccagcctggagcccagcgctgagatccctgagggcagccctgagagccccaaggaccctgcccccagccccagcgtgtccaccaccggggagagcggcctcttccgggtgcggctggctgatggccccaacagatgtgccggccgcctggaggtgtggcacgccggccgctggggcaccgtgtgtgatgacaactgggacctgagagatgccaccgtggcctgctgggagctgggctgcggcaaggtgcggccccgggtgggcaagacccactacggccctggcaccggccccatctggctggatgacatgggctgcaagggcagcgaggccagcctgagtgactgccccagcggggcctggggcaagcacaactgtgaccatgaagaagatgtgggcctgacctgcaccggctacacagattatgatgactacccaccctggacctgggaccccaccagccgggaggacctggccaagggcaccaccacagctggggtgcccggccacaccctgccctggaggaccaccaggaggcctggcagcagcagccctgccatccggcggctgcctgacacagagcctgaggccggcctgcgggaggtgatgctgctggtgcagggcctgcccggcctgcagaggctgcccagcccctag

SEQ ID NO: 8356 - DNA, 474 bp, Artificial Sequence
  Description of Artificial Sequence: Synthetic coding sequence
atgctgaggacagagagctgccggcccaggagccctgctggccaggtggccgccgccagccccctgctgctgctgctgctgctgctggcctggtgtgccggggcctgccgcggggcccccatcctgccccagggcctgcagcctgagcagcagctgcagctgtggaatgaaattgatgacacctgcagcagcttcctgagcattgacagccagccccaggccagcaatgccctggaggagctgtgcttcatgatcatgggcatgctgcccaagccccaggagcaggatgagaaggacaacaccaagaggagctctgtggtgcaccccctgctgcagctggtgccccacctgcacgagaggaggatgaagcgcttccgggtggatgaggagttccagagcccctttgccagccagagccggggctacttcctgttccggcccagaaatggaagaagatctgctggcttcatctag

SEQ ID NO: 8357 - DNA, 1545 bp, Artificial Sequence
  Description of Artificial Sequence: Synthetic coding sequence
atgcccagcacagtgctgcccagcacagtgctgcccagcctgctgcccacagctggggccggctggagcatgcgctggatcctgtgctggagcctgaccctgtgcctgatggcccagacagccctgggcgccctgcacaccaagaggccccaggtggtgaccaagtatggcaccctgcagggcaagcagatgcacgtgggcaagacccccatccaggtgttcctgggcgtgcccttcagccggccccccctgggcatcctgcgctttgcccctcctgagcccccagagccctggaagggcatcagagatgccaccacctacccacctggctgcctgcaggagagctggggccagctggcctccatgtatgtgtccacccgggagcgctacaagtggctgcgcttcagcgaggactgcctgtacctgaatgtgtatgccccagcccgggcccctggggacccccagctgcctgtgatggtgtggttccctggaggagccttcatcgtgggcgccgccagcagctatgagggcagtgacctggccgcccgggagaaggtggtgctggtgttcctgcagcaccggctgggcatcttcggcttcctgagcacagatgacagccacgcccggggcaactggggcctgctggaccagatggccgccctgcgctgggtgcaggagaacattgctgcctttggaggagaccctggaaatgtgaccctgtttggccagagcgctggggccatgagcatcagcggcctgatgatgagccccctggccagcggcctcttccaccgggccatcagccagagcggcacagccctcttccgcctcttcatcaccagcaaccccctgaaggtggccaagaaggtggcccacctggccggctgcaaccacaacagcacccagatcctggtgaactgcctgcgggccctgagcggcaccaaggtgatgagggtgagcaacaagatgaggttcctgcagctgaacttccagagggaccctgaggagatcatctggagcatgagccctgtggtggatggagtggtgatcccagatgaccccctggtgctgctgacccagggcaaggtgtcctctgtgccctacctgctgggcgtgaacaacctggagttcaactggctgctgccctacaacatcaccaaggagcaggtgcccctggtggtggaggagtacctggacaacgtgaatgaacatgactggaagatgctgaggaacaggatgatggacatcgtgcaggatgccacctttgtgtatgccaccctgcagacagcccactaccaccggggcctgtccatgggcaaggagaaggccctgagcctgcagatgatgaagtactgggccaactttgccaggacaggcaaccccaatgatggcaacctgccctgctggccccgctacaacaaggatgagaagtacctgcagctggacttcaccaccagggtgggcatgaagctgaaggagaagaagatggccttctggatgagcctgtaccagagccagaggcctgagaagcagaggcagttctag

SEQ ID NO: 8358 - DNA, 1062 bp, Artificial Sequence
  Description of Artificial Sequence: Synthetic coding sequence
atgagcaaccccacccagacagatgctgacagcgacctggtgggagatgtgtgtgacaccaatgaagattctgatggagatggccaccaggacaccaaggacaactgcccccagctgcccaacagcagccagctggacagcgacaatgatggcctgggagatgaatgtgatggagatgatgacaatgatggcatcccagactatgtgcccccaggccctgacaactgccgcctggtgcccaaccccaaccagaaggacagtgatggaaatggagtgggagatgtgtgtgaagatgactttgacaatgatgctgtggtggaccccctggatgtgtgcccagagagcgctgaggtgaccctgacagacttccgggcctaccagacagtggtgctggaccctgaaggagatgcccagattgaccccaactgggtggtgctgaaccagggcatggagatcgtgcagaccatgaacagcgaccccggcctggccgtgggctacacagccttcaacggggtggactttgagggcaccttccacgtgaacacagtgacagatgatgattatgccggcttcctgttctcctaccaggacagcggccgcttctacgtggtgatgtggaagcagacagagcagacctactggcaggccacccccttccgggctgtggcccagcccggcctgcagctgaaggctgtgacctctgtgtctggccctggagagcacctgagaaatgccctgtggcacacaggccacaccccagaccaggtgcggctgctgtggacagaccccagaaatgtgggctggagggacaagaccagctaccgctggcagctgctgcaccggccccaggtgggctacatccgggtgaagctgtatgagggcccccagctggtggccgacagcggggtcatcatcgacacctccatgagaggaggccgcctgggcgtcttctgcttcagccaggagaacatcatctggagcaacctgcagtaccgctgcaatgacacagtgcctgaagattttgagcccttccggcggcagctgctgcagggccgggtgtag

SEQ ID NO: 8359 - DNA, 1074 bp, Artificial Sequence
  Description of Artificial Sequence: Synthetic coding sequence
atggagattgagcacaccctggaccagatgatcagcaaggtgggcaaccacattgatgtgctgaccgggaagtgggtggcccaggatgctggcatcggggccggcgtggacagctactttgagtacctggtgaagggggccatcctgctgcaggacaagaagctgatggccatgttcctggagtacaacaaggccatccggaactacaccaggtttgatgactggtacctgtgggtgcagatgtacaagggcaccgtgtccatgcctgtgttccagagcctggaggcctactggccaggcctgcagagcctgattggagacatcgacaatgccatgaggaccttcctgaactactacacagtgtggaagcagtttggaggcctgcctgagttctacaacatcccccagggctacacagtggagaagcgggagggctaccccctgcggcctgagctgattgaaagtgccatgtacctgtaccgggccactggagaccccaccctgctggagctgggcagagatgctgtggagagcattgagaagatcagcaaggtggagtgtggctttgccaccatcaaggacctgcgggaccacaagctggacaacaggatggagagcttcttcctggccgagaccgtgaagtacctgtacctgctgtttgaccccaccaacttcatccacaacaacggcagcacctttgatgctgtgatcaccccctacggggagtgcatcctgggcgccggcggctacatcttcaacacagaggcccaccccattgatcctgctgccctgcactgctgccagaggctgaaggaggagcagtgggaggtggaggacctgatgagggagttctacagcctgaagaggagccgcagcaagttccagaagaacacagtgagcagcggcccctgggagcccccagcccggcccggcaccctcttctccccagaaaatcatgaccaggcccgggagaggaagccagccaagcagaaggtgcccctgctgagctgccccagccagcccttcaccagcaagctggccctgctgggccaggtgttcctggacagcagctag

SEQ ID NO: 8360 - DNA, 1341 bp, Artificial Sequence; identical to SEQ ID NO: 7099
  Description of Artificial Sequence: Synthetic coding sequence

SEQ ID NO: 8361 - DNA, 900 bp, Artificial Sequence; identical to SEQ ID NO: 7128
  Description of Artificial Sequence: Synthetic coding sequence

SEQ ID NO: 8362 - DNA, 1458 bp, Artificial Sequence
  Description of Artificial Sequence: Synthetic coding sequence
atggacaacaacaagcactgcaagcaggacaactgcctgctgacccccaacagcggccaggaggatgctgacaatgatggagtgggggaccagtgtgatgatgatgctgatggagatggcatcaagaatgtggaggacaactgccgcctcttccccaacaaggaccagcagaacagcgacacagacagctttggagatgcctgtgacaactgccccaacgtgcccaacaatgaccagaaggacacagatggaaatggagaaggagatgcctgtgacaatgatgtggatggagatggcatccccaacggcctggacaactgccccaaggtgcccaaccccctgcagacagacagagatgaagatggagtgggagatgcctgtgacagctgcccagagatgagcaaccccacccagacagatgctgacagcgacctggtgggagatgtgtgtgacaccaatgaagattctgatggagatggccaccaggacaccaaggacaactgcccccagctgcccaacagcagccagctggacagcgacaatgatggcctgggagatgaatgtgatggagatgatgacaatgatggcatcccagactatgtgcccccaggccctgacaactgccgcctggtgcccaaccccaaccagaaggacagtgatggaaatggagtgggagatgtgtgtgaagatgactttgacaatgatgctgtggtggaccccctggatgtgtgcccagagagcgctgaggtgaccctgacagacttccgggcctaccagacagtggtgctggaccctgaaggagatgcccagattgaccccaactgggtggtgctgaaccagggcatggagatcgtgcagaccatgaacagcgaccccggcctggccgtgggctacacagccttcaacggggtggactttgagggcaccttccacgtgaacacagtgacagatgatgattatgccggcttcctgttctcctaccaggacagcggccgcttctacgtggtgatgtggaagcagacagagcagacctactggcaggccacccccttccgggctgtggcccagcccggcctgcagctgaaggctgtgacctctgtgtctggccctggagagcacctgagaaatgccctgtggcacacaggccacaccccagaccaggtgcggctgctgtggacagaccccagaaatgtgggctggagggacaagaccagctaccgctggcagctgctgcaccggccccaggtgggctacatccgggtgaagctgtatgagggcccccagctggtggccgacagcggggtcatcatcgacacctccatgagaggaggccgcctgggcgtcttctgcttcagccaggagaacatcatctggagcaacctgcagtaccgctgcaatgacacagtgcctgaagattttgagcccttccggcggcagctgctgcagggccgggtgtag

SEQ ID NO: 8363 - DNA, 2358 bp, Artificial Sequence
  Description of Artificial Sequence: Synthetic coding sequence
atgaagcacaccctggccctgctggcccccctgctgggcctgggcctgggcctggccctgagccagctggccgccggggccacagactgcaagttcctgggccctgctgagcacctgaccttcaccccagctgcccgggcccgctggctggccccccgggtgcgggcccctggcctgctggacagcctgtatggcaccgtgcggcgcttcctgtctgtggtgcagctgaaccccttccccagcgagctggtgaaggccctgctgaatgagctggcctctgtgaaggtgaatgaggtggtgcgctatgaggccggctacgtggtgtgtgctgtgattgctggcctgtacctgctgctggtgcccacagctggcctgtgcttctgctgctgccgctgccaccggcgctgtggcggccgggtgaagacagagcacaaggccctggcctgtgagcgggccgccctgatggtgttcctgctgctgaccaccctgctgctgctgattggagtggtgtgtgcctttgtgaccaaccagaggacccatgagcagatgggccccagcattgaggccatgcctgagaccctgctgagcctgtggggcctggtgtctgatgtgccccaggagctgcaggccgtggcccagcagttcagcctgccccaggagcaggtgtctgaggagctggatggagtgggcgtgtccatcggcagcgccatccacacccagctgcggagctctgtgtaccccctgctggccgctgtgggcagcctgggccaggtgctgcaggtgtctgtgcaccacctgcagaccctgaatgccaccgtggtggagctgcaggccggccagcaggacctggagcccgccatccgggagcaccgggaccggctgctggagctgctgcaggaggcccgctgccagggcgactgtgccggggccctgtcctgggcccggaccctggagctgggcgctgacttcagccaggtgcccagcgtggaccacgtgctgcaccagctgaagggcgtgcctgaggccaacttcagctccatggtgcaggaggagaacagcaccttcaatgccctgcctgccctggccgccatgcagaccagctctgtggtgcaggagctgaagaaggctgtggcccagcagcctgagggcgtgaggaccctggccgagggcttccctggcctggaggccgccagccgctgggcccaggccctgcaggaggtggaggagagcagccggccctacctgcaggaggtgcagagatatgagacctaccgctggatcgtgggctgtgtgctgtgcagcgtggtgctgtttgtggtgctgtgcaacctgctgggcctgaacctgggcatctggggcctgagcgccagagatgaccccagccaccctgaggccaagggggaggccggggcccgcttcctgatggccggcgtgggcctgtccttcctgtttgctgcccccctcatcctgctggtgtttgccaccttcctggtgggcggcaatgtgcagaccctggtgtgccagagctgggagaatggagagctgtttgaatttgctgacaccccaggcaacctgccccccagcatgaacctgagccagctgctgggcctgaggaagaacatcagcatccaccaggcctaccagcagtgcaaggagggcgccgccctgtggacagtgctgcagctgaatgacagctatgacctggaggagcacctggacatcaaccagatccagaggcctgtggtgaagacctccatggagcagctggcccaggagctgcagggcctggcccaggcccaggacaacagcgtgctgggccagaggctgcaggaggaggcccagggcctgaggaacctgcaccaggagaaggtggtgccccagcagagcctggtggccaagctgaacctgtctgtgcgggccctggagagcagcgcccccaacctgcagctggagaccagtgatgtgctggccaacgtgacctacctgaagggggagctgcctgcctgggccgcccgcatcctgagaaatgtgtctgagtgcttcctggcccgggagatgggctacttcagccagtatgtggcctgggtgcgggaggaggtgacccagagaattgccacctgccagcccctgagcggggccctggacaacagcagggtcatcctgtgtgacatgatggctgacccctggaatgccttctggttctgcctggcctggtgcaccttcttcctgatccccagcatcatctttgctgtgaagaccagcaagtacttccggcccatcaggaagaggctgagcagcaccagcagcgaggagacccagctgttccacatcccccgggtgaccagcctgaagctgtag

SEQ ID NO: 8364 - DNA, 792 bp, Artificial Sequence
  Description of Artificial Sequence: Synthetic coding sequence
atgggccgggtgctggaggaggccaggtttgctgtggccttcacagagagcatgaaggagatggcccaggcccagtggaaggcccggcagatcagcctggccgtgaccagcgctgtgcctgtgcagccccacgccaagggcaaggtgtatgtgcagagccagggcatcgccaccaccccaaatgctgccttcaactggaacaccttcctgcagaggtctgagatcaaccagagcgctgacaacctgcacatcttcctgctgatctgtggcctgcggcaggtgaaggaccccctgtacctggtggatgccttcagcgcctggcaccaggaggagcccaacgtgcacctggtgattgtgggccctgaggtggaccctgtgttcacccgggaggtgaaggccaaggtgaagagagctgctggggtgcggctcatcggggagatgccccaggaggacctgcatgctgtggtgaagaactgctttgctgtggtgaacagctctgtgtctgagggcatgtctgctgccatcctggaggccatggacctggaggtgcctgtgctggccaggaacatccctggaaatgctgctgtggtgaagcatgaggtgacaggcctgctcttcagcaacccccaggagtttgtgcacctggccaagaggctggtgtctgaccctgccctggagaaggagatcgtggtgaatggccgggagtatgtgaggatgtaccacagctggcaggtggagcgggacacctaccagcagctgatcaggaagctggagggcagcacagaggactag

SEQ ID NO: 8365 - DNA, 456 bp, Artificial Sequence
  Description of Artificial Sequence: Synthetic coding sequence
atgaagacagctgtgatgaaggagctgtacagcttcctgcaccaccagaacagatatggcagcgagcaggagtttgtggatgacctgaagaacatgtggtttggcctgtacagcagaggaaatgaggagggggacagcagcggctttgaacatgtgttcagcggggaggtgaagaagggcaaggtgacaggcttccacaactggatccgcttctacctggaggagaaggagggcctggtggactactacagccacatctatgatggccctgtgcctgtgaagccaggccgcatcagcctgagctgcccagacatctacctgggccaggtgcacctgtgggagtggcaggaggtgcaccgccacagcctgcacagcgtcttccacctgattgagctgcgggccaggaagggccacgagggcagctgtgaaacagaggtgctgagcagcctggactag

SEQ ID NO: 8366 - DNA, 363 bp, Artificial Sequence
  Description of Artificial Sequence: Synthetic coding sequence
atgctgccccagtggctgctgctgctcttcctgctcttcttcttcctgttcctgctgacccggggcagcctgagccccaccaagtacaacctgctggagctgaaggagagctgcatccggaaccaggactgtgagaccggctgctgccagagggccccagacaactgtgagagccactgtgccgagaagggcagcgagggcagcctgtgccagacccaggtgttcttcggccagtaccgggcctgcccctgcctgaggaacctgacctgcatctacagcaagaatgagaagtggctgagcatcgcctacggccgctgccagaagattggccggcagaagctggccaagaagatgttcttctag

SEQ ID NO: 8367 - DNA, 951 bp, Artificial Sequence
  Description of Artificial Sequence: Synthetic coding sequence
atggccgaggccgccctggaggccgtgcgctctgagctgcgggagttccctgctgctgcccgggagctgtgtgtgcccctggccgtgccctacctggacaagccacccacccccctgcacttctacagagactgggtgtgccccaaccggccctgcatcatcagaaatgccctgcagcactggccagccctgcagaagtggagcctgccctacttccgggccaccgtgggcagcacagaggtgtctgtggccgtgaccccagatggctatgcagatgctgtgcggggggaccgcttcatgatgcctgctgagcggcggctgcccctgagctttgtgctggatgtgctggagggccgggcccagcaccctggggtgctgtatgtgcagaagcagtgcagcaacctgcccagcgagctgccccagctgctgcctgacctggagagccacgtgccctgggccagcgaggccctgggcaagatgccagatgctgtgaacttctggctgggggaggccgctgctgtgaccagcctgcacaaggaccactatgaaaatctctactgtgtggtgtctggagagaagcacttcctgttccaccccccaagtgaccggcccttcatcccctatgagctgtacaccccagccacctaccagctgacagaggagggcaccttcaaggtggtggatgaggaggccatggagaaggtgccctggatccccctggaccccctggccccagacctggcccgctaccccagctacagccaggcccaggccctgcgctgcaccgtgcgggccggggagatgctgtacctgcctgccctgtggttccaccacgtgcagcagagccagggctgcatcgctgtgaacttctggtatgacatggagtatgacctgaagtacagctacttccagctgctggacagcctgaccaaggccagcggcctggactag

SEQ ID NO: 8368 - DNA, 657 bp, Artificial Sequence; identical to SEQ ID NO: 7550
  Description of Artificial Sequence: Synthetic coding sequence

SEQ ID NO: 8369 - DNA, 909 bp, Artificial Sequence
  Description of Artificial Sequence: Synthetic coding sequence
atggccatgttcctggagtacaacaaggccatccggaactacaccaggtttgatgactggtacctgtgggtgcagatgtacaagggcaccgtgtccatgcctgtgttccagagcctggaggcctactggccaggcctgcagagcctcatcggggacatcgacaatgccatgaggaccttcctgaactactacacagtgtggaagcagtttggaggcctgcctgagttctacaacatcccccagggctacacagtggagaagcgggagggctaccccctgcggcctgagctgattgagagcgccatgtacctgtaccgggccaccggggaccccaccctgctggagctgggcagagatgctgtggagagcattgagaagatcagcaaggtggagtgtggctttgccaccatcaaggacctgcgggaccacaagctggacaacaggatggagagcttcttcctggccgagaccgtgaagtacctgtacctgctgtttgaccccaccaacttcatccacaacaacggcagcacctttgatgctgtgatcaccccctatggagagtgcatcctgggcgctgggggctacatcttcaacacagaggcccaccccatcgaccctgctgccctgcactgctgccagaggctgaaggaggagcagtgggaggtggaggacctgatgagggagttctacagcctgaagaggagccgcagcaagttccagaagaacacagtgagcagcggcccctgggagcccccagcccggcccggcaccctcttcagccctgagaaccacgaccaggcccgggagaggaagccagccaagcagaaggtgcccctgctgagctgccccagccagcccttcaccagcaagctggccctgctgggccaggtgttcctggacagcagctag

SEQ ID NO: 8370 - DNA, 459 bp, Artificial Sequence
  Description of Artificial Sequence: Synthetic coding sequence
atgctggtggatggccccagcgagaggcctgccctgtgcttcctgctgctggccgtggccatgtccttcttcggcagcgccctgagcattgatgagacccgggcccacctgctgctgaaggagaagatgatgaggctgggcggccgcctggtgctgaacaccaaggaggagctggccaatgaaaggctgatgaccctgaagattgctgagatgaaggaggccatgaggaccctcatcttccccccatccatgcacttcttccaggccaagcacctgattgaaagaagccaggtgttcaacatcctgaggatgatgcccaagggagctgccctgcacctgcatgacatcggcatcgtgaccatggactggctggtgagaaatgtgacctaccggccccactgccacatctgcttcaccccccggggcatcatgcagttccgctttgcccaccccacctag

SEQ ID NO: 8371 - DNA, 3951 bp, Artificial Sequence
  Description of Artificial Sequence: Synthetic coding sequence
atggagcccaggctcttctgctggaccaccctcttcctgctggccggctggtgcctgcccggcctgccctgccccagccgctgcctgtgcttcaagagcacagtgcgctgcatgcacctgatgctggaccacatcccccaggtgccccagcagaccaccgtgctggacctgcgcttcaaccgcatccgggagatccctggcagcgccttcaagaagctgaagaacctgaacaccctgctgctgaacaacaaccacatcaggaagatcagcagaaatgcctttgagggcctggagaacctgctgtacctgtacctgtacaagaatgagatccacgccctggacaagcagaccttcaagggcctcatcagcctggagcacctgtacatccacttcaaccagctggagatgctgcagcctgagaccttcggggacctgctgcggctggagcggctcttcctgcacaacaacaagctgagcaagatcccagctggcagcttcagcaacctggacagcctgaagaggctgcggctggacagcaatgccctggtgtgtgactgtgacctgatgtggctgggggagctgctgcagggctttgcccagcacggccacacccaggccgccgccacctgtgagtacccccggcggctgcacggccgggctgtggcctctgtgacagtggaggagttcaactgccagagcccccgcatcacctttgagccccaggatgtggaggtgcccagcggcaacacagtgtacttcacctgcagagctgagggcaaccccaagccagagatcatctggatccacaacaaccacagcctggacctggaggatgacacccggctgaatgtgtttgatgatggcaccctgatgatccggaacacccgggagagtgaccagggcgtgtaccagtgcatggccaggaacagcgctggggaggccaagacccagagcgccatgctgcgctacagcagcctgcctgccaagcccagctttgtgatccagccccaggacacagaggtgctgattggcaccagcaccaccctggagtgcatggccaccggccacccccaccccctcatcacctggacccgggacaatggcctggagctggatggcagccgccacgtggccaccagcagcggcctgtacctgcagaacatcacccagagggaccacggccgcttcacctgccacgccaacaacagccacggcaccgtgcaggccgccgccaacatcatcgtgcaggccccaccccagttcaccgtgacccccaaggaccaggtggtgctggaggagcacgctgtggagtggctgtgtgaggctgatggcaaccccccacctgtgattgtgtggaccaagacaggaggccagctgcctgtggagggccagcacacagtgctgagcagcggcaccctgagaattgaccgggccgcccagcacgaccagggccagtatgagtgccaggccgtgagcagcctgggcgtgaagaaggtgtctgtgcagctgactgtgaagcccaaggccctggccgtgttcacccagctgccccaggacacctctgtggaggtgggcaagaacatcaacatcagctgccacgcccagggcgagccccagcccatcatcacctggaacaaggagggcgtgcagatcacagagagcggcaagttccacgtggatgatgagggcaccctgaccatctatgatgctggcttcccagaccagggccgctatgaatgtgtggccagaaattcctttggcctggccgtgaccaacatgttcctgactgtgacagccatccagggccggcaggccggagatgactttgtggagagcagcatcctggatgctgtgcagagggtggacagcgccatcaacagcaccaggaggcacctgttcagccagaagccccacaccagcagtgacctgctggcccagttccactacccccgggaccccctgattgtggagatggcccgggccggggagatctttgagcacaccctgcagctgatccgggagcgggtgaagcagggcctgactgtggacctggagggcaaggagttccgctacaatgacctggtgagccccaggagcctgagcctgattgccaacctgagcggctgcacagcccggcggcccctgcccaactgcagcaaccgctgcttccacgccaagtaccgggcccatgatggcacctgcaacaacctgcagcagcccacctggggcgccgccctgacagcctttgcccggctgctgcagcctgcctacagagatggcatccgggccccccggggcctgggcctgcctgtgggcagccggcagcccctgcccccaccccggctggtggccaccgtgtgggcccgggctgctgctgtgaccccagaccacagctacaccaggatgctgatgcactggggctggttcctggagcatgacctggaccacacagtgcctgccctgagcacagcccgcttcagtgatggccggccctgcagctctgtgtgcaccaatgaccccccctgcttccccatgaacaccaggcatgctgacccccggggcacccacgccccctgcatgctgtttgcccggagcagccctgcctgtgccagcggccggcccagcgccaccgtggacagcgtgtatgcccgggagcagatcaaccagcagacagcctacattgatggcagcaatgtgtatggcagcagcgagcgggagagccaggccctgcgggaccccagcgtgccccggggcctgctgaagacaggcttcccctggcccccatctgggaagcccctgctgcccttcagcacaggccccccaacagaatgtgcccggcaggagcaggagagcccctgcttcctggccggggaccaccgggccaatgagcacctggccctggccgccatgcacaccctgtggttccgggagcacaacaggatggccacagagctgagcgccctgaacccccactgggagggcaacacagtgtaccaggaggccaggaagatcgtgggcgctgagctgcagcacatcacctacagccactggctgcccaaggtgctgggggaccccggcaccaggatgctgcggggctaccggggctacaaccccaacgtgaatgccggcatcatcaacagctttgccacagctgccttccgcttcggccacaccctcatcaaccccatcctgtaccgcctgaatgccaccctgggggagatcagcgagggccacctgcccttccacaaggccctcttcagccccagccgcatcatcaaggagggcggcattgatcctgtgctgcggggcctgtttggagtggccgccaagtggagggcccccagctacctgctgagccctgagctgacccagaggctcttctctgctgcctacagcgctgctgtggacagcgctgccaccatcatccagaggggccgggaccacggcatccccccctacgtggacttccgggtcttctgcaacctgacctctgtgaagaactttgaggacctgcagaatgagatcaaggacagcgagatccggcagaagctgaggaagctgtatggcagccctggggacatcgacctgtggccagccctgatggtggaggacctgatccctggcaccagggtgggccccaccctgatgtgcctgtttgtgacccagttccagaggctgagagatggagaccgcttctggtatgaaaatcctggggtcttcaccccagcccagctgacccagctgaagcaggccagcctgagccgggtgctgtgtgacaacggggacagcatccagcaggtgcaggctgatgtgtttgtgaaggccgagtacccccaggactacctgaactgcagcgagatccccaaggtggacctgcgggtgtggcaggactgctgtgccgacaagcaggccggcggcaccccagaggccggccgggtgtaccgctgctag

SEQ ID NO: 8372 - DNA, 891 bp, Artificial Sequence
  Description of Artificial Sequence: Synthetic coding sequence
atggaccccagcaagatcgcccacacagagtaccctgtgaacaccatcatcatccacgaggactttgacaacaacagcatgagcaacaacatcgccctgctgaagacagacacagccatgcacttcggcaacctggtgcagagcatctgcttcctgggccgcatgctgcacaccccacctgtgctgcagaactgctgggtgtctggctggaaccccaccagcgccaccggcaaccacatgaccatgtctgtgctgaggaagatctttgtgaaggacctggacatgtgccccctgtacaagctgcagaagacagaatgtggcagccacaccaaggaggagaccaagacagcctgcctgggggaccccggcagccccatgatgtgccagctgcagcagtttgacctgtgggtgctgcggggcgtgctgaactttggaggagagacctgccccggcctcttcctgtacaccaaggtggaggactacagcaagtggatcaccagcaaggccgagcgggccggcccccccctgagcagcctgcaccactgggagaagctgatctccttcagccaccacggccccaatgccaccatgacccagaagacctacagcgacagcgagctgggccacgtgggcagctacctgcagggccagaggaggaccatcacccacagccggctgggcaacagcagccgggacagcctggatgtgcgggagaaggatgtgaaggagagcggccgcagccctgaggcctctgtgcagcccctgtactatgactactacggcggggaggtgggggagggccgcatctttgctggccagaaccggctgtaccagcctgaggagatcatcctggtgtcctttgtgctggtgttcttctgcagcagcatctag

SEQ ID NO: 8373 - DNA, 2808 bp, Artificial Sequence
  Description of Artificial Sequence: Synthetic coding sequence
atgaggaagcccaggaggaagagccggcagaatgctgagggcagaagaagccccagcccctacagcctgaagtgcagccccacccgggagaccctgacctacgcccaggcccagagaattgtggaggtggacattgatggccgcctgcaccgcatcagcatctatgaccccctgaagatcatcacagaagatgagctgacagcccaggacatcacagagtgcaacagcaacaaggaaaattctgagcagccccagtttcctgggaagagcaagaagcccagcagcaagggcaagaagaaggagagctgcagcaagcacgccagcggcaccagcttccacctgccccagcccagcttcaggatggtggacagcggcatccagcctgaggccccacccctgcctgctgcctactaccgctacatcgagaagcccccagaggacctggatgctgaggtggagtatgacatggatgaggaggacctggcctggctggacatggtgaatgagaagagaagagtggatggccacagcctggtgtctgctgacacctttgagctgctggtggaccggctggagaaggagagctacctggagagccgcagcagcggggcccagcagagcctgattgatgaagatgccttctgctgcgtgtgcctggatgatgagtgccacaacagcaatgtcatcctcttctgtgacatctgcaacctggccgtgcaccaggagtgctacggcgtgccctacatccctgagggccagtggctgtgccgctgctgcctgcagagccccagcaggcctgtggactgcatcctgtgccccaacaagggcggggccttcaagcagaccagtgatggccactgggcccacgtggtgtgtgccatctggatccctgaggtgtgctttgccaacacagtgttcctggagcccatcgagggcatcgacaacatccccccagcccgctggaagctgacctgctacatctgcaagcagaagggcctgggcgccgccatccagtgccacaaggtgaactgctacacagccttccacgtgacctgtgcccagagagctggcctcttcatgaagattgagcccatgagggagaccagcctgaatggcaccatcttcaccgtgaggaagacagcctactgtgaggcccacagccccccaggagctgccacagcccggaggaaaggagacagccccaggagcatcagcgagactggagatgaggagggcctgaaggagggagatggagaggaggaggaggaggaggaggtggaggaggaggagcaggaggcccagggcggcgtgtctggcagcctgaagggcgtgcccaagaagagcaagatgagcctgaagcagaagatcaagaaggagcctgaggaggccggccaggacacccccagcaccctgcccatgctggccgtgccccagatccccagctaccgcctgaacaagatctgcagcggcctgtccttccagaggaagaaccagttcatgcagaggctgcacaactactggctgctgaagaggcaggccagaaatggagtgcccctcatccggcggctgcacagccacctgcagagccagagaaatgctgagcagcgggagcaggatgagaagaccagcgctgtgaaggaggagctgaagtactggcagaagctgcggcatgacctggagcgggcccggctgctgattgagctgatcaggaagcgggagaagctgaagcgggagcaggtgaaggtgcagcaggccgccatggagctggagctgatgcccttcaacgtgctgctgcggaccaccctggacctgctgcaggagaaggaccctgcccacatctttgctgagcctgtgaacctgtctgaggtgcctgactacctggagttcatcagcaagcccatggacttcagcaccatgaggaggaagctggagagccacctgtaccgcaccctggaggagtttgaggaggacttcaacctgattgtgaccaactgcatgaagtacaatgccaaggacaccatcttccacagagctgctgtgcggctgcgggacctgggcggggccatcctgcggcatgcccggcggcaggccgagaacatcggctatgaccctgagcggggcacccacctgcctgagagccccaagctggaggacttctaccgcttctcctgggaggatggcatgaccaacggctttgggaagcacacagagagcggcagtgacagtgaatgttccctgggcctgagcggcggcctggcctttgaggcctgcagcggcctgaccccacccaagaggagccggggcaagccagccctgagccgggtgcccttcctggagggcgtgaatggagacagcgactacaacggcagcggccgcagcctgctgctgccctttgaagatagaggagacctggagcccctggagctggtgtgggccaagtgccggggctaccccagctacccagccctgatcatcgaccccaagatgccccgggagggcctgctgcacaatggagtgcccatccctgtgccccccctggatgtgctgaagctgggggagcagaagcaggccgaggccggggagaagctgttcctggtgctcttctttgacaacaagaggacctggcagtggctgccccgggacaaggtgctgcccctgggcgtggaggacacagtggacaagctgaagatgctggagggcaggaagaccagcatcaggaagtctgtgcaggtggcctatgaccgggccatgatccacctgagccgggtgcggggcccccacagctttgtgaccagcagctacctgtag

SEQ ID NO: 8374 - DNA, 270 bp, Artificial Sequence
  Description of Artificial Sequence: Synthetic coding sequence
atgaagacaggcctcttcttcctgtgcctgctgggcacagctgctgccatccccaccaatgcccggctgctgagtgaccacagcaagcccacagctgagaccgtggccccagacaacacagccatccccagcctgcgggcagaggccgaggagaatgagaaggagacagctgtgtccacagaagatgacagccaccacaaggccgagaagagctctgtgctgaagagcaaggaggagagccatgagcagagcgctgagcagggcaagtag

SEQ ID NO: 8375 - DNA, 657 bp, Artificial Sequence; identical to SEQ ID NO: 7550
  Description of Artificial Sequence: Synthetic coding sequence

SEQ ID NO: 8376 - DNA, 540 bp, Artificial Sequence
  Description of Artificial Sequence: Synthetic coding sequence
atgagcctgggccctgaggtgttcctgggccccccagaggcccagagcttcctgagcagccacacccgcatcccccgggccaaccactgggacctggagctgctgaccccaggcaacctggagagagaatgtctggaggagcgctgctcctgggaggaggcccgggagtactttgaggacaacaccctgacagagcgcttctgggagagctacatctacaacgggaagggcggccggggccgggtggatgtggccagcctggccgtgggcctgaccggcggcatcctgctgattgtgctggccggcctgggcgccttctggtacctgcgctggaggcagcaccggggccagcagccctgcccccaggaggccggcctcatcagccccctgagccccctgaaccccctgggcccccccacccccctgcccccacctcctcctcctcctcctggcctgcccacctatgagcaggccctggccgccagcggcgtgcatgatgcccctcctccaccctacaccagcctgcggcggccccactag

SEQ ID NO: 8377 - DNA, 765 bp, Artificial Sequence
  Description of Artificial Sequence: Synthetic coding sequence
atgaccctggaggacatcgtgcagcgggaggtgtggggcaccgtggtggcccggggggccccagcccctcctggccctgtgcccaccaggggggccgccagccggcggctgtctgtgtccccagccagcaccagcgagaccagcctgtaccaggtgctgctgggcgcccggcagctggtgcagcccggcccccacgccatgtatgcccgggtgcggcaggtggagagcaaccccctgtaccagggcacagccagcagcgcagatgtggccctggtggagctggaggcccctgtgcccttcaccaactacatcctgcctgtgtgcctgcctgaccccagcgtcatctttgagaccggcatgaactgctgggtgacaggctggggcagccccagcgaggaggacctgctgcctgagccccgcatcctgcagaagctggccgtgcccatcatcgacacccccaagtgcaacctgctgtacagcaaggacacagaatttggctaccagcccaagaccatcaagaatgacatgctgtgtgccggctttgaggagggcaagaaggatgcctgcaagggggacagcggcggccccctggtgtgcctggtgggccagagctggctgcaggccggggtcatctcctggggcgagggctgtgcccggcagaacagacctggggtgtacatccgggtgacagcccaccacaactggatccaccgcatcatccccaagctgcagttccagcctgcccggctgggcggccagaagtag

SEQ ID NO: 8378 - DNA, 1899 bp, Artificial Sequence
  Description of Artificial Sequence: Synthetic coding sequence
atgaccccacctgtgctgaccacagctgagacctctgtgaagcccagcgtgtctgccttcacccacagccccccagagaacaccaccggcatcagcagcaccatctccttccacagcaggaccctgaacctgacagatgtgattgaggagctggcccaggccagcacccagaccctgaagagcaccatcgccagcgagaccaccctgagcagcaagagccaccagagcaccaccaccaggaaggccatcatccgccacagcaccatcccccccttcctgagcagcagcgccaccctgatgcctgtgcccatcagcccccccttcacccagagagctgtgacagacaacgtggccacccccatcagcggcctgatgaccaacacagtggtgaagctgcacgagagcagccgccacaatgccaagccccagcagctggtggccgaggtggccaccagccccaaggtgcaccccaatgccaagttcaccatcggcaccacccacttcatctacagcaacctgctgcacagcacccccatgcctgccctgaccaccgtgaagagccagaacagcaagctgacccccagcccctgggccgagaaccagttctggcacaagccctacagcgagattgctgagaagggcaagaagccagaggtgtccatgctggccaccaccggcctgtctgaggccaccaccctggtgtctgactgggatggccagaagaacaccaagaagagtgactttgacaagaagcctgtgcaggaggccaccaccagcaagctgctgccctttgacagcctgagccgctacatctttgagaagcccagaattgtgggcggcaaggccgccagcttcaccatcccagccaacagtgatgccttcctgccctgtgaggccgtgggcaaccccctgcccaccatccactggaccagggtgcccagcggcctggacctgagcaagaggaagcagaacagccgggtgcaggtgctgcccaacggcaccctgagcatccagagggtggagatccaggaccggggccagtacctgtgcagcgccagcaacctgtttggaacagaccacctgcacgtgaccctgtctgtggtgtcctacccaccccgcatcctggagaggaggaccaaggagatcaccgtgcacagcggcagcacagtggagctgaagtgcagagctgagggccggcccagccccaccgtgacctggatcctggccaaccagacagtggtgtctgagagcagccagggcagccggcaggccgtggtgacagtggatggcaccctggtgctgcacaacctgagcatctatgaccggggcttctacaagtgtgtggccagcaaccctgggggccaggacagcctgctggtgaagatccaggtgattgctgcccctcctgtgatcctggagcagaggcggcaggtgattgtgggcacctggggcgagagcctgaagctgccctgcacagccaagggcaccccccagcccagcgtgtactgggtgctgagtgatggaacagaggtgaagcccctgcagttcaccaacagcaagctgttcctgttcagcaatggcaccctgtacatccggaacctggccagcagtgaccggggcacctatgaatgtattgccaccagcagcacaggcagcgagcggcgggtggtgatgctgaccatggaggagcgggtgaccagcccccgcatcgaggccgccagccagaagaggacagaggtgaactttggagacaagctgctgctgaactgcagcgccactggagagcccaagccccagatcatgtggaggctgcccagcaaggctgtggtggaccagcagcaccgggtggccgccggcagcaccagcaccctgatggacccctgcctgctggaccagtag

SEQ ID NO: 8379 - DNA, 681 bp, Artificial Sequence
  Description of Artificial Sequence: Synthetic coding sequence
atggacatcatcgtgctgctgcccaagggccactgcaccaagatccaggagctgcagatgaccaccgtgctgaagcagaatgtgcacgtgtttggagtggagggcaacagtgatgagctggatgagcccatcaagacagtgtttgctgatgtggcctttgtgaagaagcacaacctgatgagcctgaacagcatcaactggagccgggtgctggtgcagatggcccaccacttctttgcctacttccagtgcacccccagcctggacacccaccccctgcccctggtggaggtggtggtgcccaccggggctgctggcaacctggccgccggctacatcgcccagaagattggcctgcccatccggctggtggtggccgtgaacagaaatgacatcatccacaggacagtgcagcagggcgacttcagcctgtctgaggccgtgaagagcaccctggccagcgccatggacatccaggtgccctacaacatggagagggtcttctggctgctgagcggcagtgacagccaggtgacccgggccctgatggagcagtttgagaggacccagagcgtgaacctgcccaaggagctgcacagcaagcacagccctgtgctgccccggccctgcctgtgcagccaggtgcccggcagctgccccggctgctggccagacccctag

SEQ ID NO: 8380 - DNA, 729 bp, Artificial Sequence
  Description of Artificial Sequence: Synthetic coding sequence
atgttccagacaggaggcctcatcgtgttctacggcctgctggcccagaccctgcccctgaatgtgaacccagccctgcccctgagccccaccggcctggccggcagcctgaccaatgccctgagcaatggcctgctgagcggcggcctgctgggcatcctggagaacctgcccctgctggacatcctgaagccaggcggcggcaccagcggcggcctgctgggcggcctgctgggcaaggtgaccagcgtcatccctggcctgaacaacatcatcgacatcaaggtgacagacccccagctgctggagctgggcctggtgcagagcccagatggccaccggctgtatgtgaccatccccctgggcatcaagctgcaggtgaacacccccctggtgggcgccagcctgctgcggctggccgtgaagctggacatcacagctgagatcctggccgtgcgggacaagcaggagcgcatccacctggtgctgggggactgcacccacagccctggcagcctgcagatcagcctgctggatggcctgggccccctgcccatccagggcctgctggacagcctgaccggcatcctgaacaaggtgctgcctgagctggtgcagggcaatgtgtgccccctggtgaatgaggtgctgcggggcctggacatcaccctggtgcatgacatcgtgaacatgctgatccacggcctgcagtttgtgatcaaggtgtag

SEQ ID NO: 8381 - DNA, 1422 bp, Artificial Sequence
  Description of Artificial Sequence: Synthetic coding sequence
atgagcctggaggccagcctgtgcagcctggaggagtgtgccgccttccagcccagcagccccagccccctgcagccccagggccctgtgaagagcaacaacatcgtgacagtgacaggcatcagcctgtgcctcttcatcatcatcgccaccgtgctgatcaccctgtggaggcgcttcggccgcccagccaagtgcagcaccccagcccggcacaacagcatccacagccccagcttcaggaagaacagtgatgaggagaacatctgtgagctgtctgagcagaggggcagcttcagtgatggaggagatggccccaccggcagccctggggacaccggcatccccctgacctaccgccgcagcggccctgtgcccccagaagatgatgccagcggcagcgagagcttccagagcaatgcccagaagatcatccccccactcttctcctaccgcctggcccagcagcagctgaaggagatgaagaagaagggcctgacagagaccaccaaggtgtaccacgtgtcccagagccccctgacagacacagccattgatgctgcccccagcgcccccctggacctggagagccctgaggaggccgccgccaacaagttccgcatcaagagccccttccctgagcagcctgctgtgtctgctggggagcggccccccagccggctggacctgaatgtgacccaggccagctgtgccatcagccccagccagaccctcatcaggaagagccaggcccggcacgtgggcagccggggcggccccagcgagaggagccacgccagaaatgcccacttccggaggacagccagcttccacgaggcccggcaggcccggcccttccgggagaggtccatgagcaccctgaccccccggcaggccccagcctacagcagcaggaccaggacctgtgagcaggctgaagatcgcttccggccccagagcagaggagcccacctgtttcctgagaagctggagcacttccaggaggccagcggcacccggggccccctgaaccccctgcccaagagctacaccctgggccagcccctgaggaagccagacctgggggaccaccaggccggcctggtggccggcatcgagaggacagagccccaccgggcccggcggggccccagccccagccacaagtctgtgtccaggaagcagagcagccccatcagccccaaggacaactaccagagggtgagcagcctgagccccagccagtgcaggaaggacaagtgccagagcttccccacccaccctgagtttgccttctatgacaacaccagctttggcctgacagaagctgagcagaggatgctggacctgcccggctacttcggcagcaatgaagaagatgagaccaccagcaccctgtctgtggagaagctggtgatctag

SEQ ID NO: 8382 - DNA, 2310 bp, Artificial Sequence
  Description of Artificial Sequence: Synthetic coding sequence
atgctgagcaagaagggcatcttcccctggatcctgacctgcatcagcgaggagatggccttccgcaccatctgtgtgctggtgggcgtcttcatctgcagcatctgtgtgaagggcagcagccagccccaggcccgggtgtacctgacctttgatgagctgcgggagaccaagaccagcgagtacttcagcctgagccaccaccccctggactaccgcatcctgctgatggatgaggaccaggaccgcatctacgtgggcagcaaggaccacatcctgagcctgaacatcaacaacatcagccaggaggccctgagcgtcttctggccagccagcaccatcaaggtggaggagtgcaagatggccggcaaggaccccacccacggctgcggcaactttgtgcgggtcatccagaccttcaacagaacccacctgtatgtgtgtggcagcggggccttcagccctgtgtgcacctacctgaacagaggccgccgctctgaggaccaggtgttcatgattgacagcaaatgtgagagcggcaagggccgctgcagcttcaaccccaacgtgaacacagtgtctgtgatgatcaatgaggagctgttcagcggcatgtacatcgacttcatgggcacagatgctgccatcttccgcagcctgaccaagagaaatgctgtgaggacagaccagcacaacagcaagtggctgtctgagcccatgtttgtggatgcccacgtgatcccagatggaacagaccccaatgatgccaaggtgtacttcttcttcaaggagaagctgacagacaacaacagaagcaccaagcagatccacagcatgattgcccgcatctgccccaatgacaccggcggcctgcggagcctggtgaacaagtggaccaccttcctgaaggcccggctggtgtgcagcgtgacagatgaagatggccctgagacccactttgatgagctggaggatgtgttcctgctggagacagacaaccccaggaccaccctggtgtatggcatcttcaccaccagcagcagcgtcttcaagggcagcgctgtgtgtgtgtaccacctgagtgacatccagacagtgttcaacggcccctttgcccacaaggagggccccaaccaccagctgatctcctaccagggccgcatcccctaccccaggcctggcacctgccctggaggagccttcacccccaacatgaggaccaccaaggagttcccagatgatgtggtgaccttcatccggaaccaccccctgatgtacaacagcatctaccccatccacaagaggcccctcatcgtgagaattggaacagactacaagtacaccaagattgctgtggacagagtgaatgctgctgatggccgctaccacgtgctcttcctgggcacagaccggggcaccgtgcagaaggtggtggtgctgcccaccaacaacagcgtgtctggagagctgatcctggaggagctggaggtgttcaagaaccacgcccccatcaccaccatgaagatcagcagcaagaagcagcagctgtatgtgagcagcaatgaaggagtgtcccaggtgtccctgcaccgctgccacatctatggaacagcctgtgccgactgctgcctggcccgggacccctactgtgcctgggatggccacagctgcagccgcttctaccccaccgggaagaggaggagccggcggcaggatgtgagacatggcaaccccctgacccagtgccggggcttcaacctgaaggcctacagaaatgctgctgagatcgtgcagtatggagtgaagaacaacaccaccttcctggagtgtgcccccaagagcccccaggccagcatcaagtggctgctgcagaaggacaaggacaggaggaaggaggtgaagctgaatgaaagaatcatcgccaccagccagggcctgctgatccgctctgtgcagggcagtgaccagggcctgtaccactgcatcgccacagaaaattccttcaagcagaccatcgccaagatcaacttcaaggtgctggacagcgagatggtggccgtggtgacagacaagtggagcccctggacctgggccagctctgtgcgggccctgcccttccaccccaaggacatcatgggcgccttcagccacagcgagatgcagatgatcaaccagtactgcaaggacacccggcagcagcaccagcagggagatgagagccagaagatgagaggagactatggcaagctgaaggccctgatcaacagcaggaagagcaggaacagaagaaaccagctgcctgagagctag

SEQ ID NO: 8383 - DNA, 942 bp, Artificial Sequence
  Description of Artificial Sequence: Synthetic coding sequence
atgcctggctggctgaccctgcccaccctgtgccgcttcctgctgtgggccttcaccatcttccacaaggcccagggcgaccctgccagccaccctggcaccaccccacccagctacaaggtgcgctggagcaaggtggagcccggggagctgcgggagaccctcatcctgatcaccaacggcctgcacgcccggggctacggccccctgggcggccgggccaggatgagaagaggccaccggctggatgccagcctggtgattgctggggtgcggctggaggatgagggccgctaccgctgtgagctgatcaatggaattgaagatgaatctgtggccctgaccctgagcctggagggcgtggtgttcccctaccagcccagccggggccgctaccagttcaactactatgaggccaagcaggcctgtgaggagcaggacggccgcctggccacctacagccagctgtaccaggcctggacagagggcctggactggtgcaatgccggctggctgctggagggctctgtgcgctaccctgtgctgacagcccgggccccctgtggcggccggggccggcccggcatccgctcctatggcccccgggacaggatgagggacagatatgatgccttctgcttcaccagcgccctggccggccaggtgttctttgtgcccggccgcctgaccctgtctgaggcccacgccgcctgcagaagaagaggagctgtggtggccaaggtgggccacctgtatgctgcctggaagttcagcggcctggaccagtgtgatggcggctggctggctgatggctctgtgcgcttccccatcaccaccccccggccccgctgtggcggcctgcctgaccccggggtgcgcagctttggcttcccccggccccagcaggccgcctacggcacctactgctacgccgagaactag

SEQ ID NO: 8384 - DNA, 1089 bp, Artificial Sequence
  Description of Artificial Sequence: Synthetic coding sequence
atggcctggacctttgagtgcagcaggaccaccagccctgagcccctgagcaccagcccctgcaggaccaccagcagcaggaacagccccaccatgagctgcccagcctctgtggcctgtgagcccagcaccagcaccaccaccagcagcccccccaaggcctgcctgacccggcccagcagccccagccccagctgcagcaccagcgcctggcacaacaagaacaacctgatcagcaaggtgcccaggggggccctgagccggcagacccagctgcgggagctgtacctgcagcacaaccagctgacagattctggcctggatgccaccaccttcagcaagctgcacagcctggagtacctggacctgagccacaaccagctgaccaccgtgcctgctggcctgcccaggaccctggccatcctgcacctgggcaggaaccgcatccggcaggtggaggccgcccggctgcacggggcccggggcctgcgctacctgctgctgcagcacaaccagctgggcagcagcggcctgcctgctggggccctgcggcccctgcggggcctgcacaccctgcacctgtatggaaatggcctggacagagtgcccccagccctgccccggcggctgcgggccctggtgctgccccacaaccacgtggccgccctgggcgcccgggacctggtggccaccccaggcctgacagagctgaacctggcctacaaccggctggccagcgcccgggtgcaccaccgggccttccggcggctgcgggccctgcggagcctggacctggccggcaaccagctgacccggctgcccatgggcctgcccaccggcctgcggaccctgcagctgcagaggaaccagctgaggatgctggagcctgagcccctggccggcctggaccagctgcgggagctgagcctggcccacaaccggctgcgggtgggggacatcggccctggcacctggcatgagctgcaggccctgcaggtgcgccaccggctggtgagccacacagtgccccgggccccacccagcccctgcctgccctgccacgtgcccaacatcctggtgtcctggtag

SEQ ID NO: 8385 - DNA, 900 bp, Artificial Sequence
  Description of Artificial Sequence: Synthetic coding sequence
atgctgcaccctgagaccagccctggccggggccacctgctggccgtgctgctggccctgctgggcacagcctgggccgaggtgtggccaccccagctgcaggagcaggcccccatggccggggccctgaacaggaaggagagcttcctgctgctgagcctgcacaaccggctgcgctcctgggtgcagcccccagctgctgacatgaggcggctggactggagcgacagcctggcccagctggcccagggcagccccctgtggaaccccaaccctgagcccggggtgcggcctgtggcccacccagccagcggcctggagcacgccgccgccccccgggcctggtgccccctgagcaagtggagcctgtggtttgctgagggccagcgctacagccacgccgctggagaatgtgccagaaatgccacctgcacccactacacccagctggtgtgggccaccagcagccagctgggctgcggccgccacctgtgcagcgctggccaggccgccatcgaggcctttgtgtgtgcctacagcccccggggcaactgggaggtgaatggcaagaccatcgtgccctacaagaagggggcctggtgcagcctgtgcacagcctctgtgtctggctgcttcaaggcctgggaccacgccggcggcctgtgtgaggtgcccaggaacccctgcaggatgagctgccagaaccacggccgcctgaacatcagcacctgccactgccactgccccccaggctacacaggccgctactgccaggtgcgctgcagcctgcagtgtgtgcacggccgcttccgggaggaggagtgcagctgtgtgtgtgacatcggctatgagcccagcgtgcccccacgctgcatcttccccagcacccctgtgacctag

SEQ ID NO: 8386 - DNA, 1047 bp, Artificial Sequence
  Description of Artificial Sequence: Synthetic coding sequence
atgctggacaccaacctgatcctgctgcccctcttccagttcatcgtgcccaaggagtggaacagcaagtacagacctgtgtgcatccacctggccggcaccggggaccaccactactggaggaggaggaccctgatggcccggcccatgatcaaggaggccaggatggccagcctgctgctggagaacccctactacggctgcaggaagcccaaggaccaggtgcgcagcagcctgaagaatgtgtctgacctgtttgtgatgggcggggccctggtgctggagagcgctgccctgctgcactggctggagcgggagggctacggccccctgggcatgacaggcatctccatgggcggccacatggccagcctggccgtgagcaactggcccaagcccatgcccctcatcccctgcctgtcctggagcacagccagcggggtcttcaccaccacagacagcttcaagatgggccaggagtttgtgaagcacttcaccagcagcgctgacaagctgaccaacctgaacctggtgtccaggaccctgaacctggacatcagcaaccaggtggtgtcccagaagccagctgactgccacaacagcagcaagacctctgtgtctgccaccagcgagggcctgctgctgcaggacaccagcaagatgaagcgcttcaaccagaccctgagcaccaacaagagcggctacaccagcaggaacccccagagctaccacctgctgagcaaggagcagagcaggaacagcctgaggaaggagagcctcatcttcatgaagggcgtgatggatgaatgtacccacgtggccaacttctctgtgcctgtggaccccagcctcatcatcgtggtgcaggccaaggaggatgcctacatccccaggactggagtgcgcagcctgcaggagatctggccaggctgtgagatccgctacctggagggcggccacatcagcgcctacctgttcaagcagggcctcttccggcaggccatctatgatgcctttgaccgcttcctgcacaagtatgccaactag

SEQ ID NO: 8387 - DNA, 1044 bp, Artificial Sequence
  Description of Artificial Sequence: Synthetic coding sequence
atgagggcctgcatcagcctggtgctggccgtgctgtgtggcctggcctgggccgacctgtacagcgcccccaccagctgccagggccgctgctatgaggcctttgacaagcaccaccagtgccactgcaatgcccgctgccaggagtttggaaactgctgcaaggactttgagagcctgtgcagcgaccacgaggtgagccacagcagtgatgccatcaccaaggaggagatccagagcatcagcgagaagatctacagagctgacaccaacaaggcccagaaggaggacatcgtgctgaacagccagaactgcatcagccccagcgagaccaggaaccaggtggaccgctgccccaagcccctcttcacctacgtgaatgagaagctgttcagcaagcccacctatgctgccttcatcaacctgctgaacaactaccagagggccaccggccacggggagcacttcagcgcccaggagctggccgagcaggatgccttcctgcgggagatcatgaagacagctgtgatgaaggagctgtacagcttcctgcaccaccagaacagatatggcagcgagcaggagtttgtggatgacctgaagaacatgtggtttggcctgtacagcagaggaaatgaggagggggacagcagcggctttgagcacgtgttttctggagaggtgaagaagggcaaggtgacaggcttccacaactggatccgcttctacctggaggagaaggagggcctggtggactactacagccacatctatgatggcccctgggacagctacccagatgtgctggccatgcagttcaactgggatggctactacaaggaggtgggcagcgccttcatcggcagcagccctgagtttgaatttgccctgtacagcctgtgcttcatcgcccggcctgggaaggtgtgccagctgagcctgggcggctaccccctggccgtgaggacctacacctgggacaagagcacctatggaaatggcaagaagtacatcgccacagcctacatcgtgagcagcacctag

SEQ ID NO: 8388 - DNA, 864 bp, Artificial Sequence
  Description of Artificial Sequence: Synthetic coding sequence
atgctgaagaagatctctgtgggcgtggccggggacctgaacacagtgaccatgaagctgggctgtgtgctgatggcctgggccctgtacctgagcctgggcgtgctgtgggtggcccagatgctgctggccgccagctttgagaccctgcagtgtgagggccctgtgtgcacagaggagagcagctgccacacagaagatgacctgacagatgcccgggaggccggcttccaggtgaaggcctacaccttcagcgagcccttccacctgattgtgtcctatgagctgtttcctgcccccatcctgcgggctgtgcccagcgctgagccccaggccggcagccccatgaccctgagctgccagaccaagctgcccctgcagaggtctgctgcccggctgctcttctccttctacaaggatggaagaattgtgcagagccggggcctgagcagcgagttccagatccccacagccagcgaggaccacagcggcagctactggtgtgaggccgccacagaggacaaccaggtgtggaagcagagcccccagctggagatccgggtgcagggcgccagcagcagcgctgccccacccaccctgaacccagccccccagaagtctgctgcccctggaacagcccctgaggaggcccctggccccctgcccccaccacccacccccagcagcgaggaccccggcttcagcagccccctgggcatgccagacccccacctgtaccaccagatgggcctgctgctgaagcacatgcaggatgtgcgggtgctgctgggccacctgctgatggagctgcgggagctgagcggccacaggaagccaggcaccaccaaggccacagctgagtag

SEQ ID NO: 8389 - DNA, 1815 bp, Artificial Sequence; identical to SEQ ID NO: 6847
  Description of Artificial Sequence: Synthetic coding sequence

SEQ ID NO: 8390 - DNA, 1005 bp, Artificial Sequence
  Description of Artificial Sequence: Synthetic coding sequence
atgaggtctgctgggggccgcggggagatcaaggtgagaagagagctgcagcccagcaagcaggtgtctggcctgaccaaccacgccaggacaggccaggagaagaggaacctgcagaggctggtgctggagacccccagccagaacatcttcttcagccctgtgtctgtgtccaccagcctggccatgctgagcctgggcgcccacagcgtgaccaagacccagatcctgcagggcctgggcttcaacctgacccacaccccagagagcgccatccaccagggcttccagcacctggtgcacagcctgactgtgcccagcaaggacctgaccctgaagatgggcagcgccctgtttgtgaagaaggagctgcagctgcaggccaacttcctgggcaatgtgaagaggctgtatgaggccgaggtgttcagcacagacttcagcaaccccagcatcgcccaggcccgcatcaacagccacgtgaagaagaagacccagggcaaggtggtggacatcatccagggcctggacctgctgacagccatggtgctggtgaaccacatcttcttcaaggccaagtgggagaagcccttccaccctgagtacaccaggaagaacttccccttcctggtgggggagcaggtgacagtgcacgtgcccatgatgcaccagaaggagcagtttgccttcggcgtggacacagagctgaactgctttgtgctgcagatggactacaagggagatgctgtggccttctttgtgctgcccagcaagggcaagatgaggcagctggagcaggccctgagcgcccggaccctgaggaagtggagccacagcctgcagaagcgctggattgaggtgttcatcccccgcttcagcatcagcgccagctacaacctggagaccatcctgcccaagatgggcatccagaatgtgtttgacaagaatgctgacttcagcggcatcgccaagagggacagcctgcaggtgtccaaggtgtcctag

SEQ ID NO: 8391 - DNA, 1065 bp, Artificial Sequence
  Description of Artificial Sequence: Synthetic coding sequence
atggccccagcccggcggcctgctggggcccggctgctgctggtgtatgccggcctgctggccgctgctgctgctggcctgggcagccctgagcccggggcccccagccgcagccgggcccggcgggagcccccacctggaaatgagctgccccggggccctggagagagcagagctggccctgctgcccggcccccagagcccacagctgagcgggcccacagcgtggaccccagagatgcctggatgctgtttgtgcggcagagcgacaagggcgtgaatggcaagaagaggagccggggcaaggccaagaagctgaagtttggcctgcccggccccccaggccccccaggcccccagggccccccaggccccatcatccccccagaggccctgctgaaggagttccagctgctgctgaagggagctgtgcggcagcgggagcgggcagagcctgagccctgcacctgtggccctgctggccctgtggccgccagcctggcccctgtgtctgccacagctggggaggatgatgatgatgtggtgggagatgtgctggccctgctggccgcccccctggcccctggcccccgggccccccgggtggaggccgccttcctgtgccgcctgcggagagatgccctggtggagcggcgggccctgcacgagctgggcgtgtactacctgcctgatgctgagggcgccttcagaagaggccctggcctgaacctgaccagcggccagtaccgggcccctgtggccggcttctacgccctggccgccaccctgcacgtggccctgggggagcccccccggcggggccccccccggccccgggaccacctgcggctgctgatctgcatccagagccgctgccagagaaatgccagcctggaggccatcatgggcctggagagcagcagcgagctgttcaccatctctgtgaatggagtgctgtacctgcagatgggccagtggaccagcgtcttcctggacaatgccagcggctgcagcctgactgtgcgcagcggcagccacttctctgctgtgctgctgggcgtgtag

SEQ ID NO: 8392 - DNA, 2685 bp, Artificial Sequence; identical to SEQ ID NO: 8214
  Description of Artificial Sequence: Synthetic coding sequence

SEQ ID NO: 8393 - DNA, 2685 bp, Artificial Sequence; identical to SEQ ID NO: 8214
  Description of Artificial Sequence: Synthetic coding sequence

SEQ ID NO: 8394 - DNA, 2886 bp, Artificial Sequence; identical to SEQ ID NO: 7526
  Description of Artificial Sequence: Synthetic coding sequence

SEQ ID NO: 8395 - DNA, 2559 bp, Artificial Sequence; identical to SEQ ID NO: 7494
  Description of Artificial Sequence: Synthetic coding sequence

SEQ ID NO: 8396 - DNA, 756 bp, Artificial Sequence
  Description of Artificial Sequence: Synthetic coding sequence
atgccccacctggccagcctcttcaccgccagcagccgctgctgcccccaccccctgcggcctgagggcagcggggccatgggccctgaggccctgagcagcctgctgctgctgctgctggtggccagcggagatgctgacatgaagggccactttgatcctgccaagtgccgctatgccctgggcatgcaggacaggaccatcccagacagcgacatcagcgccagcagctcctggagcgacagcacagctgcccggcacagccggctggagagcagtgatggagatggagcctggtgcccagctggcagcgtcttccccaaggaggaggagtacctgcaggtggacctgcagaggctgcacctggtggccctggtgggcacccagggcagacatgctgggggcctgggcaaggagttcagccgcagctaccgcctgcgctacagcagagatggaagacgctggatgggctggaaggaccgctggggccaggaggtgatctctggaaatgaagatcctgagggcgtggtgctgaaggacctgggcccccccatggtggcccggctggtgcgcttctaccccagggctgacagagtgatgtctgtgtgcctgcgggtggagctgtatggctgcctgtggagaggagagtggctgtccttcctgggcatctgcttcctgagccggggcctggagggcggggagtgtggggagtgggccagccgcatccccagccctgctgggaagctgagcctgtag

SEQ ID NO: 8397 - DNA, 726 bp, Artificial Sequence
  Description of Artificial Sequence: Synthetic coding sequence
atgaagttcatcctgctgtgggccctgctgaacctgactgtggccctggccttcaacccagactacacagtgagcagcaccccaccctacctggtgtacctgaagagtgactacctgccctgtgccggcgtgctgatccaccccctgtgggtgatcacagctgcccactgcaacctgcccaagctgcgggtcatcctgggcgtgaccatcccagctgacagcaatgagaagcacctgcaggtgattggctatgagaagatgatccaccacccccacttctctgtgaccagcattgaccatgacatcatgctgatcaagctgaagacagaagctgagctgaatgactatgtgaagctggccaacctgccctaccagaccatcagcgagaacaccatgtgcagcgtgtccacctggagctacaacgtgtgtgacatctacaaggagccagacagcctgcagacagtgaacatcagcgtcatcagcaagccccagtgcagagatgcctacaagacctacaacatcacagagaacatgctgtgtgtgggcatcgtgcctggaagacggcagccctgcaaggaggtgtctgctgccccagccatctgcaatggcatgctgcagggcatcctgagctttgctgatggctgtgtgctgcgggcagatgtgggcatctatgccaagatcttctactacatcccctggattgaaaatgtcatccagaacaactag

SEQ ID NO: 8398 - DNA, 1536 bp, Artificial Sequence
  Description of Artificial Sequence: Synthetic coding sequence
atggccaagggcctgtctgtgcagaatgacaagcaccctggctaccagcctgccctgctgctgagccctggggcccccctgtttgctgatggccctgcctatgccctgctgcacctgctgctgcacgagggcaaggccgagatggctgaccaggccgccgcctggctgacccggcagggcagcttccagggcggcttccgcagcacccaggacaccgtcatcgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaagattatgaatatgatgagctgcctgccaaggatgatcctgatgcccccctgcagcctgtgacccccctgcagctgtttgagggcagaagaaacagaagaagaagagaggcccccaaggtggtggaggagcaggagagccgggtgcactacacagtgtgcatctggagaaatggcaaggtgggcctgagcggcatggccatcgcagatgtgaccctgctgagcggcttccacgccctgcgggctgacctggagaagctgaccagcctgagtgaccgctacgtgagccactttgaaacagagggcccccacgtgctgctgtactttgattctgtgcccaccagcagagaatgtgtgggctttgaagctgtgcaggaggtgcctgtgggcctggtgcagcctgccagcgccaccctgtatgactactacaaccctgagcggcgctgcagcgtcttctatggagcccccagcaagagccggctgctggccaccctgtgcagcgctgaggtgtgccagtgtgccgagggcaaatgtccccggcagaggcgggccctggagcggggcctgcaggatgaagatggctacaggatgaagtttgcctgctactacccccgggtggagtatggcttccaggtgaaggtgctgcgggaggacagcagagctgccttccggctgtttgagaccaagatcacccaggtgctgcacttcaccaaggatgtgaaggctgctgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 8399 - DNA, 2067 bp, Artificial Sequence; identical to SEQ ID NO: 8067
  Description of Artificial Sequence: Synthetic coding sequence

SEQ ID NO: 8400 - DNA, 2559 bp, Artificial Sequence; identical to SEQ ID NO: 7494
  Description of Artificial Sequence: Synthetic coding sequence

SEQ ID NO: 8401 - DNA, 1737 bp, Artificial Sequence; identical to SEQ ID NO: 7521
  Description of Artificial Sequence: Synthetic coding sequence

SEQ ID NO: 8402 - DNA, 1326 bp, Artificial Sequence; identical to SEQ ID NO: 7358
  Description of Artificial Sequence: Synthetic coding sequence

SEQ ID NO: 8403 - DNA, 2685 bp, Artificial Sequence; identical to SEQ ID NO: 8214
  Description of Artificial Sequence: Synthetic coding sequence

SEQ ID NO: 8404 - DNA, 216 bp, Artificial Sequence; identical to SEQ ID NO: 7542
  Description of Artificial Sequence: Synthetic coding sequence

SEQ ID NO: 8405 - DNA, 2760 bp, Artificial Sequence; identical to SEQ ID NO: 7514
  Description of Artificial Sequence: Synthetic coding sequence

SEQ ID NO: 8406 - DNA, 447 bp, Artificial Sequence; identical to SEQ ID NO: 7498
  Description of Artificial Sequence: Synthetic coding sequence

SEQ ID NO: 8407 - DNA, 5097 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagtacccaggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccggggcagcagcacctggctgacagcctttgtgctgaaggtgctgagcctggcccaggagcaggtgggcggcagccctgagaagctgcaggagaccagcaactggctgctgagccagcagcaggctgatggcagcttccaggacctgagccctgtgatccaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccagcagcttcctgggggagaaggccagcgctggcctgctgggcgcccacgccgccgccatcacagcctatgccctgaccctgaccaaggccccagctgacctgcggggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 8408 - DNA, 1986 bp, Artificial Sequence
  Description of Artificial Sequence: Synthetic coding sequence
atggacctggtgctgaagcgctgcctgctgcacctggccgtgattggagccctgctggccgtgggcgccaccaaggtgcccaggaaccaggactggctgggcgtgtcccggcagctgcggaccaaggcctggaaccggcagctgtacccagagtggacagaggcccagaggctggactgctggaggggcggccaggtgtccctgaaggtgtccaatgatggccccaccctcatcggggccaatgccagcttcagcatcgccctgaacttccctggcagccagaaggtgctgcctgatggccaggtgatctgggtgaacaacaccatcatcaatggcagccaggtgtggggcggccagcctgtgtacccccaggagacagatgatgcctgcatcttcccagatggcggcccctgccccagcggctcctggagccagaagaggagctttgtgtatgtgtggaagacctggggccagtactggcaggtgctgggcggccctgtgtctggcctgagcatcggcaccggccgggccatgctgggcacccacaccatggaggtgacagtgtaccacagaagaggcagccgctcctatgtgcccctggcccacagcagcagcgccttcaccatcacagaccaggtgcccttctctgtgtctgtgtcccagctgcgggccctggatggcggcaacaagcacttcctgaggaaccagcccctgacctttgccctgcagctgcatgaccccagcggctacctggccgaggccgacctgagctacacctgggactttggagacagcagcggcaccctcatcagccgggccctggtggtgacccacacctacctggagcccggccctgtgacagcccaggtggtgctgcaggccgccatccccctgaccagctgtggcagcagccctgtgcccggcaccacagatggccaccggcccacagctgaggcccccaacaccacagctggccaggtgcccaccacagaggtggtgggcaccaccccaggccaggcccccacagctgagcccagcggcaccacctctgtgcaggtgcccaccacagaggtgatcagcacagcccctgtgcagatgcccacagctgagagcacaggcatgaccccagagaaggtgcctgtgtctgaggtgatgggcaccaccctggccgagatgagcaccccagaggccaccggcatgaccccagctgaggtgtccatcgtggtgctgagcggcaccacagctgcccaggtgaccaccacagagtgggtggagaccacagcccgggagctgcccatccctgagcctgagggcccagatgccagcagcatcatgagcacagagagcatcaccggcagcctgggccccctgctggatggaacagccaccctgcggctggtgaagaggcaggtgcccctggactgtgtgctgtaccgctatggcagcttctctgtgaccctggacatcgtgcagggcattgaatctgctgagatcctgcaggccgtgcccagcggggagggagatgcctttgagctgactgtgtcctgccagggcggcctgcccaaggaggcctgcatggagatcagcagccctggctgccagcccccagcccagaggctgtgccagcctgtgctgcccagccctgcctgccagctggtgctgcaccagatcctgaagggcggcagcggcacctactgcctgaatgtgtccctggccgacaccaacagcctggccgtggtgtccacccagctgatcatgcctggccaggaggccggcctgggccaggtgcccctgattgtgggcatcctgctggtgctgatggctgtggtgctggccagcctcatctacagaagaaggctgatgaagcaggacttctctgtgccccagctgccccacagcagcagccactggctgcggctgccccgcatcttctgcagctgccccatcggggagaacagccccctgctgagcggccagcaggtgtag

SEQ ID NO: 8409 - DNA, 516 bp, Artificial Sequence; identical to SEQ ID NO: 8098
  Description of Artificial Sequence: Synthetic coding sequence

SEQ ID NO: 8410 - DNA, 1986 bp, Artificial Sequence; identical to SEQ ID NO: 8408
  Description of Artificial Sequence: Synthetic coding sequence

SEQ ID NO: 8411 - DNA, 1737 bp, Artificial Sequence; identical to SEQ ID NO: 7521
  Description of Artificial Sequence: Synthetic coding sequence

SEQ ID NO: 8412 - DNA, 1326 bp, Artificial Sequence; identical to SEQ ID NO: 7358
  Description of Artificial Sequence: Synthetic coding sequence

SEQ ID NO: 8413 - DNA, 447 bp, Artificial Sequence; identical to SEQ ID NO: 7498
  Description of Artificial Sequence: Synthetic coding sequence

SEQ ID NO: 8414 - DNA, 732 bp, Artificial Sequence; identical to SEQ ID NO: 8058
  Description of Artificial Sequence: Synthetic coding sequence

SEQ ID NO: 8415 - DNA, 732 bp, Artificial Sequence; identical to SEQ ID NO: 8058
  Description of Artificial Sequence: Synthetic coding sequence

SEQ ID NO: 8416 - DNA, 1224 bp, Artificial Sequence
  Description of Artificial Sequence: Synthetic coding sequence
atgaggctgctggcctggctgatcttcctggccaactggggcggggcccgggcagagcccgggaagttctggcacatcgctgacctgcacctggaccctgactacaaggtgtccaaggaccccttccaggtgtgccccagcgctggcagccagcctgtgcctgatgctggcccctggggagactacctgtgtgacagcccctgggccctgatcaacagcagcatctatgccatgaaggagattgagcctgagccagacttcatcctgtggacaggagatgacacccctcatgtgcctgatgagaagctgggggaggccgctgtgctggagatcgtggagcggctgaccaagctgatccgggaggtgtttcctggggccttctactgtgagaagctgcccggccccagcggggccggcagaattgtggtgctgaacaccaacctgtactacaccagcaatgccctgacagctgacatggctgaccccggccagcagttccagtggctggaggatgtgctgacagatgccagcaaggccggggacatggtgtacatcgtgggccacgtgcccccaggcttctttgagaagacccagaacaaggcctggttccgggagggcttcaatgagaagtacctgaaggtggtgaggaagcaccaccgggtgattgctggccagttcttcggccaccaccacacagacagcttcaggatgctgtatgatgatgctggggtgcccatcagcgccatgttcatcaccccaggagtgaccccctggaagaccaccctgcccggggtggtgaatggagccaacaacccagccatccgggtgtttgaatatgaccgggccaccctgagcctgaaggacatggtgacctacttcatgaacctgagccaggccaatgcccagggcaccccccgctgggagctggagtaccagctgacagaggcctatggagtgcctgatgccagcgcccacagcatgcacacagtgctggacagaattgctggggaccagagcaccctgcagcgctactacgtgtacaacagcgtgtcctacagcgctggggtgtgtgatgaggcctgcagcatgcagcacgtgtgtgccatgaggcaggtggacattgatgcctacaccacctgcctgtatgccagcggcaccacccctgtgccccagctgcccctgctgctgatggccctgctgggcctgtgcaccctggtgctgtag

SEQ ID NO: 8417 - DNA, 756 bp, Artificial Sequence; identical to SEQ ID NO: 8396
  Description of Artificial Sequence: Synthetic coding sequence

SEQ ID NO: 8418 - DNA, 756 bp, Artificial Sequence; identical to SEQ ID NO: 8396
  Description of Artificial Sequence: Synthetic coding sequence

SEQ ID NO: 8419 - DNA, 456 bp, Artificial Sequence
  Description of Artificial Sequence: Synthetic coding sequence
atggacctggtgctgaagcgctgcctgctgcacctggccgtgattggagccctgctggccgtgggcgccaccaaggtgcccaggaaccaggactggctgggcgtgtcccggcagctgcggaccaaggcctggaaccggcagctgtacccagagtggacagaggcccagaggctggactgctggaggggcggccaggtgtccctgaaggtgtccaatgatggccccaccctcatcggggccaatgccagcttcagcatcgccctgaacttccctggcagccagaaggtgctgcctgatggccaggtgatctgggtgaacaacaccatcatcaatggcagccaggtgtggggcggccagcctgtgtacccccaggagacagatgatgcctgcatcttcccagatggcggcccctgccccagcggctcctggagccagaagaggagctttgtgtactag

SEQ ID NO: 8420 - DNA, 216 bp, Artificial Sequence; identical to SEQ ID NO: 7542
  Description of Artificial Sequence: Synthetic coding sequence

SEQ ID NO: 8421 - DNA, 447 bp, Artificial Sequence; identical to SEQ ID NO: 7498
  Description of Artificial Sequence: Synthetic coding sequence

SEQ ID NO: 8422 - DNA, 447 bp, Artificial Sequence; identical to SEQ ID NO: 7498
  Description of Artificial Sequence: Synthetic coding sequence

SEQ ID NO: 8423 - DNA, 1326 bp, Artificial Sequence; identical to SEQ ID NO: 7358
  Description of Artificial Sequence: Synthetic coding sequence

SEQ ID NO: 8424 - DNA, 2067 bp, Artificial Sequence; identical to SEQ ID NO: 8067
  Description of Artificial Sequence: Synthetic coding sequence

SEQ ID NO: 8425 - DNA, 1326 bp, Artificial Sequence
  Description of Artificial Sequence: Synthetic coding sequence
atggagtttgaatttgaccggctgcgggccttccaggccatgcaggtgcactgcaacaacatgcacaccctgggcgcccggctgcctggaggagtggagtgccgcttcagaagaggccctgccatggcctgggagggggagcccatgaggcacaacctgggcggcaacctgggggacccccgggcccgggctgtgtctgtgcccctgggcggccgggtggcccgcttcctgcagtgccgcttcctgtttgctggcccctggctgctcttcagcgagatctccttcatcagtgatgtggtgaacaacagcagccctgccctgggcggcaccttccccccagccccctggtggcccccaggccccccacccaccaacttcagcagcctggagctggagccccggggccagcagcctgtggccaaggccgagggcagccccacagccatcctgattggctgcctggtggccatcatcctgctgctgctgctgatcatcgccctgatgctgtggaggctgcactggaggcggctgctgagcaaggtgctggagagccaccccaggaccaggagccctggcctggtgggcatccggcccaccctgctgcctgtgagccccatggccctgcgctgctgcagccccatccagcccacagccagcttctggcccctgacccctgtgcccctggaggcccgggccccaccccaccccccaggccccaacccccccaccccccggggcgtgactggaggcaacacctatgctgtgcctgccctgcccccaggagctgtgggagatggccccccccgggtggacttccccaggagccggctgcgcttcaaggagaagctgggggagggccagtttggagaggtgcacctgtgtgaggtggacagcccccaggacctggtgtccctggacttccccctgaatgtgaggaagggccaccccctgctggtggccgtgaagatcctgcggccagatgccaccaagaatgccagaaatgacttcctgaaggaggtgaagatcatgagccggctgaaggaccccaacatcatccggctgctgggcgtgtgtgtgcaggatgaccccctgtgcatgatcacagactacatggagaatggagacctgaaccagttcctgagcgcccaccagctggaggacaaggctgctgagggcgcccctggagatggccaggccgcccagggccccaccatctcctaccccatgctgctgcacgtggccgcccagatcgccagcggcatgagatacctggccaccctgaactttgtgcacttctggggcgagcggcaccgcttcctgcactag

SEQ ID NO: 8426 - DNA, 2559 bp, Artificial Sequence; identical to SEQ ID NO: 7494
  Description of Artificial Sequence: Synthetic coding sequence

SEQ ID NO: 8427 - DNA, 732 bp, Artificial Sequence; identical to SEQ ID NO: 8058
  Description of Artificial Sequence: Synthetic coding sequence

SEQ ID NO: 8428 - DNA, 2760 bp, Artificial Sequence; identical to SEQ ID NO: 7514
  Description of Artificial Sequence: Synthetic coding sequence

SEQ ID NO: 8429 - DNA, 2700 bp, Artificial Sequence; identical to SEQ ID NO: 7525
  Description of Artificial Sequence: Synthetic coding sequence

SEQ ID NO: 8430 - DNA, 447 bp, Artificial Sequence; identical to SEQ ID NO: 7498
  Description of Artificial Sequence: Synthetic coding sequence

SEQ ID NO: 8431 - DNA, 516 bp, Artificial Sequence; identical to SEQ ID NO: 8098
  Description of Artificial Sequence: Synthetic coding sequence

SEQ ID NO: 8432 - DNA, 666 bp, Artificial Sequence
  Description of Artificial Sequence: Synthetic coding sequence
atgaccacccagctgcgggtggtgcacctgctgcccctgctgctggcctgctttgtgcagaccagccccaagcaggagaagatgaagatggactgccacaaggatgagaagggcaccatctatgactatgaggccatcgccctgaacaagaatgaatatgtgtccttcaagcagtatgtgggcaagcacatcctgtttgtgaatgtggccacctactgcggcctgacagcccagtacccagagctgaatgccctgcaggaggagctgaagccctacggcctggtggtgctgggcttcccctgcaaccagtttgggaagcaggagcccggggacaacaaggagatcctgcccggcctgaagtatgtgcggcctgggggcggctttgtgcccagcttccagctgtttgagaagggagatgtgaatggagagaaggagcagaaggtgttctccttcctgaagcacagctgcccccaccccagcgagatcctgggcaccttcaagagcatctcctgggaccctgtgaaggtgcatgacatccgctggaactttgagaagttcctggtgggcccagatggcatccctgtgatgcgctggagccaccgggccaccgtgtcctctgtgaagacagacatcctggcctacctgaagcagttcaagaccaagtag

SEQ ID NO: 8433 - DNA, 447 bp, Artificial Sequence; identical to SEQ ID NO: 7498
  Description of Artificial Sequence: Synthetic coding sequence

SEQ ID NO: 8434 - DNA, 1737 bp, Artificial Sequence; identical to SEQ ID NO: 7521
  Description of Artificial Sequence: Synthetic coding sequence

SEQ ID NO: 8435 - DNA, 1737 bp, Artificial Sequence; identical to SEQ ID NO: 7521
  Description of Artificial Sequence: Synthetic coding sequence

SEQ ID NO: 8436 - DNA, 756 bp, Artificial Sequence; identical to SEQ ID NO: 8396
  Description of Artificial Sequence: Synthetic coding sequence

SEQ ID NO: 8437 - DNA, 1764 bp, Artificial Sequence
  Description of Artificial Sequence: Synthetic coding sequence
atgaggccccggggcctgccccccctgctggtggtgctgctgggctgctgggcctctgtgtctgcccagacagatgccaccccagctgtgaccacagagggcctgaacagcacagaggccgccctggccaccttcggcaccttccccagcaccaggcctcctggcaccccccgggcccctggccccagcagcggcccccggcccacccctgtgacagatgtggccgtgctgtgtgtgtgtgacctgagccctgcccagtgtgacatcaactgctgctgtgaccctgactgcagctctgtggacttctctgtgttcagcgcctgcagcgtgcctgtggtgactggagacagccagttctgcagccagaaggccgtcatctacagcctgaacttcaccgccaaccccccccagagggtgtttgagctggtggaccagatcaaccccagcatcttctgcatccacatcaccaactacaagccagccctgtccttcatcaaccctgaggtgcctgatgagaacaactttgacaccctgatgaagaccagtgatggcttcaccctgaatgctgagagctatgtgtccttcaccaccaagctggacatccccacagctgccaagtatgaatatggagtgcccctgcagaccagtgacagcttcctgcgcttccccagcagcctgaccagcagcctgtgcacagacaacaacccagctgccttcctggtgaaccaggccgtgaagtgcaccaggaagatcaacctggagcagtgtgaggagattgaggccctgtccatggccttctacagcagccctgagatcctgcgggtgcctgacagcaggaagaaggtgcccatcaccgtgcagagcatcgtcatccagagcctgaacaagaccctgacccggcgggaggacacagatgtgctgcagcccaccctggtgaatgccggccacttcagcctgtgtgtgaatgtggtgctggaggtgaagtacagcctgacctacacagatgctggggaggtgaccaaggctgacctgagctttgtgctgggcaccgtgtcctctgtggtggtgcccctgcagcagaagtttgagatccacttcctgcaggagaacacccagcctgtgcccctgagcggcaaccctggctacgtggtgggcctgcccctggccgccggcttccagccccacaagggcagcggcatcatccagaccaccaacagatatggccagctgaccatcctgcacagcaccacagagcaggactgcctggccctggagggcgtgaggacccctgtgctgtttggctacaccatgcagagcggctgcaagctgcggctgaccggggccctgccctgccagctggtggcccagaaggtgaagagcctgctgtggggccagggcttcccagactatgtggcccccttcggcaacagccaggcccaggacatgctggactgggtgcccatccacttcatcacccagagcttcaacaggaaggacagctgccagctgcccggggccctggtgattgaggtgaagtggaccaagtatggcagcctgctgaacccccaggccaagatcgtgaatgtgacagccaacctgatcagcagcagcttccctgaggccaacagcggaaatgaaagaaccatcctgatcagcacagctgtgacctttgtggatgtgtctgccccagctgaggccggcttccgggcccccccagccatcaatgcccggctgcccttcaacttcttcttcccctttgtgtag

SEQ ID NO: 8438 - DNA, 2067 bp, Artificial Sequence; identical to SEQ ID NO: 8067
  Description of Artificial Sequence: Synthetic coding sequence

SEQ ID NO: 8439 - DNA, 303 bp, Artificial Sequence
  Description of Artificial Sequence: Synthetic coding sequence
atgaccacccagctgcgggtggtgcacctgctgcccctgctgctggcctgctttgtgcagaccagccccaagcaggagaagatgaagatggactgccacaaggatgagaagggcaccatctatgactatgaggccatcgccctgaacaagaatgaatatgtgtccttcaagcagtatgtgggcaagcacatcctgtttgtgaatgtggccacctactgcggcctgacagcccagtacccaggcatgtctgtgcagggagaagatctctacctggtgagcagcttcctgaggaagggcatgtag

SEQ ID NO: 8440 - DNA, 705 bp, Artificial Sequence
  Description of Artificial Sequence: Synthetic coding sequence
atgaagaccctggccggcctggtgctgggcctggtgatctttgatgctgctgtgacagcccccaccctggagagcatcaactatgacagcgagacctatgatgccaccctggaggacctggacaacctgtacaactatgagaacatccctgtggacaaggtggagattgagatcgccaccgtgatgcccagcggcaaccgggagctgctgaccccaccaccccagcctgagaaggcccaggaggaggaggaggaggaggagagcaccccccggctgattgatggcagcagcccccaggagcctgagttcaccggggtgctgggcccccacaccaatgaagacttccccacctgcctgctgtgcacctgcatcagcaccaccgtgtactgtgatgaccacgagctggatgccatcccccccctgcccaagaacacagcctacttctacagccgcttcaaccgcatcaagaagatcaacaagaatgactttgccagcctgagtgacctgaagagaattgacctgaccagcaacctgatcagcgagattgatgaagatgccttcaggaagctgccccagctgcgggagctggtgctgcgggacaacaagatccggcagctgcctgagctgcccaccaccctgaccttcatcgacatcagcaacaaccggctgggcaggaagggcatcaagcaggaggccttcaagtag

SEQ ID NO: 8441 - DNA, 2559 bp, Artificial Sequence; identical to SEQ ID NO: 7494
  Description of Artificial Sequence: Synthetic coding sequence

SEQ ID NO: 8442 - DNA, 2760 bp, Artificial Sequence; identical to SEQ ID NO: 7514
  Description of Artificial Sequence: Synthetic coding sequence

SEQ ID NO: 8443 - DNA, 1737 bp, Artificial Sequence; identical to SEQ ID NO: 7521
  Description of Artificial Sequence: Synthetic coding sequence

SEQ ID NO: 8444 - DNA, 516 bp, Artificial Sequence; identical to SEQ ID NO: 8098
  Description of Artificial Sequence: Synthetic coding sequence

SEQ ID NO: 8445 - DNA, 2067 bp, Artificial Sequence; identical to SEQ ID NO: 8067
  Description of Artificial Sequence: Synthetic coding sequence

SEQ ID NO: 8446 - DNA, 5097 bp, Artificial Sequence; identical to SEQ ID NO: 8407
  Description of Artificial Sequence: Synthetic coding sequence

SEQ ID NO: 8447 - DNA, 726 bp, Artificial Sequence; identical to SEQ ID NO: 8397
  Description of Artificial Sequence: Synthetic coding sequence

SEQ ID NO: 8448 - DNA, 732 bp, Artificial Sequence; identical to SEQ ID NO: 8058
  Description of Artificial Sequence: Synthetic coding sequence

SEQ ID NO: 8449 - DNA, 1986 bp, Artificial Sequence; identical to SEQ ID NO: 8408
  Description of Artificial Sequence: Synthetic coding sequence

SEQ ID NO: 8450 - DNA, 2760 bp, Artificial Sequence; identical to SEQ ID NO: 7514
  Description of Artificial Sequence: Synthetic coding sequence

SEQ ID NO: 8451 - DNA, 216 bp, Artificial Sequence; identical to SEQ ID NO: 7542
  Description of Artificial Sequence: Synthetic coding sequence

SEQ ID NO: 8452 - DNA, 2685 bp, Artificial Sequence; identical to SEQ ID NO: 8214
  Description of Artificial Sequence: Synthetic coding sequence

SEQ ID NO: 8453 - DNA, 273 bp, Artificial Sequence
  Description of Artificial Sequence: Synthetic coding sequence
atgcagctgttcctgctgctgtgcctggtgctgctgagcccccagggcgccagcctgcaccgccaccacccccgggagatgaagaagagggtggaggacctgcacgtgggcgccaccgtggcccccagcagcagaagagacttcacctttgacctgtaccgggccctggccagcgctgcccccagccagagcatcttcttcagccctgtgtccatctccatgagcctggccatgctgagcctgggcgccggcagcagcaccaagatgcagtag

SEQ ID NO: 8454 - DNA, 618 bp, Artificial Sequence; identical to SEQ ID NO: 7228
  Description of Artificial Sequence: Synthetic coding sequence

SEQ ID NO: 8455 - DNA, 30 bp, Artificial Sequence
  Description of Artificial Sequence: Synthetic coding sequence
atgtccttcagcgccaccatcctcttctag

SEQ ID NO: 8456 - DNA, 600 bp, Artificial Sequence
  Description of Artificial Sequence: Synthetic coding sequence
atgtccttcagcgccaccatcctcttcagccccccatctggcagcgaggcccgctgctgctgctgtgcctgcaagtctgagaccaatggaggcaacacaggcagccagggcggcaaccccccacccagcacccccatcaccgtgactggacatggcctggccgtgcagagcagcgagcagctgctgcacgtgatctaccagagggtggacaaggctgtgggcctggccgaggccgccctgggcctggcccgggccaacaatgagctgctgaagaggctgcaggaggaggtgggggacctgcggcagggcaaggtgtccatcccagatgaagatggagagagccgggcccacagcagccccccagaggagcccggccccctgaaggagagccctggagaggccttcaaggccctgtctgctgtggaggaggagtgtgacagcgtgggcagcggcgtgcaggtggtgattgaggagctgcggcagctgggcgccgcctctgtgggccctggccccctgggcttccctgccacccagagggacatgaggctgcccggctgcaccctggccgccagcgaggccgcccccctgctgaacccctag

SEQ ID NO: 8457 - DNA, 633 bp, Artificial Sequence; identical to SEQ ID NO: 7785
  Description of Artificial Sequence: Synthetic coding sequence

SEQ ID NO: 8458 - DNA, 1221 bp, Artificial Sequence; identical to SEQ ID NO: 7163
  Description of Artificial Sequence: Synthetic coding sequence

SEQ ID NO: 8459 - DNA, 600 bp, Artificial Sequence; identical to SEQ ID NO: 7206
  Description of Artificial Sequence: Synthetic coding sequence

SEQ ID NO: 8460 - DNA, 411 bp, Artificial Sequence
  Description of Artificial Sequence: Synthetic coding sequence
atgtccttcagcgccaccatcctcttcagccccccatctggcagcgaggcccgctgctgctgctgtgcctgcaagtctgagaccaatggaggcaacacaggcagccagggcggcaaccccccacccagcacccccatcaccgtgactggacatggcctggccgtgcagagcagcgagcagctgctgcacgtgatctaccagagggtggacaaggctgtgggcctggccgaggccgccctgggcctggcccgggccaacaatgagctgctgaagaggctgcaggaggaggtgggggacctgcggcagggcaaggtgtccatcccagatgaagatggagagagccgggcccacagcagccccccagaggagcccggccccctgaaggagagccctggagaggccttcaagtag

SEQ ID NO: 8461 - DNA, 252 bp, Artificial Sequence
  Description of Artificial Sequence: Synthetic coding sequence
atgtccttcagcgccaccatcctcttcagccccccatctggcagcgaggcccgctgctgctgctgtgcctgcaagtctgagaccaatggaggcaacacaggcagccagggcggcaaccccccacccagcacccccatcaccgtgactggacatggcctggccgtgcagagcagcgagcagctgctgcacgtgatctaccagagggtggacaaggctgtgggcctggccgaggccgccctgggcctggcctag

SEQ ID NO: 8462 - DNA, 30 bp, Artificial Sequence; identical to SEQ ID NO: 8455
  Description of Artificial Sequence: Synthetic coding sequence

SEQ ID NO: 8463 - DNA, 519 bp, Artificial Sequence
  Description of Artificial Sequence: Synthetic coding sequence
atgcagctgttcctgctgctgtgcctggtgctgctgagcccccagggcgccagcctgcaccgccaccacccccgggagatgaagaagagggtggaggacctgcacgtgggcgccaccgtggcccccagcagcagaagagacttcacctttgacctgtaccgggccctggccagcgctgcccccagccagagcatcttcttcagccctgtgtccatctccatgagcctggccatgctgagcctgggcgccggcagcagcaccaagatgcagatcctggagggcctgggcctgaacctgcagaagagcagcgagaaggagctgcaccggggcttccagcagctgctgcaggagctgaaccagcccagagatggcttccagctgagcctgggcaatgccctcttcacagacctggtggtggacctgcaggacacctttgtgtctgccatgaagaccctgtacctggccgacaccttccccaccaacttccgggacagcgctggggccatgaagcagatctag

SEQ ID NO: 8464 - DNA, 615 bp, Artificial Sequence
  Description of Artificial Sequence: Synthetic coding sequence
atgcctgggggcaagaaggtggccggcggcggcagcagcggggccacccccaccagcgctgctgccacagcccccagcggcgtgcggcggctggagaccagcgagggcaccagcgcccagagagatgaggagcctgaggaggagggggaggaggacctgagagatggaggagtgcccttctttgtgaacagaggaggcctgcctgtggatgaggccacctgggagaggatgtggaagcacgtggccaagatccacccagatggagagaaggtggcccagaggatccggggggccacagacctgcccaagatccccatccccagcgtgcccaccttccagcccagcacccctgtgcctgagcggctggaggccgtgcagcgctacatccgggagctgcagtacaaccacacaggcacccagttctttgagatcaagaagagccggcccctgaccggcctgatggacctggccaaggagatgaccaaggaggccctgcccatcaagtgcctggaggccgtcatcctgggcatgtaccccagcagccctgagggggagggcagcggcctgctgtgggccagcgccagctgcagcgagagcgagggcggcgtgggctag

SEQ ID NO: 8465 - DNA, 1221 bp, Artificial Sequence; identical to SEQ ID NO: 7163
  Description of Artificial Sequence: Synthetic coding sequence

SEQ ID NO: 8466 - DNA, 3837 bp, Artificial Sequence; identical to SEQ ID NO: 7920
  Description of Artificial Sequence: Synthetic coding sequence

SEQ ID NO: 8467 - DNA, 261 bp, Artificial Sequence
  Description of Artificial Sequence: Synthetic coding sequence
atgcagctgttcctgctgctgtgcctggtgctgctgagcccccagggcgccagcctgcaccgccaccacccccgggagatgaagaagagggtggaggacctgcacgtgggcgccaccgtggcccccagcagcagaagagacttcacctttgacctgtaccgggccctggccagcgctgcccccagccagagcatcttcttcagccctgtgtccatctccatgagcctggccatgctgagcctgggcgccggcagcagctag

SEQ ID NO: 8468 - DNA, 906 bp, Artificial Sequence
  Description of Artificial Sequence: Synthetic coding sequence
atgcagctgttcctgctgctgtgcctggtgctgctgagcccccagggcgccagcctgcaccgccaccacccccgggagatgaagaagagggtggaggacctgcacgtgggcgccaccgtggcccccagcagcagaagagacttcacctttgacctgtaccgggccctggccagcgctgcccccagccagagcatcttcttcagccctgtgtccatctccatgagcctggccatgctgagcctgggcgccggcagcagcaccaagatgcagatcctggagggcctgggcctgaacctgcagaagagcagcgagaaggagctgcaccggggcttccagcagctgctgcaggagctgaaccagcccagagatggcttccagctgagcctgggcaatgccctcttcacagacctggtggtggacctgcaggacacctttgtgtctgccatgaagaccctgtacctggccgacaccttccccaccaacttccgggacagcgctggggccatgaagcagatcaatgactatgtggccaagcagaccaagggcaagatcgtggacctgctgaagaacctggacagcaatgctgtggtgatcatggtgaactacatcttcttcaaggccaagtgggagaccagcttcaaccacaagggcacccaggagcaggacttctacgtgaccagcgagaccgtggtgcgggtgcccatgatgagccgggaggaccagtaccactacctgctggacaggaacctgagctgccgggtggtgggcgtgccctaccagggcaatgccacagccctcttcatcctgcccagcgagggcaagatgcagcaggtggagaatggcctgtctgagaagaccctgaggaagtggctgaagatgttcaagaagcgctacttccagacctag

SEQ ID NO: 8469 - DNA, 411 bp, Artificial Sequence
  Description of Artificial Sequence: Synthetic coding sequence
atggagaccttccccctgctgctgctgagcctgggcctggtgctggccgaggccagcgagagcaccatgaagatcatcaaggaggagttcacagatgaggagatgcagtatgacatggccaagagcggccaggagaagcagaccatcgagatcctgatgaaccccatcctgctggtgaagaacaccagcctgtccatgagcaaggatgacatgagcagcaccctgctgaccttccgcagcctgcactacaatgaccccaagggcaacagcagtggaaatgacaaggagtgctgcaatgacatgacagtgtggaggaaggtgtctgaggccaacggcagctgcaagtggagcaacaacttcatccgcagcagcacagaggtgatgagaagagtgcaccgggcccccagctag

SEQ ID NO: 8470 - DNA, 1221 bp, Artificial Sequence; identical to SEQ ID NO: 7163
  Description of Artificial Sequence: Synthetic coding sequence

SEQ ID NO: 8471 - DNA, 618 bp, Artificial Sequence; identical to SEQ ID NO: 7228
  Description of Artificial Sequence: Synthetic coding sequence

SEQ ID NO: 8472 - DNA, 240 bp, Artificial Sequence
  Description of Artificial Sequence: Synthetic coding sequence
atgtccttcagcgccaccatcctcttcagccccccatctggcagcgaggcccgctgctgctgctgtgcctgcaagtctgagaccaatggaggcaacacaggcagccagggcggcaaccccccacccagcacccccatcaccgtgactggacatggcctggccgtgcagagcagcgagcagctgctgcacgtgatctaccagagggtggacaaggctgtgggcctggccgaggccgcctag

SEQ ID NO: 8473 - DNA, 618 bp, Artificial Sequence; identical to SEQ ID NO: 7228
  Description of Artificial Sequence: Synthetic coding sequence

SEQ ID NO: 8474 - DNA, 3789 bp, Artificial Sequence
  Description of Artificial Sequence: Synthetic coding sequence
atgaggctgctgctgctggtgcccctgctgctggccccagcccctggcagcagcgcccccaaggtgcggcggcagagcgacacctggggcccctggagccagtggagcccctgcagcaggacctgtggcggcggcgtgtccttccgggagcggccctgctacagccagaggagagatggcggcagcagctgtgtgggccctgcccggagccacaggagctgcaggacagagagctgcccagatggagcccgggacttccgggcagagcagtgtgccgagtttgatggagctgagttccagggccgccgctaccgctggctgccctactacagcgcccccaacaagtgtgagctgaactgcatccccaagggggagaacttctactacaagcaccgggaggccgtggtggatggcaccccctgtgagcccgggaagagagatgtgtgtgtggatggcagctgccgggtggtgggctgtgaccacgagctggacagcagcaagcaggaggacaagtgcctgcgctgtggaggagatggcaccacctgctaccctgtggccggcacctttgatgccaatgacctgagccggggctacaaccagatcctgattgtgcccatgggcgccaccagcatcctgattgatgaggccgccgccagcaggaacttcctggccgtgaagaatgtgcggggggagtactacctgaatggccactggaccatcgaggccgcccgggccctgcctgctgccagcaccatcctgcactatgaaagaggagctgagggggacctggcccctgagcggctgcacgcccggggccccaccagcgagcccctggtgattgagctgatcagccaggagcccaaccctggggtgcactatgagtaccacctgcccctgcggcggcccagccctggcttctcctggagccacggctcctggagcgactgcagcgcagaatgtggcggcggccaccagagccggctggtgttctgcaccatcgaccacgaggcctacccagaccacatgtgccagaggcagcccaggcctgctgaccggcgcagctgcaacctgcacccctgcccagagaccaagcgctggaaggccggcccctgggccccctgcagcgccagctgtggcggcggcagccagagccgctctgtgtactgcatcagcagtgatggagctggcatccaggaggccgtggaggaggctgaatgtgccggcctgcccgggaagcccccagccatccaggcctgcaacctgcagagatgtgccgcctggagccctgagccctggggcgagtgcagcgtgtcctgtggggtgggcgtgaggaagaggtctgtgacctgccgcggggagcggggcagcctgctgcacacagctgcctgcagcctggaggacaggcctcccctgacagagccctgtgtgcatgaggactgccccctgctgagtgaccaggcctggcacgtgggcacctggggcctgtgcagcaagagctgcagcagcggcacccggcggcggcaggtgatctgtgccatcggcccccccagccactgcggcagcctgcagcacagcaagcctgtggatgtggagccctgcaacacccagccctgccacctgccccaggaggtgcccagcatgcaggatgtgcacaccccagccagcaacccctggatgcccctgggcccccaggagagccctgccagtgacagccggggccagtggtgggccgcccaggagcaccccagcgcccggggggaccacagaggagagcggggggaccccaggggggaccagggcacccacctgagcgccctgggccctgcccccagcctgcagcagcccccctaccagcagcccctgcggagcggcagcggcccccatgactgccgccacagcccccacggctgctgcccagatggccacacagccagcctgggcccccagtggcagggctgccctggggccccctgccagcagagccgctatggctgctgcccagacagagtgtctgtggccgagggcccccaccacgccggctgcaccaagagctatggaggagacagcactggaggcatgcccaggagcagagctgtggccagcacagtgcacaacacccaccagccccaggcccagcagaatgagcccagcgagtgccggggcagccagtttggctgctgctatgacaacgtggccacagctgctggccccctgggggagggctgtgtgggccagcccagccatgactgggccgcccgctggtactttgtggcctctgtgggccagtgcaaccgcttctggtacggcggctgccacggcaatgccaacaactttgccagcgagcaggagtgcatgagcagctgccagggcagcctgcacggcccccggcggccccagcccggggccagcggccgcagcacccacacagatggcggcggcagcagccctgctggggagcaggagcccagccagcacaggactggagctgctgtgcagaggaagccctggcccagcggcggcctgtggaggcaggaccagcagcccggccctggagaggccccccacacccaggcctttggagagtggccctggggccaggagctgggcagccgggcccctggcctgggcggagatgctggcagccctgccccacccttccacagcagcagctaccgcatcagcctggccggcgtggagcccagcctggtgcaggccgccctgggccagctggtgcggctgagctgcagtgatgacacagcccctgagagccaggccgcctggcagaaggatggccagcccatcagcagtgacagacaccggctgcagtttgatggcagcctcatcatccaccccctgcaggctgaagatgctggcacctacagctgtggcagcaccaggcctggccgggacagccagaagatccagctgcgcatcattggaggagacatggctgtgctgtctgaggccgagctgagccgcttcccccagccccgggaccctgcccaggactttggccaggccggggccgccggccccctgggcgccatccccagcagccacccccagcctgccaaccggctgcggctggaccagaaccagccccgggtggtggatgccagccctggccagaggatccgcatgacctgcagagctgagggcttccccccaccagccatcgagtggcagagagatggccagcctgtgagcagccccaggcaccagctgcagccagatggcagcctggtgatcagccgggtggccgtggaggatggcggcttctacacctgtgtggccttcaacggccaggaccgggaccagcgctgggtgcagctgcgggtgctgggggagctgaccatcagcggcctgcccccaacagtgacagtgcctgagggggacacagcccggctgctgtgtgtggtggccggggagagcgtgaacatccgctggagcagaaatggcctgcctgtgcaggctgatggccaccgggtgcaccagagcccagatggcaccctgctgatctacaacctgcgggccagagatgagggcagctacacctgcagcgcctaccagggcagccaggccgtgagccgcagcacagaggtgaaggtggtgtccccagcccccacagcccagccccgggaccccggccgggactgtgtggaccagcctgagctggccaactgtgacctgatcctgcaggcccagctgtgtggaaatgagtactacagcagcttctgctgtgccagctgcagccgcttccagccccacgcccagcccatctggcagtag

SEQ ID NO: 8475 - DNA, 321 bp, Artificial Sequence
  Description of Artificial Sequence: Synthetic coding sequence
atgtccttcagcgccaccatcctcttcagccccccatctggcagcgaggcccgctgctgctgctgtgcctgcaagtctgagaccaatggaggcaacacaggcagccagggcggcaaccccccacccagcacccccatcaccgtgactggacatggcctggccgtgcagagcagcgagcagctgctgcacgtgatctaccagagggtggacaaggctgtgggcctggccgaggccgccctgggcctggcccgggccaacaatgagctgctgaagaggctgcaggaggaggtgggggacctgcggcagggcaaggtgtcctag

SEQ ID NO: 8476 - DNA, 444 bp, Artificial Sequence; identical to SEQ ID NO: 7729
  Description of Artificial Sequence: Synthetic coding sequence

SEQ ID NO: 8477 - DNA, 435 bp, Artificial Sequence
  Description of Artificial Sequence: Synthetic coding sequence
atgcagctgttcctgctgctgtgcctggtgctgctgagcccccagggcgccagcctgcaccgccaccacccccgggagatgaagaagagggtggaggacctgcacgtgggcgccaccgtggcccccagcagcagaagagacttcacctttgacctgtaccgggccctggccagcgctgcccccagccagagcatcttcttcagccctgtgtccatctccatgagcctggccatgctgagcctgggcgccggcagcagcaccaagatgcagatcctggagggcctgggcctgaacctgcagaagagcagcgagaaggagctgcaccggggcttccagcagctgctgcaggagctgaaccagcccagagatggcttccagctgagcctgggcaatgccctcttcacagacctggtggtggacctgcaggacacctag

SEQ ID NO: 8478 - DNA, 540 bp, Artificial Sequence; identical to SEQ ID NO: 8200
  Description of Artificial Sequence: Synthetic coding sequence

SEQ ID NO: 8479 - DNA, 444 bp, Artificial Sequence; identical to SEQ ID NO: 7729
  Description of Artificial Sequence: Synthetic coding sequence

SEQ ID NO: 8480 - DNA, 600 bp, Artificial Sequence; identical to SEQ ID NO: 7206
  Description of Artificial Sequence: Synthetic coding sequence

SEQ ID NO: 8481 - DNA, 153 bp, Artificial Sequence
  Description of Artificial Sequence: Synthetic coding sequence
atgtccttcagcgccaccatcctcttcagccccccatctggcagcgaggcccgctgctgctgctgtgcctgcaagtctgagaccaatggaggcaacacaggcagccagggcggcaaccccccacccagcacccccatcaccgtgactggatag

SEQ ID NO: 8482 - DNA, 75 bp, Artificial Sequence
  Description of Artificial Sequence: Synthetic coding sequence
atgcagctgttcctgctgctgtgcctggtgctgctgagcccccagggcgccagcctgcaccgccaccacccctag

SEQ ID NO: 8483 - DNA, 633 bp, Artificial Sequence; identical to SEQ ID NO: 7785
  Description of Artificial Sequence: Synthetic coding sequence

SEQ ID NO: 8484 - DNA, 36 bp, Artificial Sequence
  Description of Artificial Sequence: Synthetic coding sequence
atgtccttcagcgccaccatcctcttcagcccctag

SEQ ID NO: 8485 - DNA, 444 bp, Artificial Sequence; identical to SEQ ID NO: 7609
  Description of Artificial Sequence: Synthetic coding sequence

SEQ ID NO: 8486 - DNA, 696 bp, Artificial Sequence
  Description of Artificial Sequence: Synthetic coding sequence
atgcagctgttcctgctgctgtgcctggtgctgctgagcccccagggcgccagcctgcaccgccaccacccccgggagatgaagaagagggtggaggacctgcacgtgggcgccaccgtggcccccagcagcagaagagacttcacctttgacctgtaccgggccctggccagcgctgcccccagccagagcatcttcttcagccctgtgtccatctccatgagcctggccatgctgagcctgggcgccggcagcagcaccaagatgcagatcctggagggcctgggcctgaacctgcagaagagcagcgagaaggagctgcaccggggcttccagcagctgctgcaggagctgaaccagcccagagatggcttccagctgagcctgggcaatgccctcttcacagacctggtggtggacctgcaggacacctttgtgtctgccatgaagaccctgtacctggccgacaccttccccaccaacttccgggacagcgctggggccatgaagcagatcaatgactatgtggccaagcagaccaagggcaagatcgtggacctgctgaagaacctggacagcaatgctgtggtgatcatggtgaactacatcttcttcaaggccaagtgggagaccagcttcaaccacaagggcacccaggagcaggacttctacgtgaccagcgagaccgtggtgtag

SEQ ID NO: 8487 - DNA, 1626 bp, Artificial Sequence
  Description of Artificial Sequence: Synthetic coding sequence
atggccaagtttggagtgcaccgcatcctgctgctggccatcagcctgaccaagtgcctggagagcaccaagctgctggccgacctgaagaagtgtggggacctggagtgtgaggccctgatcaacagagtgtctgccatgagggactaccggggccctgactgccgctacctgaacttcaccaagggggaggagatctctgtgtatgtgaagctggccggggagcgggaggacctgtgggccggcaagggcaaggagtttggctacttccccagagatgctgtgcagatcgaggaggtgttcatcagcgaggagatccagatgagcaccaaggagagtgacttcctgtgcctgctgggcgtgtcctacacctttgacaatgaagacagcgagctgaatggagactatggagagaacatctacccctatgaggaggacaaggatgagaagagcagcatctatgaaagtgacttccagatcgagcccggcttctacgccacctatgagagcaccctgtttgaggaccaggtgcctgccctggaggcccctgaggacatcggcagcaccagcgagagcaaggactgggaggaggtggtggtggagagcatggagcaggaccgcatccctgaggtgcacgtgccccccagcagcgctgtgtctggagtgaaggagtggtttggcctgggcggggagcaggccgaggagaaggcctttgagagcgtcatcgagcctgtgcaggagagcagcttccgcagcaggaagattgctgtggaggatgaaaatgacctggaggagctgaacaacggggagccccagacagagcaccagcaggagagcgagagcgagattgattctgtgcccaagacccagagcgagctggccagcgagagcgagcacatccccaagccccagagcacaggctggtttggaggcggcttcaccagctacctgggctttggagatgaggacaccggcctggagctgattgctgaggagagcaacccccccctgcaggacttccccaacagcatcagcagtgacaaggaggccaccgtgccctgcacagagatcctgacagagaagaaggacaccatcaccaatgacagcctgagcctgaagcccagctggtttgattttggatttgccatcctgggctttgcctatgccaaggaggacaagatcatgctggatgacaggaagaatgaagaagatggcggcgcagatgagcacgagcaccccctgaccagcgagctggaccctgagaaggagcaggagattgagaccatcaagatcatcgagacagaggaccagattgacaagaagcctgtgtctgagaagacagatgaaagtgacaccatcccctacctgaagaagttcctgtacaactttgacaacccctggaacttccagaacatccccaaggagacagagctgcccttccccaagcagatcctggaccagaacaacgtgattgaaaatgaggagaccggggagttcagcattgacaactaccccacagacaacaccaaggtgatgatcttcaagagcagctacagcctgagcggctggtatgagaacatctacatccgcatctacttcatcttcaagcacaacctcttcctgtag

SEQ ID NO: 8488 - DNA, 1245 bp, Artificial Sequence; identical to SEQ ID NO: 7247
  Description of Artificial Sequence: Synthetic coding sequence

SEQ ID NO: 8489 - DNA, 618 bp, Artificial Sequence; identical to SEQ ID NO: 7228
  Description of Artificial Sequence: Synthetic coding sequence

SEQ ID NO: 8490 - DNA, 516 bp, Artificial Sequence
  Description of Artificial Sequence: Synthetic coding sequence
atggagaccttccccctgctgctgctgagcctgggcctggtgctggccgaggccagcgagagcaccatgaagatcatcaaggaggagttcacagatgaggagatgcagtatgacatggccaagagcggccaggagaagcagaccatcgagatcctgatgaaccccatcctgctggtgaagaacaccagcctgtccatgagcaaggatgacatgagcagcaccctgctgaccttccgcagcctgcactacaatgaccccaagggcaacagcagtggaaatgacaaggagtgctgcaatgacatgacagtgtggaggaaggtgtctgaggccaacggcagctgcaagtggagcaacaacttcatccgcagcagcacagaggtgatgagaagagtgcaccgggcccccagctgcaagtttgtgcagaaccctggcatcagctgctgtgagagcctggagctggagaacacagtgtgccagttcaccaccgggaagcagttcccccgctgccagtactag

SEQ ID NO: 8491 - DNA, 633 bp, Artificial Sequence; identical to SEQ ID NO: 7785
  Description of Artificial Sequence: Synthetic coding sequence

SEQ ID NO: 8492 - DNA, 537 bp, Artificial Sequence; identical to SEQ ID NO: 8033
  Description of Artificial Sequence: Synthetic coding sequence

SEQ ID NO: 8493 - DNA, 474 bp, Artificial Sequence
  Description of Artificial Sequence: Synthetic coding sequence
atgcagctgttcctgctgctgtgcctggtgctgctgagcccccagggcgccagcctgcaccgccaccacccccgggagatgaagaagagggtggaggacctgcacgtgggcgccaccgtggcccccagcagcagaagagacttcacctttgacctgtaccgggccctggccagcgctgcccccagccagagcatcttcttcagccctgtgtccatctccatgagcctggccatgctgagcctgggcgccggcagcagcaccaagatgcagatcctggagggcctgggcctgaacctgcagaagagcagcgagaaggagctgcaccggggcttccagcagctgctgcaggagctgaaccagcccagagatggcttccagctgagcctgggcaatgccctcttcacagacctggtggtggacctgcaggacacctttgtgtctgccatgaagaccctgtacctggccgacacctag

SEQ ID NO: 8494 - DNA, 1035 bp, Artificial Sequence
  Description of Artificial Sequence: Synthetic coding sequence
atgccacccaggatgctggtggcccccctgcccctgcacttcctgctggccgctgtgtcctctgagaacagaagtggaagacggcagtggcagcaggccgtggccgccggcagcggccctggcaggaacagcagccgggccatccactggagcctgccccgggccctggtgcctgccaccggcacccgggccagcggcagccagaagaggcagaggcctcccaagggccaggaggccctgtggagccggccccacagccgccacagcgctgagagagctgggggcagccacagcgaccccggccgcctgagcgcccccctgggcctgggcctgcccagcggccggggccgcctgacagccatgcctggccgggcccccctgaggacagtgcctggggccctgggcgcctggctgctgggcggcctgtgggcctggaccctgtgtggcctgtgcagcctgggcgctgtgggcgccccccggccctgccaggccccccagcagtgggagggccggcaggtgatgtaccagcagagcagtggaagaaacagccgggccctgctgtcctatgatggcctgaaccagagggtgcgggtgctggatgagaggaaggccctgatcccctgcaagaggctgtttgagtacatcctgctgtacaaggatggagtgatgttccagattgaccaggccaccaagcagtgcagcaagatgaccctgacccagccctgggaccccctggacatcccccagaacagcacctttgaggaccagtacagcattggaggcccccaggagcagatcaccgtgcaggagtggagcgacaggaagagcgcccggagctatgagacctggattggcatctacacagtgaaggactgctaccctgtgcaggagaccttcaccatcaactacagcgtcatcctgagcacccgcttctttgacatccagctgggcatcaaggaccccagcgtcttcaccccacccagcacctgccagatggcccagctggagaagatgtctgaggactgctcctggtag

SEQ ID NO: 8495 - DNA, 321 bp, Artificial Sequence
  Description of Artificial Sequence: Synthetic coding sequence
ggccagcccaaggccgcccccagcgtgaccctcttcccccccagcagcgaggagctgcaggccaacaaggccaccctggtgtgcctggtgtctgacttctacccaggagctgtgacagtggcctggaaggcagatggcagccctgtgaaggtgggcgtggagaccaccaagcccagcaagcagagcaacaacaagtatgctgccagcagctacctgagcctgaccccagagcagtggaagagccacaggagctacagctgccgggtgacccatgagggcagcacagtggagaagacagtggccccagctgagtgcagctag

SEQ ID NO: 8496 - DNA, 672 bp, Artificial Sequence
  Description of Artificial Sequence: Synthetic coding sequence
atgaggctgcagaggccccggcaggccccagctgggggccggcgggccccccggggcggccggggcagcccctacagaccagaccccggccgcggggcccggcggctgcggcgcttccagaagggcggggagggcgcccccagggctgaccccccctgggcccccctgggcaccatggccctgctggccctgctgctggtggtggccctgccccgggtgtggacagatgccaacctgacagcccggcagagggaccctgaggacagccagaggacagatgaaggagacaacagagtgtggtgccacgtgtgtgaaagagagaacacctttgagtgccagaacccccggcgctgcaagtggacagagccctactgtgtgattgctgctgtgaagatcttcccccgcttcttcatggtggccaagcagtgcagcgctggctgtgccgccatggagcggcccaagccagaggagaagcgcttcctgctggaggagcccatgcccttcttctacctgaagtgctgcaagatccgctactgcaacctggagggcccccccatcaacagctctgtgttcaaggagtatgccggctccatgggagagagctgtggcggcctgtggctggccatcctgctgctgctggccagcattgctgctggcctgagcctgtcctag

SEQ ID NO: 8497 - DNA, 408 bp, Artificial Sequence
  Description of Artificial Sequence: Synthetic coding sequence
atgacccccacccccacagctgcctggaccccacctccacccctgcggcccagcgctgctgctgctggggcccagtgccgcagctgccccttccggggcggctgtgcccccagcacagcccggaccccaccagcctgcatgaggcctgctggcccctgtgccccacccacctggccagcccccagcaccaccaccagcacctgcaccagcagaagagctggctgcacagccagcagcgccagctacagcaccctggccgccgcctgcagcctgcggcgcagcggcgtgcgctggccacccagcagcgcctacagcacctgggcctttgccagctgctgtgccagcagcgccagctgccgctgctgctgctgctgctgggccgccggggcctggaccagcgcctggtag

SEQ ID NO: 8498 - DNA, 1542 bp, Artificial Sequence; identical to SEQ ID NO: 7949
  Description of Artificial Sequence: Synthetic coding sequence

SEQ ID NO: 8499 - DNA, 1341 bp, Artificial Sequence; identical to SEQ ID NO: 7099
  Description of Artificial Sequence: Synthetic coding sequence

SEQ ID NO: 8500 - DNA, 936 bp, Artificial Sequence
  Description of Artificial Sequence: Synthetic coding sequence
atgggcgtgatggccatgctgatgctgcccctgctgctgctgggcatcagcggcctgctcttcatctaccaggaggtgtcccggctgtggagcaagtctgctgtgcagaacaaggtggtggtgatcacagatgccatcagcggcctgggcaaggaatgtgcccgggtcttccacactggaggagcccggctggtgctgtgtgggaagaactgggagcggctggagaacctgtatgatgccctgatctctgtggccgaccccagcaagaccttcacccccaagctggtgctgctggacctgagtgacatcagctgtgtgcctgatgtggccaaggaggtgctggactgctacggctgtgtggacatcctgatcaacaatgcctctgtgaaggtgaagggccctgcccacaagatcagcctggagctggacaagaagatcatggatgccaactacttcggccccatcaccctgaccaaggccctgctgcccaacatgatcagcagaagaacaggccagatcgtgctggtgaacaacatccagggcaagtttggcatccccttccgcaccacctacgccgccagcaagcatgctgccctgggcttctttgactgcctgcgggcagaggtggaggagtatgatgtggtgatcagcacagtgagccccaccttcatccgcagctaccacgtgtacccagagcagggcaactgggaggccagcatctggaagttcttcttcaggaagctgacctacggcgtgcaccctgtggaggtggccgaggaggtgatgaggacagtgcggaggaagaagcaggaggtgttcatggccaaccccatccccaaggctgctgtgtatgtgaggaccttcttccctgagttcttctttgctgtggtggcctgtggggtgaaggagaagctgaatgtgcctgaggagggctag

SEQ ID NO: 8501 - DNA, 594 bp, Artificial Sequence; identical to SEQ ID NO: 7046
  Description of Artificial Sequence: Synthetic coding sequence

SEQ ID NO: 8502 - DNA, 705 bp, Artificial Sequence
  Description of Artificial Sequence: Synthetic coding sequence
atgaaggtgctgctgctgaccggcctgggcgccctcttctttgcctactactgggatgacaactttgaccccggcggcctggactacctggtgctgaaccacatcggcggggccccagctggcacccgggcccggagcccccaggccacccgctggctgatgcaggtgaactttgtgtcctatgtgcagctgaccagccgggccctgcccagcctgacagacagcaagggcagcctggtggtggtgagcagcctgctgggccgggtgcccaccagcttcagcaccccctacagcgctgccaagtttgccctggatggcttcttcggcagcctgcggcgggagctggatgtgcaggatgtgaatgtggccatcaccatgtgtgtgctgggcctgcgggaccgggccagcgctgctgaggccgtgcgcagcagcaccagccggccccggcagcctgagcacagaggagtgcccctgcagagccagacagccatgttcctgcccccaacagtgcctggggcccggaccctgacagagacccccctgcggggctggccccagcccaagatgaagagcagccggcagaagagcaagacagagaagaatgatggccacctggagcctgtgacagcctgggaggtgcaggtgccccgggtgcggcggctgtgccggggcctggcccggccccacctgtttggacatgactag

SEQ ID NO: 8503 - DNA, 228 bp, Artificial Sequence
  Description of Artificial Sequence: Synthetic coding sequence
atgaaggtgctgctgctgaccggcctgggcgccctcttctttgcctactactgggatgacaactttgatcctgccagcctgcagggcgcccgggtgctgctgactggagccaatgccggcgtgggggaggagctggcctaccactacgcccggctgggcagccacctggtgctgacagcccacacagaggccctgctgcagaaggccggctggaccaccagctgctag

SEQ ID NO: 8504 - DNA, 225 bp, Artificial Sequence
  Description of Artificial Sequence: Synthetic coding sequence
atgcagcccagcgagatggtgatgaaccccaagcaggtgttcctgtctgtgctgatcttcggcgtggccggcctgctgctcttcatgtacctgcaggtgtggattgaggagcagcacacaggccgggtggagaagaggcgggagcagaaggtgaccagcggctggggccctgtgaagtacctgcggcctgtgccccgcatcaagccccaggtgtcccatgcctag

SEQ ID NO: 8505 - DNA, 861 bp, Artificial Sequence; identical to SEQ ID NO: 7232
  Description of Artificial Sequence: Synthetic coding sequence

SEQ ID NO: 8506 - DNA, 459 bp, Artificial Sequence
  Description of Artificial Sequence: Synthetic coding sequence
atgcaggtgaactttgtgtcctatgtgcagctgaccagccgggccctgcccagcctgacagacagcaagggcagcctggtggtggtgagcagcctgctgggccgggtgcccaccagcttcagcaccccctacagcgctgccaagtttgccctggatggcttcttcggcagcctgcggcgggagctggatgtgcaggatgtgaatgtggccatcaccatgtgtgtgctgggcctgcgggaccgggccagcgctgctgaggccgtgcggggcgtgaccagggtgaaggccgcccctggccccaaggccgccctggccgtcatccggggcggggccaccagggctgctggggtcttctacccctggaggttccggctgctgtgcctgctgcggcgctggctgccccggccccgggcctggttcatccggcaggagctgaatgtgacagctgctgctgcctag

SEQ ID NO: 8507 - DNA, 2856 bp, Artificial Sequence
  Description of Artificial Sequence: Synthetic coding sequence
atgagggtgctggcctgcctgctggccgccctggtgggcatccaggccgtggagcggctgcggctggctgatggcccccacggctgtgccggccgcctggaggtgtggcatggaggccgctggggcaccgtgtgtgatgatggctgggacctgagagatgctgctgtggcctgccggcagctgggctgcggcggggccctggccgcccctgggggcgccttctttggagagggcgccggccctgtgtggctgtctgagctggcctgcagaggaaatgaaggccagctgggcctgtgccaccaccggggctggaaggcccacatctgcagccatgaagaagatgctggggtggtgtgtgccggccagagggtggccaacagcagagatgacagcaccagccccctggatggagccccctggccaggcctgctgctggagctgagccccagcacagaggagcccctggtgacccacgcccccaggcctgctggcaacccccagaatgccagcaggaagaagagcccccggcccaagcaggccaagagcacccgggcccccctgctgaccaccggggccccccggcaggagcggctgcggctggtgtctggcccccaccgctgtgccggccgcctggaggtgtggcatggaggccgctggggcaccgtgtgtgatgatggctgggacctgagagatgctgctgtggcctgccgggagctgggctgcggcggggccctggccgcccctgggggcgccaggtttggacctggagctggccctgtgtggatggatgatgtgggctgcggcggcggggagcaggccctgcgggactgccccaggagcccctggggccgcagcaactgtgaccacagtgaagatgctggcctggtgtgcaccggccctgccccccggctgcggctggctgatggcccccacggctgtgccggccgcctggaggtgtggcatggaggccgctggggctctgtgtgtgatgatgcctgggacctgagagatgctgctgtggcctgccgggagctgggctgcggcggggccctggccgcccctgggggcgccttctttggagagggcagcggccccatcatcctggatgacctgcgctgcagaggaaatgaaacagccctgcgcttctgcccagcccggccctggggccagcacgactgccaccacagagaagatgctggagctgtgtgtgatggcatgcccctgggctacgtgcccccaacagcccccacagacagcaacaacagcaccccccgggaggccgccagcaggcctcccagcaccatgaccagccaggcccctggaacagctggggtgtccccacctccagccagccccaccgtgctgtgggagcccggccctgaggccggcagcccccagctgcggctggtggccggccccagcaaatgttctggccgcctggaggtgtggcatgaccagcgctggggcaccgtgtgtgatgacagctgggacatgagggacagcgctgtggtgtgccgggagctgggctgcggcggcccccagcagcctgaccctgctgctggccgcttcggctggggcgccggccccatctggctggatgatgtgggctgtgtgggcacagaggccagcctgagtgactgcccagctgccccctggggcaagcacaactgtgcccacaatgaagatgtgggcgtgacctgcaccggccccccaggcctggacagcatcagtgaccccttctcctggagctggatccctggcctgggccgggacagagatgcctggctgcctggagagctggccaccaagcccagcgcctctgtgacagcctctgtgctggagaagaccaccaccaaggcccctgggaagatgcccaagagcaccaagaagtgggtgaccaagaatgccaagaggcccaccacccagccccctgtgatgcccaccaccaagcacagccgggcccagagccccccagacctgaccagccagaccacagctgccctgaccacagaggccagccggcggcccaccagcgagttcacccggcggcccaccacagaggccccccagcgctggaccagccacaccacagccaccctgaccccccaggccccccgggagaggaccaccaagaccatggccatgctgaccacccagggcccccaggagatgaccagcgagagcaccatcaagagcatcccccaggccagcctggagcccagcgctgagatccctgagggcagccctgagagccccaaggaccctgcccccagccccagcgtgtccaccaccggggagagcggcctcttccgggtgcggctggctgatggccccaacagatgtgccggccgcctggaggtgtggcacgccggccgctggggcaccgtgtgtgatgacaactgggacctgagagatgccaccgtggcctgctgggagctgggctgcggcaaggtgcggccccgggtgggcaagacccactacggccctggcaccggccccatctggctggatgacatgggctgcaagggcagcgaggccagcctgagtgactgccccagcggggcctggggcaagcacaactgtgaccatgaagaagatgtgggcctgacctgcaccggctacacagattatgatgactacccaccctggacctgggaccccaccagccgggaggacctggccaagggcaccaccacagctggggtgcccggccacaccctgccctggaggaccaccaggaggcctggcagcagcagccctgccatccggcggctgcctgacacagagcctgaggccggggcccccagaggagatgcccccaggagcaggacagcccgggtggccgccccaccctag

SEQ ID NO: 8508 - DNA, 8430 bp, Artificial Sequence; identical to SEQ ID NO: 6956
  Description of Artificial Sequence: Synthetic coding sequence

SEQ ID NO: 8509 - DNA, 291 bp, Artificial Sequence; identical to SEQ ID NO: 7562
  Description of Artificial Sequence: Synthetic coding sequence

SEQ ID NO: 8510 - DNA, 1890 bp, Artificial Sequence
  Description of Artificial Sequence: Synthetic coding sequence
atgcagcaggacggcctgggcgtgggcaccagaaatggcagcggcaagggccgctctgtgcaccccagctggccctggtgtgccccccggcccctgcgctacttcggcagagatgcccgggcccggcgggcccagacagctgccatggccctgctggccggcggcctgagccggggcctgggcagccaccctgctgctgctggaagagatgctgtggtgtttgtgtggctgctgctgagcacctggtgcacagccccagcccgggccatccaggtgacagtgagcaacccctaccacgtggtgatcctcttccagcctgtgaccctgccctgcacctaccagatgaccagcacccccacccagcccatcgtcatctggaagtacaagagcttctgccgggacagaattgctgatgccttcagccctgcctctgtggacaaccagctgaatgcccagctggccgccggcaaccctggctacaacccctacgtggagtgccaggacagcgtgaggacagtgcgggtggtggccaccaagcagggcaatgctgtgaccctgggggactactaccagggccgccgcatcaccatcactggaaatgctgacctgacctttgaccagacagcctggggagacagcggcgtgtactactgcagcgtggtgtctgcccaggacctgcagggcaacaatgaggcctatgcagagctgattgtgctggactggctgtttgtggtggtggtgtgcctggccgccttcctgatcttcctgctgctgggcatctgctggtgccagtgctgcccccacacctgctgctgctacgtgcgctgcccctgctgcccagacaagtgctgctgcccagaggccctgtatgctgctgggaaggccgccaccagcggcgtgcccagcatctatgcccccagcacctacgcccacctgagccctgccaagaccccacctcctccagccatgatccccatgggccctgcctacaacggctacccaggcggctacccaggagatgtggacaggagcagcagcgctgggggccagggcagctatgtgcccctgctgcgggacacagacagctctgtggcctctgtgcgcagcggctaccgcatccaggccagccagcaggatgacagcatgagggtgctgtactacatggagaaggagctggccaactttgaccccagccggcccggcccccccagcggccgggtggagcgggccatgtctgaggtgaccagcctgcatgaagatgactggaggagccggcccagccggggccctgccctgacccccatcagagatgaggagtggggcggccacagccccaggagcccccggggctgggaccaggagcccgcccgggagcaggccggcggcggctggagggcccggcggccccgggcccggtctgtggatgccctggatgacctgaccccacccagcacagctgagagcggcagccgcagccccaccagcaatggaggccgcagccgggcctacatgccacccaggagccgcagcagagatgacctgtatgaccaggatgacagccgggacttccccaggagccgggacccccactatgatgacttccgcagccgggagcggcccccagctgaccccaggagccaccaccacaggacccgggacccccgggacaatggcagccgcagcggggacctgccctatgatggccgcctgctggaggaggccgtgaggaagaagggcagcgaggagcggcggcggccccacaaggaggaggaggaggaggcctactaccccccagcccccccaccctacagcgagacagacagccaggccagccgggagcggcggctgaagaagaacctggccctgagccgggagagcctggtggtgtag

SEQ ID NO: 8511 - DNA, 591 bp, Artificial Sequence
  Description of Artificial Sequence: Synthetic coding sequence
atgagccggcggagcatgctgctggcctgggccctgcccagcctgttacggctcggggctgcccaagagacagaggaccctgcttgctgcagtcccatcgtacctcgcaacgagtggaaagcacttgcgtccgagtgtgcccagcatctctccctgcccttacgttatgtggtggtcagccatacggcagggagttcctgtaatactcccgcttcttgtcaacagcaagcacgcaacgttcagcactaccacatgaagactttaggatggtgtgacgtcggctacaactttctgatcggagaggacggcctggtatacgaaggtagaggttggaatttcaccggtgcccattctggccatctctggaacccgatgagcattgggatttcctttatgggcaattacatggatagggtgccgacccctcaggccatcagggcagcacagggcctattagcatgtggcgtggcccagggggccctgcggtctaactacgtgttaaagggacatcgtgacgtgcagcggacactgtctcccggaaaccagctctatcacctcatccagaattggcctcactaccgctcaccctag

SEQ ID NO: 8512 - DNA, 1056 bp, Artificial Sequence
  Description of Artificial Sequence: Synthetic coding sequence
atggaggccttcgccctgggccccgcccggcggggccggcggcggacaagggccgctggatccctgctctcacgagccgccatcctactgtttatcagtgcttttctcgtgcgagttccttcatcagtcggacatctggtgcgattaccgagggctttccgcctgaccaaggattccgtcaaaattgtcggctccacaagcttccccgtgaaggcatacgttatgcttcaccaaaagtccccacatgtcctctgcgttacccagcagctgcgtaacgccgagctgatagacccttccttccagtggtacggacctaaggggaaggtggtgagcgtggagaatagaacagcccaaatcacatccacgggcagccttgtctttcaaaattttgaggaaagtatgtctggaatttacacctgctttcttgagtacaaacccacagtagaggaaatagtgaaacgactccagctgaagtacgccatttacgcctatcgcgagcctcactattactaccaattcaccgctcgataccacgcagccccgtgcaactctatctacaatatcagcttcgagaagaaactcctgcaaattttgtctaaacttctactcgacctctcgtgcgagatttcactcctcaagtcagaatgtcacagggtgaagatgcaacgggccggattgcagaacgagctatttttcgccttcagtgtgagcagtctagatactgagaaagggcccaaacgttgcacagatcacaactgcgaaccgtacaagaggttattcaaagctaaaaatctgatcgagcggttctttaatcagcaggtagagatcttaggaagacgggccgagcaactgccacagatatattacattgagggcaccctgcaaatggtctggattaatcgctgcttccccgggtacggaatgaatgtgcaacagcatccaaagtgcccggaatgttgcgtcatctgctccccggggtcctataatccccgcgacggaatccactgtctgcagtgtaactcaagtctggtttacggagcaaaaacctgcctgtag

SEQ ID NO: 8513 - DNA, 420 bp, Artificial Sequence
  Description of Artificial Sequence: Synthetic coding sequence
atggagaccaacgtgttccacctgatgctgtgcgtgaccagcgcccggacccataaaagcacttctctttgtttcgggcactttaacagttacccatctctgccgcttatccacgacctactcctcgaaatcagcttccagctgtctgccccacacgaagacgccaggctaacaccagaggagctagagcgtgctagcctgctgcagatacttcctgagatgctgggcgccgaacgcggcgatattcttcgcaaggcagactcatcgaccaacattttcaatcctcggggaaacctaagaaagtttcaagacttcagcggccaggaccccaatatactactgtcccacctgttggctcgaatttggaaaccttacaagaaaagagaaacaccagactgcttctggaaatattgtgtatag

SEQ ID NO: 8514 - DNA, 606 bp, Artificial Sequence
  Description of Artificial Sequence: Synthetic coding sequence
atgggcagcggccggcgggccctgagcgccgtgcccgccgtgctgctagtcctgacgttgcctgggctacccgtctgggcgcagaatgacacggagccaatagtcctggaaggtaaatgcttagtggtatgcgacagcaatccagctacggacagtaaaggctcttcttctagccccttaggaattagcgtacgcgccgccaactctaaggtggcctttagcgcagtgagatccactaatcacgaaccctcagagatgagcaataagacacgaattatttatttcgaccaaatcctcgtcaatgtggggaacttcttcacccttgagtccgtgtttgttgccccccgaaagggtatctatagttttagcttccatgttatcaaggtgtaccagtctcaaacaatccaagttaatcttatgctgaatggcaagcctgttatcagtgcattcgctggggataaggacgttacaagggaagctgcaaccaatggtgtgcttttgtatctggataaggaggacaaggtttacctgaagcttgaaaagggaaacctggttgggggatggcagtactcaacttttagcggctttctggtcttcccattatag

SEQ ID NO: 8515 - DNA, 264 bp, Artificial Sequence
  Description of Artificial Sequence: Synthetic coding sequence
atgaaggtgctgcgggcctggctgctgtgcctgctgatgctgggcctggcactgcgaggggcagcttcacgcactcacagacattcgatggaaattcgaacaccggatatcaatcctgcatggtacgcctctcgaggaatccggcccgtcggcagattcggacgccgcagagcaacactcggagatgtgcctaaacctggactccgcccccgattgacatgttttcccctcgagggcggtgcaatgtcatcccaggacggctag

SEQ ID NO: 8516 - DNA, 1098 bp, Artificial Sequence
  Description of Artificial Sequence: Synthetic coding sequence
atgcccggcggcaagaaggtggccggcggcggcagcagcggcgccacacccacaagcgccgcggccactgctcccagcggagttcggcggcttgaaacgagtgaaggaacatcggcccagagagatgaggaacctgaggaagagggcgaggaggacttgagggacgggggcgtaccctttttcgtcaatagaggtggactgcccgtggacgaggcaacctgggagcggatgtggaagcacgtcgccaaaattcaccctgatggagagaaggtggcccaaagaatcaggggcgccactgaccttcccaaaattcccatcccctcagtgccgacatttcaaccttcaaccccagtgcctgaaagactggaagccgtccagagatatattcgggagctacagtataatcatacagggacccaatttttcgagattaaaaagtctcgacctctcaccgggctcatggacttagcaaaggaaatgacgaaagaggcactgcccatcaagtgtctggaggcagtgatcctggggatttacttaacaaatagtatgccaacattggaaagattccctatttcttttaagacttacttctctggcaactacttccggcatatcgtgctgggggtgaactttgcaggccggtacggcgctctcggaatgtcaagacgagaggacttaatgtacaagcctcccgcttttcgcacactgagtgaactagttcttgactttgaggctgcttatgggagatgctggcatgtgctgaagaaggtgaagcttggccaaagcgtgtcccatgacccccatagcgtcgaacagattgagtggaaacatagtgtcctagacgtggaaagattgggccgggacgattttcgaaaagagcttgagcgccacgccagggacatgaggttgaagatcggaaagggcaccgggcccccgtcaccgaccaaagacaggaagaaggatgtatcatccccacagagggctcagtcttcaccccacaggcgcaactctaggagcgaacgacgcccctcgggggacaagaagacatcagagccaaaagcaatgcccgacttgaacggatatcagatccgcgtctag

SEQ ID NO: 8517 - DNA, 1377 bp, Artificial Sequence
  Description of Artificial Sequence: Synthetic coding sequence
atggcctgggccagccggctgggcctgctgctggccctgctgctgcccgttgtaggtgcatcaacacctggcacggtggtgcggttgaataaagccgctttatcatatgtgtccgagatcggcaaggcccctttgcagcgggctctacaggtgactgtgccccactttttagactggtcaggcgaggcactgcagccaacccgcatccggatactcaacgtccatgttccccgcctgcatttaaaattcattgccggctttggtgttcgactgctggccgccgccaactttaccttcaaggtgttccgggcccctgaaccgctcgagctcacgctgcccgttgagcttctggctgatactagagtgacacaatcatccattagaacaccggtggtcagcatatccgcttgttccctgttctccggtcacgccaatgaattcgacggcagtaattcaacgtcccacgctctgttagtgctggtccagaagcacatcaaagcagtgctgagcaacaaactttgcttgtctattagcaatctggtccaaggcgtgaacgtccacctgggcacgcttattggactgaatcccgttgggccagagtcacagatccgttactcaatggtctccgtccccaccgtgacctctgactatatttcgctggaggtgaacgcggtcctgtttttgctggggaagcccattatactgcccacagacgcaactccctttgttctgccaagacatgtaggaacggaaggtagcatggccaccgtaggcctgagccaacaactgttcgactccgccctcctgctgttacagaaagcgggtgcgctgaatctcgacattacaggccagctccggagcgatgacaatctgctgaataccagcgctctaggccgcctcattccggaggtggccagacaatttccagaaccaatgccggtcgtgctgaaagtgagactgggcgcaacccctgtggctatgttacatacgaacaacgcaacgctccggttgcagcccttcgtggaagtcctggcgaccgcatccaattcagcattccagtccctgttttctctagacgtcgtggtgaatttgcggctgcagctatcggtgtccaaagtcaagctccaggggacaacctcggtgctgggggatgtccaactgaccgtcgcttctagcaacgtcggattcatagatacggaccaggtgcggacgttgatgggaacagttttcgaaaaaccattgctcgatcacctcaacgcgctgttggccatgggaatagctcttcccggtgtggtgaaccttcactacgttgctccggagatattcgtatacgaaggatatgtggttatctcatcaggtttgttttaccagagctag

SEQ ID NO: 8518 - DNA, 1815 bp, Artificial Sequence
  Description of Artificial Sequence: Synthetic coding sequence
atgatgcgggccgtgtgggaggccctggccgccctggccgccgtggcttgcctggtaggagctgtgagggggggcccaggactctcaatgtttgcggggcaagcagcgcaaccagatccttgttcagatgaaaatggacacccccggagatgcattccagactttgtcaatgccgcctttggcaaggacgtgcgggtgtcttcgacttgcggacgtcctcccgccaggtactgtgttgtgagtgaacggggagaggagaggctgcgatcctgtcatttgtgcaatgctagtgaccccaaaaaagctcaccctcccgcttttctgactgatttaaataacccccataacctgacatgttggcagtcagagaattatctgcagtttccgcacaatgttacccttactttaagcctaggaaaaaaattcgaggttacttacgttagtctgcagttttgcagtcctcggcctgagtcaatggcgatctataaatctatggattacggccgaacatgggtgccattccaattttactcaactcagtgcagaaagatgtacaatcgacctcacagggccccgattaccaagcagaatgagcaagaagcagtatgtaccgattcgcacactgatatgcggcctctgagcgggggcttgattgcattctccactctcgatggccggccatctgcacacgacttcgacaacagtcccgtgttgcaggactgggtcactgcaacagacattagagtggcattttcccgccttcatacctttggcgacgagaacgaagacgactccgagcttgctagggattcctacttctacgctgtgtccgacctgcaggtagggggccggtgcaagtgcaacggccacgcagctaggtgcgtgcgggatcgggatgacagcctggtttgcgactgcagacacaatacggccggtcctgagtgcgatcggtgcaaaccttttcattacgatcggccctggcagcgggctaccgctagggaggccaacgagtgtgtggcgtgcaactgcaacctgcatgccaggcggtgtaggtttaatatggagctctataagctgtcaggacggaagtctggaggtgtatgtttgaactgtcgtcacaacaccgccgggcggcattgccattattgcaaggagggctactatagggatatgggcaaacccattacgcaccggaaagcttgtaaggcttgtgactgccaccctgtcggagcagctggcaagacatgcaaccagacaaccgggcagtgcccctgtaaggacggggtcaccggcattacttgtaatcgttgcgctaagggttaccagcaaagtcggtccccaatcgccccatgtattaaaattcccgtggcgcctcccacaacggccgcaagctcagtcgaggagccggaggattgtgactcttattgtaaggcaagtaaggggaagttaaaaattaatatgaagaaatattgtaaaaaagattatgcagtccaaatccatatcctgaaggctgataaggcgggagattggtggaagttcactgtgaacatcatctctgtctacaagcaggggacaagccgcattagaaggggcgaccagtcactgtggatacgctcccgcgacattgcctgtaagtgtccaaaaataaaaccgctgaaaaaatacttgctgttgggcaacgctgaagatagccctgaccagtctggcatagtggccgacaaaagttccttggtcatccagtggcgtgacacttgggcaaggcgacttcgtaaattccagcagcgcgagaaaaagggtaaatgtaaaaaggcctag

SEQ ID NO: 8519 - DNA, 675 bp, Artificial Sequence
  Description of Artificial Sequence: Synthetic coding sequence
atgcccggccgggcccccctgcggaccgtgcccggcgccctgggcgcctggctattgggagggctctgggcatggactctgtgtggtctatgtagtctgggtgccgttggagctccgaggccttgccaggctcctcagcagtgggaaggtaggcaggtgatgtaccagcagagttccgggcgcaactcccgggctctgttatcttacgacggattaaaccagagggtgcgggtgctggacgagagaaaggcactaataccgtgcaaaaggttatttgagtatattttgctttataaggacggagtgatgtttcagattgatcaggctactaagcaatgcagcaagatgaccttgacccagccttgggaccccctcgacatcccacagaactccacattcgaagaccagtacagcatcgggggacctcaagagcagattacagtacaggagtggtctgatcggaagtccgcacgcagttatgaaacttggataggaatctacactgtcaaggattgttacccagtgcaggaaacattcacgatcaactatagcgttatcctgtctacccgtttcttcgatatccagctgggcattaaggatccctcagtcttcacccccccctctacctgccagatggcccagctggagaaaatgtccgaagattgctcctggtag

SEQ ID NO: 8520 - DNA, 5106 bp, Artificial Sequence
  Description of Artificial Sequence: Synthetic coding sequence
atgggcttcctgcccaagctgctgctgctggccagcttcttccccgccggacaggcatcatggggagtctcgagtccgcaggacgtccaaggggttaaaggaagttgtctgttgatcccatgcatattctccttccccgcagacgtagaggtgccagatggtatcaccgcgatatggtactacgactacagtggccagcggcaagtggtatcgcactccgcggaccccaagttggtcgaagccagatttcggggccgcacagagttcatggggaatcctgaacacagggtttgcaatttactccttaaagatctgcaacccgaagacagcggatcttataactttcgtttcgagataagtgaggtgaaccgttggagcgacgtcaaaggaaccctggtgaccgtcaccgaggagcctcgagtccctacaattgcttcccccgttgagctcctcgagggaactgaggttgatttcaactgctcaaccccctatgtctgcttgcaagagcaggttcgtctgcagtggcaagggcaggatccagcgaggtctgtgaccttcaactcacagaagtttgagccgactggcgtggggcacctcgaaacattgcatatggccatgtcatggcaggaccatggccgcattctgaggtgccagctgagcgtcgctaaccacagggcccagagcgagatccacctccaggtcaagtatgcacccaaaggggtgaagatcctgctgtcaccgagcggaaggaacatattgccgggagaactcgtgactcttacttgccaggtcaactcttcctatcccgccgtgagcagcattaagtggctaaaagacggggtgcggctgcagactaagacgggcgtgctgcatctcccacaggccgcctggtcggacgccggagtgtacacctgccaggccgagaatggcgtggggtctttggtgtccccccccatctcactgcacatcttcatggcggaggtccaagtctctcccgccggaccgatccttgaaaaccagactgtgacccttgtatgtaatactcctaatgaggcaccatctgatttgagatacagctggtacaagaatcacgtccttctcgaagatgctcactcacatacgctacgtttacacctggccaccagagccgatacaggattttacttttgtgaagtgcagaatgtgcatggatctgaacggtccggccccgtaagcgtggttgtgaaccaccccccccttactcctgtgctcacggctttcctagagacccaagcaggattggtaggaattctgcactgtagcgtggtgtccgagcccctggcaaccctagtcttgtcacatggtgggcacatcctagcaagtacctctggagattctgaccattctcctcgattctcaggcacgagcggtccaaactcactccggttggaaattcgggacttagaagagaccgacagtggagaatacaaatgtagcgccacgaactctctcggtaatgccacttcaactctggacttccacgcgaacgctgcacgactacttatatcacccgccgccgaggttgtcgaaggccaggcagtaaccctgagttgcagatccgggctgagccccacgcccgacgctcgtttcagttggtacttaaatggggcactgctccatgagggccccggatcctcgctcctgctccccgcagcttcttccaccgacgctggaagttatcattgtagggcccgggacggacactccgcatctggcccttcttctccggcagtgctcacagttctgtatcccccaaggcagcctacctttaccacccgcctggacctagacgccgcaggagcgggcgctggccggcgaggcctactgttgtgtcgcgtggacagcgacccacccgctaggttgcagttgcttcataaagatagggtggtcgctacgagcctaccttcaggcggcgggtgttcaacctgcggcgggtgttcacccagaatgaaggtgactaaagccccaaatctgttaagagtagagatccacaaccctctcctcgaggaggaggggctctacctctgcgaagcttccaacgctctgggcaacgctagcaccagtgctacatttaacgggcaagcaactgtgctagcaattgctccttcgcacaccttgcaggagggcaccgaggcaaaccttacctgtaatgtatctcgcgaggcagccggctcgccagctaacttttcgtggttcaggaatggtgtgctctgggctcagggaccgttggagacagtgaccctgttgccagtggcacggaccgacgctgctctgtatgcctgtagaatccttactgaggctggcgcccagctatccacaccagtgctgctatcagtcctctatcctccggaccggcccaagctttccgcacttctcgacatgggccagggccacatggcccttttcatttgtaccgtggattctcgtcctctggccctgctggccctgtttcacggcgaacacctgcttgcgacctcccttggtccccaggtacccagtcacggaagattccaggctaaggcagaggcaaattcccttaagctggaggtacgcgaactgggattgggggattcggggtcctaccgttgcgaggctaccaatgtgttgggctcctctaacacaagcctgttctttcaagtgcgaggagcttgggttcaggtttcaccgagtccagagttacaggaagggcaggcagtggttctgtcatgtcaggtgcacacaggcgtccctgagggaacgagctacaggtggtacagggatgggcaacctttacaggagtcgacatctgccaccctgcgcttcgccgcgatcactctgacacaggccggcgcttaccactgtcaggcccaggctcccgggagcgcaaccacgagtctcgcagctcctatctcgctccacgtcagttatgccccaaggcacgtgaccctgacaaccctgatggataccggacctggcaggcttggcctactgttgtgtcgagtggactctgaccctccagcccagctgaggttgctacacggagaccgcctagtagcaagcaccctgcagggggttggagggcccgagggatcgtctcctcggttgcacgtagccgtagcccctaataccctgcgtttggaaattcacggggccatgctcgaggacgaaggagtctacatctgtgaagcctcaaacacattgggccaggcttcggcatctgccgatttcgatgcccaagccgtgaacgtgcaagtgtggccgggagccactgtaagagaaggacagctggtgaatctgacctgtctcgtctggacgacacatcctgcccagcttacctacacctggtatcaggatgggcaacagcgattggacgcacattccatccccctgcctaacgtgactgtccgcgacgccacatcttataggtgcggtgtggggccgcccggtcgtgccccccgcctgtcccggcctatcacacttgacgtgctgtatgcccccaggaatctgaggcttacctatctcctggagtcacatggtggtcagttggccctggtcctttgtaccgttgattctaggccacccgcacaattagcactctcacatgccgggaggctgcttgcatcttccacagcggcatcagtgcccaacacactgcgcttggaactgcgagggccacagccccgtgatgagggtttttacagctgttccgcccgatcacccctgggccaggccaacacatccttggaactgcgcttagagggcgtgcgggttatcctggcccctgaggccgccgtcccagaaggagctcctattacagtgacttgcgcagatccagcggcgcacgcccccacattgtacacatggtatcacaatggccgctggcttcaggagggcccagctgccagcctgtcctttctggttgccactagggctcatgccggcgcttactcttgtcaagcccaagatgctcagggtacccggtcttctagaccagctgcactccaggtcttgtatgccccccaggacgccgtcctctcaagcttccgggattcaagagcacggtcaatggcggttatacagtgcacagtggactcagagcctcccgctgaactggccctgagccatgacggtaaagtattagccacctcgtccggtgttcattccctggcaagcggaactggacacgttcaggtggctagaaatgcccttcgcttacaagtgcaggacgttcctgcaggcgacgatacgtacgtgtgcaccgcccaaaacctgttgggctctattagtacgataggacgcctgcaggtggagggggcacgcgtagtcgccgagcctgggttggatgtacctgagggggctgcactcaatctgagctgcagactgttgggaggtccaggacccgttggcaactctactttcgcatggttttggaatgacaggcggctgcatgcagaaccggtgccaaccctcgccttcacccacgttgcacgagctcaggctgggatgtatcattgtctggctgaactgccaaccggggcagctgccagtgcgcctgtgatgcttagagtgctgtaccccccaaagacccctacaatgatggtgtttgtagagccagaaggaggcctgagaggcattttagactgcagggtggatagtgaaccactggcgagcttaaccctccacctgggatctcgtttggtggcctcgtcacagcctcaaggagcccctgcagagccccacatccacgtcctggcctctcccaatgccctcagggtagatatcgaagccctgcgtccttccgaccagggtgaatacatctgtagtgctagcaacgtgctcggttccgcttcgactagcacttacttcggagttagagctcttcatcgactgcaccaatttcagcagctgctttgggtgctcggtttactggtcggactactgctgctgttgcttggcctgggcgcatgctacacctggagttctctcatactgatgcagcctcacgtcagaccccaaccagtgccgcatccgtgggccgaccagtggtgttgtctccccagcggtggagaaagcggccaaaacctgtag

SEQ ID NO: 8521 - DNA, 708 bp, Artificial Sequence
  Description of Artificial Sequence: Synthetic coding sequence
atgaccgtgctggcccccgcctggagccccaccacctacctgctgctgctcctgctgctgagctccggactgtcgggtacgcaggattgctctttccaacactccccaatttcgtcggacttcgctgtgaagataagggaactgtcagattaccttctccaggactacccagtgactgtagcctccaacctgcaggatgaggagctctgtggaggcctttggagacttgtgttagcgcagcggtggatggaacgcctcaaaaccgtcgccggcagcaagatgcaggggctcctggaaagagtgaacaccgagatccatttcgtgactaagtgcgcttttcaaccgccccccagttgtttacggttcgtgcagaccaacattagccgtctcctgcaagagaccagcgagcagctcgtggcactgaagccatggataactcgccaaaatttttcccgctgtctggaactccagtgccagcccgactcttctactctgcctccaccttggtcaccccgtccccttgaagccaccgcaccaacggccccacagccccccctgctgctgctgctgctgctgcctgtcggattgttgttactggctgctgcttggtgtcttcactggcagcgtactaggcggaggaccccaaggcccggtgagcaggtgccgccagtaccaagccctcaggatctcctgctggtggaacactag

SEQ ID NO: 8522 - DNA, 3297 bp, Artificial Sequence
  Description of Artificial Sequence: Synthetic coding sequence
atgaccctgcaggagctggtgcacaaggccgccagctgctacatggatagggtggccgtctgtttcgacgaatgtaataatcagctccccgtttactatacctacaagacagtggttaatgccgccagtgagctcagcaatttccttctcctgcattgcgattttcagggaatccgcgagatcggactgtattgtcagcctgggatcgatctcccaagctggattttggggatacttcaggtgcctgctgcctatgtgcccatagaaccagattcaccaccctccctatctacccactttatgaagaaatgtaaccttaagtatatactggtcgagaagaagcagattaacaaatttaagagtttccacgaaactctgttgaactatgacacttttacagtcgaacataatgatctggttctgtttcgccttcattggaaaaacacagaggtcaatctaatgcttaacgacggaaaagagaagtacgagaaagaaaaaataaagtcaatcagcagtgagcacgtcaacgaggagaaagcagaggagcacatggacctgagactaaaacattgtctggcgtatgtgttgcacacctcaggaacgaccggtatacctaagatagtccgagtcccccataaatgtatcgtaccaaacatccagcacttccgcgttctgttcgatatcacacaagaggacgtgctcttcctggcttcaccactgacatttgatccgagtgttgtcgagatttttttagcattgtcctccggtgcttcactgctgattgtccccacctctgtgaagctcctgccctccaagctggcgtccgtccttttctcgcaccatagagtgaccgtcctgcaggctacgcccacacttttgcggcgctttgggtctcagcttattaagtcgacggtcctttcagcaactacatcactccgtgtcctcgcccttggaggtgaagccttcccctccctcacagtcctgcggtcctggcgcggtgagggaaataagacacagatttttaatgtttacggcattacagaggtgagcagctgggctaccatctatcggatccccgaaaagaccctgaacagcaccctcaaatgtgagctgccagtgcagttaggctttccacttctgggaaccgtggttgaagtgcgggatacaaacggttttacgatacaagaggggagcggccaagtctttctgggagggagaaatcgggtctgcttcctggatgacgaagtgaccgtacccctcgggacaatgagggccacaggggattttgtgacagtgaaggatggtgagattttttttcttggcaggaaagactcccagatcaaacgtcacggtaagcgactgaacatcgagttggtacagcaagtcgccgaagagctacaacaggtcgagtcttgcgctgtcacctggtacaaccaggagaaattgatcctctttatggtctcgaaagacgcctcagtcaaggagtacattttcaaagagctccagaagtatctgccaagccatgccgtaccggacgagctggtcttaattgattcactgccctttaccagccacggaaagatcgatgtttctgagctgaataagatttatttaaattacataaacctcaaatctgaaaataagctgagcggcaaggaagacctgtgggagaagttgcagtatttatggaaaagtacccttaatctgccagaagatctcctcagagtgccagacgaatccctgtttctcaattctgggggcgactccctcaagtccatccgcttgttgtccgagatcgaaaaattggttggcacgagtgtgccagggttactggaaattatcctgtctagctctattctcgaaatctataatcacattctgcagacagtcgtcccggacgaagatgtaacctttcgcaagtcttgcgctacgaaacgcaagctgtctgatattaatcaagaagaggccagcggaacgagcctgcatcaaaaggcaatcatgacttttacctgccataacgaaattaacgcgttcgttgtgctttcccgcgggagtcagatcttgtcactcaacagcacacgcttcttgaccaaactgggccattgctcgtcagcatgtccctccgactcggtcagccagactaacatacagaatctaaaaggcctaaacagtcccgtgttaataggaaagagcaaggatccctcctgcgtagccaaggtgagcgaagaaggcaaacctgccatcggaactcagaaaatggagcttcacgtgcgatggagatctgataccggaaagtgtgtggacgcttcgccgctggttgtcattcctacctttgacaagtctagcactaccgtatacatcggctctcattctcacaggatgaaggccgttgatttctattcggggaaggtcaagtgggaacagatcctgggagataggatagagtccagcgcttgcgtctctaagtgcgggaacttcatagtggttggatgctataacggcctcgtgtatgtcctgaagagcaactctggcgagaaatattggatgttcaccaccgaggatgcagtaaagtcctcggctaccatggaccctacaactggactcatttacatcggcagccacgaccagcatgcttatgcactagatatctatagaaagaaatgcgtgtggaagtctaaatgcgggggtacagtgtttagtagtccatgcctgaatctgatcccacaccacttatacttcgcgaccttgggaggacttttgctggccgtcaatcctgccaccggaaacgtaatctggaagcacagctgcggtaaaccattattctctagcccacaatgttgttctcagtatatctgtatcggatgtgtggacgggaacctcttatgctttactcattttggtgagcaggtgtggcagttctccacaagcggcccgatattctcctcaccctgcaccagtccgtccgagcagaagatcttctttggatcacatgactgttttatttactgttgcaacatgaaagggcatctccagtggaagtttgagacaacaagcagagtctacgctacgcccttcgccttccataactataacggtagcaacgaaatgctcctggcagccgccagcacggatggaaaggtgtggattctggaaagtcagagtggccagctgcaatcggtttacgaactccccggtgaggtgtttagctcgcctgtggttctggagtcaatgctaataataggatgccgagacaactacgtatactgtctggacctgctggggggcaaccagaagtag

SEQ ID NO: 8523 - DNA, 774 bp, Artificial Sequence
  Description of Artificial Sequence: Synthetic coding sequence
atggccagcaagatcggcagccggcggtggatgctgcagctgatcatgcagcttggatctgtgctcctaactaggtgccctttctggggttgtttttcacagctgatgttgtacgcggaaagagctgaggcacgcagaaaaccagatatacctgtgccctacttgtactttgacatgggagcagccgtgttgtgtgcctcctttatgtctttcggcgttaagagaaggtggtttgccctcggtgccgcgcttcagcttgccatttctacgtatgcagcctacatcgggggatatgtccactatggcgactggctgaaggtgagaatgtattcccgtaccgtggcaatcataggagggtttctggtccttgcttccggcgccggggaattatatcggcgcaagcctcggtctcgcagtttgcaatccaccggccaagtgtttctgggcatctatttgatttgtgtagcctacagcctacagcatagcaaggaggacagattggcttatttgaatcatctcccgggaggcgaactgatgatacagctgttttttgtgttgtatggaatactcgcactagcttttttgtccggttattacgtcaccctggccgcccagatcctcgcagtgctgcttccccccgtcatgttgctcatcgatggcaacgtggcatactggcacaatacaaggagggtggagttctggaaccagatgaagctgctgggtgagtcagttgggatctttggcacggccgtgatccttgctacagatggctag

SEQ ID NO: 8524 - DNA, 2118 bp, Artificial Sequence
  Description of Artificial Sequence: Synthetic coding sequence
atggagaagccccggagcatcgaggagacccccagcagcgagcccatggaagaggaagaggatgacgatctggagctgttcgggggatacgactcattcaggagttacaacagcagtgttgggtccgagagcagttcatatcttgaggagtcaagcgaagccgaaaatgaggaccgggaagcaggcgaactcccaacttcccccctgcacctgttatctcccggcacaccacgtagcctggacggcagcggcagcgagcccgcggtatgcgagatgtgcggaatagtcggtacgagggaggcctttttctcaaagaccaagagattctgtagcgttagctgcagcagatcttatagttcaaacagcaaaaaggcctctatactcgcccgactacagggcaaacctcccacaaagaaagcgaaggtgctgcataaggctgcctggtcagcgaaaatcggtgcatttctacactcgcaaggaactggacagctggccgacggcacccctaccgggcaggatgcgctcgtactggggtttgactggggaaaattcctgaaggaccacagctacaaagccgcccccgtctcctgtttcaagcatgtacctctatacgatcaatgggaagacgttatgaaggggatgaaggttgaggtgcttaatagcgacgccgtgctgccctcaagggtctattggattgccagtgtaatccaaacagccggttatagggtgttgcttcgctacgaaggtttcgagaatgatgcctctcatgacttttggtgcaatctgggtaccgtggacgtgcatcccatcggttggtgcgcaatcaactccaaaattctcgtacccccaaggacaatacatgcaaagttcactgattggaagggatatctaatgaagcgcctggtcggtagtagaaccttacccgttgatttccacattaaaatggtggaatcaatgaagtaccctttccgacaaggaatgcgactggaggtggtagacaaatcacaggttagccgcacaagaatggctgtggtggacactgtcatcggtgggagactaaggttgctgtatgaggacggtgactctgacgacgatttttggtgtcacatgtggagtcctctcatacatccagtgggctggtcgcgcagggtgggtcacggaattaagatgtcggagcgcagatcagacatggcgcaccatccaacattcagaaaaatttattgtgatgctgtcccttatctttttaaaaaagtgcgtgccgtatacacggagggcggatggtttgaagagggaatgaagctagaagcaatcgaccccctcaatctgggaaatatatgcgtggctactgtgtgcaaagtcctgctggacgggtatctgatgatctgcgtggacggaggcccaagtactgatggactggactggttttgctaccacgcatctagccatgccatctttcctgctaccttttgccagaaaaatgacattgagctaactcctccgaaaggctatgaagcacaaacttttaattgggagaattacttggagaagacgaagagtaaagctgctccttcgagactgttcaatatggattgccctaatcatggcttcaaagtgggcatgaaactggaagccgtcgatcttatggagccaagacttatatgtgtggccactgtgaaaagggtggtccacagactgcttagcattcactttgacggctgggactcagagtatgatcagtgggttgattgcgagtctccagatatatatcctgtcggctggtgcgagcttaccggctatcaactgcagcctcctgtggccgcagagcctgccacgcccttaaaagcgaaagaggccacgaaaaagaaaaaaaagcaattcggcaaaaagaggaaacggatccctccgaccaagacccggcccctgcgccagggatctaaaaaacctctgttggaagatgacccgcagggggcacgcaagatctcatccgagcccgtcccaggcgagatcatagccgtgcgtgtcaaggaagaacatctggatgtggcttcacctgacaaggcctcgtccccggaactgcccgtcagtgttgagaatattaaacaagagactgatgattag

SEQ ID NO: 8525 - DNA, 2103 bp, Artificial Sequence
  Description of Artificial Sequence: Synthetic coding sequence
atgagccggcggacccggtgcgaggacctggacgagctgcactaccaggacactgacagcgatgttcctgaacaaagggacagcaagtgcaaggtgaagtggacccacgaagaagacgagcagctcagggctctcgtccgccagttcggacaacaggactggaaatttcttgcatcacactttcctaatcgtaccgaccagcaatgccagtataggtggttaagggtgctgaacccagacttggtgaagggcccatggacaaaggaggaggaccagaaggtgatcgagctggtaaagaaatacgggaccaagcagtggacgctgatcgccaagcatctcaaagggcgtcttggaaagcagtgtcgcgaacgatggcacaaccatctcaaccccgaagtaaaaaagagctgttggaccgaggaggaggataggatcatttgtgaagcccacaaggttctggggaacaggtgggctgagatcgccaagatgcttccagggcgaacagataacgcagtcaagaaccactggaactctacaatcaaacggaaagtagatacaggaggattcctgtctgagtctaaggattgtaaaccgccagtttatctgctccttgaactcgaagacaaagacgggctgcagtccgctcaaccgacagagggacagggcagtttactcacaaattggccaagtgtacctcccactataaaggaggaggaaaattccgaagaagaactggcagcggctactacaagtaaagaacaagaacctatagggacagatctggacgccgtgcgcacccctgaacccctcgaggagttccccaaacgcgaagatcaggaagggtccccccccgaaacctccctcccttataagtgggttgttgaagccgcaaacttactgatccctgccgtcgggtcttctctgtctgaggcccttgatctaattgagagcgacccggatgcatggtgtgacctgagtaaatttgacctcccagaagaaccttcagcggaggatagtattaataacagcctggtgcaattgcaggctagtcaccagcagcaggtcttaccacctagacagccttcagccctggtgccctccgtcactgaatacaggctggatggtcataccatctcagatctgtctcgaagctcacggggtgaactcatcccaatttcgccctctactgaggtgggaggttcagggattggaactcccccatcagtcctcaagcgccagcgcaaacgccgggtggccctgtctccggtcaccgagaactccaccagcctgtcctttttagatagttgcaactccctgacgccaaagagcacacctgtgaagacactaccttttagcccttcgcagttcctcaacttttggaataagcaagacacactcgaactggaatccccaagtctcacctccacccccgtgtgctcccagaaggtggtggttacaacgcctctacacagggacaagacccctctgcaccagaagcatgcagcctttgtgactcccgaccagaagtactccatggacaacactccccatacccctaccccattcaaaaatgctctggaaaaatacggaccgctgaagccactgccccagaccccgcacctagaggaggatctcaaggaggtccttagatctgaagccggcattgagctgatcatcgaagacgacatcagacctgaaaaacagaagcgtaagcccggcttacgacgaagcccaattaagaaagttcgaaaatcattggccctcgatatagtagacgaagacgtgaagctcatgatgtcaaccctgcctaagtccctcagcctgcccactactgctccctcaaactcgtcttcactgacattgtccggcatcaaggaagataatagcctactgaatcagggctttctacaggctaagcctgaaaaggcggcagttgcccaaaagccacgttcccattttactactccagcccccatgtcctctgcatggaagacagtggcatgcggcggcacccgcgaccagctgttcatgcaggagaaagccagacagcttctgggcaggctgaaaccatctcacacatcccggaccttgatcctgtcctag

SEQ ID NO: 8526 - DNA, 528 bp, Artificial Sequence
  Description of Artificial Sequence: Synthetic coding sequence
atgctgcggaccgaggtgccccggctgccccggagcaccaccgccattgtgtggagctgtcatttaatggctacagctagcgccatggccggtccatcttcggagacaacatcagaggaacagttgattacacaggaaccaaaggaggcaaattccactacaagccagaagcagtcaaaacaaagaaagagaggccgccacggtcccagacgctgccatagcaattgtcgtggcgactcatttgccacttatttccggagggtcttgaagcaggtccatcagggactgtccctgtcccgggaggctgtctccgtcatggacagccttgtgcatgacatcttggacaggatcgcaaccgaggccggaagactcgccaggtctaccaaaagacagaccattacggcatgggagactaggatggctgtgcgtctgctgctgccaggccaaatggggaaattggctgaatccgaaggcaccaaggccgtgcttagaacttccctgtacgccattcaacagcagagaaagtag

SEQ ID NO: 8527 - DNA, 624 bp, Artificial Sequence
  Description of Artificial Sequence: Synthetic coding sequence
atggcccccttcgagcccctggccagcggcatcctgctgctgctgtggctcatcgccccctctcgggcctgcacgtgcgttccccctcatccccagactgccttttgtaactccgaccttgtgatccgggccaaattcgttgggactcccgaggtgaaccaaaccacgctctatcagagatatgagatcaaaatgactaaaatgtataagggattccaggccctgggggatgcagctgacataagattcgtctatacaccggctatggagagtgtctgtgggtactttcaccgatcgcataacaggtccgaagaattcctgatcgcaggtaaattacaggacggactgctgcatatcacaacatgctctttcgttgcgccttggaatagcctgagcctagcacagaggcgtggcttcacaaagacctatacagtggggtgcgaagaatgcaccgttttcccctgtttatccattccctgcaaattacaatcgggcacacattgcttgtggactgatcagctcctgcagggctccgaaaaaggtttccagagcaggcacctcgcatgcttgcctagagaacccggattatgcacctggcagtctctgaggtcccagattgcttag

SEQ ID NO: 8528 - DNA, 1686 bp, Artificial Sequence
  Description of Artificial Sequence: Synthetic coding sequence
atggccgaccacaaccccgacagcgacagcaccccccggaccctgttgcgcagagtgctggatacagctgatcctaggacgccgcggagacctaggtccgcgcgcgccggtgcaaggcgcgccttgctagaaacagcttcgcctagaaagctgagcggtcagactcgcaccattgcccgggggcggtctcacggcgccaggagtgttggacggagcgcccacattcaggccagcggccacctggaggaacagacccccagaaccctcctcaagaatatcctgctcacagccccagaatcttctatactcatgcctgaaagcgttgtgaaacccgttcccgccccccaggctgtccaaccctcaagacaggagagcagctgtggctccctggaactgcaactgcccgagctcgaaccacctactactttagcacccggccttttggcgccggggcgacgtaagcagcggttacgcctgagtgttttccaacagggagtggatcagggtctttcactttcccaagagccgcaggggaacgctgacgccagtagccttacacggagccttaatttaaccttcgctacacctcttcaaccccagtcagtgcagagacccggattagcgcgtagacctcccgcccgcagagcggtcgacgtgggagccttccttcgggatctccgcgacacctcactggccccaccaaacatagtgctcgaggatacccagcccttttctcaacctatggtcggaagccctaacgtgtaccattccctcccctgtacacctcacactggtgccgaagacgcagagcaggctgcaggcaggaaaacccagtcaagcgggcctggcctccagaagaactcacccgggaagcccgcccaattcctggctggggaagccgaggaagtgaatgcttttgcgctggggtttctctccacctcttcaggcgtgtcaggcgaggacgaggtcgagccattgcacgatggcgtggaagaggccgaaaagaagatggaggaagaaggggtgtccgtctcagagatggaggcaactggagcccaaggccctagtagagtggaagaggctgaaggtcacaccgaggtgactgaggctgaagggagccagggcacggcagaagccgatggacccggtgcttcctcaggggacgaggacgcaagcggcagagccgcctctccggaatcggcctcctctacccctgagtctttacaggctagaagacaccaccaatttttagaaccagctcctgcaccaggcgcagcagtcctatcatcagaacctgctgaaccactgctggtgcgccatcctccgaggcctcgcacaaccggacccaggccaaggcaagacccacacaaggcgggccttagccattacgtgaagctcttttctttctatgccaagatgcctatggagcgcaaggctctcgaaatggtcgaaaagtgcttagacaagtattttcagcatctgtgcgacgacctggaagtctttgccgcccacgcaggcagaaaaacagtgaagcccgaagacctggaactgcttatgcggaggcagggactggtgaccgatcaggtatctttacatgtgctcgtggaacggcatctgcccctggaatataggcagctcctgattccatgtgcatattcgggaaactcagttttccctgctcagtag

SEQ ID NO: 8529 - DNA, 1134 bp, Artificial Sequence
  Description of Artificial Sequence: Synthetic coding sequence
atgaccgacgacgagagcgagagcgtgctgagcgacagccacgagggttcagagctggaattacccgtcatccaattgtgcgggcttgtggaagaactctcttatgtgaactctgccctcaagacggaaacggaaatgtttgagaaatactacgcaaagttagaaccgcgagatcagcgccctcctcgcctgagtgagattaagataagcgccgccgactatgcccagttccgcgggaggcgtagaagtaagtccaggactgggatggaccggggagttggtttgaccgcagaccagaagcttgaactggtccagaaggaagttgctgatatgaaagacgacttgcggcataccagagccaatgcggagagggacttgcagcatcatgaagccataatagaggaggcggaaatccgctggagtgaagtcagccgcgaggtccacgagttcgaaaaggatatactcaaagcaattagcaaaaagaagggcagcattttagcaacacaaaaagtgatgaagtacatcgaagacatgaatcgtaggcgcgacaacatgaaagagaagctacgtctcaagaacgtctcactcaaagtgcaacgcaaaaaaatgctcttgcagctgcgccagaaagaggaggtgtcagaggccttgcatgatgtggacttccagcagctgaaaatcgagaatgctcagttcctggagactattgaagcacgaaatcaggagctgactcagcttaaactgtcgtctggtaacactctgcaggtcctgaatgcctacaaatcgaaactacacaaggcaatggagatctatctgaatctcgacaaagagatactgctgaggaaagagttgctagagaaaatcgaaaaggagaccctgcaagtggaagaagacagggccaaggccgaagcagtgaacaagcgattaaggaaacagcttgccgaatttcgtgccccacaagttatgacttatgttcgggagaagatattgaacgctgaccttgaaaaatcaatccggatgtgggagcgcaaagttgaaattgctgagatgtccctgaaaggtcaccggaaggcctggaacagaatgaaaattaccaatgaacagctgcaggcagattacctggctggcaagtag

SEQ ID NO: 8530 - DNA, 1548 bp, Artificial Sequence
  Description of Artificial Sequence: Synthetic coding sequence
atggaggcccgggagcccggccggcccacccccacctaccacctggttcccaacaccagccagagccaagtggaagaggacgtgagctccccaccccagcggtcttctgaaaccatgcagctcaaaaaggagattagcctgttaaatggcgtgtctctggtcgtaggaaacatgataggttctggaattttcgtctcccccaaaggcgttctggtacataccgcctcatatggtatgtcattgatcgtttgggccatcgggggtctttttagtgtcgttggagccctgtgctatgctgagctgggtaccacaattaccaagtccggcgccagctacgcatacatcctggaggcatttggggggtttatagcctttatccgcctctgggtgagtctgctcgtggttgaacccaccggccaggccattatcgctattacttttgcaaactacatcattcagcctagttttccttcatgtgaccccccgtatctcgcgtgccgcctcctggcagccgcctgcatctgcctgctgacatttgtgaactgcgcctatgtaaaatggggcaccagagtgcaggatactttcacctacgctaaagtggttgcactgatcgcaatcattgtgatggggttagtcaaactgtgccaggggcactccgagcattttcaggatgcttttgaaggatcatcatgggatatggggaatttgtccctggcactgtactcggccctgttcagttattccggctgggatactctgaatttcgtgacagaggaaattaaaaatcctgagcgcaatctgcccttggccatcgggattagcatgccaatcgtcaccctgatatacatcctgacgaatgtcgcatattatacagtgttgaatataagcgatgttctcagctctgacgcagtggctgtgacctttgccgaccagacgtttggaatgttcagttggactatccccatagcagtggcactcagttgttttggtggactgaatgcctcaatctttgcaagttcccggttattcttcgtcgggtcccgagagggccatctgccagacctactgagcatgatacacattgagcgttttacacccattccggccctgctattcaattgtactatggcattaatctatctcatcgtggaagatgttttccagttgatcaattatttttctttcagctactggttcttcgtgggtttgtccgtggtgggacaactatacctacgctggaaggaaccaaaacgcccgcgcccactcaagctgagtgtgttcttcccgatcgtgttctgcatctgctccgtcttcctggtcattgtgccattgttcactgacaccattaattccctcatcggaatcggcattgccctgtctggcgttccgttttattttatgggggtttatctacctgaatcccgacgacccctgttcataaggaacgttttggcagctatcacccggggaacccagcagttatgtttctgtgtgctcaccgaacttgacgttgccgaagagaagaaggacgagagaaaaacggactag

SEQ ID NO: 8531 - DNA, 1623 bp, Artificial Sequence
  Description of Artificial Sequence: Synthetic coding sequence
atgaacggcgaggccatctgcagcgccctgcccaccatcccctaccataagttggccgatttacgctatctgagcagaggcgcgtccggaaccgtgtcttcagctcgccacgccgactggagagtgcaggtggcggtgaagcacctacacatacacacaccactgcttgatagcgagaggaaggacgtccttagggaggctgagattctgcacaaggcacgatttagctatatcctgcctatcttgggtatctgcaatgagcctgagttcctcggtatagtgacagagtatatgcccaacgggagtcttaatgagctgctgcatcggaagacggagtatccagatgtcgcttggcctctcagatttcggattctgcacgaaatcgcactgggagtgaactatcttcataatatgaccccgcccctgttacaccacgacctgaaaacacagaacattcttcttgacaatgaatttcacgtgaagatcgccgattttggcctgagcaaatggagaatgatgtcattgtcccagtcgaggtcttcaaagagcgcacccgagggaggaacaattatctatatgcctcccgaaaattatgagcctggccagaagtccagagccagtattaaacatgatatatattcctatgccgtcattacctgggaggtcctctccagaaagcaaccattcgaagacgtgacaaaccccctccagatcatgtactcagtctcacaagggcatcggcctgtgattaatgaagagtcacttccgtatgacatcccccatagggccaggatgatctcactcatcgagtcaggctgggcccagaaccccgatgaacgacccagtttcctgaagtgtttgatcgagctggagccagttctgagaacctttgaagagattaccttcctcgaagctgtgatccagttaaagaaaacaaagctgcagtctgtctcaagcgcgatccatctgtgcgataagaagaaaatggagctgagcctgaatataccggttaaccacgggcctcaggaggaaagttgtgggtcaagtcagctgcacgagaattccggtagccccgagacttctcgctctttgccagctcctcaggacaatgacttcctgagccgcaaggcccaggattgctacttcatgaagcttcaccactgtccaggtaatcattcatgggactccacaattagcggcagccaaagggcggcattttgtgaccacaaaactactccctgtagctccgctattatcaacccattatctaccgccggcaactcggagcggttacagcctgggatcgctcaacagtggatccagagcaagagagaagacattgttaatcagatgacagaggcctgtctgaatcagagcctcgatgctctgctctctcgtgacctcataatgaaggaggattacgagctggtaagcactaaacctacacgtaccagtaaagtccgccaactgcttgacacaactgatatccagggggaggagtttgctaaagtaatcgtgcagaagctaaaggacaacaaacagatgggactccagccatatcccgagatccttgtcgtctcccgcagcccatctcttaatctgttacaaaacaagagcatgtag

SEQ ID NO: 8532 - DNA, 2079 bp, Artificial Sequence
  Description of Artificial Sequence: Synthetic coding sequence
atgcgggcctgcgccggcagcacccgggaggccggcagcggcgcccaggatttgagtactttgctttgccttgaggaaagcatggaggagcaggatgaaaagccaccagaacctccaaaggcctgcgctcaagattccttccttccccaggaaattatcatcaaagtggagggcgaagatacaggatcccttacaatcccttcacaggaaggagttaattttaagatcgtaaccgtggacttcacaagggaagagcagggcacatggaatccagcccagcgcacactggaccgcgacgttatactggaaaatcatcgcgaccttgtgtcctgggacctcgccaccgctgtgggcaaaaaggattctacctcgaagcaacgcatcttcgacgaggaacccgctaatggagttaaaatcgaaaggttcaccagggatgacccctggcttagctcctgcgaggaggtggatgattgcaaggaccaattggaaaaacaacaagagaaacaggagatcttactgcaggaggttgcctttacccagcgaaaggccgttattcacgagcgtgtgtgtaagagtgatgaaaccggtgagaagtctggtctgaactcctctctattctcctctcccgtgatccccatcagaaatcattttcataaacacgtgtcccatgccaagaaatggcacctgaatgcggctgtgaactctcatcagaaaataaatgaaaatgaaactctgtatgagaacaatgagtgtgggaaacccccccaaagcattcacctgatccagtttacacgaacccagacgaaggacaaatgttacggcttctccgatcgaatacagtctttttgccacgggaccccactgcatatacacgaaaaaatccatggaggaggcaagacctttgattttaaagagtgtggacaggtgctgaatcctaagatttctcataacgaacagcagagaattccatttgaagagagtcagtataaatgttctgagacctcacacagttcttcacttactcagaacatgaggaataacagtgaagagaaaccattcgaatgcaatcagtgtggtaagtcattttcctggtcctctcatctggtggcacatcaaagaactcatacaggcgagaagccatatgaatgctcggaatgcgggaagtccttctcgcgaagctctcatcttgtcagtcaccagaggactcacaccggcgagaaaccatacaggtgtaatcaatgtggaaagtccttttctcagagttacgtgttggtggtgcaccaacggacgcatactggagaaaagccttacgagtgtaatcagtgtgggaaaagcttccggcagagttacaagctgatagctcaccaacgaacacataccggcgaaaaaccctacgagtgtaatcagtgcggaaagtctttcatccagagctataaactgatcgctcaccagagaatacacactggcgaaaaaccctacgagtgcaatcagtgtggaaaaagtttcagccaatcatacaaactcgtggcccaccagaggacacataccggcgagaaaccatttgagtgtaaccagtgcggcaaaagctttagttggagcagtcagctggtcgcccatcagcgcactcataccggagaaaaaccatacgaatgtagtgaatgcggcaaatcctttaatcgctcgagtcacctggttatgcatcagcggattcatactggcgaaaagccctacgaatgcaatcagtgtggtaaatctttcagccagagctacgtgctggttgtgcatcaaagaacccatacgggagagaagccctacgagtgctcccaatgcggtaaatcatttcgccaatcgagctgcttaacgcaacaccaacggacccataccggagaaaagcctttcgagtgtaatcagtgcgggaagacattttccctatccgcgcgactgattgtgcatcagcgcacccacaccggggagaagccctttacttgtatccaatgcggcaaagcttttatcaactcatacaaattgattaggcaccaggccacacatacagaggaaaaactctatgaatgtaactag

SEQ ID NO: 8533 - DNA, 942 bp, Artificial Sequence
  Description of Artificial Sequence: Synthetic coding sequence
atggacaacaagaagcggctggcctacgccatcatccagttcctgcacgaccagctacggcacggtggcttgtcttctgacgcgcaggaaagcctagaagtagccatccagtgtctggagactgcttttggtgtgactgtagaggatagtgatctggcactgccccagacactcccagagatcttcgaggcagcagccaccggaaaggagatgccccaggatctgaggtctcccgcaagaacaccaccttcagaggaggacagtgcggaggctgagaggctgaaaaccgagggcaacgagcagatgaaggtagagaatttcgaggccgctgtgcatttctacggaaaggctattgagctgaatccagccaatgctgtgtacttttgtaaccgcgcggccgcctattcaaaacttggcaattatgctggggctgttcaggactgtgaacgagctatttgcattgacccagcttattctaaagcatatggccggatggggctcgccctcagctcccttaataaacacgtggaagctgtggcttattacaaaaaagcccttgagctggaccctgataacgagacctataagtctaatttgaagattgcagaactcaaactaagggaggccccttctcctactggcggggtaggcagctttgacatcgccgggctgctaaacaaccccggattcatgtctatggcctctaatctgatgaataatccacaaattcagcagttgatgagtggtatgataagcggtggcaataatccactcggaactcccggtacatccccgtctcagaacgatctggccagtctgatacaggccggccagcaattcgcccagcaaatgcagcagcagaacccagagctgatagagcagctcagatcgcaaattagaagcagaacaccctccgcgagtaatgacgaccagcaggagtag

SEQ ID NO: 8534 - DNA, 1584 bp, Artificial Sequence
  Description of Artificial Sequence: Synthetic coding sequence
atgtaccagcccgaggacgacaacaacagcgacgtgaccagcgacgacgacatgacccgaaacagaagggagtcgtcccctcctcactctgtgcattccttctctggcgatagagattgggacagaaggggcaggtctagagacatggaacctcgcgatcgatggtctcacacacgcaatccgcgcagcaggatgcctccacgcgatctttccctgccggtggttgccaagacttccttcgagatggacagagaggacgacagagattcaagggcttatgagagcagatcccaggacgcagaatcctatcagaatgttgtggatctggcggaagatcgtaaaccccataacacgatccaggacaatatggaaaactacagaaagcttttgagcctgggatttctagctcaggactctgttcccgcagaaaaaaggaatacagagatgctagacaacttaccatccgcagggtctcagttcccggatttcaaacatttaggcaccttcttagtattcgaggagcttgtaacgttcgaagatgtgcttgtggacttttcccccgaggagctctcaagcctttctgcagcccaacgaaacctgtacagagaagtaatgctggagaattacagaaatctagtgtcactggggcatcaattttctaagcccgacattatctctagactggaggaggaggagtcctatgcaatggagactgactcccggcatacagtgatttgtcagggagaaagccatgacgacccattggagcctcaccaggggaatcaggagaagcttctaacccccataactatgaacgacccaaagaccctaacgccggagcgaagttatggttctgacgagttcgaaaggtctagcaacctgtctaaacagagcaaggaccccttgggcaaggatccgcaggaaggaactgctcctggaatctgcacttcgccacagagcgcctcacaggaaaacaagcataatcggtgtgaattctgtaaacggaccttttccacccaggtcgcgctgagacgccacgaaagaattcacactggaaaaaagccatacgagtgcaaacagtgtgccgaagctttctacctaatgccccatttaaacagacatcagaaaacacactccggtagaaagacgagcggatgtaatgagggtcgaaaacccagcgtccagtgtgcgaacctgtgcgagagagttagaatccatagccaggaggattactttgaatgcttccagtgtgggaaggccttcttacagaacgtacatcttctgcaacatttaaaggctcacgaagccgcaagagtgctgccaccaggattatcccactctaaaacctacctaattaggtaccagcggaaacatgactatgtgggcgaaagggcttgccagtgttgtgactgtggacgggtattttcaagaaatagctacctgatccaacattatcggacgcacacgcaagagcgcccatatcagtgtcagctttgtggaaaatgttttggccgtcctagttacctaacgcagcattaccagctccacagtcaggaaaagacagtcgagtgcgatcactgctag

SEQ ID NO: 8535 - DNA, 444 bp, Artificial Sequence
  Description of Artificial Sequence: Synthetic coding sequence
atggccctgaagcggatccagaaggagctgaccgacctgcagcgggacccaccggcccagtgctccgccggacccgtgggggatgatctgttccattggcaagctaccatcatgggccccaacgattcaccgtatcagggaggggtgttttttcttactatacacttccctacagactatccgtttaaaccgcccaaagtcgcgttcaccactaagatctatcatcccaacatcaacagtaatgggtccatctgtttggatattctgaggtcacagtggtcgcccgctctgacagtgtcaaaagttctgctctccatatgctccctcttgtgcgaccccaatccggatgaccccttggtccctgagatcgcgcacacctacaaagcagatcgagaaaagtataaccgcctcgcccgtgagtggacccagaaatacgccatgtag

SEQ ID NO: 8536 - DNA, 3072 bp, Artificial Sequence
  Description of Artificial Sequence: Synthetic coding sequence
atgttccacctgcggacctgcgccgccaagctgcggcccctgaccgcctcacaaactgtgaagacattctcccaaaatagacccgccgcggctagaacctttcagcaaattcggtgttactcagcacccgttgccgccgagcccttcctgtccggaacttcttccaattatgtggaggaaatgtattgcgcatggttagaaaaccccaaatccgtgcataaatcttgggacattttctttagaaatacaaacgctggcgctcctccagggaccgcataccaatcgcccctccccctgtctcggggaagcttggcagctgtggcccatgcccaaagcctggtggaggcccagcctaacgtggacaaactcgtcgaggatcacctcgccgtgcagtcactgatacgggcctatcagatcagaggccaccatgtcgcacagctggaccctctcggcatcctggacgccgacctcgactctagtgtgccagcggatatcataagctcgactgacaaactcggattctatggtcttgatgagtctgacctggataaggttttccacttacccacaacgacatttattgggggtcaggagagcgctctgccacttagggaaatcatcagacgtctggaaatggcttactgccagcatatcggcgttgaatttatgtttattaacgacttggaacagtgccagtggatacggcagaagttcgaaaccccagggatcatgcagttcaccaatgaagagaagcgtacactcctcgcccgtctggtgcggagcacacggtttgaggagtttcttcaacggaaatggagttcagaaaaaagattcggattggaaggctgcgaagtcctgattccagccctgaagacgattatcgacaagtcttccgagaatggcgtcgattatgtaattatgggtatgccacaccggggacgactgaatgtcctggcgaacgtcatcagaaaagaacttgagcagatcttttgtcagttcgactccaagcttgaggccgccgacgagggcagtggagacgtgaagtaccacctgggaatgtaccatcggcgaatcaaccgcgtaaccgaccgaaacatcaccctaagcctcgtcgccaatccctcccacctggaagccgcagaccctgtagtcatgggcaaaacgaaagccgagcagttctattgcggggacactgagggaaaaaaggtaatgagtatcctgttgcatggcgatgcggcatttgctggacagggaatagtgtacgaaaccttccacctttcagatttgcccagttacaccacgcacggtactgttcacgtagttgtaaacaatcaaataggctttactacagatccaaggatggcaaggagctccccatatccaacagatgtggccagggtggttaatgctccgatcttccacgtgaatagtgatgatcccgaggccgtaatgtacgtgtgcaaagtcgccgctgaatggaggagcaccttccataaagacgtcgtcgttgacctcgtctgttacagaaggaatgggcacaacgagatggatgaacctatgttcactcagcccctgatgtacaagcaaattcgaaagcagaagccggtactgcagaagtatgcagagttgcttgtcagccagggcgtggttaatcaacccgagtatgaggaggagatctcgaagtacgataagatctgcgaggaggcgtttgcacggtccaaagacgagaaaattctgcacataaagcactggctggattctccgtggcccgggttctttaccctggatgggcaacctcgctcaatgtcttgtccgagcacaggacttacggaggacatcctcacgcacatcggaaacgtcgcctcaagtgtgccggttgagaactttaccatacatggcgggcttagccgtatcctgaaaacccggggtgagatggtgaaaaatcgaacggtagattgggctttagctgagtacatggctttcggatctcttctgaaagaaggcatccacatacggttgtccggtcaggacgtggaacgcggtacgttttcacacagacaccacgtgctacatgatcaaaatgttgacaaaaggacttgcatcccaatgaatcatttgtggcccaatcaagccccttacaccgtctgcaactcctccctgagcgaatatggggtgttgggcttcgaactgggtttcgccatggcctcaccaaacgctctggtactctgggaagcacagtttggtgacttccacaacaccgctcaatgtatcatcgatcaattcatttgccccggccaggccaaatgggtgagacagaacggaattgtccttttgttaccccatggcatggagggaatgggacctgagcatagtagtgcaaggcctgagcggttcctacagatgtgcaacgacgatccagatgtgctgccggacctcaaggaagcaaatttcgatatcaaccagttgtatgactgtaattgggtggtagtgaactgctcaaccccaggcaactttttccatgtattgcgtcgccagatattattgccgtttcggaaacctctgatcatttttaccccaaagagccttttgaggcaccctgaagctcgatccagttttgacgagatgttacccggcacacactttcaaagagtcattcctgaagacggacccgctgcacagaaccccgagaacgtgaaacgcctgttgttctgtaccgggaaagtctactacgacttaacgagggagagaaaagcgagagacatggtggggcaagtcgccattaccaggatagaacagctgagtcccttcccctttgacctgctgctcaaagaagtgcagaaataccccaatgcagaactagcttggtgccaggaggagcataaaaatcagggctattatgactacgttaagccccgcctgcgcacaacgatttccagagcaaagccggtgtggtatgccgggagggacccggcagcggccccagccacaggcaacaagaaaacacacctgacggaactgcagcgcctgctcgacaccgcctttgatctggatgtgtttaaaaacttttcctag

SEQ ID NO: 8537 - DNA, 2667 bp, Artificial Sequence
  Description of Artificial Sequence: Synthetic coding sequence
atggagggcgacgactgcgagttccggtacggcgacggcaccaacgaagctcaggataatgattttccgaccgtggagcgcagccgcttgcaggagatgctgagcctcttaggactggagacttaccaagtgcaaaagctctctctgcaagatagcttgcagattagcttcgatagcatgaagaattgggcgccccaggttcctaaggatctgccctggaatttcttacgcaaactgcaggctcttaatgctgacgctagaaatactaccatggtactggatgtgctgccagatgctagaccggtggagaaggagagccagatggaggaagagataatctactgggaccctgccgacgatctagccgcggacatctactccttttcagagctgcccacccctgacactcctgttaatcctcttgacctgttatgtgcactgctgctgagcagcgactcattcctgcagcaggagattgcattgaagatggccctatgccagtttgctcttcctctggtgctccccgatagtgaaaaccattaccataccttccttctgtgggcaatgaggggcattgtcaggacctggtggtcacagcccccacgcggcatggggtccttccgagaagacagtgtggtcctgtcacgggccccggccttcgcgttcgtgaggatggatgtgtcgtccaacagcaaatctcaattgcttaatgcggtcttgtcccctggacaccggcaatgggactgcttctggcacagagacctgaacttaggcacaaacgccagagagatttcagacggcctcgtggagatcagctggttttttcccagcggccgagaggaccttgacatattccccgagcctgtagccttcctgaacttgcgaggagatatcggctcacattggctccagttcaagttactcaccgagatctcaagcgcggttttcatactgactgataatatatcgaagaaagagtacaagctcctctactccatgaaggaaagtacaaccaaatactattttatcttatcaccataccgtggcaagaggaacacaaatttacgctttttgaacaagctgattcccgtgttgaagatcgatcactcacatgttctagttaaggtgtcttctaccgatagcgatagcttcgtgaagcgtatccgcgccattgtggggaacgtgctgcgcgcaccatgtcgaagggtgtcagtggaagatatggcacacgccgcccggaaactggggctgaaagttgacgaagattgcgaggagtgccagaaggccaaggatcggatggagcggataactagaaaaattaaagattctgatgcataccgccgtgatgaactcaggttacagggtgacccttggaggaaggccgcccaagtggagaaggagttctgccagctccagtgggcagtggacccacctgagaaacatcgcgccgagctcagacgtcgtctgctggaacttaggatgcaacagaacggccatgacccatcctcaggcgttcaagaatttatcagcggaattagcagtcccagtctgtccgaaaaacagtactttctgcggtggatggagtggggacttgccagagttgcccagccacgtctgcgtcagcctcccgagactctcttgacgctgcggcctaaacacggcggaaccaccgacgttggtgagcccctgtggccagagccattaggcgtggaacattttctccgcgaaatgggccagttttacgaggctgagtcttgtctggtcgaggctggcagacttccagcaggccagcggcggtttgcgcattttcccggattggcatccgaactattgttaacgggcttgccactggaactcattgacggctccacactgtccatgcctgtgcggtgggtgacaggcctgctgaaagagttgcacgtgagactggagcgaagatctcgcctggtggtcctatcaaccgttggcgtgccagggaccggcaagagcactctgctcaataccatgttcggccttcggttcgccactggaaaatcttgcggcccacgtggcgcttttatgcagttgatcactgtagcagaaggcttttcgcaagaccttggatgtgatcacatactagtgatcgacagtgggggtcttatcgggggagccctcacttcagccggagatcgattcgaactggaggctagtctggctacactgctcatgggcctcagcaacgtcactgtgatttcacttgccgaaacaaaggatattcctgccgccattctccacgcctttttaaggttagagaagacaggtcacatgccaaactatcagttcgtgtatcagaacctgcacgacgtgagcgttccaggacctcgcccaagagacaagcgccagcttctcgacccgcccggcgatctcagccgggctgctgcccaaatggaaaagcagggtgacggtttcagggctcttgccgggctcgccttttgtgaccccgagaaacagcacatatggcacattcctggactgtggcatggagccccacctatggccgctgtctcattggcgtacagcgaggctatcttcgagcttaaacgatgcctcctcgaaaacatccgcaacgggctgagcaatcagaataaaaacatccagcagctgatcgagctggtccgccgtttgtag

SEQ ID NO: 8538 - DNA, 3744 bp, Artificial Sequence
  Description of Artificial Sequence: Synthetic coding sequence
atgatgcgggagtgggtgctgctgatgagcgtgctgctgtgcggcttggcaggccccacccacctttttcaaccgagcctcgttttggatatggctaaggtgctcttagataattactgcttccccgaaaaccttctcggaatgcaagaagctattcagcaagcaattaagagccacgagatactctctatttcagaccctcagactctggcctccgtgctgaccgccggggtgcagtcctcactcaacgatcccaggctagtcatctcttatgaaccaagtactccggaaccaccgccccaggtgcccgcgctgacaagcctgtccgaggaggagttgttagcgtggctccaaagaggcctgcggcacgaagtgttggagggcaatgttggatacctgcgggtggatagtgtgcccggtcaggaagtgctgtctatgatgggtgagtttctggtagcgcatgtgtggggcaatctgatggggactagcgcattggtgctggatctgcggcactgcactggtggacaagtgagcggcatcccctacatcatcagctatctccatccaggcaatacaatcctgcatgtcgacacaatctacaaccgaccctctaacactactactgaaatttggacattgcctcaggtactcggagagaggtacggcgccgacaaggacgtcgttgttctgactagtagccagactcggggagtcgccgaggacattgctcacattctgaaacagatgcgtcgtgcgattgtggtgggagagcgaaccggaggtggtgcgttggatttgcggaagctccgcattggtgagtcggatttcttcttcaccgtgccagtctctaggagtttgggaccccttggcggcggatctcagacatgggaggggtcaggcgtccttccttgcgtcggcactcccgcagagcaggctctggaaaaagccctggcgatcttgactcttaggtccgcactccccggagtggtgcactgcctgcaagaggtgctcaaagattactacacactcgtggaccgggtgcccaccctgctgcaacatttggcatctatggatttctctactgtggtgtcagaggaagatctcgtaaccaagcttaacgcgggacttcaggccgcatcagaggatccacgcttgctggtccgagcaattggaccaacagaaacaccctcttggcctgccccagatgcagccgcggaagattcgccaggggtggcccccgaattgcccgaggacgaggccatccgccaagccctggttgactccgtgtttcaggtgtctgtgctgcccggaaatgtcggatatctacgtttcgattctttcgctgacgcatcagtattgggagtgctcgctccttatgtcctgcgtcaggtttgggagcctctccaggacacggagcacctgattatggacctcaggcataatcccggggggcccagttccgccgttccgctcttgttgtcttactttcaggggcccgaggcagggcccgtccacctatttaccacatatgatcggagaacgaatataactcaggaacattttagccacatggagctgcccggccctcgctactccactcagagaggcgtctatctgctgactagtcatcgtacagcaaccgctgcagaggagtttgcatttctcatgcaaagcctcgggtgggcgactctcgtcggggagattactgctggtaatctgttgcatactcgtactgtacccctcctggatacccccgagggctccctggccttgaccgtacctgttctgacattcatcgataatcatggagaagcttggctcggtggtggcgtcgtgcccgatgcgatagtactcgccgaggaggcactcgataaagcgcaggaggtgctggagtttcatcagtctctcggggccctcgttgagggcacaggacatcttctcgaagcacactacgcccgcccagaggtcgtcggccagacctctgctttgttgagagccaaactcgcccagggggcttatagaaccgcggttgacctggagagccttgctagccagctgacagcagacctgcaggaggtgagcggcgatcataggctcctcgttttccattctcccggagaactggtagtggaggaggcacctcccccaccgcccgccgtaccgtccccggaggagctcacatacttgatcgaggccctgttcaaaacagaagtactccctggccagctggggtatcttaggtttgatgcaatggccgagctggagaccgtcaaggctgtcggtcctcagttggtgaggctggtgtggcagcagttggtggacacagcagcgctggtaatagacctcaggtacaatcctgggtcctacagtaccgcaatccccctgctgtgctcttatttcttcgaggccgaaccacggcagcatctttacagtgttttcgaccgggccacatcgaaagttacagaggtctggaccctgccccaggttgccggccagcgatacgggtcacacaaggacctgtacatcttgatgtcacataccagtggaagtgcagccgaggcctttgcgcacactatgcaggacctccagcgagctactgttattggcgagcccacagcaggcggtgcactaagtgtagggatttatcaggtgggatccagcccactgtacgcctccatgcctacccagatggccatgagcgccacgacggggaaagcctgggacctggcgggtgtggagcccgatatcacagtgccaatgagtgaggccctttccattgctcaggatatagtagctctaagagcgaaagtcccgaccgtactacagaccgccggtaaactcgtggcagataactacgcctctgctgaactgggggccaaaatggctacaaagctcagtggcttgcagtcgcgctattcgagggttacaagtgaggtggcattagcagaaatccttggggcagacctgcaaatgctgtccggggacccacatctcaaggctgcccacattcctgagaacgccaaagatcgaattccggggatagtgccgatgcagattccctctccggaagtctttgaggaacttattaagtttagctttcacacaaatgtgctggaggacaatatcgggtacctcagatttgacatgttcggggacggtgagctcctaactcaggtgagtaggctattggtggagcacatttggaaaaagatcatgcacaccgatgcgatgattattgacatgcgctttaacattggtggacccacgtccagtatcccgatcctgtgcagctactttttcgatgaaggccccccagtgttgctggacaagatttattcgcgtccagatgacagcgtttcagaactttggacccatgctcaggtcgtgggagagcggtatgggagcaagaaaagcatggtgattttaacctcatccgtcactgctggaactgctgaggaattcacctacattatgaaaaggttgggtagggcattggtgattggggaggttacatccgggggatgccagccaccccagacctaccacgtagacgatactaacctctatctcaccatcccaaccgccagaagcgtcggggcatcagacggatccagctgggagggcgtgggagttacaccacacgtcgtagtccccgcagaagaagccttggcacgggccaaagagatgctgcaacacaatcagctgagagtgaagaggagcccaggtctgcaggatcacctgtag

SEQ ID NO: 8539 - DNA, 885 bp, Artificial Sequence
  Description of Artificial Sequence: Synthetic coding sequence
atgaacagcgagctggactactacgagaagttcgaggaggtgcacggaatactgatgtataaggacttcgtgaaatactgggataacgttgaggcttttcaggctcgtcccgacgacttggtgatcgccacatacccaaagagtggtactacgtgggtatcagaaattgtctacatgatttataaggaaggtgatgtcgagaagtgtaaggaggacgtgatttttaacaggatccccttcctcgagtgtcggaaagagaaccttatgaacggcgtaaaacagctcgatgagatgaatagccctcgcattgtaaaaactcatcttcccccggaactgcttcccgcaagtttttgggaaaaagactgtaaaatcatatacctgtgccgcaatgccaaagatgtggccgtttcattctactatttctttctgatggtggcggggcatccaaaccccgggagctttcccgagtttgtagaaaaatttatgcagggccaagttccttatggttcttggtacaagcatgtgaagagttggtgggaaaaagggaaatccccacgtgtgctgtttctgttttatgaggacctgaaggaagatatccgaaaagaagtgatcaagctcatccattttctggaacgcaagcccagcgaggagctagtcgacagaattatacatcacacttcatttcaagagatgaagaataacccctccactaactacaccaccctgccagacgagattatgaatcagaagctgtccccttttatgcgcaagggcataaccggagactggaagaaccactttactgttgcattaaatgaaaagttcgataagcattatgaacagcagatgaaagagtcgacactaaagtttagaaccgagatctag

SEQ ID NO: 8540 - DNA, 1446 bp, Artificial Sequence
  Description of Artificial Sequence: Synthetic coding sequence
atggcctacaacgacaccgaccggaaccagaccgagaagctgctgaagagggtccgggagcttgaacaggaagtccagaggttgaaaaaggagcaagctaagaacaaagaagatagcaacattcgggaaaattccgcaggagcaggaaaaacaaagcgagccttcgacttttctgcacacggtcgccgtcatgttgcgctgcgcattgcgtacatgggatgggggtaccaaggttttgcaagtcaagagaacaccaacaacaccatagaggaaaagctgttcgaagcactgacaaaaacaagattggttgaatctaggcagaccagtaactaccaccggtgtggccgcacggataaaggggtttctgccttcggtcaggtgattagtctggacctgcgctcacagttcccaaggggccgggattctgaggattttaacgtgaaagaagaggctaatgctgctgccgaagagattcggtacacccacatattgaaccgagtgctcccacctgacatccgcattttggcatgggcccctgttgaacctagcttttccgctaggttttcctgtttggaaaggacctacaggtatttcttcccacgggctgatctcgacatcgtcactatggactacgcagctcagaaatacgtaggaacacacgatttccgaaatctctgcaaaatggatgtcgccaacggggtgattaatttccaacgaacaatcctttcggcccaagtccagctggttggacagagccctggggagggtaggtggcaggaacccttccaactttgccagttcgaagtcactggccaggcttttctgtatcaccaggtgcggtgcatgatggccattctcttccttatcgggcagggcatggaaaagccagagattattgacgaattgctgaatattgaaaaaaaccctcagaaaccccagtattcaatggccgtggagtttcctctggttctgtatgactgtaaattcgagaatgtgaagtggatatacgatcaggaggcacaagagttcaacattactcatctgcagcagctctgggctaaccatgccgtcaaaacacatatgttgtatagtatgctacagggcttagataccgtacccgtgccgtgtggtatcggaccaaaaatggacggcatgacggaatggggcaatgtcaagccatctgtgatcaaacagacctcagctttcgttgaaggcgtgaagatgaggacatataagcccctgatggatcggcctaaatgtcaaggactggaatcccggatccagcattttgtgcggcgtggcaggatagagcatccacaccttttccacgaagaggagaccaaggctaagcgcgattgtaatgataccctggaagaggagaatactaatctggagactccaacaaaacgcgtttgcgttgataccgagattaagtctattatctag

SEQ ID NO: 8541 - DNA, 618 bp, Artificial Sequence
  Description of Artificial Sequence: Synthetic coding sequence
atgagcaacttcctgcacctgaagtacaacgagaagagcgtgagcgtgacaaaagccctcactgtaaggttcctgactaagaggtttattggagagtacgcgtcgaattttgaaagtatctataagaagcacttgtgcctggagcggaaacaattaaacctagagatttatgatccttgctcccaaactcagaaagccaagttcagcctgacatccgagctccattgggccgatggattcgtgatagtttacgatatatctgacaggagctcttttgccttcgcgaaagctctcatttatagaatccgggagccacagacaagtcattgtaagagagcggtcgaaagcgccgtcttccttgtgggaaataaaagggacctgtgccacgtgagggaagtaggctgggaagagggccagaagttggccctggagaaccgctgccagttctgtgagctctccgcagccgagcagagtcttgaggtggagatgatgttcatcaggattatcaaggacatcctaattaactttaagctcaaggagaaaagaagaccatcgggtagtaaaagtatggcaaagctaatcaataacgtgttcgggaaacgccggaaaagcgtatag

SEQ ID NO: 8542 - DNA, 1008 bp, Artificial Sequence
  Description of Artificial Sequence: Synthetic coding sequence
atgggcaaggtgaaggtgggcgtgaacggcttcggccggatcggccgccttgtaacccgcgcagccttcaattctggtaaggtcgacattgtggcaataaacgatccctttatagatctcaattacatggtttacatgtttcagtacgacagcacccatgggaagttccacggcaccgtcaaggctgagaacggcaagcttgtgattaacggcaaccctattaccatttttcaagaacgagatcccagcaagataaaatggggcgatgcaggggccgaatacgtcgtggagtccacaggagtatttaccactatggaaaaggccggtgcgcacctgcaagggggagcaaagagggtgattatatccgccccatcagccgatgctccaatgtttgtaatgggcgtgaatcacgaaaagtatgacaacagtctgaaaatcatctccaatgcaagctgtaccaccaactgcttagctccattggccaaagtaattcacgacaactttggcatagtcgaaggcctcatgaccactgtccatgctattaccgccactcagaaaacagtggacggaccctctggcaagctgtggagagatggcagaggggcgctgcagaacattataccagcatccaccggggccgccaaagctgttggaaaggtgattcccgagctgaatggcaaacttactggaatggcctttcgtgtgcccacggctaacgtttctgtcgtcgatttaacctgccgattggaaaagccagccaagtacgacgacatcaaaaaggtggttaagcaggcatccgaaggccccttaaagggtatcctgggatatactgaacaccaggtagtgtcatcggattttaatagcgacactcacagcagcacttttgacgccggggccgggattgctctgaacgaccacttcgtgaaactgatctcatggtacgataatgagtttggctattctaacagggtagttgacctaatggcacatatggcaagtaaggagtag

SEQ ID NO: 8543 - DNA, 597 bp, Artificial Sequence
  Description of Artificial Sequence: Synthetic coding sequence
atggacagcctgctgatgaaccggcggaagttcctgtaccagttcaagaatgtgagatgggctaaaggacggcgagagacctatttgtgctacgtggttaagcggagagacagcgctacctcattcagcttagacttcggatatctccgtaacaagaatgggtgccatgtagaactgctgtttctcagatatattagtgactgggatctggatcccggcagatgttatcgcgtgacttggtttacttcctggtccccctgctatgactgcgccaggcacgtggctgacttcctgagggggaatcctaacctctcactccggatttttacagcccgcctttacttttgtgaggatagaaaagcagaacctgaggggctgaggcgtcttcaccgggcaggggtgcagatcgcaatcatgacatttaaggactacttctactgttggaacacattcgtagagaaccacgagcgaacatttaaagcttgggagggcctgcatgagaactccgtgaggctgtctcgtcagctaaggagaatccttctgcccctgtacgaggtcgacgacctccgggatgctttccggaccttggggctttag

SEQ ID NO: 8544 - DNA, 5472 bp, Artificial Sequence
  Description of Artificial Sequence: Synthetic coding sequence
atggccctgagcagcgcctggcggagcgtgctgcccctgtggctgctttggtcggccgcgtgcagcagggccgcctccggggacgacaacgcattcccatttgacatagaaggcagcagcgccgtcggtcgacaggatccccccgagacaagtgaacctcgagtggccctcgggagactcccacctgcagccgagaagtgtaatgcaggattctttcatactctgtctggggaatgtgttccttgcgactgcaacggcaatagcaacgaatgtctggacggaagcggctactgcgtgcattgccagcggaataccacaggtgaacattgtgaaaaatgtctcgacggatatatcggagatagcattagaggtgcccctcagttttgccagccatgcccatgtcctttaccacacttggcgaattttgcagagtcgtgctatagaaaaaatggcgcggttaggtgtatctgcaatgagaattacgcgggccctaactgtgagcggtgcgcgcctggatattacgggaaccccctcctgatcggaagtacatgtaagaagtgtgactgcagcggcaactctgaccctaacctaatctttgaagattgtgacgaagtgactggccagtgcagaaactgtctgagaaacacaaccggctttaaatgtgaacggtgcgcccctggctactatggagatgctaggatcgccaaaaattgtgctgtctgcaactgtggtgggggaccctgcgattctgtgacaggggagtgcttagaagaggggttcgagccacctaccggaatggactgcccaaccatctcatgcgataagtgtgtgtgggatctgactgatgctctgaggcttgctgcactcagtattgaggaggggaagagcggggtcctctccgttagctccggggctgcagcgcaccggcatgtgaatgagatcaatgcaactatatatttgttgaagactaagttatccgagcgggaaaatcagtacgccctgcggaaaatacagattaataatgcagagaataccatgaagtccttgttgtccgatgtcgaagagttggtggaaaaggaaaaccaagcgagcaggaagggccagctcgtacagaaagaaagcatggacactattaatcacgcttcgcagctggtagagcaggcccacgatatgcgcgataagatccaggaaattaacaacaagatgctgtactatggagaggaacatgaactgtcacctaaggagatatccgaaaaactggtgttagctcagaagatgctggaagagatacgcagccggcagcctttcttcactcaaagggagctggtggacgaagaagctgacgaggcctacgagctcctctctcaagccgagagttggcagcgtttgcataatgagacccgcactctgtttccagtagtgctggagcagctggacgattataatgccaagctgtccgacctgcaggaggctctggatcaggctctcaactacgtgcgcgacgcagaagatatgaatagagctaccgccgccaggcaacgcgaccacgaaaagcagcaagaacgcgtccgggaacagatggaggtggtcaacatgagtctctctaccagcgccgattctttgaccactccacggcttaccctcagcgaactagatgatatcatcaaaaatgcatcaggaatctacgcagagatcgatggggccaagtcagagctgcaggttaagctgagcaacctatccaatttgtctcatgacttagtgcaggaagccatcgaccatgcacaggacctccagcaggaggccaatgaactctctagaaagttgcattcttctgacatgaatggtctggtgcagaaagcactcgacgcctccaacgtttatgaaaatatcgtcaactatgttagcgaagcaaatgaaaccgcggagttcgccctgaatactactgataggatatacgatgccgtctcaggaatcgacacccaaattatctatcacaaggatgagagtgagaacctgctcaaccaggcacgagagctgcaggcaaaagcagaatccagttccgatgaagcagtggcggacaccagtcgccgagtgggcggagccctggcacgaaagtccgccttaaagacaaggctgtccgacgcagtaaaacagttgcaggcagccgaacgtggagacgcacagcagcggctcgggcaaagccgccttatcaccgaagaagccaatcggaccacaatggaagtgcaacaggctacagctccaatggccaacaacctgaccaactggagccagaacctgcagcactttgactcttccgcctacaatacagctgtgaattctgccagggacgcagtgagaaatctgaccgaggtcgtgccccagctcttagatcagctacggacagtagaacagaaaaggcctgcctcaaacgtgagtgcgagcattcagaggattagagaactgatagcccagaccaggagtgtagcaagcaaaattcaagtatctatgatgtttgacgggcagtcggccgtggaggtgcactctagaacaagcatggacgatctcaaggctttcacttccctcagcttgtacatgaagcctcctgtgaagcgcccggaactgactgagacggctgatcagttcatactgtatcttggaagcaaaaacgcgaagaaggaatatatggggctcgccattaaaaatgacaatctcgtatatgtttacaatctcggcaccaaagacgtagagatacccttagactctaagccagtatcatcttggccagcatactttagcatcgttaaaatcgagcgggtaggcaagcacggcaaagtgttcctgaccgtacccagcctctcctcaacggctgaggagaagtttattaaaaagggggagttcagcggagacgattctctgcttgacctcgaccccgaggatacagtattctatgtcggcggggtgccctccaatttcaagcttccaacatcgctgaatctgcctgggtttgttggctgcctggagctggcaaccctaaacaacgacgttatctcgctatacaatttcaaacatatctataacatggacccgtcgacatcagtcccgtgcgccagggacaaactcgcatttactcagtccagggccgcatcttacttcttcgacggctctgggtatgcggtagtgcgggatatcacacgtagggggaagtttggacaggtaacgagattcgacattgaagtgaggactcccgccgacaatggccttatcttgctgatggtgaacgggagcatgttctttcgcttagagatgagaaacggttacctccacgtcttttacgactttggttttagcggcggacccgtgcatttggaggataccctgaagaaagcccaaattaacgatgctaaatatcatgaaatcagcatcatttaccacaatgataaaaagatgatcttggtggttgataggcgccacgtaaaaagcatggataacgaaaaaatgaaaatccctttcaccgatatctacatcggtggtgctccgcctgagatcctacagtcccgcgcactgagagctcacctgccgctcgacatcaatttccgtggctgtatgaaggggttccagtttcaaaaaaaggatttcaatcttcttgaacagacagagacccttggtgtgggatacgggtgccccgaggactccctgatcagccggagagcctactttaacggtcagtccttcatcgcatctattcagaagatttcatttttcgacggctttgagggcggcttcaacttccgtaccctgcaacccaacggcctcttgttctattacgccagcggctctgacgtgttttccatcagcctcgataacggaacagtcataatggatgttaaagggattaaagtgcagagcgtggacaaacagtataacgacggcctgtcccacttcgtgatttctagtgtgagcccaaccaggtacgagctgattgttgacaaatctagagttggttccaaaaaccctactaagggcaaaattgagcaaacacaggcaagcgagaaaaagttctacttcggcggctcacctatctctgctcagtacgcaaacttcacagggtgtatctcaaacgcgtacttcactcgggtggaccgcgatgtcgaggttgaggatttccagagatatactgaaaaagtgcacactagtctgtacgaatgtccaattgaatcttctcctttatttttactacataagaaagggaagaacctgtccaaacccaaagcttcacagaataagaaaggcgggaagtccaaggacgcgcctagttgggaccctgtggctctcaaattgcctgaacgcaatacccctcgaaatagtcattgccatctctctaattctcctagggctattgagcatgcatatcaatatggcggtactgctaactcaagacaggagttcgaacacctaaagggagatttcggcgctaaatcccagttcagcatcaggctgcgaaccaggtcatcacatggtatgatcttttatgttagtgatcaagaagagaacgattttatgaccctgtttcttgcacacggcagactcgtgtatatgtttaacgtgggccacaagaagttaaaaatcagaagccaggagaagtataacgatggactgtggcacgatgtaatcttcattcgagaaagatcctctggacgccttgtgatagacggcctccgggtcttagaggagtccctcccgcctactgaggccacctggaaaattaaggggcctatttacttgggaggggttgcccctggaaaggctgtgaagaatgttcagatcaactcaatttacagtttctccgggtgcctctccaatcttcaactcaatggggcctccatcacttcagctagccagactttctcagtgacaccctgcttcgaagggcctatggaaaccggcacctacttttccacagagggagggtacgtggttctggatgaaagtttcaacatcggacttaagttcgaaatagcgtttgaggtacgcccgaggtcctcaagcggcaccctggtgcacggccactcggtcaacggcgagtacttgaatgtgcacatgaagaatggtcaggtgattgtgaaggtcaataacgggatcagggactttagtaccagtgttacacctaaacagtctctttgtgacggcagatggcaccgtatcacggtgattcgtgactctaatgtcgtccagttggatgtcgactccgaagtcaaccatgtagtgggcccattgaatccaaaaccaatcgaccacagagagcctgtgttcgttggcggcgtgccagagagtctgcttacacccagactggcgcccagtaaacctttcacaggttgtatcaggcattttgtgatcgacggacaccctgtctcgttctctaaggccgcgctggtgagcggagcggtgtcaatcaactcttgccccgccgcctag

SEQ ID NO: 8545 - DNA, 1434 bp, Artificial Sequence
  Description of Artificial Sequence: Synthetic coding sequence
atgaccagcaagttcctgctggtgagcttcatcctggccgccctgtccctatctactacattcagtctgcagcccgatcaacaaaaagtgctgctggtgagtttcgatgggttcagatgggattacctgtacaaggtccccacaccgcactttcattatataatgaaatacggcgtccacgttaaacaggttacaaatgtgttcattactaaaacctatcccaaccactacaccttggtcacgggcctctttgctgaaaatcatgggatcgttgctaacgacatgttcgacccgatacggaacaagtccttttccctcgaccatatgaatatctacgactccaaattctgggaagaggccacaccgatttggattacaaaccagcgggcaggtcatactagcggcgcagcgatgtggcctgggacagacgtaaagattcacaagaggttccctacgcattacatgccttacaacgaatctgtttctttcgaagaccgggtagcaaaaattatagaatggttcacgtccaaggaaccaatcaatctggggctgctgtactgggaggatccagacgatatgggacaccatctcggtcccgattctcccctgatgggccctgtgatcagtgacatagataaaaaacttgggtacttaatccagatgttaaagaaggctaagttatggaataccctgaacctgatcatcacatcagatcatggcatgacccagtgcagcgaagaacgtctgatcgagctagatcaataccttgacaaagaccactacacattgatcgaccagagcccagtcgcagcaatattgcccaaggagggaaagtttgacgaggtctatgaagctctcacccacgcacatccgaacctgaccgtgtataagaaagaagatgtccccgagcgctggcattacaagtataatagcagaatccagcccattatcgccgtggccgacgagggctggcatatattgcagaataaatctgatgatttcttactgggaaatcacgggtatgacaatgcgctggccgacatgcaccccatattcttggcccacggcccagcattccggaagaatttctcaaaggaggcgatgaattccacagacctatacccccttttgtgccacctgctgaacatcacagctatgccccataatgggtctttctggaatgttcaggacctcttaaatagcgccatgccacgtgtggtgccttatactcagtctactattctgctgcccggcagtgtgaagcctgccgaatatgatcaggagggtagttacccttactttattggggtgtctctgggatccattatcgttatcgtcttcttcgtcatttttattaaacatctcatacactcacagataccggcattgcaggacatgcatgctgagatcgcccagcccctccttcaagcctag

SEQ ID NO: 8546 - DNA, 1254 bp, Artificial Sequence
  Description of Artificial Sequence: Synthetic coding sequence
atgcggttcgcctggaccgtgctgctgctgggccccctgcagctgtgtgccctggtgcattgcgcgccccctgctgcaggtcagcaacaaccccctcgtgaaccacccgctgcacccggagcctggaggcaacagatccagtgggagaacaatggtcaagtgttcagtctgctgagcctcggatcccagtaccaaccccagaggagaagagaccccggggctgccgtgcctggcgctgccaatgcctcggctcaacagccaagaaccccaattcttctcattcgggacaataggacagctgctgctaggaccaggaccgccgggtcctcaggagtgaccgccggtagacctaggccaacggcgcgccactggtttcaagccgggtattccacatcccgcgccagagaggcaggtgcctctcgggccgagaaccagacagcacccggagaagttcctgccctgagtaatctgagaccaccctcccgcgtggatggtatggtgggagacgacccttacaatccttataaatactcagacgataatccctactacaactattatgacacatacgagaggccacggcccggaggaaggtaccgaccaggttacggcactggatacttccagtatggcctccccgacctcgtcgccgacccctattatatacaggcatccacttacgtgcagaaaatgtcaatgtataatctccggtgtgcagccgaagagaactgtctggcctccactgcatacagggcggacgtgcgggattatgaccaccgggtcctgctgaggtttccacagcgagtgaagaatcaaggcacttctgacttcctgccttctaggcctagatacagctgggaatggcactcctgtcatcagcattaccatagtatggacgagttcagccattacgacctgctggatgccaatactcaacggagagtggccgaaggtcacaaggcatctttttgtctcgaggacacatcgtgcgactatggatatcatcgtagattcgcgtgtacggcccacactcaggggttgagccccggctgttatgacacctatggtgcagacatcgattgccaatggatagatataacggatgtgaagccggggaactatatcctgaaagtgtcagttaatccgtcgtacctggttccagaaagcgactatacgaataacgttgtgcggtgtgacatccgatataccggtcatcatgcttacgccagcggctgtacaatatcaccatactag

SEQ ID NO: 8547 - DNA, 879 bp, Artificial Sequence
  Description of Artificial Sequence: Synthetic coding sequence
atgggcgagaagagcgagaactgcggcgtgcccgaggacctgctgaatggactgaaggtgaccgacacccaggaagccgagtgtgctggccctcctgtcccagatccaaaaaaccagcactcacaaagcaagctgttgagagatgacgaggcacatcttcaagaagatcagggagaggaggagtgctttcacgattgttccgctagtttcgaagaggaaccaggtgcagataaggttgaaaacaaaagcaatgaagatgtgaacagttccgagctcgacgaggaatacctgatcgaactcgagaagaatatgagtgacgaggagaaacagaagaggagagaagagtcaacgcgccttaaagaggaggggaacgaacagtttaagaagggggactacatcgaagccgagtcgtcctactcccgcgccttggagatgtgcccttcatgttttcagaaagagcgtagcatccttttctccaacagagcggccgctcgaatgaagcaggataagaaggaaatggccattaatgattgttctaaggcgatccagctgaacccctcctacattagggccattctgaggcgggccgaactgtacgaaaagactgacaaacttgatgaagcgttagaggactataaatccatcctggaaaaagacccctcaattcatcaggcccgagaggcctgtatgcgcctgccaaagcagatcgaagaacggaatgaaagacttaaggaagaaatgctcggaaagctcaaggacctggggaacctggtgctgagacctttcggactgtccaccgagaatttccagatcaagcaagatagtagtaccggttcatactcaatcaattttgtccagaaccccaacaataaccggtag

SEQ ID NO: 8548 - DNA, 2316 bp, Artificial Sequence
  Description of Artificial Sequence: Synthetic coding sequence
atgagcggcttcttcaccagcctggacccccggcgggtgcagtggggagctgcatggtatgccatgcattcgcgcatcctgcgaactaaacctgtggaatccatgctggagggcaccggcacgactaccgcccatggcacaaagcttgcccaggtcctgaccactgtcgatctcataagtcttggcgtggggtcctgcgtgggcaccggcatgtacgtggtttccggtctggtcgctaaagaaatggctggacctggagttatagtgagttttatcattgcggccgtggcaagcattctgtctggggtctgctacgcggagtttggtgtgcgcgttcctaaaacgacggggtctgcctatacttatagttatgtcacggtgggagagttcgtagctttcttcattgggtggaacttgatcctagagtacctcattgggacagcagctggcgctagtgcactgagctccatgttcgactcacttgccaaccatacgatttcccgatggatggctgattccgtgggtactttaaacggcttaggcaagggggaagagagttaccctgacctcctggcgcttctcattgcagtcatcgtgacaatcattgttgccttaggggtgaagaactctattggattcaacaacgtgctaaatgtgcttaatttggctgtctgggtgttcattatgattgcaggactgttcttcatcaatggcaaatactgggcagaagggcaattccttccccatggctggtctggcgtgctccagggcgctgctacgtgcttctatgcctttataggattcgatatcatcgcaacaactggggaagaggccaagaaccccaacaccagtatcccctatgcaattactgcatcattagtcatttgtcttaccgcttacgtctccgtaagcgttattcttaccttgatggttccctattataccattgatacggaatcacctttgatggaaatgttcgtggcccatggtttctatgcggcaaagttcgtcgtcgctatcggcagtgtggcgggtctgactgtgagtcttttggggagcctgtttcccatgccacgagtgatctacgcaatggccggggatggactcctgttcagatttctggctcacgttagttcgtacaccgaaacccccgtggtggcatgtattgtaagtggctttctggccgcactgctggccctccttgtgtctctccgtgatctgattgagatgatgagcattggcaccctgttagcctacacccttgtatccgtttgcgtgttactcctgagatatcaacccgagagtgatatcgatggtttcgttaaatttctgagtgaagaacataccaagaagaaggagggaatactggccgactgcgagaaggaagcctgttcgcctgtgagcgaaggtgacgagttctcaggccccgctacaaacacgtgcggagctaagaacctacccagcctgggggataatgagatgctgataggaaagtccgacaagtcaacctacaacgtgaaccacccgaactacggaaccgttgacatgactactggcatcgaagctgacgaatccgagaacatctacctgattaaactcaaaaagctaatcggccctcactattatacaatgcgaattcgccttggcctgcctggcaaaatggaccgcccaacggcagctacaggacacacggttactatatgcgtgctgctgctgtttatcctgatgttcatcttttgcagttttattatttttggatccgactatatcagcgaacagagctggtgggcgattctgctggttgtcctgatggtgttgctcattagcacactggtctttgtcatcctccagcagcccgagaatcccaaaaagctcccatacatggctccgtgcttgccattcgtgccagctttcgccatgctggtgaacatctacctaatgctcaagctctccacaataacctggattcgctttgcagtgtggtgcttcgtcggacttctcatttacttcggctacggcatctggaactctacccttgaaatttctgctcgtgaggaagcccttcaccagagcacctatcaacggtatgacgttgacgatcctttctctgtggaggaggggttctcctatgccaccgaaggagagagccaggaagactggggtggaccaactgaagacaaaggcttctactatcagcagatgtctgatgcaaaggccaatgggcggacatccagtaaagccaagtcgaagtctaagcacaagcagaactctgaggcccttattgcaaatgacgaattggattattccccagaatag

SEQ ID NO: 8549 - DNA, 513 bp, Artificial Sequence
  Description of Artificial Sequence: Synthetic coding sequence
atgggcaacgaggccagctaccccctggagatgtgcagccacttcgacgccgacgagataaaacgcctgggaaaaaggtttaaaaagctcgatttggacaactccgggtcgctgagcgtggaggagttcatgtctctgccagaactccagcaaaatccccttgtgcaacgtgtgatcgatattttcgatacagatggcaacggagaggttgattttaaagaattcatcgagggtgtttctcagttcagcgtcaaaggcgataaggagcagaagcttaggtttgcattccgcatctatgatatggataaggacggttacatttcaaatggggaattgtttcaggtgcttaagatgatggttggcaacaatctgaaggacacacagctccagcagatcgtcgataaaaccattattaacgccgacaaagatggcgacggtcgtatatcctttgaggagttttgtgccgtagtagggggcttggatattcataaaaagatggttgtagacgtttag

SEQ ID NO: 8550 - DNA, 1218 bp, Artificial Sequence
  Description of Artificial Sequence: Synthetic coding sequence
atgagcagcagcgtgaagacccccgccctggaggagctggtgcccggatccgaagagaagcctaagggtagatccccactgtcttggggatctcttttcggccatagatctgagaagatagtatttgcaaagagcgacggagggactgacgagaatgtgctgacagttaccattactgagaccaccgtgatcgaaagcgatctgggagtctggtcatcgagggctcttctatacctcacattgtggtttttctttagcttttgcactctatttttaaataagtacattttgtcgctgcttggaggggagccttccatgctgggagcagtgcagatgctgagcacaaccgtgattggatgtgtgaaaacccttgtaccatgttgtctctaccagcataaagctcggctcagctacccccctaattttctcatgaccatgctgtttgtcggcctcatgcggttcgccactgtagtgctgggtctggtctcattaaagaacgtcgcagtcagtttcgccgagaccgtcaaatcctcagcccccatattcacagttattatgagtcggatgattttaggagaatatacaggactgctggtgaatctgagcctgattcctgtcatggggggcctcgccttatgtaccgctaccgagatctcttttaatgtcctggggtttagtgccgccctcagtacgaacatcatggattgtcttcagaacgtgttctccaaaaagttacttagtggcgacaagtatcggttctcagccccagagttacaattctacacatcagcagccgccgtggctatgctggttccagctcgcgtgttcttcaccgatgtacccgtgatagggaggtcggggaagtctttttcatacaaccaggacgtcgtgctcctcctacttacagatggggtgctgtttcacttgcagtccgttacagcatatgcactcatgggaaagatctcccctgtaacattctccgtggctagtacagtcaagcatgccctaagcatatggttatccgtgatcgtgtttggtaacaaaatcacctctctctcagctgtcggtaccgccctggtaaccgtgggagtgctcctgtataacaaagcgaggcagcaccagcaggaggccctccagagcctggccgccgctacggggcgtgccccagacgataccgtggagcctctcttaccccaggatcctaggcaacatccatag

SEQ ID NO: 8551 - DNA, 1131 bp, Artificial Sequence
  Description of Artificial Sequence: Synthetic coding sequence
atgctgaagaagatcagcgtgggcgtggccggcgacctgaacaccgttacaatgaagctgggatgcgtgctgatggcctgggccctgtacctaagcctcggggttttatgggtggctcaaatgttgctggcagcctccttcgagaccctccagtgcgagggaccagtttgcacggaggagtcttcctgtcacacagaggacgatctaaccgatgctagggaagcggggtttcaggtaaaggcctacaccttctccgagccatttcacctgatagtcagctacgactggctgatccttcagggacctgctaagcccgttttcgaaggagacctcctcgtcctaaggtgtcaggcttggcaagattggcccctcacacaagttaccttctatcgagacggatccgcactcggtcctccggggcccaatcgagagttttctatcacggtggtccaaaaagcagatagtggccattaccactgcagcgggatctttcaaagtcctggtcctgggatacctgaaacagcgtccgtggtcgcaattacagtgcaggaactgtttcccgcacctatcctccgggcagttccgtctgcggaacctcaagctggaagtccaatgactctgtcttgccaaaccaagttacctttgcaacgttcggcagcccgccttttatttagcttctacaaggatggtcggatagtccagagccgcggtctgagttcggagttccagatcccgactgcctcggaggatcatagtggcagctactggtgcgaggcagccacagaggataaccaggtctggaagcagagcccccaactggaaattagagtgcagggggcttctagctctgcagccccccctaccctcaaccccgccccacaaaagtcagccgcgccgggcaccgctccggaggaagcaccgggccccttgcctccccccccaaccccctcatccgaagatcccggctttagctcgccactcggaatgccagatccccacctgtatcaccagatggggttgctgctgaaacatatgcaggacgttcgtgtgctcctagggcatcttttaatggagctgagagagctgagcggccacagaaaacctggtaccactaaagcaactgcagagtag

SEQ ID NO: 8552 - DNA, 1572 bp, Artificial Sequence
  Description of Artificial Sequence: Synthetic coding sequence
atggcccggaaggccctgaagctggccagctggaccagcatggccttggcggctagcgggatctacttttacagtaacaaatacctagaccccaatgactttggtgctgtgcgcgtgggccgggcggttgcaaccaccgcagtgatttcttacgattatctgacctcattgaaaagcgtcccgtatggatcagaggagtacttacagctgagaagtaaagtccacttaagatctgctagaagactttgtgagctctgttgtgccaatcgtggaactttcataaaagttgggcagcacctgggggctcttgattatttgctgcctgaagagtacacttccactctgaaggtcctgcacagccaggccccacaaagcagcatgcaggaaatcagacaggtgatcagagaggatctggggaaggaaatccacgatctgtttcagtcatttgacgacacccccctgggcaccgccagcctggctcaggtccataaagcagtgctccatgacgggcgtacagtggctgttaaagttcagcatcccaaagtcagggctcagagcagcaaggacatcctgctcatggaggtgctggtgctcgctgtgaaacaattgtttcctgaattcgagttcatgtggctggtagacgaggccaagaaaaacctccctttggagctggacttcctaaacgaaggccgcaatgcagagaaagtcagccagatgctgcgacacttcgattttcttaaagtcccccgcatccactgggacctttcgaccgagcgggtgctcctgatggagttcgtggatgggggccaggtaaacgatcgggattatatggaaaggaataaaatcgatgtgaatgagatctctagacacctggggaagatgtactccgaaatgatttttgtgaacggttttgtccactgcgacccccatcccggtaacgtcctggtgcgcaaacaccccgggaccggtaaagcagagatcgtgctgctggaccatggcttgtatcagatgctgaccgaggagtttaggttaaactactgccacttgtggcaatcccttatctggacggacatgaaacgggtaaaagaatatagccagcggctcggggccggggacttgtatccactgttcgcctgtatgttgacagcccggtcatgggattctgttaatcggggcattagccaagctcctgtgacagcaacagaggatctcgaaatccggaataatgcagccaattacttgccccagatcagccatctgttgaatcatgtccctaggcagatgctcttgattctgaagactaacgacctgcttagagggattgaagctgcactcgggaccagagcatccgcaagtagctttctcaacatgagtcgatgttgcatccgagcattggcagagcataaaaagaagaatacttgtagcttctttagaagaactcaaattagtttcagcgaggcctttaatctgtggcagataaacctgcatgagttgattctgcgggtcaaaggattgaagttagctgaccgcgtgctggccttaatctgttggctttttcctgcgcccctctag

SEQ ID NO: 8553 - DNA, 1197 bp, Artificial Sequence
  Description of Artificial Sequence: Synthetic coding sequence
atgtggctgctgctgaccatggccagcctgatcagcgtgctgggcacaactcatggtctgtttggaaagctgcatcccggctctcctgaagtgacaatgaacatatcccaaatgatcacctactggggctaccccaatgaagagtatgaagttgtcaccgaggatggatacatcctggaagtaaataggatcccatacggcaagaagaactcgggcaataccgggcaaagacccgtcgtgttcttacagcacggcttgctggcttctgcgaccaactggatttctaacctccctaacaatagccttgcatttatacttgccgatgctggctatgatgtgtggctgggcaattccaggggaaatacctgggcaaggagaaacttatattacagccctgatagtgttgaattctgggcatttagcttcgacgaaatggccaagtatgatttgcctgcaacaattgacttcattgtgaaaaagaccggacagaagcagttgcattacgtgggacacagccaaggcaccaccataggcttcatcgccttctctactaatccaagtctagctaaacggatcaaaacgttctatgctctggcacctgtggcaaccgtgaagtacaccaaatccctgattaataaactgcgcttcgtgcctcaatctttattcaaatttatcttcggcgacaagatcttttatccccacaatttctttgatcagttcctggccactgaagtctgtagtcgagaaatgctcaatctcctttgcagtaatgccctgttcattatctgtgggtttgactccaaaaactttaataccagccgattagacgtttacctgtcacataaccccgctggcacctccgtccagaatatgtttcattggacccaggctgtgaagtctgggaaatttcaagcttacgattggggatcgcctgtccaaaacaggatgcattacgaccagagccaacctccatattataatgtcaccgccatgaatgtgcccatcgccgtgtggaatggaggaaaggatctcctggctgacccacaggacgtggggctccttctgcctaagctgccaaacctgatctatcataaggagatccctttttacaaccacttagactttatttgggccatggacgccccacaggaggtttacaatgatatcgtgagcatgatttcagaggacaaaaagtag

SEQ ID NO: 8554 - DNA, 555 bp, Artificial Sequence
  Description of Artificial Sequence: Synthetic coding sequence
atgcggggccagggccggaaggagagcctgagcgacagccgggacctagacgggagctatgaccagttgactgattcagtagacgacgagttcgagctgagtacagtttgccacaggcctgaagggctggaacaattgcaggagcagaccaaattcacaaggaaagaactgcaggtgctgtaccggggattcaagaatgagtgccccagcggaattgtcaatgaggagaattttaaacagatctattcacagttttttccccagggagattcctccacgtatgcgacatttctcttcaacgctttcgacaccaaccatgatggaagtgtatcatttgaggaaatgctcgatatcatgaagagcatctacgatatgatggggaaatatacctatcccgccctcagagaggaagcacctcgggaacatgtcgagtcctttttccagaaaatggacagaaataaagacggagtggtgacgattgaggaatttatcgagtcatgccagaaggtgcagctgccagccctctacatcacccttacctggacccaggcatag

SEQ ID NO: 8555 - DNA, 3900 bp, Artificial Sequence
  Description of Artificial Sequence: Synthetic coding sequence
atgagcctgcaggagatgttccggttccccatgggcctgctgctgggatccgtgctactggtggcttcggctcccgcaacgttggagcccccggggtgcagcaacaaggagcaacaagtcactgtcagccacacatacaagatcgacgtgccaaagtcagcactcgtgcaggtagatgctgacccgcaaccactctcagatgatggcgccagtttgctggccttgggagaggcacgcgaggagcaaaacatcatttttagacacaatatccggctgcagacgccgcagaaagattgcgagctcgctggctctgtccaggacttgcttgccagggtgaagaagctggaagaggagatggtggagatgaaggaacagtgttctgcccagcgctgctgtcagggtgtcaccgatctctcaaggcactgttccggccatgggaccttctctctggaaacttgctcgtgccactgcgaggaagggagagaaggccccgcttgcgagagattggcatgcccgggcgcttgcagtggccacggtaggtgcgtggatgggagatgtctgtgtcacgagccttatgtaggggcagactgcggttatcccgcgtgtccggaaaattgtagcggccatggtgaatgtgtgcgtggggtgtgtcagtgccacgaggacttcatgagcgaggactgtagcgaaaaaagatgtcccggcgattgcagtggacatggcttttgtgatacaggcgagtgttactgtgaggaaggctttaccggactcgactgcgctcaggtggtcacgccccaggggcttcagctgctaaagaacaccgaggattcattgttggtatcttgggagcccagctcacaggttgaccactacttgttgagttattaccccttaggcaaggaactctcaggtaagcagatccaagtccctaaggaacagcactcttatgagatcctcgggctgttgcccggcacgaaatacattgtgactttgcgcaacgtgaaaaacgaggtctcaagtagtccccagcacctgctggccacaaccgacttagccgtcctggggactgcttgggtcacggatgagactgaaaatagtcttgacgtggaatgggagaatccctctacagaggtcgactactacaagctcaggtacggcccaatgactgggcaggaggtcgctgaggtgaccgtgcccaaatcctccgacccaaaatcgcggtacgacatcacaggcctccatcctggcactgaatacaagattacagttgttccaatgagaggtgaattggaaggcaaacccattcttctgaatggtagaactgagattgactcaccgactaatgtggtgacggacagggtgacagaagatactgctacagtgagctgggatccagtgcaggcagtgattgacaagtatgtagtacgttacacctcagcagatggtgatactaaagaaatggccgttcacaaggatgaatccagcacagttctcacaggtctgaagccaggcgaagcctacaaagtttacgtctgggccgaacgcggcaatcaggggtctaaaaaagccgatacgaacgctctgaccgagattgatagccccgccaacctggtcaccgaccgcgtgactgaaaatactgctaccataagctgggatccagtgcaggcaacaatcgataagtatgtggtgagatacacttctgctgacgaccaggaaaccagagaggtgttggttggcaaggaacagtcctctacagtcctgaccggcctgcgcccaggagtagagtacaccgtgcatgtatgggcacaaaaaggagaccgcgaaagcaagaaggccgataccaatgcccccacagatatcgactcccccaaaaaccttgtcactgatagagtcaccgagaatatggcaacggtgtcatgggacccggttcaagcagccattgacaaatatgtggttaggtacaccagcgctggcggcgaaactagagaggtgccagtcggcaaagagcagtcatctacagtgctcactggtctgcgacccggcatggaatatatggtccatgtgtgggcacagaaaggagaccaggagtccaagaaggcagacacaaaagcacaaaccgatatcgactcaccccagaacctggttactgatcgcgttacagagaatatggcaacagtgagctgggacccagtcagggccaccatcgaccgctacgtcgtcagatacactagcgccaaggatggagagacacgtgaagtccctgtaggaaaagaacagtcgagcacggtgctaacagggctgcggcccggagtagagtacacggtgcatgtgtgggcccagaagggggctcaggagagtaaaaaggcagacaccaaggctcagacagacatagactcaccccagaatctcgtgacggactgggttacggaaaacaccgctacggtttcttgggatccagttcaggccactattgaccgctacgtcgtgcactatacctcagccaatggggagacacgggaggtgccagtgggaaaggagcagtcatcaaccgtgctgaccgggttacgacccggcatggaatacacagtacatgtatgggctcagaaaggcaatcaggaaagcaagaaggctgacactaaagcccagactgagattgacggacccaagaacctggtgacagactgggtgacggagaacatggcaacagtatcatgggaccccgttcaggcaacaatagataagtacatggtacgctacacctccgccgatggtgagaccagggaggtccctgttggcaaggagcatagctctacagtgctgacgggcctccgtcctggcatggaatatatggtgcacgtgtgggcccagaagggcgcccaggagtcaaagaaggccgacaccaaagcccaaaccgagctggacccgccgagaaacttacggcctagtgcagtgactcagtctggcggaatcctgacatggacacccccctctgcccagattcacggctatatcctaacttatcagttcccagacggcactgtaaaggaaatgcagttaggtagagaggatcagcggttcgccctacagggcctggagcagggtgcaacgtaccccgtatccctagtggcttttaagggtggtcgcaggtcacgtaacgtcagtactactcttagcaccgtcggcgctcgctttccccacccttccgactgctcgcaggtgcagcagaattccaacgccgcatccgggctctatacaatatacttacatggcgacgccagtaggccactgcaggtgtactgtgacatggaaaccgacggcgggggttggatagtcttccaacggcggaataccgggcaattggattttttcaagaggtggcgcagttacgtcgaagggtttggagatcccatgaaggagttttggctggggctggacaagctccataacttaactaccggaactcctgccaggtatgaggtacgagtcgacctgcagaccgctaacgagagtgcctatgcgatttatgattttttccaggtagcctcttcaaaggaacgctataagctcacagttggaaaatacagggggaccgcaggtgacgccctgacctatcacaatggctggaagtttacaacgttcgatagggacaatgacatcgctctatctaattgcgctttgacacatcacggggggtggtggtacaagaattgtcacctggcaaaccctaatggcagatatggtgagaccaaacacagcgagggagttaactgggaaccatggaagggccacgagtttagtataccttacgtggagctgaagattaggcctcacgggtattccagagagcccgtcctgggcaggaagaagaggacccttagagggcgcctgcggaccttctag

SEQ ID NO: 8556 - DNA, 1662 bp, Artificial Sequence
  Description of Artificial Sequence: Synthetic coding sequence
atgacccggggcggccccggcggccggcccggcctgccccagccccctccgctccttttgctcctcctcctgctgccgctgctgctggttactgccgaaccccccaagcccgcaggcgtttattacgcaacagcgtattggatgcccgccgaaaaaaccgttcaggtaaagaatgtgatggataagaatggcgatgcctacggcttttacaataacagcgtgaaaacgactggctggggaattctcgaaataagggcagggtacggaagtcagacgctcagcaacgagatcatcatgttcgtcgctgggttcctggaaggataccttaccgccccgcatatgaatgatcactacaccaacctatatccacagttgattacgaaaccgagtatcatggacaaagtccaggactttatggaaaagcaagataagtggacccgtaagaacatcaaggaatataagacagatagcttctggcggcataccggctatgtgatggcccagatcgatggcttgtacgtcggcgctaagaaacgcgcgatcctcgaaggtaccaagcccatgacattattccagatccagtttctcaacagcgtcggcgatttgctcgacctgattccatcactttcccccaccaaaaatggatcactgaaggtcttcaagagatgggatatgggtcactgctctgctctgattaaggtgctgcctggattcgagaacatcctgtttgctcactcctcatggtacacctatgcagcaatgcttaggatttacaagcattgggatttcaatgtgattgacaaggacacgagttcaagcagactgtcgttttcatcttaccctggttttttggaaagtctggacgatttctatatcttgtctagcggacttatcttgctgcagactaccaatagtgtgtttaacaaaacgttactcaagcaggtgatcccagaaactctgctttcttggcaacgggttcgtgttgcaaacatgatggcggatagcggaaaacgctgggcagacatattttcaaaatataactccggcacctataacaaccagtacatggtcttggacctgaagaaggtgaagttaaatcattccctggacaaggggacactgtacatcgtagaacagattccaacatacgtagagtatagcgagcaaacggacgtgttgcgtaaaggctactggcctagttacaacgtgccatttcatgagaagatatataattggagcgggtacccattactggtgcagaaactagggctcgattactcgtatgatctggccccacgagctaaaatatttaggcgggatcagggcaaagtgaccgatacagcctctatgaagtatattatgcgatataataattataagaaagacccatacagccggggtgacccttgcaacacaatttgctgccgcgaggatcttaattcgcccaacccatcacctggaggatgttatgacaccaaggtcgccgacatatatctggctagccagtacacctcctatgcaatctctggcccaactgtgcagggaggtctgccggtgttcagatgggaccgatttaacaagactctccatcaggggatgcctgaggtttataactttgactttatcactatgaagccaattctgaagcttgacataaagtag

SEQ ID NO: 8557 - DNA, 2271 bp, Artificial Sequence
  Description of Artificial Sequence: Synthetic coding sequence
atgagccggcccggcaccgccacccccgccctggccctggtgctgttagccgtgacactggctggggtgggcgcccagggtgctgcactggaagatcctgactactatggtcaagagatctggtctagggagccctactacgcccgaccggagcccgagctagaaactttctccccacctctgccagcagggcccggcgaagagtgggaacggcgtcctcaggagccacgtccccccaagagggccacaaagccaaaaaaagctcccaagagggagaagagcgcccctgagcctcctcctccggggaagcattccaacaagaaagtcatgcgcactaagagcagcgaaaaggctgcaaacgatgaccatagtgtgagggtggctcgagaggatgtccgcgagtcatgtccacccttggggctagaaactctgaagattacagacttccagttacacgcttccacggtcaagcgttacggactgggcgctcaccggggcagattgaacatacaagcaggcataaacgaaaatgacttctatgatggagcctggtgtgccggcagaaatgatctgcagcaatggattgaggtcgacgcccggaggttgaccaggttcactggtgtcattacgcagggtcgcaattccctgtggctaagcgactgggtaacctcatacaaggtgatggtctccaacgatagccatacttgggtgactgttaagaacggctcaggagatatgatttttgaaggcaactcggagaaagagatccctgtcctgaacgaactgccagtgcccatggttgcacgttacattcgcatcaaccctcagtcctggtttgacaacggtagcatctgtatgcggatggaaatcctcggttgtccgttaccagaccctaataattattaccaccggagaaatgagatgacaacgacagatgatcttgactttaaacatcataattataaagaaatgcgacagttaatgaaggtcgtgaatgagatgtgccctaacattacccgtatttataatattggtaagagtcaccaaggactgaagctttatgccgtggagatctcggaccatcccggggaacatgaggttggcgaaccagaatttcactatattgccggcgcgcacggcaatgaagtgctgggtcgggagctactactattgctggtgcagttcgtgtgccaggaatacttggcgagaaacgcgaggatcgttcacctcgtggaagagacaaggatccatgtgctgccttccctcaacccagacggttacgaaaaagcttatgagggcggatcggagctggggggttggtcgctcggacgttggacccacgacggtatcgacatcaacaataatttccctgacctgaacacgctcctgtgggaggctgaggacagacagaacgtgccaaggaaagtcccaaatcactacattgcaatcccagaatggtttttgtccgagaacgcgacagtagcggccgagactagagccgtgattgcttggatggagaagatcccctttgtcctaggcggtaatctgcagggtggtgagctggtggtggcttatccttacgacctggtgcgttcaccatggaagacacaggagcatacaccaactccagatgatcacgtgtttagatggctggcatatagttacgcaagcacacataggcttatgacagatgcaaggaggcgagtctgtcatacagaggattttcagaaggaggagggcactgtcaatggagcaagctggcacaccgtggccgggagcctgaacgacttcagctacctacataccaattgcttcgagctcagtatctatgttggatgtgacaaataccctcatgagtcccaactcccagaagagtgggagaataacagagaaagcttaatcgtatttatggagcaggtgcaccgcggaatcaagggcctagttcgggattcccatggtaaagggattcctaatgcaattattagcgttgaggggatcaatcacgacattcgcactgctaatgacggggactattggcgcctactcaaccccggcgaatacgtggtgaccgctaaggctgaagggttcaccgcctcgactaaaaattgcatggtcgggtacgatatgggtgccaccagatgcgatttcactctgtctaagactaacatggctcgcattcgggagatcatggagaaatttggtaagcagcctgtatctctgcccgctaggcgcttaaaactgcggggacaaaagaggcgtcaaagaggttag

SEQ ID NO: 8558 - DNA, 702 bp, Artificial Sequence
  Description of Artificial Sequence: Synthetic coding sequence
atggccaccccccccttccggctgatccggaagatgttcagcttcaaagtaagccgctggatggggctcgcttgcttccggtccctagcagcatctagcccaagcatccgccagaagaaactgatgcacaaactgcaggaagagaaggccttccgggaagagatgaagatattccgcgagaagatagaggactttagagaggagatgtggactttccgaggcaagatacatgcctttagggggcaaatcttgggcttttgggaagaagaacggcctttttgggaagaggagaagacattttggaaagaagaaaagtccttttgggaaatggaaaaatcctttcgcgaggaagagaagactttctggaaaaagtatcggaccttctggaaagaagataaagcgttctggaaagaagacaacgctctctgggaaagggacagaaacctcctgcaggaggacaaagccctgtgggaggaagaaaaagctttgtgggtggaagaacgggcgctgctggaaggggagaaagctctgtgggaagacaagacctctttgtgggaagaagagaatgccctctgggaggaggagcgagctttttggatggagaacaacggccacatcgctggggagcaaatgctcgaggacggaccacacaacgcaaatcggggccagagattgctcgctttttccaggggacgggcttag

SEQ ID NO: 8559 - DNA, 696 bp, Artificial Sequence
  Description of Artificial Sequence: Synthetic coding sequence
atgatgctgagctgcctgttcctgctgaaggccctgctggccctgggttctttagagagctggatcactgcgggcgagcacgctaaagagggggaatgcccacctcataagaacccatgcaaagagctgtgccagggagacgaattgtgtcccgccgagcagaaatgttgtaccacaggttgcggcagaatttgccgcgatatccccaaaggacgcaaaagggactgtccgagggtgatccgcaagcagagctgtctgaagagatgcattaccgatgaaacatgcccaggagtgaaaaagtgctgtactcttggctgtaataaaagctgcgtagtgcctatcagcaagcagaagcttgctgaatttggaggggaatgtcccgcggaccccctgccatgcgaggaactgtgcgacggtgacgctagctgtccccaaggtcataagtgctgcagcacaggttgcggtcgcacctgtctaggtgatatcgagggcggacgagggggggattgcccaaaggtgctggtggggttatgtatcgtgggatgcgtgatggacgaaaactgccaggccggggagaaatgctgtaagagcggatgtggccgattctgcgtgccaccggtgctgcctccaaaattaacaatgaatcccaattggaccgtgcgctcggactcagaactggagatccctgtgccctag

SEQ ID NO: 8560 - DNA, 1050 bp, Artificial Sequence
  Description of Artificial Sequence: Synthetic coding sequence
atgggccccatcagcgcccccagctgccggtggcggatcccctggcaaggtctgctcctgacggcatcattgtttacgttttggaatcccccaactacagcacaactgaccatcgaggccgtgccgtcaaacgccgcagaaggtaaggaagtgctgctgttagtacataatctacctcaggatcctagaggctataactggtataagggagagaccgtggacgcaaaccgccgaattataggttacgtgatctccaaccagcagattacacctggcccagcttattccaacagagagactatttatcctaatgctagccttttaatgaggaatgtgacccgtaacgatacaggctcttatacacttcaggtcatcaaactgaatctgatgagcgaggaggttacggggcagtttagcgttcaccctgaaacccctaaaccttcaattagttccaataacagcaatcccgtggaggataaggatgccgtcgcctttacatgcgaacccgaaacccagaacacaacatacctgtggtgggtcaatggacagagcctcccagtgtctcctagactgcagctaagcaatggaaacagaactctaactttactaagcgttaccagaaacgacgttggtccttacgagtgcgagatccagaacccggcctctgctaatttttccgaccccgttaccttgaatgtgctctacggacctgatgcccctaccatctctccgtcagacacatactatcacgctggggtcaacctgaacttgtcatgtcatgctgcatccaacccaccctcacaatatagctggtccgttaatggaacattccagcagtatactcagaagctgttcatccctaatattaccacaaaaaactcaggcagctacgcctgtcacactacaaattcggcaactggccgtaataggactactgtcaggatgatcactgtatctgatgccttagtccagggaagttctcccggactttcggctcgcgcgacggtgtccatcatgattggcgtgctggctagggtggccctgatctag

SEQ ID NO: 8561 - DNA, 510 bp, Artificial Sequence
  Description of Artificial Sequence: Synthetic coding sequence
atgaccgccggccggcggatggagatgctgtgcgccggccgggtgcctgctttactgctgtgtctggggtttcatcttttacaggccgtcttgagcactacagtgatcccatcttgcattccaggagaatcctctgataactgcaccgcactggtgcagactgaagacaacccccgagttgcccaggtgtctatcactaaatgttcatctgacatgaacggctattgtctgcatgggcagtgcatctatcttgtcgatatgtcccagaattattgcaggtgcgaagtgggatacacaggggtgagatgcgaacatttttttttgactgtgcaccagccattaagcaaggagtacgtagcgctgactgtgatcctgattatcctgttcctgatcacggttgtgggttctacttactatttctgcaggtggtaccgtaacaggaaatccaaggagcccaagaaggaatatgaacgagtgacctcgggagatcctgagcttcctcaggtctag

SEQ ID NO: 8562 - DNA, 273 bp, Artificial Sequence
  Description of Artificial Sequence: Synthetic coding sequence
atgaagctgagcgtgtgcctgctgctggtgaccctggccctgtgctgttaccaggccaacgccgaattttgtccagctctggtcagtgaactcttggattttttcttcatttcagaacctctgtttaaactcagcctggccaagtttgacgcaccgccggaggccgtcgctgccaagctgggagtgaaacggtgtacagatcagatgtccctacagaagagatcactcattgcagaagtgctagtgaagatcctgaaaaagtgcagcgtatag

SEQ ID NO: 8563 - DNA, 429 bp, Artificial Sequence
  Description of Artificial Sequence: Synthetic coding sequence
atgccccggtgccggtggctgagcctgatcctgctgaccatcccccttgcgctggttgcgaggaaagaccccaaaaaaaacgaaactggggtcctgaggaaacttaaaccagttaatgcgtccaatgctaatgtgaaacagtgtctctggttcgccatgcaagaatacaacaaggaatcagaagacaaatatgtcttcctagtggtaaaaactctgcaggcacaactccaggttactaatctgttagagtatctgatcgatgtggagattgcacggagcgattgcaggaagcccctgtcaaccaacgaaatatgtgccattcaggagaactcaaagctgaagagaaagctgtcatgcagttttctggtgggcgccctgccttggaacggcgaatttacagttatggaaaaaaaatgcgaagacgcatag

SEQ ID NO: 8564 - DNA, 438 bp, Artificial Sequence
  Description of Artificial Sequence: Synthetic coding sequence
atgggcatcggctgctggcggaaccccctgctgctgctgatcgccttggtgttgtccgcaaaattaggccactttcaaagatgggaaggctttcagcagaagttgatgagtaagaagaacatgaacagcacactgaatttctttatccagagctataacaacgcctcaaacgatacatatctctaccgcgtgcagaggctcatccgctcccaaatgcagctcacaacgggagttgagtacatcgtgaccgtgaaaatcggatggaccaaatgtaagcggaatgatactagcaattcatcttgtccactgcagagtaaaaagctgcggaaaagcctgatctgtgagagtctgatctacacaatgccatggataaattatttccagctgtggaataattcctgcctcgaagccgaacatgttgggcgcaatctccgatag

SEQ ID NO: 8565 - DNA, 552 bp, Artificial Sequence
  Description of Artificial Sequence: Synthetic coding sequence
atgaagctgctgttccccatcttcgccagcctgatgctgcagtaccaggttaacacagagtttatagggctccgtagatgcctgatgggcctggggcgttgtcgtgatcattgcaacgtggatgaaaaggaaatccagaaatgtaagatgaaaaaatgttgtgtggggcctaaggtagtcaaactgattaagaattatttgcagtacggaactccaaatgtactgaatgaagatgtacaagagatgctgaaaccagcaaaaaatagctccgcagtgattcagcggaaacatatactttccgttctgccacagataaaatctacctcttttttcgcaaacacaaatttcgtgatcatccctaacgctactcctatgaattccgcgacaatctccactatgaccccaggccaaataacatataccgccacaagtaccaagtcgaacacaaaggaaagtcgggactccgctactgcctcccccccccccgcacctcccccaccgaacatattgcctactccatccctggagctggaagaggccgaagaacaatag

SEQ ID NO: 8566 - DNA, 609 bp, Artificial Sequence
  Description of Artificial Sequence: Synthetic coding sequence
atgcggggccaccccagcctgctgctgctgtacatggccctgaccacatgcctcgatacaagcccatctgaggagacagatcaagaagtgttcttgggcccacccgaggctcagtcttttctgagctcccatacaaggattcctcgcgcaaaccactgggacctggaactcttaacaccgggtaacctggaacgtgagtgtctggaagagcgctgttcctgggaggaggcccgtgaatacttcgaggacaataccctgacagaacggttttgggaaagctacatatataatggtaaggggggacgcggcagagtcgatgtcgcgtcactggcagtagggctcaccggtggcatactcctgattgtgctggcaggcctcggtgccttctggtatctccgctggagacagcaccgtggccagcaaccttgtccacaggaggcgggactaatatctcctctgtcacccctgaaccccttaggaccccctactccattgcctccgcctcccccaccaccacccggactgcctacctatgaacaggccttggctgcatctggcgtgcatgacgctcccccgccaccctatacttccctccgacgaccccactag

SEQ ID NO: 8567 - DNA, 558 bp, Artificial Sequence
  Description of Artificial Sequence: Synthetic coding sequence
atgcggctgctgatcctgacctgcctggtggccgtggccctggccaggcccaagctgcccttaaggtatcccgaaaggctgcagaatccatctgaaagctcggagcccatcccattggaaagccgtgaagaatacatgaatggtatgaaccggcagaggaacatcctgcgagagaaacaaacagatgagatcaaggatacaaggaatgagagcactcaaaactgcgtggtcgccgagcccgagaagatggagtcaagcataagcagtagtagcgaggagatgtctctaagtaagtgcgctgaacaattctgcagacttaatgagtataatcagttgcagctgcaggcggcacatgcccaagagcagataagacggatgaatgaaaattcccacgtacaggtgcctttccagcagctcaaccagctcgccgcctacccatacgctgtgtggtattacccccagatcatgcaatatgtgcctttcccaccttttagcgacatatccaacccaaccgctcatgagaactatgagaagaataacgtgatgctgcagtggtag

SEQ ID NO: 8568 - DNA, 1410 bp, Artificial Sequence
  Description of Artificial Sequence: Synthetic coding sequence
atgatcaccgagggcgcccaggccccccggctgctgctgccccccttgctgctgctgttaactctccctgcaaccgggagcgatccagttctctgttttacccagtacgaggagtcttccgggaagtgtaagggacttttaggcggcggcgtttctgtcgaggattgttgtcttaatactgcgtttgcgtaccagaagaggagcgggggattgtgtcaaccgtgccggagccctagatggagtctctggagtacgtgggcaccctgtagcgtgacttgcagtgaggggagccagttgagatacagacggtgcgtaggctggaatggacaatgctcaggaaaagttgcccccgggaccttagaatggcagctgcaggcttgcgaagaccagcagtgctgccccgagatgggcggatggtccggctgggggccttgggagccatgttctgtgacttgtagtaagggaacgcgtactaggcggcgcgcctgcaatcaccccgccccaaagtgcggggggcattgccccggtcaggcccaggagagcgaggcttgcgacacccagcaggtgtgtccgactcacggggcctgggcaacctggggcccttggaccccttgttcggcttcctgccatggagggccccacgaacctaaggagacccggagtcggaagtgtagcgcccctgaaccgagccagaagccacctggcaaaccctgtcctggattagcttacgagcaacgccgatgcaccggtcttccaccttgccctgtagccggcggctggggtccctggggacctgtgtcgccttgccccgtgacctgtggcctaggacagactatggagcaaaggacttgcaaccaccccgtgcctcagcatggtggccctttttgtgctggtgacgccacccggacccatatttgtaatactgctgtgccctgtccggtggatggcgagtgggattcttggggcgagtggtccccttgcatccggcgcaacatgaagtctatcagttgtcaggagatcccgggccagcaaagcagagggaggacatgtcgcggcaggaagtttgatggccacagatgtgccggacagcaacaagatatccgacattgctacagcatccagcactgccccttaaaggggagttggtcagaatggtcgacttggggcctgtgcatgcccccctgcggcccaaatcctaccagagctaggcagaggctctgcacacccctcttacctaagtaccctccaacggtaagcatggtcgagggccagggagagaaaaatgttactttttgggggcgccccctaccacggtgtgaggagctgcaaggtcagaagctggtagtcgaagagaagaggccctgcttgcacgtgcctgcatgtaaggatcccgaggaggaagagttatag

SEQ ID NO: 8569 - DNA, 453 bp, Artificial Sequence
  Description of Artificial Sequence: Synthetic coding sequence
atgctgatcgccaccagcttcttcctgttcttcagcagcgtggtggctgcaccaacgcattcatccttttggcagttccagcgaagagtcaagcacatcaccggccgttcagctttcttctcttattacggatacggctgctactgtggacttggggacaaaggcataccagtggatgatactgacagcccatcatctccctccccgtacgagaaactgaaagagtttagctgtcagccggttctcaactcttaccagttccacattgtgaatggtgccgtcgtttgcggttgtacactcgggccaggtgcatcgtgtcactgtcgcctcaaagcttgcgagtgtgacaagcagagcgtgcattgctttaaggaatctctgcctacatacgaaaagaactttaaacaattctccagtcaacccaggtgcggaagacataaaccttggtgttag

SEQ ID NO: 8570 - DNA, 1347 bp, Artificial Sequence
  Description of Artificial Sequence: Synthetic coding sequence
atgcgggagtgcatcagcgtgcacgtgggccaggccggcgtgcagatgggaaatgcatgctgggaactgtattgtctcgagcatggtatacagccggacggccagatgccatcagacaaaaccattggcggaggcgacgacagcttcacaaccttcttttgcgagacaggcgcaggaaagcatgttcccagggcggtgttcgtggatctggagccgaccgtgatcgatgagattcggaacgggccatatcgccagcttttccaccctgagcagctgattacggggaaggaggatgcagctaataactacgctaggggccattatacaatcgggaaagaaattatcgacccggtgctggaccggattcgcaaacttagcgaccaatgcacaggactgcagggcttcctggtgtttcattcatttggagggggcacaggcagtggtttcaccagcctcctgatggaaaggctgtccgttgactatgggaagaaatctaagttagagttttctatctaccccgcaccacaggtgtccactgccgtcgtcgaaccatataattcaattttaaccacacacacaacactggaacactccgattgtgcctttatggtggataacgaagcaatctacgatatttgccgtcgtaacctggatatcgaacggccaacttataccaatctgaacagattgattagccaaatcgtgtcctccattaccgcctctctgcggttcgatggggcattgaatgtcgatctaactgaattccagacgaacctcgttccttacccacgtatacatttcccactggcaacatatgcacctgtcatttcagcagaaaaggcgtatcatgagcaattgagcgtagccgaaatcacaaatgcttgcttcgaacccgccaaccagatggtgaaatgcgatcccagacatggtaaatatatggcctgttgcttactgtaccgtggagacgtggtgccgaaagacgtcaatgcggccatcgccgcaatcaagaccaaacggagtatccagtttgttgattggtgcccaacaggctttaaggtggggatcaattatcaaccacccactgttgtccctggaggcgacctagccaaagtccagagagcagtgtgcatgctaagcaatacaaccgccattgctgaagcttgggccagattggatcacaagttcgacctaatgtacgcaaagcgagccttcgtacactggtacgtcggtgaaggaatggaggagggggaattctccgaagcgcgggaggacatggccgctctcgagaaagattacgaggaggttggaatagattcatacgaggacgaggatgaaggagaggaatag

SEQ ID NO: 8571 - DNA, 942 bp, Artificial Sequence
  Description of Artificial Sequence: Synthetic coding sequence
atgcgggtggtgaccatcgtgatcctgctgtgcttctgcaaggccgcggagcttagaaaagcctctcctgggtccgttcgatcccgcgtaaatcatggtcgcgcaggcgggggaaggcgcggtagtaatcccgtgaagcggtacgcgccaggtctgccttgcgacgtgtatacctacctccatgagaagtacctcgactgtcaagaaaggaaactggtttatgtccttcctggttggccacaggatctgctccacatgctgctggccagaaacaagattaggacactgaagaataacatgttctccaagttcaaaaaattgaagagtctcgatctgcagcaaaatgagatctcgaagatagagagtgaggcatttttcggactgaacaagttaaccaccctgctcctacaacacaaccagatcaaggtgctgacggaagaagtttttatttataccccccttctgtcttacctccggctgtatgataatccatggcactgtacttgtgagattgaaacgctgatctctatgctgcagatccctagaaataggaacttgggtaactacgcaaagtgcgagtctcctcaagagcaaaagaacaaaaagttgcgccagatcaagtcagagcaactttgtaatgaggaggagaaggagcagctggatccaaagccccaagtgtctggccggccgccagtcattaagcctgaggttgattccacgttctgccataattatgtgttccccattcagactctcgattgcaaaagaaaagagcttaagaaggtgccaaataacatcccccccgacatcgtgaaactagacctgagctacaacaagatcaaccagcttcggcctaaagaatttgaagacgtgcacgaactgaaaaagcttaacctatccagcaatggtattgagttcattgatcctggctcactgagatag

SEQ ID NO: 8572 - DNA, 972 bp, Artificial Sequence
  Description of Artificial Sequence: Synthetic coding sequence
atgcaggccgcctggctgctgggcgccctggtggtgccccagctgttgggatttggccatggagctcgtggtgctgaacgtgagtgggaaggagggtgggggggcgcccaggaagaagagagagaaagggaggcgctcatgttgaaacacctccaggaggcgctgggactccccgcgggacggggggacgagaaccctgctggaacagtggaaggaaaggaggattgggagatggaagaggaccagggcgaagaagaggaggaagaagccactcctacccctagctcagggcctagcccaagtccaacccctgaggatatcgttacatacattttggggagactggccgggctggacgcgggattgcatcagttacacgtccggttgcacgctttggatacacgcgtcgtagagttgactcagggactcagacagctgcgcaacgccgctggggatacaagagatgcagtgcaggccttgcaggaagcacagggtagagctgagagagagcacggtcgcctggaagggtgcctgaagggactgcggctggggcataagtgctttttgttgagtagggattttgaggctcaggcagcagcccaagcacggtgcacggcccggggcgggtccctcgcccagccagcagataggcagcagatggaggccctgacgagatatctgcgcgcggctcttgccccatacaattggcccgtctggctgggagtacatgatagacgtgctgagggtctgtacctcttcgagaacggccagcgggtgtcattttttgcctggcaccgaagtcccaggcctgagttgggggcccaaccctccgcaagtccgcatccactcagcccagatcagcctaacggaggtaccctcgagaactgcgtggcccaagcatccgatgatgggtcttggtgggatcacgattgtcagaggcggctgtactatgtatgcgagttccccttctag

SEQ ID NO: 8573 - DNA, 1086 bp, Artificial Sequence
  Description of Artificial Sequence: Synthetic coding sequence
atgaacggcctgagcctgagcgagctgtgctgcctgttctgctgccccccctgtcccggtcggatcgctgcaaaacttgctttcctgccaccggaagctacatattcactggtgcccgagcctgaacccgggccaggaggcgcaggggcagcccctctaggaacattgcgggcatcatccggagctccagggcgatggaaacttcatctgacggaacgcgccgattttcagtatagtcagcgtgagttggatacaatcgaggtctttccaacgaaatccgctagggggaatagggtttcctgtatgtatgttagatgcgtgccaggagcccgccaaggacaccaagcacagggcggccacccgcagctcgcctgggtgggtcgacttggcgactcaaacaatcctgctcccggcgggtgcctgttgggcaagagctggggcacgggagctgctctggcttgcggctatatccacctgctggcacgttacacagtgctgttttcacacggtaacgccgtggatcttgggcagatgtcttccttctacatcggcctgggctctcgtctgcattgcaacatcttctcctacgactattccggatacggggcctctagtgggaggccctccgaaaggaatctatatgctgatatcgatgccgcgtggcaggcccttagaacacggtacggcattagtcccgacagtatcatcctctatgggcaaagtatcgggactgtgcctaccgtcgatctggcgagcaggtacgagtgtgctgccgtggtgttgcattcccccctcacctcaggtatgcgcgtggccttcccagataccaagaagacttactgcttcgatgccttccctaacatcgaaaaagtctcaaagatcactagtccagtcctgattatccatggcactgaggatgaggtcattgacttctcccatggacttgccctttatgagagatgtcctaaggcagtggaacccctctgggttgagggggcaggacataatgacatcgagctgtacagtcagtacctggaaaggcttcggcgattcatcagccaggagctgccatcacagagagcatag

SEQ ID NO: 8574 - DNA, 1404 bp, Artificial Sequence
  Description of Artificial Sequence: Synthetic coding sequence
atgcggaccgcccccagcctgcggcggtgcgtgtgcctgctgctggccgccattcttgacctggccaggggctatcttaccgtgaacatcgagcccctcccccccgttgtggcgggagacgcggtgaccttgaagtgcaattttaagactgacggcagaatgcgggagatcgtgtggtacagggttacagacggagggactattaaacagaaaatatttacatttgacgctatgtttagcacgaattactctcatatggagaattaccggaaacgggaggacctcgtgtaccagtctactgttcggctccctgaggtcaggatcagtgacaacgggccatatgagtgccatgtgggcatttacgaccgggccaccagagaaaaagttgtcctggcttctggtaacatttttcttaatgtaatggccccacccacgtcaatagaggtggtggcggcagacactccagcccctttcagccggtatcaggcgcagaacttcacacttgtttgcatagtgagcgggggaaagccggccccaatggtctattttaagcgggatggagaacctatcgacgccgtcccattgagtgagcccccagctgcctcctctggacccctgcaggatagtaggccttttcgctccttgcttcatcgagacctggacgataccaaaatgcagaaatctttatccctcttagatgcagagaatagaggggggcggccgtataccgagcggcctagtcgcggattgactcccgatcctaacatactactgcaacctactacagagaatatacccgaaacggtagtttcgcgggagttccccagatgggtgcattctgccgaacctacttacttcctgagacatagccggactccctcatccgatggaaccgtggaagtcagggctctcctgacttggacgcttaatccccagatagataatgaagcactgttttcctgtgaggtcaagcaccctgcgctttcaatgcccatgcaggccgaggtcactctggtagcgccaaaggggcctaagatcgtcatgactcccagccgagcccgtgtcggggacactgtgcgcatcctcgttcacggtttccagaatgaagtttttccagaacccatgtttacatggacccgagtgggcagtcggctcctcgatggcagtgccgagttcgacggcaaagaactcgtgttggagcgtgtgccagccgagttaaacggctcgatgtacaggtgtactgcacagaatcccctgggtagtacagatacacacaccagactgattgtttttgagaaccccaacatccctagagggactgaagatagtaatgggagtatcggcccaactggagcgagattgaccctcgtcctcgcactgactgtgatactggagttgacttag

SEQ ID NO: 8575 - DNA, 783 bp, Artificial Sequence
  Description of Artificial Sequence: Synthetic coding sequence
atggcccggcccggcatggagcggtggcgggaccggctggccctggtgaccggggcatctggcggaattggcgctgcggtcgcgagggccttggtccaacagggcctaaaggtggtcggttgcgcccgcactgtgggcaatatcgaagagctggccgccgaatgtaagagcgcgggctacccagggactctcatcccctaccgctgcgatctaagcaatgaggaggacattctctctatgttttctgctatccgtagccagcattctggggtggacatatgcattaataatgcaggactggcgagacccgacacattattatccggatcaacaagtgggtggaaagacatgtttaacgtcaatgtgctggcgctatcaatttgcacccgcgaggcctaccagtccatgaaggaacgtaatgtggatgacgggcacataattaacatcaactcaatgagtggtcacagggtgctcccattaagcgttacccacttttactccgctacaaagtacgctgtgacagcccttaccgagggactgcgtcaggaactgcgcgaagcccagacacatatcagagctacctgcatatcgccaggggtggtcgaaacgcaattcgcttttaagctacacgataaggatcctgagaaagctgcagcgacatatgagcaaatgaaatgcctgaaacccgaagacgtagcagaggccgtaatttatgtactgagtactcccgctcacattcagataggcgatatccaaatgaggccaacagagcaagtgacttag

SEQ ID NO: 8576 - DNA, 1218 bp, Artificial Sequence
  Description of Artificial Sequence: Synthetic coding sequence
atgagcagccccgccctgaccgccggcgccagcggcaaggtgatggactttaacaacgggacttatctagtctcctttactcttttctgggagggccaggtgtccctgtctcttttgctcattcacccttcggagggagcctccgctctgtggagggcccgaaaccagggttatgacaagatcattttcaagggtaaattcgttaacggcacttcacacgttttcaccgaatgtggcctgaccctgaatagcaatgcggagttgtgtgaatacttggatgatagggatcaggaagctttctactgtatgaagccccaacatatgccttgcgaggccctgacctacatgacaaccaggaatcgcgaagtgagctatcttaccgataaagagaattccctgttccaccgcagtaaagtaggcgtggaaatgatgaaggaccgaaaacacatcgacgtcacaaattgcaataagagagagaagattgaggagacctgtcaggtgggaatgaagccaccagtccctggtgggtataccttacagggaaaatggatcactactttttgcaaccaagttcagctcgatactatcaaaatcaacgggtgcttgaagggcaagctgatatatcttctaggggacagcactctcagacaatggatttactattttcccaaggtagtaaagaccttgaagtttttcgacctccatgagaccgggatctttaaaaagcacctgctgcttgacgccgagagacacacacagatacaatggaagaagcactcctacccatttgtaacattccagctttactccctgattgatcatgattatattccaagagagattgaccggctgtcgggcgacaaaaacaccgcaattgtgattaccttcgggcaacatttcaggccattcccgatcgacattttcatccgccgcgctatcggggtacaaaaggccattgagaggttgtttctacgatctcctgccaccaaggtcatcatcaagactgagaatatccgagagatgcatatcgagacagagagattcggcgacttccatggatacattcattatctgatcatgaaggacatatttaaagatctaaacgtcggcatcatcgacgcctgggatatgactatcgcctacgggacagacactatacatccccctgaccatgtcattggcaaccagatcaatatgtttttgaattatatatgctag

SEQ ID NO: 8577 - DNA, 597 bp, Artificial Sequence
  Description of Artificial Sequence: Synthetic coding sequence
atgcccgtgcccgccctgtgcctgctgtgggccctggccatggtgacccgtccagccagcgccgcgcccatgggcggcccagaactggctcaacatgaggaactcactctcctgtttcatgggaccctgcagctgggccaggccctgaacggagtttaccgcactaccgagggtcgtctgacaaaggccaggaattcgttggggctgtacggcaggacaatcgagctcttgggccaagaagtttccagaggaagggacgccgctcaggagctgcgagccagtctgttggaaacacagatggaggaagatatccttcagctgcaggctgaggcgaccgcagaggtgctgggtgaggtggcccaagctcagaaagtgttgagggactcagtgcagcgcctcgaggtccagctcagaagcgcctggttgggacccgcctatagggagtttgaggtgctgaaagcacatgctgacaagcagtcccacatactgtgggctctaaccggccacgtgcaacgccagagacgggaaatggtggcacagcagcataggctcagacagatccaggaacgcctacacaccgcagctttgccagcctag

SEQ ID NO: 8578 - DNA, 1455 bp, Artificial Sequence
  Description of Artificial Sequence: Synthetic coding sequence
atggccggcccctggaccttcaccctgctgtgcggcctgctggccgccaccttgattcaggctaccctttcgccgactgctgtcctgattctgggtcccaaagtcatcaaagagaagttaactcaagaactgaaagaccacaatgctacgtctatactccagcagttgccactgttgagcgcaatgcgggaaaaacccgctggtggaattcccgtgctaggatctctagtcaacacagtgctgaagcacatcatatggcttaaggtgattacagcaaacatcctgcagctgcaggtgaaaccttcagccaacgatcaggagctcctggtgaagattcctttggacatggtcgccggctttaacaccccactcgtgaagaccatcgtcgagtttcatatgaccaccgaagcccaggcaaccattcgcatggacacctcagctagcggcccgactcgactggttctttcggattgcgcaacttctcacgggtcactgcgaattcagctgctgcataaattgagtttcttggtcaacgccttggcgaaacaggtcatgaatctactggtgccctctctaccaaatctcgtgaagaatcagctctgccccgtcatcgaagcaagctttaatggaatgtatgccgatctcttacaacttgtcaaggtcccaatttcactgtccatcgatcggttagagtttgacctgctttatccagcaataaagggcgacactatccagttgtacctcggagccaagctgctagattctcaagggaaagtcactaaatggtttaataattctgctgccagcctgactatgcccaccctcgataatattccattctcactgatagtctctcaggatgtcgtgaaagccgctgtcgctgcagtgttgtcacctgaggagttcatggttctcctcgatagcgttctgccggagtcagcccatcgccttaaaagctcgattggacttataaatgagaaagcagccgacaagctgggcagcacccagatagtgaagatactgacccaggacacgccagagttctttatcgatcagggacatgcgaaggtggctcagctgatcgttctagaagtcttcccaagctctgaagcactgcgacctttgtttaccctgggcatcgaggcatcgagcgaggcacaattctacacaaagggtgaccagctgattcttaacctcaacaacatcagcagcgatagaatccaactcatgaattctggcatcggatggtttcagccagacgttctcaagaacatcatcaccgagattattcactctatcctgctccccaaccagaatggcaagctgcgcagcggagtacctgtgtctttggtcaaggcactaggtttcgaggcagctgagtccagtctaaccaaggacgccttggtactgaccccagcgagcttgtggaagccgagctcccctgtctctcagtag

SEQ ID NO: 8579 - DNA, 750 bp, Artificial Sequence
  Description of Artificial Sequence: Synthetic coding sequence
atgctgcagctgtggaagctggtgctgctgtgcggcgtgctgaccggaacgtcagagtcactgctcgacaatttaggcaacgatttatctaatgtggtggacaagctcgaacctgtgctccatgaaggccttgagactgtggacaatacgctcaagggcatactcgaaaagttgaaggtggatctaggggtgctgcaaaagagctctgcatggcagctggctaaacagaaagcacaggaagctgagaaactcctcaataacgttatctccaaactgctacctacaaacaccgacatcttcggtttgaaaatctcaaattcactgattctggatgtaaaagccgaaccaatagatgatggcaaaggactaaatttgtcatttccagtgaccgcgaacgtgactgtggccggccccatcattggacagatcatcaaccttaaagcttccctagaccttctaactgctgtgactattgaaacagacccccagacacaccagcccgtggctgttctcggagagtgcgcaagcgaccctactagtattagcctctcccttttggacaaacacagtcagataattaacaagttcgtgaatagcgtcattaatacactgaagagtaccgtaagctctctgcttcagaaggagatatgcccactgattaggattttcatccactccctggacgtcaacgttattcagcaagtcgtcgacaaccctcagcataagacccagctgcagacccttatttag

SEQ ID NO: 8580 - DNA, 1959 bp, Artificial Sequence
  Description of Artificial Sequence: Synthetic coding sequence
atgcagggccccctgctgctgcccggcctgtgcttcctgctgagcttgtttggcgcagtcactcagaaaactaagacatcctgcgccaaatgccccccgaatgcttcttgtgtcaataacacccactgtacatgcaatcatggttacacatccggatctgggcagaagttgttcaccttcccgctggaaacttgcaatgatatcaacgaatgcacgcctccttacagtgtctactgcggcttcaatgccgtatgctacaatgttgagggctcgttctattgccagtgcgttcccggatataggctccacagtggaaatgagcaattttccaactcaaatgagaatacatgtcaggacacaacctctagtaaaactactgaagggcgtaaagagttacaaaaaatcgttgacaagttcgaatccctcctcacaaatcagactctttggcgcaccgagggacgacaagaaatctcttcaacagctaccaccattttgagagatgtggaaagcaaggtcctggaaacagccttgaaagatcctgagcaaaaggtattgaagattcagaacgattcggtggccatcgaaacacaggctatcactgacaattgctccgaagagagaaaaacgtttaacttaaacgtgcagatgaattccatggatattagatgcagcgatataatacaaggcgacacccagggcccttcggccattgcttttatcagttactcatcactgggaaacattatcaatgctacatttttcgaagaaatggacaaaaaggatcaggtgtacctgaattcacaggtcgtatccgccgccattggtcccaaaagaaacgtatctctctctaagagtgttactctgacattccaacacgtcaaaatgaccccatctacaaaaaaggtgttttgcgtctactggaaatccaccgggcagggttcccaatggtccagagacggatgtttcctgatccacgtgaataagagccataccatgtgtaattgctcacatcttagcagcttcgccgttcttatggcgctgacttcccaggaggaagaccccgtcctgactgtcatcacctatgtggggttatctgtgtcactgctatgtctcttgctggccgcactgaccttcctgctgtgcaaagcaattcgtaacacttctacttcactacatctgcagctatccctgtgtctctttctagcgcatctcctctttctagtgggaatagatcggacagagcctaaagtgttgtgtagcattatcgctggggcccttcattatctctacctggctgccttcacctggatgttgctcgagggagtgcacctgtttcttacagctaggaatctgaccgtcgtgaactacagctccatcaatcggttaatgaagtggataatgttccctgtgggctacggggtcccagccgtaacggtggccataagcgccgccagttggccccacctatatggaaccgcggaccggtgttggctgcatctagatcaggggtttatgtggtcatttctggggccagtctgtgctattttttccgccaaccttgtgctgtttatactggtgttctggattcttaaaaggaaattatcatccctcaattccgaggtgtccactatacagaatacaagaatgcttgcattcaaggccacagcccagctcttcattctcggctgtacctggtgcctaggactacttcaggtgggcccggccgcacaggtaatggcctatctgtttactatcatcaatagcttgcagggcttcttcatttttctcgtgtattgcctgctgtcacaacaggtacagaagcagtaccagaaatggttccgagagatagtgaagtcaaaatctgaatcggagacctacacgctaagcagcaagatggggcctgacagtaagccctccgaaggagatgtgtttcccgggcaggtcaaacggaaatactag

SEQ ID NO: 8581 - DNA, 1263 bp, Artificial Sequence
  Description of Artificial Sequence: Synthetic coding sequence
atgagccccccccccctgctgcagcccctgctgctgctgctgccccttctgaacgtggaacctagcggtgcgacgctgatcagaatccctctgcacagggtgcagcccgggcgaagaatcctgaatttgctccgcggctggagagaacccgccgagttgcctaagctcggagcgcccagccccggagacaagcccatttttgttcctctatcaaactaccgggacgtgcagtacttcggcgagatcggactgggaactccgccacagaacttcactgtggccttcgatactgggtctagcaatttgtgggtaccctcccggaggtgtcacttttttagtgttccatgctggctccatcatcggttcgatcctaaagcctcgagcagcttccaagccaacggcacaaagttcgcaatccagtacggcaccgggcgtgtggacgggattctgagtgaagacaagctgacaatcggaggaatcaaaggggctagcgtaattttcggggaggctctctgggagccttcactcgttttcgccttcgctcatttcgacggaatcctcggactaggttttcccatcttaagcgtggaaggggtccggccacccatggatgtattggtggagcagggactgctagacaagcccgtcttttcattctacctgaacagagaccctgaggagccagacgggggtgagctggtgttagggggtagcgacccagcacactatattcctcctctcaccttcgtgcctgtgacggttcctgcatattggcaaattcacatggagagggttaaggttggacccggccttaccctgtgtgctaaagggtgtgcggccatcctcgacactgggacctcactgattacggggccgaccgaggagatacgcgcactgcacgctgctattggcggcattcccttactggcaggggagtatattattctttgctccgagattccaaaactgccagcggtgtccttcctgttaggaggagtgtggttcaatctgacagcgcatgactacgttatccagacgaccagaaatggagtacgattgtgcctcagcgggtttcaagcgctggacgttcctcctcccgccggtcccttctggatactgggcgatgtgtttctcggaacttatgtagctgtcttcgatcgcggcgacatgaaatcatccgccagggtgggactggcccgcgctcgaacaaggggcgcagacctgggatggggcgagacagcccaggcacagttccctgggtag

SEQ ID NO: 8582 - DNA, 1293 bp, Artificial Sequence
  Description of Artificial Sequence: Synthetic coding sequence
atggcctggaccttcgagtgcagccggaccaccagccccgagcccttgtcaacaagcccatgccgcaccacatcctcaaggaattcaccaacaatgtcgtgccctgcatccgtggcctgcgaaccctccacgagcactaccacgagctctcctccgaaattatcagtcgctcctcagtttctcccacgttcattgcgtgtcgccgacctagccgcgaaccaggtgatggaaatcttccctttgaccttcggtgagaaaccagccctaagaagcgtgtatcttcacaataatcagctctctaacgccggactcccgcccgacgcctttaggggtagtgaggcgatcgccaccttgtcactttccaataaccagctgagttacctgccaccgagcctgcctcccagcctcgagcggttgcatcttcagaacaatctgatatcgaaagtgcccagaggtgctctcagtagacaaacacaattgcgggagctgtatctgcagcataatcaactcacagattccggcctggatgcaaccacgttctcgaaattgcatagcctcgaatacctggatctgtcgcacaatcagctcaccacggtgcccgctggcctgccacggacattagctatcctgcacctgggacgcaatagaatcaggcaggtggaggctgctcggctccatggggccaggggcctgcgttatctgctgctccagcacaaccaactcggcagctctgggttgccagcaggcgctttaagacccttgagaggcctgcatacgcttcatctctacggaaatggcttggacagagtccctcccgccctcccgcggcggttaagggctctggttctgccgcacaaccacgtggctgctctgggtgcccgcgatcttgtggctacccctggcctgacggaactgaacttggcatataaccgcctagcttccgccagagtgcaccatcgagctttccgccgattgagggccttgaggtcactggatctggcgggcaaccagttaaccaggcttcccatgggtttgcctaccggcctgcgaacccttcagcttcagcgcaatcaactgaggatgctcgagcccgagccactggccggcctggaccaactccgggagttgtcccttgcccataataggttaagggtgggcgacataggtcccggcacctggcacgaactgcaagctctgcaagtgagacacagattggtgtcccacacagtccctcgcgcccctccatccccctgtctgccttgtcatgtgcccaatatcctggtgagttggtag

SEQ ID NO: 8583 - DNA, 3162 bp, Artificial Sequence
  Description of Artificial Sequence: Synthetic coding sequence
atgtggcagccccggcggccctggccccgggtgccctggcggtgggctcttgcacttctcgcactagttggcgctgggctctgccacgccggccctcagccaggttatccggctcgcccctccgctcgtaataagaattggtgtgcctacatagttaacaaaaatgtgtcctgctctgtgctggaagggtcagagtctttcattcaggctcagtacaattgcgcatggaaccagatgccctgcccttcggctttggtgtatagagtaaacttccggcccagatacgtgactagatataaaacggtgacgcaattagaatggagatgctgccctgggtttcgcggcggggattgccaggaaggtcccaaagaccctgtaaagactctgcgccccactcctgcccggccccgtaatagcttaaaaaaggccaccgataacgagccatcgcaatttagcgagcctaggaagaccctgagcccaaccggaactgcacaaccctcctggggtgtggacccaaaagagggtccccaagagttacaggagaagaagattcaggtgcttgaagaaaaggtccttcggttgactcgcaccgtgttagacctgcagagctctctggctggtgtcagtgaaaacctcaagcatgccacccaagacgacgcgagccggacgcgcgctccaggtctctccagccaacaccccaaaccagatactactgtgtcaggagatacagagactgggcagagtcctggagtctttaatactaaagaatctggtatgaaggacattaaatccgagctggccgaagttaaagacacccttaagaataagtcagacaagctggaggagttggacgggaaggtgaagggctacgagggtcaactgagacagctacaggaggctgctcagggacccacagtgaccatgaccaccaacgaactctatcaggcgtacgtggactcaaagatcgacgctttacgcgaggagttaatggagggcatggataggaagctcgccgatctgaagaacagttgtgaatacaaattgacaggccttcaacagcagtgtgatgattacggatcttcttatctgggcgtcatagaactcatcggggaaaaagaaacctcattgaggaaagagattaacaacctgagggctcgcctgcaggaaccgtccgctcaggcaaattgctgtgactccgagaagaacggggacattgggcagcagataaaaacacttgaccagaagatcgagagagtggcggaagccactcgcatgctgaatggacgtttagataatgaatttgaccggctgattgtgcctgaacccgacgtggacttcgacgcaaaatggaacgagctggacgcaagaataaacgttaccgagaaaaatgccgaggagcactgcttctatatcgaggagaccctgagaggcgcgataaacggtgaagtcggagacctgaaacagctggttgaccaaaaaatccagtccttagaagatcgcctgggcagcgtgctgctccaaatgacaaacaatacaggtgccgagctcagcccgcccggcgccgccgcactccccggcgtgagcgggtcaggcgatgaacgcgtcatgatggagctcaaccacctcaaagataaagtccaggtcgtggaagacatctgcttgcttaacattcagggtaaaccacatggaatggagggcgcactgcctaacagagaagatcgagcggtacgggactctctgcatcttctgaagagtctgaatgacactatgcaccggaaatttcaggagaccgagcagacgattcagaaactgcagcaggacttctcgttcttgtactctcagctgaatcacaccgaaaacgacgtgactcacctgcaaaaagaaatgagcaattgtcgggcaggcgagaatgccgggatgggacggtttacgaaggtgggcgaacaagagcgtactgtggacacgttgccctccccacagcatccagtggcacactgctgctcccaattggaggaacgctggcagagattacaaagccaggtgatctcagaactcgatgcatgtaaagagtgcacccagggagtacaacgagaggtcagtatggtggagggaagagtgtcccacatggagaagacatgctcaaaactggactctatcagtgggaacctgcagaggattaaggaaggtcttaacaaacatgtgtcaagcttgtggaactgtgttagacagatgaacggaaccctccggtcccacagtcgagatatatcgggtctcaagaacagcgtgcagcagttctacagccacgtctttcagataagcactgacttacaggacctggtcaagtttcagccaagtgccaaggctccatcccccccacctccggccgaggcaccgaaggagcccctgcagccagagcccgcgccgccccgaccctctggccctgcaactgccgaagatccgggcagacgccctgtccttccccagcgcccacccgaggaaaggcccccccaacctccgggaagcaccggtgttattgcggaaaccggccaggccggaccgccggctggtgccggcgtgtccggcagaggtctgccacgtggggtggatggacaaacagggtcggggactgtacccggagctgaaggctttgccggggctccagggtatcccaagtcccccccggtagcttctcctggcgcccctgttccatcgctggtgtcattctccgccggcttgacgcagaaacccttcccaagcgatggtggagtggtcctgtttaataaggtacttgttaatgatggagacgtgtacaatccgagcacgggggtgttcacagctccctacgacgggagatacctgatcaccgccacattaacgccagaaagagatgcttatgtggaggctgtccttagtgtgtccaatgcaagcgtggcccaactccacaccgccggctaccgcagagagttcctcgagtatcaccggccccctggcgccctgcacacatgtggaggcccaggcgcctttcacctgatcgtacacctgaaagctggcgacgcagttaacgtggttgttacaggagggaaacttgcacacacagacttcgacgagatgtacagtacctttagtggagtattcctctatcctttcctgagccacctgtag

SEQ ID NO: 8584 - DNA, 1548 bp, Artificial Sequence
  Description of Artificial Sequence: Synthetic coding sequence
atggcccagctgttcctgcccctgctggccgccctggtgctggcccaggccccagctgctttggcagacgtgctggaaggagacagctctgaagacagagcatttcgcgtacgtattgcaggcgatgccccactccaaggggttcttggcggcgcactgacaattccttgccacgtacactatctgagaccaccccctagccgacgggccgtgttggggtctcccagggttaaatggacttttcttagccggggcagagaggcagaggtgcttgttgcaaggggcgtgcgagtaaaggttaatgaggcctatcggttccgagtcgccctgccagcgtatcccgcctctcttacggatgtgtcattggctctttctgagctgcgacccaatgacagcggaatctatcgctgtgaggtccagcacggcatagatgattctagtgatgctgtggaggattcacagctgtatcccatccagacccctcgggaggcttgctacggcgacatggatggatttcccggcgtgcgcaactatggcgtggtcgatccagatgacttgtatgatgtgtattgctacgctgaagacctgaacggcgagttattcctgggcgacccccccgaaaagctcacacttgaagaagccagagcttattgtcaggaacgcggagctgagattgcaactacgggtcagttatacgcggcctgggatggcgggctcgaccattgttcgccaggatggctcgctgatggctcagtaaggtatcccatcgtaaccccgtctcaaagatgcggaggaggcttgcctggcgttaaaaccctgttcttgttcccaaaccagactggcttccccaacaagcatagccgctttaatgtgtactgcttccgtggatcgacttgcctcctcccttctctcaggccaccaacccaacctcctacccaggacggcctggaagccattgtgaccgtgacagagactctcgaggaacttcagctgccacaagaggcaacagagtccgagagccgtggtgcgatctactccatccccatcatggaagacggcggcggagggtcctcgactcccgaagatcctgctgaggccccaagaacactcctcgagtttgagacccagtccatggtgcccccgacagggttctccgaagaggagggaaaagcactggaagaagaggagaagtacgaagacgaggaagagaaagaggaagaagaagaagaggaagaggtagaggatgaggctctttgggcatggcccagcgaattgagttcacctggaccggaggcctccctccccactgagcccgccgctcaagaagaatctctgagccaggcgcccgcgcgggctgtccttcagccgggtgcctcccctctgcctgatggcgagagcgaagcatcaagaccgcctagagtacacggcccacctactgaaacactccctacacccagagagcgtaatctggcaagtccctcccccagtaccctggttgaagcacgtgaggtaggggaggccaccggtggacctgaactgtccggctag

SEQ ID NO: 8585 - DNA, 1023 bp, Artificial Sequence
  Description of Artificial Sequence: Synthetic coding sequence
atgcccggctggctgaccctgcccaccctgtgccggttcctgctgtgggcatttacaatcttccacaaggcacaaggggacccagcatctcatcctgggccgcactatctgctgcctcccatccacgaagtaattcactcacacagaggcgccaccgccaccctgccatgcgtcttgggcactactccgccctcttataaggtccgctggagcaaggttgaaccaggtgagttacgggagacactaatccttatcaccaacgggctccatgcccgcgggtatgggccattgggcggtcgcgccaggatgcggagaggccatcgactcgacgcttcactagtgattgcgggcgtcaggctggaggacgaaggacgttatcgttgtgaactgatcaatggcattgaggacgagtctgtagcactgactctttctctggagggcgttgtgtttccgtaccagccaagtcgcggtcggtatcagtttaactactatgaagcaaagcaggcctgcgaagagcaagatggccggctggcgacctattcgcaactctatcaagcttggacagaggggttggattggtgcaacgcagggtggctacttgaagggtctgtccgctaccccgtgctcaccgcccgtgccccctgcggtggtaggggcagaccggggatccggtcgtacggaccgagagaccggatgagggaccggtacgatgctttctgttttacctcggcactcgccggacaggtatttttcgtgccaggaaggctgaccctgtccgaagcccacgccgcgtgcagacggcgcggcgctgtcgtcgctaaggtcgggcacctttatgcagcctggaagtttagtggattagaccagtgcgacggcggatggctggcggacggatcagtcagatttcctatcaccactcctcggccccggtgtgggggcctgcctgacccaggcgtgcgctcctttggcttcccaagaccccagcaggccgcgtatggtacatactgctatgccgaaaattag

SEQ ID NO: 8586 - DNA, 690 bp, Artificial Sequence
  Description of Artificial Sequence: Synthetic coding sequence
atggacctgctgcagttcctggccttcctgttcgtgctgctgctgtccggtatgggcgccacaggaacgcttagaaccagtctcgacccctccttggaaatttacaaaaagatgtttgaagttaaacggagggagcagctcctcgctctaaaaaacctggctcaacttaatgatattcaccaacagtataagattctagacgttatgctcaaaggtctcttcaaagtgctagaagactccagaaccgtcttaacagccgccgacgtgctgccagatggaccattccctcaggatgagaaattgaaagacgcattttcacacgttgtggagaataccgcttttttcggagacgtcgtcctgaggtttcccagaattgtccactattactttgatcataatagcaactggaacctgcttatccggtggggtatctctttttgcaatcagaccggtgttttcaaccagggtccccacagcccaattttatccctcatggcacaggagctggggatttctgagaaggatagtaacttccagaaccctttcaaaatagacaggacagaattcattccttccacagacccttttcagaaagctctgcgggaagaggaaaagaggcggaagaaggaggagaaaagaaaagagattcgaaaagggccccggatctctcgctcacaaagtgagctgtag

SEQ ID NO: 8587 - DNA, 465 bp, Artificial Sequence
  Description of Artificial Sequence: Synthetic coding sequence
atgagcgtgggcaccagcctggagcaggcccagatgagcaccctgacatgccccctcttcattccgactgtggggcggaagaccgccctccactctggcgaggacttccaaactctgctgtttgaacgggtcttcgtgaacctggacgggtgcttcgacatggcaactggacaattcgcagctccactcaggggcatctatttcttttcactgaatgttcattcttggaattataaggagacatacgtgcacatcatgcataatcagaaagaagccgtcattctgtacgctcagccatcagagcggtcaatcatgcagagccaatcagtgatgcttgacctcgcctacggggatagagtgtgggtgagactttttaagcgacaacgagaaaatgccatttatagcaacgactttgatacatacataacgttttccggccacttaattaaggccgaggatgattag

SEQ ID NO: 8588 - DNA, 900 bp, Artificial Sequence
  Description of Artificial Sequence: Synthetic coding sequence
atgcggagcgtgggcgagggcgcccgggagtggatccgggagtgccaacaccagtttcggcaccaccgatggaattgcacaactttggacagggatcacacagtgtttgggcgagtcatgctgcggagttcccgagaggcagcattcgtttatgctatttcctcggctggagtcgtgcacgcaataacccgcgcctgtagccagggggagttatctgtttgttcatgtgacccctacactaggggccgccatcacgatcagcggggcgacttcgactggggagggtgcagcgacaatatccattacggcgtgcgatttgccaaagctttcgtggatgccaaggaaaagagactcaaggatgcccgcgccctgatgaaccttcacaataaccgatgcgggcgtacagctgtgagacggttcctgaagctggaatgtaagtgccacggagtgagcggatcgtgtacgctaagaacctgctggagggctctatctgatttccgtcgaactggggactatcttaggagacggtacgacggggctgtccaggtcatggccacccaggatggagcaaattttaccgctgccagacagggatatcgtcgggcgacccgcactgatttggtctactttgacaattccccagactattgcgtgctcgacaaggccgcggggtctcttggaacagccggtagagtgtgtagcaaaacctcaaaggggactgatgggtgtgaaatcatgtgttgtggtcgcggatatgataccacaagagttaccagggtaacgcaatgcgaatgcaaatttcactggtgctgcgctgtgcgctgcaaggagtgcagaaataccgtggatgtgcatacatgtaaagcacctaaaaaggccgaatggttggaccagacgtag

SEQ ID NO: 8589 - DNA, 1710 bp, Artificial Sequence
  Description of Artificial Sequence: Synthetic coding sequence
atgctgctgctgttcagcgtgatcctgatcagctgggtgagcaccgtgggcggggaaggaacactatgcgactttccaaagattcatcacggtttcttatacgatgaggaggactataacccattcagtcaggtgcctacaggtgaagtcttctactactcttgcgagtataattttgtgagtcctagtaaatccttctggactaggattacctgcaccgaagaagggtggtcccctacccccaaatgtttgagaatgtgttcattcccatttgtaaaaaacggtcactccgagtcctctggtctgatccatcttgaaggggatacggttcagatcatttgcaacaccggctactctctgcagaacaatgagaagaacatctcttgcgtcgaaaggggttggagcactccaccaatttgttcctttacaaagggcgagtgccacgtaccaatcctggaagccaatgttgacgcccagccaaaaaaagaaagctataaggtcggggatgtcctcaagtttagctgccgaaaaaatctgatccgcgtgggctctgactcagtccagtgctatcagttcggctggagccctaacttccccacatgcaaagggcaggtgcggagctgcggacccccaccccaactgagcaacggagaggtgaaagaaattagaaaggaagagtacgggcacaacgaagtagtggagtacgactgtaacccaaacttcattattaacgggccaaaaaagattcagtgtgtagatggggagtggacaacactacccacctgtgtggagcaggtgaagacctgcggttatatcccggagttggaatatggctatgtccagccatccgtacccccttatcaacatggtgtttccgtcgaagtcaattgccggaatgagtacgccatgattggcaataatatgatcacttgcattaacggcatctggaccgaactgcccatgtgcgtggccactcaccagctgaagagatgtaaaattgctggtgtgaacattaagacattactcaagctgtcagggaaggaatttaaccacaattcccgtatcagataccggtgctccgatatctttcggtatcgacacagtgtgtgtattaacgggaagtggaatcctgaggttgattgcactgagaaaagagaacagttttgcccacctccgccccagatccctaatgcccagaacatgacaacaacagtcaattaccaggacggggaaaaggttgctgtgttgtgtaaggagaactacctgctgcctgaggccaaggagatagtatgcaaagatgggagatggcagagccttcctaggtgtgttgagtcaactgcatattgtggtcccccaccaagcatcaataatggcgataccacatcctttcccttgtccgtgtacccgcctggttccactgtcacctaccgctgtcagtctttctacaaactccagggatctgtgacagtgacatgtagaaacaagcagtggtccgaacctccacgttgcctggatccatgcgtagtgtcagaggagaatatgaataaaaacaacattcagctcaaatggcggaacgacggaaagctgtacgctaagaccggggatgccgtggagttccagtgtaagttcccccataaagccatgatcagcagccccccttttcgcgcgatctgccaggaaggaaagttcgaataccccatctgcgaatag

SEQ ID NO: 8590 - DNA, 351 bp, Artificial Sequence
  Description of Artificial Sequence: Synthetic coding sequence
atgaagggcctgcggagcctggccgccaccaccctggccctgttcctggtatttgtttttttgggcaacagtagttgcgccccccagagattactggagaggagaaactggacaccccaggcgatgctatacttgaagggggcccagggacgaagatttatttcagatcagtctcgccgcaaggacttgagcgatcgcccattaccagaaaggagatctccgaacccccagctgttgaccatcccagaagccgccaccattctgcttgcctctctgcagaaatctccggaggatgaagagaaaaacttcgatcagacccgctttctagaggatagtctgctgaactggtag

SEQ ID NO: 8591 - DNA, 192 bp, Artificial Sequence
  Description of Artificial Sequence: Synthetic coding sequence
atgaagcacgtgctgaacctgtacctgctgggcgtggtgctgaccttactgtctatttttgttcgtgtgatggaatcgctggagggattacttgagtcacccagtccaggcactagctggaccaccaggtcccagttagccaacacagagccgacaaagggactgccagatcatccttcacggagcatgtag

SEQ ID NO: 8592 - DNA, 567 bp, Artificial Sequence
  Description of Artificial Sequence: Synthetic coding sequence
atggtgcccggcgccgccggctggtgctgcctggtgctgtggctgcctgcctgcgtcgccgcccatgggtttcggatccatgactacctgtatttccaggtccttagtcctggcgatatacggtatatcttcactgccacacccgctaaggatttcggagggattttccacactcggtacgaacagatccacctggtgcccgccgagccgcctgaggcgtgtggggaactgtctaacggtttttttattcaagatcaaattgcactggtggaacgggggggttgcagcttcctatcaaaaactcgagtagtgcaagaacacggtgggcgtgcggtaattatcagtgataatgccgtggataatgattccttttatgtagagatgatccaggacagcacccaacggacagccgacattcccgctctttttcttctcgggagagacggatacatgattcgacggagcctcgaacagcatggtctcccttgggctatcatttctattcctgtcaacgtgacaagcatccctaccttcgaattgctacagcctccatggaccttttggtag

SEQ ID NO: 8593 - DNA, 2559 bp, Artificial Sequence
  Description of Artificial Sequence: Synthetic coding sequence
atgaagcccatgctgaaggacttcagcaacctgctgctggtggtgttgtgcgactatgtccttggagaggcggagtatttattattgcgggagccaggtcacgtagctctctccaacgacactgtctatgttgactttcagtatttcgatggggcgaatggcactctgcgcaatgtctctgtgctcctgctagaagccaacacaaatcagacagtgaccaccaaatatctgctgacgaatcagtctcagggcactttgaagtttgaatgcttctactttaaggaagcaggggattattggtttaccatgaccccagaggctactgacaatagtactccctttccttggtgggaaaagtctgcttttctcaaagttgagtggcccgtttttcatgttgatcttaaccgatctgccaaggcagccgagggtaccttccaggtgggcttatttactagccagccactgtgtccctttcccgtggacaagcccaatattgtcgtggacgtgatcttcaccaatagcttgcccgaggctaggcggaattcaaggcagcctctggagatccgaacatcgaaacgcacggaacttgctcagggccagtgggtcgaatttgggtgcgcccccctgggccctgaagcttatgtaactgtagtccttaagttactcggccgggactctgtgattacttcaacaggacccatcgacctggcacagaaattcggctacaagctcgtgatggttccagagctaacttgtgagagtggagtggaggtaaccgtactaccacctccatgcacattcgtgcagggagtagtgaccgtgtttaaggaagcaccacggtacccaggcaagcgcaccatccatctcgctgagaattcgctgcctctaggtgagcgaagaaccatctttaactgtacactttttgatatgggaaagaataaatattgtttcgatttcggtatctcttcccggtcccatttcagcgccaaagaggagtgcatgttgatccaacgcaataccgagacgtgggggctgtggcaaccctggtcccaatgttccgctacttgtggagatggggtccgggagcgtcgccgtgtctgtctcacaagtttcccttctagtcctgtctgtcctggcatgagcctcgaagccagtctctgttctcttgaggaatgcgctgcttttcaaccaagctccccatcgcccctgcagccccaagggccagtgaaaagcaataacatcgtgactgtaaccggcatatctctctgccttttcatcatcatcgccacggttctaattaccctgtggaggagatttggccgcccagctaaatgttccaccccggcacgccataactcaattcattcaccctcattccgcaagaatagtgatgaggaaaacatctgcgagctcagtgaacagcgcggatccttcagtgatggcggggacggcccaacagggtctccgggtgacacggggatccctttaacttatcgaaggtccggaccagtcccccctgaggatgacgcctccggttccgagtcctttcagtcaaacgcacagaagatcatcccccccctcttctcttataggcttgcacagcagcagttaaaggaaatgaaaaagaagggcctgacggaaactaccaaagtgtaccatgtgtcacagtcaccgctgactgataccgccatcgacgcagccccatccgcccccctggatttggagagtcccgaagaggctgccgccaataagtttcgcataaaatctccgttcccagagcagccagctgtgtcagccggcgaaaggcccccatcccgcctggacctcaacgtgacccaagcaagctgcgccattagtcccagccagacactcatccggaaatcacaggcacggcatgtgggatctaggggagggccttcagaaaggtcccacgcacgcaatgcccatttcagacggacagcttctttccacgaggccagacaagctcggccattcagagaaagatctatgagcaccctgactccccgtcaggctcccgcttattcatccagaacccgaacatgtgaacaggcggaagatcgctttcggccacagtcgcgtggagctcacctgttcccagaaaaattagagcactttcaagaggcctccggtacacgcgggcctctgaatccactgccaaaatcctatactttgggccagcctctgaggaaaccggacctgggcgaccatcaagcgggactggtggctggaattgaacgtacagagccccaccgcgcccggagaggtcccagcccctcccacaaaagtgtatccaggaagcaatcctcccctatctctcctaaagacaattaccagcgggtatccagcctgtccccttcccagtgcaggaaagataagtgccagagctttcctacacatcccgagttcgcattctatgataatacgagttttggactgacagaggctgaacagcgaatgctggacttacccggctatttcggatccaacgaagaggacgaaactacttctaccctgtcggttgagaagctcgtgatatag

SEQ ID NO: 8594 - DNA, 369 bp, Artificial Sequence
  Description of Artificial Sequence: Synthetic coding sequence
atgggcttccacttctgcatctggatcatcttcctgctgccccccccttgcaaaaagtgcctgtcaccccccactatgaatcttagaccccctaagagttgtgggaacgtgttttattgggtcctggtcctgaattcaggtctgctgtataagttttgccagaccatcaaatgtagggcgaattggcgcccagcccgagcgcccaggggctggaatgaggccaccgagagacatcaggagagacgcacacagatggagaccgagatgggcggcatcagtaccacctattggcacaggctttgcacctgcaccgaccggagagctgaaaagcttgttatggatggaaacaactgttggttccataagtag

SEQ ID NO: 8595 - DNA, 978 bp, Artificial Sequence
  Description of Artificial Sequence: Synthetic coding sequence
atgcagggccgggtggccggcagctgcgcccccctgggcctgctgctggtttgcctgcacctcccaggactgtttgcaaggtccattggcgtcgtagaggagaaggtcagtcagaacctcggaactaacctgccccagcttggtcaaccatcatcaaccggaccgagtaattctgaacaccctcagcccgccctggatccacgctctaacgatcttgcccgcgtgccattgaaacttagcgtgcccgcctctgacggatttcctccagcgggaggctccgccgtacagaggtggcctccctcttggggtctgcccgccatggactcgtggccccctgaggacccctggcagatgatggccgccgccgcagaagaccgacttggagaggctttgcccgaagaactgagctacctcagctccgcagctgcactagcccctggctcaggtccgctccccggtgaatcgagcccagatgctaccggcctatccccaaaagcctcacttctgcaccaagacagcgagtctagacgcttacctaggtccaacagcctgggggcaggcggtaagatcctgtcccagagacccccctggtctctgatacacagggtgttacccgatcatccttggggcactctgaacccaagcgtatcttggggtggagggggccctggaactggatggggcactagaccaatgccccaccctgaaggcatttgggggattaataaccagccgcccggaacctcctggggaaacataaaccgatacccaggagggtcgtggggcaacataaatcgttatcctggagggtcctggggcaatatcaaccggtatccgggcgggtcttggggcaatattcatctttaccccggaatcaacaaccctttcccgcccggtgtcctgcggcctccaggttctagctggaatattcctgctgggttccccaatcccccatctccacgcctccaatggggctag

SEQ ID NO: 8596 - DNA, 2631 bp, Artificial Sequence
  Description of Artificial Sequence: Synthetic coding sequence
atgggccccgaggccctgagcagcctgctgctgctgctgctggtggcatcgggagatgccgacatgaaaggccattttgacccggctaaatgtcgctatgcactgggcatgcaggacaggacaattccagattcagacatctcagcgagtagttcgtggtctgacagcactgcagcaagacatagccgactcgaatcctccgacggcgacggagcctggtgtccggcaggctcggtatttcctaaggaagaggagtatctgcaggtcgacctgcagagactgcatctggtcgccctggtaggcacccaaggaagacacgccggcgggctgggcaaggaattctctagatcctaccgactccgctattccagagacgggcggagatggatgggctggaaagaccggtgggggcaggaggtgataagtggcaacgaggacccagaaggtgtcgtgctaaaagatctcggacctccaatggtagctcgcctggtgcgattctaccctcgcgccgatagggtaatgtcagtatgcctgagggtggaactctacggatgcctttggcgtgatgggctgctctcctacaccgccccagtggggcagacaatgtatctgtcggaagcagtgtatctgaatgactctacctatgatggccacaccgtgggggggctgcagtatggaggcctagggcaattggcggatggcgtggtggggctggatgactttcggaaatcccaggagttgcgagtctggccagggtatgactacgtggggtggtctaatcactcattttccagtggctacgtcgagatggagtttgagttcgaccggctgcgtgcctttcaagcaatgcaagtccactgcaataatatgcacacgctcggcgctcggctgcctgggggagtcgaatgtcggttcaggcgaggccctgccatggcctgggaaggggaacctatgcggcacaaccttggcggcaatttaggcgacccccgcgcgcgcgccgtctccgtgcctctgggtggaagggttgcgaggttcctgcaatgtcggtttctgttcgcaggtccctggctgctcttctctgaaataagcttcatcagcgatgtggtcaacaacagcagccctgctttgggcgggacgtttccgcccgccccgtggtggcctcctggcccccccccaactaacttctcttccctggagcttgaaccgaggggacagcaaccagtggccaaggccgaaggcagtcccactgctatcttaatcggatgtctagtggctattattctgcttctgctgctcataatcgccctcatgttatggcgtctgcactggagaaggctgctgagcaaggcggaaaggcgagtacttgaggaggaactcaccgtgcacttgagcgtcccgggcgacaccattttgatcaataatcgacccggtcctagagagcccccaccttatcaggagccgaggcccaggggcaatcccccccatagcgctccctgcgtgcccaatggctcagcttatagtggggactacatggagccagaaaagccaggagctcccttgctgcccccccctccgcaaaacagcgtgccacactatgcagaggccgacatcgtgacgctgcagggcgttactgggggcaacacatatgcggtaccagccctgccccccggcgctgtgggagatggcccccccagagtggactttcccagatcaaggctacgcttcaaagaaaagctgggggaaggccagttcggggaggtgcacctctgcgaggtagatagcccccaggacctggtctctttagactttccactgaatgtacggaaaggccatcctcttcttgtggccgtgaaaatcttgagacccgatgctacaaaaaatgcccggaacgatttcctgaaggaagtaaaaataatgagcaggttaaaagaccctaacattatccgcctcctgggggtttgtgtgcaggacgaccctttatgtatgattacggactatatggaaaatggtgacttgaaccagttcctctcagcgcaccagttggaagataaggccgcagaaggcgcacccggagatggccaggccgcccaaggaccgactatttcctatcctatgctgcttcacgtcgcggcacagatcgcaagtggcatgcggtatcttgctactttaaacttcgttcaccgcgacctggccactcgcaattgtctggtgggcgagaatttcaccatcaagatcgctgatttcggaatgtctcgcaacctgtatgcgggagattactatagggtgcagggcagagcagtgttacccattcgatggatggcttgggagtgcatactgatgggcaaattcactacagctagcgacgtatgggcattcggcgttactctgtgggaagttctgatgctctgtcgggcacaaccctttggccagctgactgacgagcaagtgatagaaaacgccggggagttctttcgcgatcagggcagacaggtgtatttgtcccgccctccagcttgtccacagggattatatgagttgatgctgaggtgttggtcaagagagtccgaacagcgccctccttttagccaattgcacaggttcctcgcagaggatgccctgaacacagtgtag

SEQ ID NO: 8597 - DNA, 672 bp, Artificial Sequence
  Description of Artificial Sequence: Synthetic coding sequence
atgaagttcgtgccctgcctgctgctggtgaccctgagctgcctgggaacactgggccaggctccacgtcagaaacagggctccactggcgaggaattccattttcagaccggaggacgtgactcctgtacgatgcggccatcttctctcggtcagggagcaggagaagtgtggttacgcgtggattgcagaaacacagatcaaacctactggtgtgaataccggggccaaccatccatgtgccaggcctttgccgcagaccccaaaccatactggaatcaagccctccaggagttgcgcagactgcaccatgcctgccagggagcacctgtgttaaggcccagcgtgtgccgggaggctgggcctcaggcccacatgcagcaggtaaccagcagtctcaaaggttctcctgagcccaatcagcagccggaggcaggcaccccctcccttcgtcctaaagcaactgtaaaactgactgaggcaacgcagctgggtaaagacagtatggaggaactagggaaggcaaagccaacaacccggcccaccgcaaagccaacacagccaggccccagacccggtgggaacgaagaggctaaaaagaaggcttgggagcactgttggaagccattccaggcattgtgcgcctttctgattagttttttccgcgggtag

SEQ ID NO: 8598 - DNA, 585 bp, Artificial Sequence
  Description of Artificial Sequence: Synthetic coding sequence
atgaccatgcggcacaactggacccccgacctgagccccctgtgggtccttttgctctgcgcacatgtggtcaccctgctggttagggctacacccgtttctcagactaccacagccgctactgctagcgtccgatcgacaaaggatccgtgtcctagccagccccccgtcttccctgccgccaaacagtgtccagcgctggaagtgacgtggccagaagtggaggtcccgttaaacggaacactaagcctgtcttgcgtggcatgcagtagattcccaaacttctccattctctattggctgggaaacggctctttcatcgaacatcttcccggccgcctttgggagggatctacatcaagggaaaggggtagcaccgggactcaactttgtaaggcacttgttttggagcaattgactccggcactccactccactaatttctcctgtgtactggtggaccccgaacaggtcgtccagaggcatgtagtgcttgctcaactctgggctgggctcagggctacactcccgccaacgcaagaggccctgcctagctctcactcctcaccgcagcagcaaggttag

SEQ ID NO: 8599 - DNA, 777 bp, Artificial Sequence
  Description of Artificial Sequence: Synthetic coding sequence
atgatcgccatcagcgccgtgagcagcgccctgctgttcagcctgctgtgcgaagcctccactgtggtcttactaaacagtaccgattcgtccccccccaccaacaactttactgacattgaggcggcccttaaggcccagcttgacagcgcagatattcctaaagcccgccggaagaggtacatctcgcaaaatgatatgatcgccattctagattaccacaatcaagtgcggggaaaagtatttcctccagctgcgaatatggaatacatggtctgggatgagaatcttgcgaagagcgcagaggcctgggcagccacatgtatctgggatcacggaccctcataccttcttcgcttccttggacagaatctcagcgtgcgtactggaagatacagatccatcctgcaactggttaagccttggtatgacgaggtgaaagattacgcatttccttatcctcaggattgcaaccccagatgccctatgcgttgcttcggtcctatgtgcacccactatacccagatggtctgggctactagtaataggattggctgcgccatccacacttgtcagaatatgaatgtgtgggggtccgtctggcgcagagcggtatatctcgtgtgcaattacgctcctaaaggcaactggattggcgaggccccttacaaggtgggcgtgccttgttcctcctgcccaccttcgtatggtggtagctgtaccgacaacctgtgtttccctggcgttactagcaactatctctactggtttaagtag

SEQ ID NO: 8600 - DNA, 906 bp, Artificial Sequence
  Description of Artificial Sequence: Synthetic coding sequence
atgctgcccctgaccatgaccgtgctgatcctgctgctgctgcccactggtcaggctgcccctaaagatggcgttacccggccagacagcgaggtccaacaccagctacttcccaatccttttcagcctggccaggagcagttgggacttctgcagtcctatctcaaggggttaggtagaaccgaggtccagctagagcatctgtcccgggagcaggtcctgttgtacctgtttgcattacatgattacgatcaaagcggacaactggatggcctcgagctcctctcaatgttgaccgccgctctggcacctggcgcagccaacagccctacaactaatcccgtaattcttatcgttgataaggtgctggaaacgcaggatctcaatggagacggactcatgactccagccgaattgatcaacttcccaggtgtcgccttgcgacatgtcgaaccaggtgaacctttagcaccctcacctcaggaacctcaggctgtggggcgtcagagcctcctggctaagagccccttgaggcaggagacacaagaggcccccgggcccagagaggaagccaagggtcaggttgaggcccggcgggagagcctggatcccgtccaagaacccgggggccaggcggaggccgacggcgacgtccccggaccccgaggcgaagccgaaggacaagcagaggcaaaaggggatgctcctggaccgcggggcgaggccggcgggcaggccgaggcggaaggcgatgcccccggtccgagaggcgaggctggcggccaggcagaagccagggagaacggagaagaagcaaaggaattgcccggcgagactctggaatccaaaaacacccaaaatgatttcgaggtgcatattgtgcaggtagaaaatgatgagatctag

SEQ ID NO: 8601 - DNA, 969 bp, Artificial Sequence
  Description of Artificial Sequence: Synthetic coding sequence
atgaagaccctggccggcctggtgctgggcctggtgatcttcgacgcggcagtgacagccccaactctagagtctattaactacgattctgagacttacgacgcaactctcgaagacctggataatctgtacaattatgagaacatcccagtcgacaaggtcgagattgagatcgctacagttatgccatccgggaatagggagctcctgactccccctccccaacccgagaaagcgcaggaggaggaagaggaggaggaaagcacacctcgattgatagatggatccagcccacaggaaccagaattcaccggagtcctcgggcctcatacaaacgaggacttccccacctgcctcctatgcacatgcatctccaccaccgtctattgcgacgatcacgagctggacgccatacctcctctgcccaaaaacactgcctatttctactccagatttaaccgaataaaaaaaataaataagaacgattttgccagccttagtgacctcaaaaggattgatctaacttctaatttaatcagcgagattgacgaagacgcatttcgcaagttgcctcagctgcgggagctagtgctgagagataacaaaattaggcagctgcctgagctacccacaacactgacattcattgacatatctaataatcggttggggcgtaaaggtatcaaacaggaggcgtttaaggatatgtacgacctccaccatctctatctaacagacaacaacttggatcatattccactaccactgcctgaaaatctcagagccctgcaccttcagaataacaatattcttgagatgcatgaagatacgttttgcaatgtgaagaatctgacctatatcaggaaggccctcgaggatattagattggatggcaacccaattaacctttcgaagacaccgcaagcgtacatgtgtcttcctagactgcctgtcggaagcctagtgtag

SEQ ID NO: 8602 - DNA, 618 bp, Artificial Sequence
  Description of Artificial Sequence: Synthetic coding sequence
atggtgaacctggccgccatggtgtggcggcggctgctgcggaagcgctgggtcctggcattagtctttggcctgtcgcttgtctactttttgtcctctaccttcaagcaggaagagagagccgttagggaccgcaatttactccaggtgcacgatcataatcagcctatcccctggaaggtgcagtttaacctcggcaactcctcaaggccttcaaatcagtgcagaaacagcattcaaggtaagcatctcatcaccgacgagcttgggtatgtttgtgagcggaaagacctcctggtgaacggctgttgcaacgtgaacgtgccctcaaccaaacagtactgctgcgatggctgctggcccaatggctgctgtagtgcttacgagtattgcgtttcttgctgcttgcaaccaaataagcaactcctgctcgagcggtttcttaacagagccgctgttgcatttcaaaacctatttatggctgtcgaagatcacttcgaactgtgccttgcgaagtgtaggacatctagccagtccgttcaacatgaaaacacttacagagaccccatagccaagtattgctatggcgagagtccacctgagctgtttccagcatag

SEQ ID NO: 8603 - DNA, 3057 bp, Artificial Sequence
  Description of Artificial Sequence: Synthetic coding sequence
atggtgagccacttcatgggcagcctgagcgtgctgtgcttcctgctgctcctcggatttcagtttgtgtgtcctcagccatctacgcagcatcgcaaagtgccacagcgcatggctgcagagggggctcctgaagacgatggcggtgggggggctcccggtgtgtggggagcttggggaccatggagcgcttgttcccgaagctgttccggtggagttatggaacagacacgtccctgtctaccaagatcctacagactcagggggggacagagacccggggccccagctcgggccttcgcggatcacgttgtgtctgccgttcgaacttcggtgcccctgcataggagccgcgacgagacacctgccctggcaggcaccgacgcctcacgccaggggcccacagtcctcagagggtcacgacacccccagccccagggccttgaggtaactggcgatagacgctctcgcacccggggtaccattgggccaggcaaatacggttatggcaaagcaccatatatattgcctctccagacggatacggcgcacacgccccaacgcctgagaaggcagaaactatccagcaggcacagtaggagccagggggcttccagcgcccgccacggttactccagcccagcgcaccaagtgccccaacacggtcctctctatcagagcgattccggccctcggtccggtctgcaggctgcggaggcgcccatctatcagctgcccttaacacacgaccagggctaccctgcggccagcagtctgttccattccccagagacgagcaacaaccatggcgtgggtacccacggggcaacccagagttttagccagccggcacgcagcaccgccatctcatgtattggcgcgtatcggcaatataagttgtgtaacactaacgtctgccccgagtcttctcggtccatacgggaggtccagtgtgcctcatacaataacaagccctttatgggtcgcttttatgaatgggagccgtttgctgaagtcaagggcaaccggaagtgcgaattaaattgccaggccatggggtaccgattttatgtgcgccaagcagagaaggtcatcgacgggacaccctgcgatcagaacggtaccgccatctgtgtgagcggacagtgtaagtccatcgggtgtgatgattatttagggagtgataaagtagttgacaagtgtggagtgtgtggaggcgacaacacaggttgtcaggtcgtgtcaggtgtttttaaacacgccttaaccagtttaggctatcaccgtgtggtggaaattcccgaaggggctacaaagatcaacataactgagatgtacaagagcaacaactacctggcgctccggtcccgctcgggacggagcatcattaacggaaattgggctatcgataggcccgggaaatatgaggggggagggacaatgttcacctacaaacggcccaacgagattagttcgacagccggggagtcctttctagctgagggccctacgaacgagatcctggacgtctacatgatccatcaacaacctaacccaggcgtccattatgagtatgtgattatgggtacgaacgccatatctcctcaggtgcccccccaccgcaggcctggagagcctttcaacggtcaaatggttactgagggccgaagtcaggaggagggtgaacagaaaggtcggaatgaagaaaaggaagacctccgcggggaagcaccagaaatgtttacatcggagagcgcacaaaccttcccagtgcgtcatcccgacagattctctccgcatcgccctgataatctagtacctccggcccctcaacctccccggcgctctagagatcacaattggaaacagctaggtaccaccgaatgctcaacgacttgcggcaagggtagccagtaccccattttccgttgtgttcacaggagcacacatgaagaagcccccgagagttactgcgattcatctatgaagcccacgcccgaggaagaaccttgcaatatttttccttgcccagcattttgggatatcggtgagtggtctgagtgcagtaaaacctgcgggctcgggatgcagcataggcaagtattgtgtcgacaggtttatgcgaatcggtccctcaccgtacagccataccgctgccaacacttggaaaagcctgaaactacctctacgtgccagctgaaaatatgcagcgagtggcagataagaacagactggacttcatgtagtgtaccctgcggtgttggccagcggacacgggatgttaaatgtgtgtcaaacatcggggatgtggtggacgatgaagaatgtaacatgaagcttcgtcccaacgacatcgagaattgtgatatgggtccttgcgccaaatcatggttcctgactgaatggtcagagcgttgtagtgctgaatgcggtgccggcgtcaggactaggagcgtggtgtgtatgaccaaccatgtctcatccttacctctcgagggttgtggaaacaataggcccgctgaagccacgccctgcgataatggaccatgtacagggaaggtggaatggttcgccggctcgtggagtcagtgctctatagaatgtggttctggaactcagcagagggaagtaatctgtgtcaggaagaatgcagatactttcgaggtgcttgacccttctgaatgtagctttcttgaaaaacctccttcgcagcaaagttgtcaccttaagccatgcggtgcgaaatggttttccacagagtggagcatgtgctcgaaatcttgccagggagggtttcgcgttagagaggtgaggtgccttagcgatgacatgacgttgtcaaatctctgcgaccctcagctgaagcctgaagaaagggagagttgcaatccccaagattgcgttcctgaagttgatgagaactgcaaggataaatactataactgtaatgtcgttgttcaggctaggctttgcgtctacaattactataaaaccgcgtgctgcgcctcctgcacaagggttgccaatcgacagaccggctttttgggcagccgatag

SEQ ID NO: 8604 - DNA, 1503 bp, Artificial Sequence
  Description of Artificial Sequence: Synthetic coding sequence
atgaagtgcaccgcccgggagtggctgcgggtgaccaccgtgctgtttatggcgcgggcgatccccgccatggtggtgccaaacgctacgctgctcgagaagctgctggagaagtatatggacgaggacggcgagtggtggatcgctaaacagaggggcaaacgagccatcacagacaacgatatgcagagtattctggacttacataataaactgcggtcccaggtctatccaacagccagcaacatggaatacatgacttgggatgttgaactggaaagatctgccgagtcctgggcggaatcgtgcctctgggaacacggccctgcctccctgctgccctcaatcgggcagaacctaggcgcacattggggccggtaccggcctcctacttttcatgtccaaagctggtatgacgaagtcaaagatttctcttatccatatgaacacgagtgtaacccgtattgtcccttccggtgtagcggtccagtctgcacacactacactcaggtggtgtgggccacatcaaaccggattggctgtgccatcaatctgtgtcataacatgaatatttggggacagatttggcctaaagcagtgtacctggtatgtaactatagcccaaagggcaattggtggggccacgctccctataagcacggacgcccatgctccgcttgtccccctagtttcggcggggggtgcagggagaacctgtgttacaaggagggctccgaccgttactatccacctcgcgaggaagagaccaacgagatcgagagacaacaatctcaagtgcacgacactcacgttcgaactaggagcgatgattcgagtcgaaacgaggtgatcagcgcccagcagatgagccagattgtgtcatgtgaggtgagattgcgcgaccagtgcaagggaaccacatgcaatcgatacgagtgccctgctggctgtttggatagcaaggccaaggtcattggctctgtgcactatgaaatgcagtcttcgatttgtagagctgcaatccactacggaatcatcgacaatgatggcggctgggtagacatcacccggcaaggtcggaagcactacttcataaagtctaaccgcaatggaattcaaactattgggaaataccaatccgccaacagcttcaccgtctcaaaagtgactgtgcaggccgtgacctgtgagacaactgtagagcagttgtgtcccttccacaagcccgccagccactgcccaagagtgtactgcccacggaattgcatgcaggcaaatccacattatgccagagtgataggcaccagggtttactccgatctgtcttcaatttgtagggccgcggtccacgccggtgtggtccgcaaccacggtggctatgttgacgtgatgcccgtggataaaagaaagacttacattgcgtcttttcaaaatggtatcttctctgaatcattgcaaaatcctcctggggggaaggccttccgcgtgttcgctgtagtgtag

SEQ ID NO: 8605 - DNA, 2070 bp, Artificial Sequence
  Description of Artificial Sequence: Synthetic coding sequence
atgaagttcggcgccgtgacccggatcggcggcccccccctgggcaaccaatcgccgagttcttgcagcctcctgcatgaaaaagaccctccgactacaagcggccctcagacagaccagcccaaaaagcacctcaccaattttaagtccgcgaccagaagagttgcccgcactcagtggcttactgcggacagacagacatgggcatcaattagcagtgtgccgtgggctcaaacaatctccgaaaaaaaacccggcggcagcctgtgggagacacggtcaagtcctcctacaacagctggcacagaagaggcaatgaacacaaccagcctgttggcaccggccgcagaaatcatggcaacaccaggatctccaagccaagcctctccaactctcggagccttcacacacgggactcagacgccgtcacctaccaaggcaaccgcaccacggtacccacagacgggagatctgtccgccgaatggccctttactgccggagaggaaccagttcttgtcccccgcccccatcaggtgtctagagttagatcaagctgttgcctgtctcccattctttgttcgccagcaatgattgcgttcctcctcacatccgtgctgatgatcccccacgccggaggccatcctttagatacaccgcatctacctcaggagttgcctcccggcctgcccaataatatcaacattacgtttttctcgggaatgttcaagaacgtggagtccgttgcggaaatttttgattgcctcgggccacactttacttggttacaggcagtttttactaacttccctgtcttaatccagtttgtgaacgggatgaaatgcgtcgcagggctgtgccctcgtgattttgaggactacggatgcacttgtcgctttgagatggaggggctgcccgttgacgaaagcgactcatgctgcttccagcacaggaggtgctatgaggaggccgccgaaatggattgcctccaagatcctgccaaactcagtaccgaggtgaattgcgtgtcgaagaaaatcatctgtgagtccaaagataattgtgagcaccttctctgcacttgcgacaaagcagctatcgaatgcttagcccgcagttctttgaatagctcactcaacctcttagacaccagcttctgcttggcacagacacccgagacaacaattaaagaagacttgacgacacttctgccgcgtgtggtgcctgtggaacccacggatacttctttgactgctttatcaggggaggtggcggctgagacagaggctgataggcttatcacgctcagtaagaagaaggctggccacgatcaggaaggagttggggcagccagagctacatcaccccccgggagcgccgaaatcgtggcaactcgcgtcacagcaaaaatagtcacactggtccctgcaggcattaagtctttgggtctggccgtgtcgtccgttgagaacgatcccgaggagaccactgaaaaagcatgcgataggtttacttttcttcatctgggctcaggcgataatatgcaggtgatgccccagctcggcgaaatgctcttttgcttaacctcacgctgtcccgaggagtttgagtcttacggatgttactgcggtcaggaaggaagaggggaaccgagggacgatctggaccggtgctgcctctcgcatcattgttgcctcgagcaggttagaaggctggggtgtcttctggaacggcttccgtggagtccggtggtgtgtgtggatcacacacccaagtgcggaggccagagtctgtgcgagaagttgctttgtgcttgtgatcagacagctgcagagtgcatgacctcagcttcattcaaccagagcctgaagagcccatctcgcctgggatgccccggccaacctgcggcgtgtgaggattcactgcaccctgttcctgctgccccgacactgggtagctctagtgaagaagactcagaagaagaccctccccaagaagatctgggccgggccaagcggttcttgcggaaaagcctgggccctttggggattggtcccctgcacggtcgttag

SEQ ID NO: 8606 - DNA, 1359 bp, Artificial Sequence
  Description of Artificial Sequence: Synthetic coding sequence
atggagctggccctgcggcggagccccgtgccccggtggctgctgcttctaccactgttgttgggattgaacgccggcgctgtgatcgactggccaaccgaggaaggaaaggaagtgtgggactacgtcacagtgaggaaagacgcctacatgttttggtggctgtattatgctacaaattcctgcaaaaatttcagtgagcttccgctggtcatgtggctgcaaggcggaccaggtggctcaagcacagggtttgggaactttgaggaaatagggccactggattctgatctcaagccccgcaagactacttggctacaggctgctagcctcttgttcgtggacaatccggtaggcacagggttctcctatgtgaacggatctggcgcttatgccaaagacctggcgatggtcgcgtcagatatgatggtgctcctaaagacctttttctcctgtcacaaagaattccagacagtacccttctatatttttagcgaatcctacggcggaaagatggctgctgggattggacttgagctgtacaaggccattcagagggggaccataaagtgcaacttcgcaggcgtcgcactcggggatagctggataagtcctgtggatagcgtactctcatgggggccttacctgtacagcatgtctctgttagaggacaaagggctcgccgaggtgtccaaggtggctgagcaggtgctgaacgctgttaacaagggcctatacagggaggccactgagctctggggcaaggccgaaatgattatcgaacagaatactgatggtgtgaatttctataacatcctaaccaaatctacgcccacctcaactatggagagctctcttgagtttacccagtctcatctggtgtgcttgtgtcaacgacatgtgcggcatctccagcgggatgccctcagccagctgatgaacggcccaatccgaaaaaaactcaagataattcctgaggatcagtcttggggtgggcaggccaccaatgtgtttgtcaacatggaggaagattttatgaaacctgttatttcaatcgtggatgaactccttgaggcagggatcaacgtgaccgtgtacaacggccaactcgacctgatcgttgatacaatggggcaggaggcctgggtccgtaagttgaaatggcccgagctgcccaaattctcacagctgaagtggaaggctctgtactcagaccctaagtcgctggagacaagcgcattcgtgaaaagctataaaaatctggccttctactggatcttaaaggccggtcacatggtgcccagtgaccagggcgacatggccctgaagatgatgcgcttggttacgcagcaggagtag

SEQ ID NO: 8607 - DNA, 1395 bp, Artificial Sequence
  Description of Artificial Sequence: Synthetic coding sequence
atggtgcggctggccgccgagctgctgctgctgctgggcctgctgttacttactttacacatcacagttctacggggttcaggagctgctgacggacccgacgctgccgcgggaaacgcctctcaggcccagttgcagaacaacctgaatgtcggaagcgacacaacgagtgaaacaagcttttccctatctaaagaggctcctcgggagcacctggaccaccaggccgcccaccagccgtttccacggccacgtttccggcaggagactgggcatccttcacttcagagggactttccaagatcatttttgctggacctgcccaactttcccgacctgagtaaagcagacattaacgggcagaaccccaacatccaggttaccattgaagttgtagacggtcctgatagcgaggcagacaaggaccaacaccctgaaaacaaacccagttggagtgtgccttccccagactggcgagcttggtggcagagaagtctgagtctggctcgcgccaactctggcgaccaggattacaaatacgactccacttcagacgacagtaatttcctgaaccctccaaggggttgggaccacaccgctcccgggcaccggacgtttgaaacaaaagatcagccggagtacgattctacagacggggaaggggactggagcttgtggagtgtctgttcggtcacctgcggtaatggaaaccagaaaaggaccaggagctgtgggtacgcctgcactgcaaccgagtctagaacctgcgacaggccaaattgtcccggaattgaagataccttccgcaccgctgctacagaggtctctctgctcgccgggagcgaagagtttaacgccactaaactgtttgaagtggacactgactcttgtgagcggtggatgtcttgcaagtcagagttcctgaaaaagtacatgcacaaagtgatgaatgatttaccatcttgtccatgcagttatcctactgaagtggcgtattcaacagcagacatctttgaccgtattaagcgcaaggatttccgatggaaagatgcatctgggccaaaagagaaattggagatctacaaacctactgccagatattgtattcgttcaatgctttccctggagagcacgaccttggctgcacagcattgctgctatggggataacatgcaactaatcacaaggggcaaaggggccggaactccgaacctgatctcaacggagttttctgcagagttgcactataaagttgacgtgcttccctggatcatctgcaaaggggactggtcaagatataacgaagccagaccacccaataacggtcagaagtgtacagagtcaccttccgacgaggactacataaagcagtttcaggaagctcgagagtattag

SEQ ID NO: 8608 - DNA, 1536 bp, Artificial Sequence
  Description of Artificial Sequence: Synthetic coding sequence
atgctggtggacggccccagcgagcggcccgccctgtgcttcctgctgttggctgtggctatgagcttcttcggctctgctctatcaattgacgaaacgcgcgctcacctcttgctgaaagagaagatgatgcgcctcggcggacgcctcgttcttaataccaaagaggaactggccaacgaacgcctgatgaccttgaagatcgcagaaatgaaagaagccatgcgcacactcatattcccaccatcgatgcatttcttccaagccaaacatctgatcgagcgttcccaggtcttcaacatcctgagaatgatgccaaaaggagccgccctgcatttgcacgacatcgggatcgtcacaatggactggttggtgcggaatgttacctaccggccgcactgccacatttgtttcactccaagagggatcatgcagtttcgtttcgcccaccccaccccccgaccttcagaaaaatgcagcaaatggatcctgctagaagactaccggaagcgcgtgcagaacgtcaccgagtttgacgatagcttgctgagaaactttaccttagttactcagcaccccgaagtgatatataccaatcaaaatgtcgtgtggagtaagttcgagaccattttcttcactatctctggactcattcactacgctcccgtgtttcgcgattacgtgtttcgtagtatgcaggagttctacgaggacaacgttctgtatatggagatcagggctcgccttctgcccgtctatgaattaagcggggaacaccacgacgaggaatggtccgtgaagacatatcaggaggtcgcacagaaattcgtagagactcaccccgagttcattggaatcaaaatcatctacagtgaccatcgcagcaaagatgttgccgttatcgccgaatccattagaatggctatgggtttgcgcatcaagttcccaaccgttgtcgccggtttcgaccttgttggccatgaggacactgggcattctcttcacgactataaggaggccttaatgatcccagcaaaggacggagtgaagctgccttacttctttcatgccggggagacggactggcaggggacaagtattgaccgaaatatcctggatgccttaatgctgaatactacacgtattggccacggctttgctctgagcaaacacccagcagtcaggacctattcctggaagaaggacatacctattgaggtttgtcctatttcaaaccaagtactgaaacttgtgtctgacctgcggaatcatcccgtagcaaccctcatggccactgggcatcctatggttatcagctcagacgatcccgcaatgttcggcgcgaagggcttatcatatgacttctacgaagtgtttatggggattggcggcatgaaggctgacttgcgcactctcaagcaactggcgatgaactccattaagtatagcactcttctggaaagtgaaaaaaacacttttatggagatctggaagaagaggtgggacaagtttatagccgacgtggcaacaaaatag

SEQ ID NO: 8609 - DNA, 777 bp, Artificial Sequence
  Description of Artificial Sequence: Synthetic coding sequence
atgaagcagatcctgcaccccgccctggagaccaccgccatgaccctgtttcccgtactactgttcctggtagctggccttttgccatcatttcctgcgaatgaagataaggatccagcattcacagcacttcttaccacgcagacacaggtccagagggaaattgttaacaaacacaatgagctgagaagagctgtgtctccccccgcccgtaatatgctgaagatggagtggaacaaggaggccgccgccaacgctcagaaatgggcgaatcagtgtaactataggcactcgaatcccaaagaccgaatgacgtccttaaagtgcggcgaaaatttgtacatgtcttcagcctcctcgagctggtcgcaggcaatccagagctggtttgatgagtataacgacttcgatttcggagtaggtcccaaaacccccaacgccgtcgtcggccattacacacaagtggtttggtactccagttacctcgtcggctgcggcaacgcctattgcccgaaccagaaagttctcaagtactactacgtctgccaatactgtccagccggcaactgggccaatagactttacgtcccctatgagcaaggagctccttgcgcttcctgtccagacaactgtgatgatggcctgtgcaccaatggctgtaaatatgaggatctgtacagcaactgtaagtcccttaagctgacccttacgtgcaagcatcagttagtcagagattcctgcaaggccagctgcaactgctccaattccatttactag

SEQ ID NO: 8610 - DNA, 714 bp, Artificial Sequence
  Description of Artificial Sequence: Synthetic coding sequence
atggtgacccccccccccccccccgtgttcagcctgctgaagatcagtcagaggatcgtctgtctggtcttggacaaatccggctctatgggcggcaaagatcggttaaaccggatgaaccaagccgcaaaacatttcttgttgcagactgtagagaatggatcctgggtggggatggtgcactttgatagtaccgcaacaatcgttaacaaactcatacaaataaaaagctcagacgaacgaaatacgttgatggcggggttgcccacttacccactgggagggactagcatatgctcggggatcaaatacgctttccaggtgatcggggaactgcactcccagctcgatggaagcgaggttctgctactcacagatggggaggacaataccgcttcgtcgtgcattgatgaggtgaaacagagtggcgcaatcgtgcacttcattgctctggggagggctgctgacgaagccgtcattgaaatgtcaaagattactggcggaagtcatttttacgtgagtgacgaagcccagaataacggacttatcgacgcctttggcgccctcacatctggtaacacggacctgtcacagaaaagtctccaagtgcgggtgctcattccctgggtgttcatgttcaccttcgccacccgtaaaaatcatctggtggtgatttcgttcgagttccatattttcctcaaagtgaatttttag

SEQ ID NO: 8611 - DNA, 459 bp, Artificial Sequence
  Description of Artificial Sequence: Synthetic coding sequence
atggacaacgtgcagcccaagatcaagcaccggcccttctgcttctccgtgaaggggcacgttaagatgcttagattggcccttacagtaacaagcatgacctttttcattattgcacaggctccggaaccttacatcgtcataacgggcttcgaggtgacagttatcctgttcttcattctgctgtatgtcctgcggctggatcggctcatgaaatggctgttttggccactactcgacatcattaactcactggttactactgttttcatgctgatagtcagtgtactggccctgattccagagacgacaaccttgacagttggggggggggtattcgccttggtgacagccgtctgttgcctggcagacggtgcattaatctatcggaaactcctgttcaacccgtcaggtccataccagaagaagcccgttcatgaaaaaaaggaagtgctctag

SEQ ID NO: 8612 - DNA, 3744 bp, Artificial Sequence
  Description of Artificial Sequence: Synthetic coding sequence
atgctggccagcagcagccggatccgggccgcctggacccgggccctcttgcttccgctcctgcttgccggccctgttggttgtctttcacggcaggagctgttcccctttggcccaggccaaggagacctggagctggaagacggcgacgacttcgtcagtcccgcactggagctgtccggagccctcaggttctacgataggtctgatatcgacgcagtctacgtgaccaccaatggcattatcgctacttccgagccccctgcaaaggagtcacatccaggcctctttcctccaacatttggcgccgttgccccttttctcgcagacctcgacacaactgatggattaggcaaagtttactaccgggaagatctgagccctagcatcacccagagggcagctgagtgcgtgcaccgggggtttccagaaatttctttccagccctcatcagctgtggtcgtgacatgggaatcggtcgcaccttatcagggacccagccgcgatccagaccagaagggcaaacggaacacctttcaggcagttctagcgagcagcgatagttcgtcgtatgccatattcctctacccggaggatgggttgcagtttcacacaaccttttccaaaaaggaaaataaccaggtgcccgccgtggtagctttcagccaagggtcggttggctttctgtggaagagtaacggcgcatacaacatctttgcaaacgacagagagtccgtggagaacttggctaaatccagcaacagtggtcaacagggcgtttgggtgtttgagataggttcaccagcgaccacaaatggggtcgtgcccgccgatgtaatcctcggaacagaggatggcgccgaatatgacgatgaggacgaagattacgatctagccaccactaggcttgggctggaggacgtggggacaacacctttcagttacaaagcgctgcggcgaggaggagccgacacttattccgtgccgtcagtactgtctccaaggagagcagctactgagcggcctttagggcctccaactgagaggactcgctctttccaacttgctgttgaaacctttcatcagcaacacccccaggtaatcgatgtcgatgaggtcgaggagacaggtgtggttttctcctacaacaccgacagtaggcagacctgcgctaacaaccgacaccaatgttctgtccatgcagaatgtcgcgactatgcaacaggtttttgctgcagttgcgtggccggttacacaggaaatggtcgccaatgcgtcgccgaaggaagccctcagcgcgtgaatgggaaagtcaaaggtcgcatctttgtcggttcctcccaagtcccaatcgtctttgagaacactgacctgcactcctatgtggtgatgaatcacggcaggtcatacactgcaatcagcactattcccgagacagtgggttactctctgcttcctctggcccctgtgggggggataatcgggtggatgtttgccgttgagcaggatgggttcaaaaatggattcagcattacgggtggagagtttacaaggcaggcggaagtgacttttgtgggacaccctggcaatctggtgattaaacagcgattttctgggatcgatgaacacggacacttaaccattgacacagagttggaaggacgtgtcccacaaatccccttcggctcttccgtgcatatcgaaccatataccgagctctaccattattcaacctcggtcatcacaagtagctcaaccagggagtacacggtgaccgaacctgagagagacggagcgagcccaagccggatttatacataccaatggagacagaccattacattccaagaatgtgttcacgatgacagtaggcctgctcttccttccacccaacagctgagtgtggatagtgtttttgttttgtacaatcaggaggaaaagattctgcggtacgcactgtcaaattctattggtcccgtcagggagggtagccctgacgcacttcaaaatccctgttacatcggcacccacggatgtgatacgaatgccgcgtgtcgaccaggaccgaggactcaatttacctgtgaatgtagtattggctttcgaggagatggcaggacttgttatgacatcgatgaatgctcagaacagccgtcagtgtgtggctcacatacaatttgcaacaatcatccagggacttttcgctgcgagtgtgtcgagggttatcagttttccgacgagggaacatgcgtcgcagtggtggaccagcgtcctattaactattgcgaaactggcctacataattgcgatatcccgcagcgggctcagtgcatttatactggaggcagttcttatacttgctcttgtttgcccgggttttcaggcgacgggcaagcctgccaagacgttgacgaatgtcagccctccagatgccacccagacgccttttgctacaatactccagggtcattcacctgccagtgtaagccaggatatcagggcgatggattccggtgtgtgcctggcgaggtggaaaagacccgttgtcagcatgagagagaacatatcctcggagctgccggcgccacagacccccagcgtccgatccctccaggactgttcgttccggaatgcgatgcccacgggcattacgcccctacacagtgccacgggtctactggttactgctggtgcgttgatagagacggtcgggaagtggagggaactagaacccgtcccggtatgactccaccctgcctctcgaccgttgcgcctcctatccaccagggtccagctgtgccgacggctgtaattccgctgcctccaggaacccatctgctgttcgcacagaccggcaagatcgagcgacttcccctcgagggaaatacaatgcgaaaaaccgaagccaaggccttcctgcatgtgccagctaaggttatcattggactggcttttgactgcgtggacaaaatggtatattggaccgacattaccgaaccaagcatcgggcgcgcctcacttcatggtggcgagccaacaactatcatccgacaagacctcggcagccctgaaggcatcgcagttgaccatctggggaggaacattttctggacagattcaaatctggatcgaatcgaagtggccaaactcgacggtacccagaggagagtcctgttcgaaaccgatctcgttaacccaagaggtatagtcaccgacagcgtacgggggaacctgtactggaccgactggaaccgagataatccgaaaatagagacatcttacatggacggcaccaatcgcaggatcctggtgcaggacgacctcggccttcctaatgggctcacttttgacgcgttctcttcgcagctctgctgggtggacgcaggaaccaatcgcgccgaatgcctcaaccctagccagcccagtagaagaaaagccctagaggggctgcagtacccctttgctgtgacctcctatggcaaaaacctgtactttaccgattggaaaatgaattctgtggtggccctggatctggcaatttccaaagagacagatgccttccaaccgcataaacaaacacgattatatggcataaccactgccctgtcacagtgtccccagggccacaattactgctcagtgaataacgggggctgtactcacctatgcctggctactccagggtcccgcacatgtcgatgccccgataacaccctgggggtggattgcatagaacaaaagtag

SEQ ID NO: 8613 - DNA, 525 bp, Artificial Sequence
  Description of Artificial Sequence: Synthetic coding sequence
atgctgcggaccgagagctgccggccccggagccccgccggccaggtggccgcggcatctccactcctgctgctcctgctgttgctggcctggtgcgccggcgcctgccggggagcacccatcctgccacagggtctccaacctgaacagcagctccaactatggaacgagatcgacgatacctgttcatcctttctgtcaattgatagccagccacaggcgtccaatgctttggaggaactttgttttatgattatggggatgctgcctaagccacaagaacaggatgagaaagacaacacaaagcgctttctttttcattacagcaaaacccaaaagctcggcaagtccaatgtagtttcttcagtggtgcatccactactccagctggtgccccacctgcatgagagacgtatgaagagattccgcgtggacgaagagttccagagtccctttgcgtcccagagcaggggttactttttgtttagaccaaggaatggtcgacgcagtgctggattcatctag

SEQ ID NO: 8614 - DNA, 1218 bp, Artificial Sequence
  Description of Artificial Sequence: Synthetic coding sequence
atggacaccatcttcctgtggagcctgctgctgctgttcttcggcagtcaggcaagtaggtgcagcgcccagaagaacaccgaatttgccgtagatctctatcaggaagtgtctctgtcacataaggataacataatcttcagccccctggggattaccttggtgcttgagatggtgcaactaggtgcgaagggcaaagcccagcagcaaatccggcagactctgaaacaacaggaaacctcggctggggaagagttcttcgtcttgaaatcttttttctccgcaatctctgaaaaaaaacaggaatttacattcaacctagcgaacgccttatatttacaggaaggtttcacggtgaaggagcagtacctacacggcaacaaagagttcttccagtcagctattaaactcgtggatttccaggacgcaaaggcctgtgcagagatgatatctacatgggttgaacggaaaacagatgggaaaatcaaggacatgttttcaggggaagaattcggcccgctgacaaggctggttttggtgaatgcgatctatttcaagggggactggaaacagaaattccgcaaagaggatacacagctgatcaacttcactaagaagaacggatccacggtcaagattcccatgatgaaagcactcctgagaacaaagtatggatattttagcgagtcatccctcaactaccaggtcctcgagttgtcttacaaaggggacgaattctcattgatcattatactgcccgcagaaggaatggatatcgaggaagtggagaagctcatcactgcccagcagatcttaaaatggctgtcagagatgcaggaggaagaagtggaaattagcctgcctaggttcaaagtggaacaaaaagtggacttcaaggacgtgttgtactccctcaacatcaccgaaatcttttcgggcggttgtgacctctcgggcataaccgactccagcgaggtttatgtgtcacaggttacgcagaaggtgttttttgagatcaatgaagacggctccgaggctgccactagcaccggcatccacattcctgtgatcatgtccctggcacagagccagttcattgcgaaccatccattcctgttcatcatgaaacacaatccaacagagtcaattctcttcatgggccgggtgactaacccagacactcaagaaataaagggcagagatctcgattcgttatag

SEQ ID NO: 8615 - DNA, 3687 bp, Artificial Sequence
  Description of Artificial Sequence: Synthetic coding sequence
atgaagggcgcccggctgttcgtgctgctgagcagcctgtggagcggggggattggtttaaacaattcaaagcattcttggaccatcccagaagacgggaactcccagaaaactatgcccagtgcgtccgtcccgcccaataagatacagtcattgcagatcttaccaactacacgggtgatgagtgctgagattgctacgacccccgaggctcgaacttccgaagattcactgcttaagtcaactttgccgccaagcgaaacgtccgctccggcagagggagtcaggaaccagaccctcacctcaacggagaaggctgaaggagttgttaagttgcagaacctgacactcccgacgaatgcttccattaagttcaatccgggcgcagagtccgtcgtgttgagcaatagcaccctcaagttcttacaaagcttcgcccggaagtcgaacgaacaagcaaccagtctcaacactgtcggaggaacgggcggcattggaggtgtggggggcacgggcggagtgggaaatagagccccaagggaaacctatttgagcagaggggacagttcaagttcccaaaggacagactaccagaagagcaactttgagaccacaagagggaagaactggtgcgcctacgtgcatacccgcctatctccaacagtcattcttgacaatcaagtgacatacgttcctggcggcaagggaccatgcgggtggacaggtggcagctgcccacagcggtcccagaagatcagcaacccagtgtaccgtatgcaacacaagatcgttacatctcttgactggaggtgctgtcctggctatagcggccccaagtgtcagctgcgggcccaggaacagcagtcccttattcacacaaaccaggccgagtcacacacagcagttggtcgtggggtagcagaacagcagcagcagcaagggtgcggagatccggaagtgatgcaaaagatgacagatcaagtgaattaccaggctatgaagctgaccctattacaaaagaagatcgacaacattagcctgaccgttaatgacgtgcgcaatacctattcttcactggagggcaaggtttcggaggacaagagcagagagttccagtcccttctaaaagggttgaagtctaagtcgatcaatgtattgatccgggacattgttcgggagcaattcaagatttttcagaacgatatgcaggaaactgtggctcagctgttcaaaaccgtatcttcactttctgaggacctggagtccacgcggcagattatccagaaagtcaacgagagcgtagtgagcattgcagcccaacagaagtttgttctagtgcaggaaaatagacctacattaaccgacattgtcgagctgcggaaccacatagtcaatgtgcgacaagagatgactctgacttgcgaaaaacctattaaagagttggaagtcaagcagacacaccttgaaggcgcactggagcaagaacactcgcggagtatcctgtactatgagagcctgaacaagaccctgtcaaagctcaaggaggtgcacgagcagttgctttcaacagagcaggtgagcgaccagaagaatgcacccgccgcagaaagcgtgtccaataatgtgacagaatacatgagtacgttacacgaaaacattaagaaacagtctctgatgatgttgcagatgttcgaggacctgcatatccaggaaagtaaaattaataatctaactgtcagcctcgaaatggagaaagaatccctgagaggcgaatgcgaggatatgctttcaaaatgccgaaatgatttcaaattccagctgaaagacaccgaagagaacctgcacgtgctgaaccagacactggccgaagtgcttttccccatggacaataaaatggacaaaatgagtgaacagttgaatgacctaacctatgatatggaaatactgcagccgctgctcgagcagggtgctagtctcagacagaccatgacttatgagcagccaaaggaagccatcgttattaggaagaaaatcgagaatctaaccagcgccgtgaactccctgaactttatcatcaaggaacttaccaaaagacacaatctgttaaggaatgaggtgcagggcagggatgatgcactggagagacgaatcaatgaatacgctctagagatggaagatggcctgaacaagaccatgacaataatcaataatgcgatcgattttatccaggataattacgctttgaaagagaccctttccaccatcaaggacaatagcgagatccatcataaatgtacatcggacatggagacaatcctgacctttataccccaatttcaccgtctaaatgacagcatacagactttagttaacgataatcaaagatacaattttgtcttgcaggtggccaagacccttgccggaattccgagagatgagaagctcaaccagtctaactttcagaaaatgtaccagatgtttaacgagactacctctcaagtccgcaagtaccagcaaaacatgtcacacctggaggagaagctactcttgacgaccaagatctcaaaaaatttcgagacccgtctccaggatatcgagtcaaaagtgactcaaactttgatcccctattatatttccgttaagaagggatccgttgtcaccaatgagcgcgaccaagcccttcaattacaggtcctcaattccagatttaaagccctggaagcaaagtctatccacctcagcatcaatttcttttctctgaataaaacactccacgaagtgctgaccatgtgccacaacgcctcaacgtccgtaagtgagctgaatgcaaccatacctaagtggatcaaacattctctgccagatattcagctgctccagaagggcctgacagaattcgtggagccaatcatacagatcaagacgcaggctgccctgtccaatttgacatgctgcatcgaccggtccctgcctggatctctcgctaatgtggtcaaaagtcaaaagcaggtcaagtccttacctaagaaaatcaacgccctgaagaaaccaaccgtgaacctgaccacagtcctgatcgggcggactcagcgcaataccgacaatataatttatccggaggaatacagtagctgctctcggcatccttgccaaaatggaggcacttgcataaatgggcggacatcgtttacgtgcgcctgccggcacccctttacaggggacaattgcacaattaaactagtcgaggagaacgccctggccccagacttctcaaaaggaagctaccgttatgcgccaatggtcgccttcttcgcgtcccatacgtatggaatgactatccctggcccaattctgttcaacaatcttgatgttaactatggtgcatcttacacgcctcggaccggcaagttccgaattccttaccttggagtctacgtgttcaagtacaccatagagagcttcagtgcacatattagcggtttcctggttgttgacggaattgataaattggcattcgaaagcgagaacatcaattcagaaattcactgcgacagagtgctcaccggggacgcacttctcgagctcaactacggacaggaagtttggttacgactggctaaagggacaatcccagcaaaattcccccctgttacgacatttagtggttatttgctgtacaggacatag

SEQ ID NO: 8616 - DNA, 1365 bp, Artificial Sequence
  Description of Artificial Sequence: Synthetic coding sequence
atgtggcccctgaccgtgcccccccccctgctgctgctgctgtgctcgggcctggccggccagaccctgtttcagaacccagaggagggctggcaactctacacaagcgcgcaggcaccggatggaaagtgcatatgtaccgcagtgatccctgcacagtccacctgcagccgtgatgggcgaagccgcgagctgcgccagctgatggaaaaagtacagaacgtgtcccaaagcatggaggtcttggagctgagaacatatagggatttgcagtatgtacgaggaatggagactttgatgcggtctttggacgcccgtctgcgagcagccgacggttccctaagcgcaaagtcctttcaggagcttaaagacaggatgaccgaactgctgccactttccagcgtgctggaacaatacaaagccgatacccgcacaatagtgaggctgagagaggaggttcgaaacctgtccggctccttggccgcgatccaggaggagatgggagcctacggctatgaggaccttcagcagcgtgttatggcgttggaagcacgactccatgcctgtgcacagaagctgggctgcggaaagctgaccggtgtcagcaacccaatcacagtccgcgcgatgggaagtagattcggctcctggatgaccgacacgatggcaccaagcgctgattcccgtgtgtggtatatggatggctactacaaagggaggagagtcctggaattcagaaccttaggggattttattaagggacagaactttattcagcacctcttacctcagccatgggccggaaccggccatgtggtatacaacggcagcctgttctacaacaagtaccagtcaaacgtggtggtcaaatatcactttcgctcacgctctgttctggtgcagaggtccctgcccggtgctggctacaacaatacctttccatattcgtggggcggattctcagatatggacttcatggtggacgagtccggcctgtgggctgtgtatacaaccaatcagaacgcgggtaatatcgtagtgtcccggctggatcctcacacactggaagtgatgcggtcatgggacacgggctatcctaaaagaagcgctggggaagcctttatgatctgtggagtcctgtacgtaacaaatagccacctggcaggtgcaaaggtatactttgcctactttactaacacttctagttatgaatacacagacgtgcccttccacaatcaatactctcatatatccatgctcgattacaaccccagagagagagcactgtacacctggaataacggccatcaggtcctctataatgttacactttttcatgtcatatccacatcaggcgacccttag

SEQ ID NO: 8617 - DNA, 909 bp, Artificial Sequence
  Description of Artificial Sequence: Synthetic coding sequence
atgtgcgccgagcggctgggccagttcatgaccctggccctggtgttagctacattcgacccggctcgaggtactgatgctactaacccgcccgagggccctcaagataggagcagccaacagaagggccgcttatctctgcagaacaccgccgagatccaacactgtctggtaaacgcgggagacgtcggctgcggcgtattcgaatgctttgagaacaactcatgtgagattaggggcctccatggtatctgcatgacttttcttcataatgccggtaaatttgacgcacaaggcaaatcattcattaaagacgctctgaagtgtaaagcacatgccctgagacacaggttcggatgtatttctcgcaagtgccctgccattagagaaatggtgtctcaacttcagcgggaatgctatttgaagcatgatctctgtgctgctgcgcaggagaacacccgtgtgatagtggagatgattcatttcaaggaccttttgctgcacgaaccgtacgttgatctggtgaatctgctgctgacctgtggggaagaagtcaaggaggccatcactcatagcgtgcaggtacaatgcgaacagaattggggatctctgtgttccattctctcattttgtacgagcgctatacagaaacctcctactgcacctcccgagcggcaaccacaagttgaccggacaaaactgtctagggcccatcacggagaggccgggcaccatctgcctgagccctcttcccgcgagaccggccggggggcgaaaggtgaacgaggatcaaagagtcaccctaacgcacacgccagagggcgggtgggcggactgggtgcacagggcccgtctggttctagtgagtgggaggacgaacaatctgagtacagcgacattcggcggtag

SEQ ID NO: 8618 - DNA, 2529 bp, Artificial Sequence
  Description of Artificial Sequence: Synthetic coding sequence
atgaagcccggcggcttctggctgcacctgaccctgctgggcgccagtctgcctgccgcgttgggctggatggatcctgggacaagtcggggtcctgatgttggagtgggtgagagtcaggcagaagaaccaaggagctttgaggttacccgccgcgaggggctctcaagccacaatgaactccttgctagctgcggaaaaaagttttgttcacgagggagcagatgtgttctgtctcggaaaactggggagcccgagtgtcagtgcctggaggcctgtcggccttcttacgtgccagtgtgcggctctgatggccggttttacgagaatcattgtaaactacacagagccgcctgcttgctgggtaaacgaatcactgtaatccattccaaagattgtttccttaagggcgacacatgtactatggctggctacgccagactgaagaatgtgctcttggcgttacaaacgagactgcagcccctgcaggaaggggacagcaggcaagaccccgcctctcagaaacggctgttggtagagagtttgttcagagacctcgacgcagatggcaacggccacctgtcgtcttctgagctggcccagcatgtgctcaaaaagcaagacctcgatgaagatctgttgggatgttctccaggggatcttctaagattcgatgattacaacagcgacagttccctcacgctccgtgagttttacatggcttttcaagtagtccaactatctctggctccagaagacagggtctctgtgacgacagtgaccgtgggattgagcactgtgctcacttgtgcagtccacggagacctgaggccccccatcatttggaagcggaacggactcacacttaacttcctggacctcgaggatatcaacgatttcggcgaagatgattcgctttacataaccaaagtcactaccatccatatgggtaattacacctgtcacgcgagtggccatgagcagctgttccaaacacatgtccttcaagtcaacgtgcccccagtaatcagagtctacccagagtcacaggcacaagaaccaggagttgcagcaagcctgcgatgtcacgctgagggaatccccatgccgagaattacgtggctaaagaatggtgtggacgtgagcacccagatgtccaagcagctgagtcttctcgccaatgggagcgagctgcacatctcttctgtgaggtatgaggatactggcgcctacacctgcatagcaaaaaacgaggttggcgttgacgaagacatatccagcctgttcatcgaggattccgccaggaagacactggccaacatcctatggagggaggaaggtctgagcgtcggcaacatgttttacgtgttctcggatgatgggataattgtgatccacccagtggactgcgaaatccagcggcatcttaaaccaacagaaaaaatattcatgtcctatgaggagatttgtccacagagggaaaagaatgcgactcaaccttgccaatgggtcagcgctgttaacgtgaggaatagatacatctacgtcgctcaaccagctctatctagggtgttggtggtagacatccaagcccagaaagtactgcagtctatcggggtcgaccctctccctgcaaaattaagctatgataagagtcatgaccaggtttgggtcctttcctggggtgatgtccacaagtcaaggccatctcttcaggtaataactgaggcttctaccggtcagtcccaacaccttattcggacacctttcgccggtgttgatgacttctttatccccccaacaaatctgatcattaaccatatccgctttggctttatctttaacaaaagtgatccagcagttcacaaagtcgatctagagaccatgatgccactgaaaactattgggctgcatcatcacggttgtgtcccgcaggccatggctcatacgcatctcggaggctattttttcatacagtgtcgacaagacagccctgccagtgctgcacggcagctcctggtcgacagtgtaactgacagtgttcttggcccgaacggtgacgtcacgggaacccctcacacatcaccagatggaagattcattgtttcagcggcagctgattcaccgtggctccatgtgcaggagattacagtgaggggcgagatccagactttgtacgacctgcagatcaattccgggatctcagacttggcattccagagatcattcactgagagtaaccagtacaacatctacgcggccctgcacacagagccggacctcctgtttctggagctgagcactggcaaagtaggtatgctaaagaatttgaaggaaccacctgccggccccgcacagccatggggaggcacacacagaataatgagggatagcggactctttggtcagtacttgttgaccccagcccgggaatcactgttcctgatcaatggccgccagaataccctccgctgcgaggtgtcgggtattaaggggggcacgaccgtggtgtgggtcggcgaagtgtag

SEQ ID NO: 8619 - DNA, 2256 bp, Artificial Sequence
  Description of Artificial Sequence: Synthetic coding sequence
atggccttccggaccatctgcgtgctggtgggcgtgttcatctgctccatttgtgttaagggatcaagccaaccacaggcacgcgtatatctgacctttgacgaattacgtgagactaaaacatcggaatacttctcattatctcatcaccccctagattaccgcatccttctgatggacgaggatcaggaccgtatttacgttgggtcaaaggaccacatcctgtccctgaacatcaacaacatctcacaggaagccctgagtgtcttttggcccgcctcgaccattaaggtggaggagtgcaagatggcagggaaagaccccacccacgggtgtgggaacttcgtgagggtaatacagacattcaatagaacccatctctatgtctgcggtagtggtgctttctcacccgtgtgcacgtacctgaacagaggtcgccgaagcgaggaccaggtgttcatgatcgactcgaagtgcgagtctggcaaggggcgttgttcattcaaccccaatgtcaacaccgttagcgtcatgatcaacgaggaactgttttccggaatgtacatagacttcatggggacagatgctgccatctttcggtccctcactaaacgcaacgcggtccgaacagatcagcataactccaagtggttgagcgagcccatgtttgtggatgcccacgtaatcccggacggtacagatccaaacgatgccaaagtttatttctttttcaaagaaaaactgacagacaataaccggtccaccaagcaaatccacagcatgattgccagaatctgccctaacgatacaggtggcttacgctccctcgttaataaatggacgacgtttctgaaggccaggctcgtatgtagcgtcaccgacgaagacggccccgagacccatttcgacgagcttgaagatgtgttcttgctagagacagataacccaagaaccaccctagtgtacggaatctttaccacctcctcttctgtgttcaaagggtccgccgtgtgtgtgtatcatttgtcagacattcaaaccgtgtttaatggccctttcgcccacaaggaaggaccgaaccatcagctcatttcttaccaaggacgaattccttacccacgtccggggacatgtcctggcggggcattcacccccaatatgcgcacaacaaaagagttccctgatgatgtggtgacctttattcggaaccaccccctgatgtataattcaatatacccaattcataagagacctctaattgtgagaatcggaacggattacaaatacacaaagattgccgtagacagagttaatgcagcagacggacgctatcatgttttattcctgggcacagatcggggtacggtacaaaaggttgtcgttctgcccactaataactctgtgtctggcgagctgatcttggaggagctagaggtctttaaaaatcacgctcccattactaccatgaagatttcgtccaagaagcagcagctgtatgtatcttctaacgaaggcgtcagccaagtctcgttgcatcggtgtcatatttacggaacagcgtgtgcagattgctgcttagccagagacccctattgcgcctgggatgggcactcttgttcacgattctacccaacaggaaagcggcgatcccgtcgccaggacgtgcggcatgggaaccctctcacgcagtgcagaggcttcaacttgaaggcctaccgtaacgctgctgagatcgtacagtacggggtgaagaacaataccacctttctggagtgcgcgcctaagagtccccaggcgagcataaagtggctgctccagaaagataaggatcgccggaaggaggttaaactgaatgaacgcattatcgccacatcccaggggctcctgatacgaagcgtgcagggatctgaccagggcctgtaccattgcatcgcgacagaaaatagtttcaaacagactattgctaaaattaatttcaaagtcctggacagcgaaatggtcgctgtagtcactgacaaatggtccccctggacttgggcatctagtgtgcgcgctctgccctttcatccaaaggatatcatgggggcgttttcacattcggaaatgcagatgattaaccagtactgtaaggatacccggcagcagcatcagcaaggggatgagagtcagaaaatgcggggggattatggaaaactcaaagctctgatcaactcccggaaaagccgtaatcggaggaaccagcttccagagtcttag

SEQ ID NO: 8620 - DNA, 2316 bp, Artificial Sequence
  Description of Artificial Sequence: Synthetic coding sequence
atgggctggctgacccggatcgtgtgcctgttctggggcgtgctgctgacagctcgcgccaattatcagaacggcaagaataacgttccacggctgaagctgtcctacaaggaaatgctggagtctaataatgtcataacttttaacgggcttgccaacagcagttcttaccacacttttctgcttgatgaggagaggagtagactctacgttggggcgaaggaccacatcttctcatttgatctggttaacattaaagactttcagaaaattgtttggcccgttagctacacacgtcgggacgaatgtaagtgggccggtaaggacatattaaaggagtgtgctaatttcatcaaggtcctaaaggcctacaaccagacccacttgtacgcttgcggcaccggagctttccaccccatctgcacctacattgaaatcggccatcatccagaagacaatattttcaagctggaaaacagtcatttcgagaatggacgcggcaagagcccatatgaccccaagctgctcactgcttctctcttaattgacggggagctctacagcggtacggccgcagatttcatgggtcgcgatttcgccattttccgcactctgggtcatcatcatccgatcagaaccgaacagcatgactcgcggtggcttaacgaccctaagtttattagcgcccacttgatttctgagtccgacaaccctgaggacgacaaagtgtatttttttttccgcgagaacgctatagatggagagcacagtggaaaagccacacacgcccggatagggcagatctgcaaaaacgatttcggaggccaccgaagcttggtgaataagtggacgacatttctgaaagctaggctgatttgctcggtcccaggccctaacggcattgatacgcactttgacgaattacaggatgtgtttctcatgaatttcaaagacccaaagaatcctgtggtttacggggtattcaccaccagctctaatatctttaagggctcggccgtctgcatgtactccatgagtgatgtgcggcgggttttcttagggccttatgctcaccgggacggaccgaactatcagtgggtgccgtaccagggcagagtcccctatccgaggcctgggacctgtccatcaaagacctttggaggatttgacagcactaaggatctgccagacgacgttatcacttttgcgcgcagtcaccctgccatgtataacccagtgtttccaatgaacaatcggccaatcgtcatcaaaacagacgtgaattatcaatttacccaaatagtcgtggaccgggtcgacgcagaagacggccagtatgacgttatgtttatcgggacagacgtgggaacagttctgaaggtggtaagcattccgaaagagacatggtatgatctggaagaggttctgctggaggagatgaccgtgtttagggaacctacggccataagcgccatggagctatccacaaaacaacagcagttatatatcggctccaccgcgggggtagctcaactccccttgcacaggtgtgacatctacggcaaagcttgtgccgaatgctgcttggctcgggacccttactgcgcgtgggacggtagtgcttgctccaggtacttccctaccgccaaaagacgtacacggcggcaggatatccgcaatggcgaccctctgacacattgctcagatcttcaccacgataaccaccatggccactcaccagaggaacgtatcatctacggtgtcgagaactcatctacttttctggaatgttcacccaaatcacagcgggccctggtgtactggcagttccagcgccgtaatgaggaacgcaaggaagagattagggtcgacgaccacataattagaacggatcagggcctgctgttgagatccctccaacagaaggactccggaaattatctttgccacgcggtcgagcacggattcatccaaaccttgttaaaagttaccttggaggttatcgacacggaacatctggaagagttgctgcacaaggacgacgatggcgacggaagcaagaccaaggagatgagcaattccatgaccccaagccagaaggtctggtatcgtgactttatgcagcttattaatcaccccaatttaaatacaatggatgagttctgtgagcaggtatggaagagggaccgaaagcagagaagacagagaccgggccacaccccgggcaacagcaataagtggaaacacctccaggaaaacaagaaaggccgtaatcgtcggacccacgagtttgagagggcaccacgtagtgtgtag

SEQ ID NO: 8621 - DNA, 4605 bp, Artificial Sequence
  Description of Artificial Sequence: Synthetic coding sequence
atggccctgacccccggctggggcagcagcgccggccccgtgcggcccgaactgtggctcctgctgtgggccgccgcctggaggcttggagcctctgcttgtccagccctgtgcacttgcacaggtacaacagtcgattgtcacggcaccggcttacaggcgatccccaagaacatacctaggaacactgagaggctggagctgaatgggaacaatattacgcgaatccacaaaaatgacttcgctggtctgaagcagctcagggttttgcagctgatggaaaaccagattggcgccgtagaacgcggagcattcgatgacatgaaagaattggaacgcctgcggctgaaccgaaaccagttacacatgctgcccgagctgttattccaaaacaaccaggctctgtccagactcgatttatcagagaatgctatccaggccatcccccgcaaggcattccgcggtgccactgatttgaagaacctgcagttggataaaaaccagatctcttgtattgaggagggggcgtttcgcgccctgagagggctcgaggtgctgaccctgaacaataacaacatcaccacaatccccgtgagctcattcaatcacatgccaaagcttcggacattccgccttcatagcaaccacttgttctgtgattgccatctggcatggctgagccaatggctgagacaacgccccaccatcggtttgttcacccagtgctcgggaccagcctctctgaggggcctgaatgtggccgaggtccaaaagagtgagttcagttgttccgggcagggcgaggcggggcgggtcccaacctgtactttgtcctcagggagctgtccggctatgtgcacatgtagcaacggcatcgtcgactgccgggggaaaggcctgaccgcaatcccagccaacctccccgagaccatgaccgaaattcgactggagctaaacgggattaaaagtatccctcccggcgccttcagcccataccgaaaactgcgaaggatagatctgtctaacaatcaaattgctgagattgctcccgacgcctttcaggggctgcgcagcctgaatagtctggtgctgtacggcaacaagatcaccgatttacctcgcggtgtttttggaggcttgtatactctgcaattgctgctgctgaacgccaataagatcaattgtatcagacccgatgctttccaggacctacagaacctgtccctgctgagcctgtacgacaacaagattcagagcctggcaaaaggaactttcacctccctccgcgctattcagaccctgcacttggcgcagaatccatttatctgcgactgtaatctgaaatggcttgctgattttctcaggacaaaccctattgagacctcaggcgctcgctgcgccagcccccggagattggccaataagcgcattggacagatcaaatctaagaaattcaggtgtagtgccaaggagcaatacttcatcccaggcaccgaagactaccaacttaactctgagtgcaattccgacgttgtgtgtccacataagtgccgctgtgaggctaacgtggtagagtgcagcagtctcaagcttaccaagatccctgaacgtatcccacagagtacggcagagctccgattaaacaacaacgaaatctctatcctcgaagccaccggaatgtttaagaaactgacacacctgaaaaagataaacctctccaataacaaagtgtccgagatcgaagacggcgcttttgaaggcgccgcgagcgtgtcagagctgcatttgaccgccaaccagcttgagagtatccgctcgggaatgtttcgaggcctcgacggactgcgaacactcatgctgcgcaacaaccgcatatcatgtattcataatgacagcttcaccggcctacggaacgtccgacttctgtccctctatgacaaccagataacaaccgtgtcccctggggcatttgatacgctgcagtcccttagcaccctgaacctcctggcaaatccgttcaattgcaattgccaacttgcctggctcggcggatggctgaggaagaggaaaattgtgactgggaacccccgttgtcaaaaccccgactttctccgtcagattccactacaggatgtagcttttcctgatttcagatgcgaagagggtcaggaagaaggaggctgtcttcccagaccgcagtgtcctcaagaatgtgcctgccttgacacagttgttaggtgtagcaataagcatctgagggcactgccaaagggaattccaaagaatgtgaccgagttgtatctggacggcaatcaatttacgttagtgcctggacagctgagcactttcaagtatctgcagctggtagacctgtccaataataaaattagctccctctcgaacagcagctttactaatatgagccagctgactaccctcatattaagctacaatgccctgcagtgtatcccccctttggccttccagggcctgagatctttacggttgttgtccctgcacggcaatgatatatcaactttgcaggagggtatcttcgctgacgtcacgagcctctctcaccttgcaatcggcgccaaccctctatactgcgactgccaccttcgctggctgagcagttgggtgaagactggctataaagaacctgggatcgctaggtgcgcgggtccacaagacatggagggaaagttgctcctcacaacacccgcaaaaaagtttgaatgtcagggacctcccaccttagccgtacaggctaaatgtgacctgtgtttatcaagcccatgccaaaaccaggggacgtgccacaatgaccctctggaagtgtacaggtgcgcctgcccaagcggatataagggacgggattgcgaggtgtcacttgatagctgttcatcgggaccttgtgagaatggtggcacctgccacgcccaggagggcgaagatgccccttttacgtgcagctgcccgaccggcttcgaagggccgacttgtggcgttaatactgatgattgcgtggatcacgcatgcgcgaatggcggagtctgtgttgatggcgtaggaaactacacttgtcagtgtccactgcagtatgagggcaaggcttgtgaacagctggtggacctgtgttcaccagatcttaacccatgccaacacgaagcccaatgcgtcgggaccccggatggccccagatgcgaatgcatgccagggtacgctggagataattgtagcgagaaccaagacgactgtcgggatcaccggtgtcagaacggggctcagtgcatggatgaggtaaacagttacagctgcctgtgcgccgagggatattcaggccagctttgcgaaatcccaccccatctcccagcccccaagtccccctgcgagggcaccgagtgtcagaacggagccaattgtgtggatcagggaaatagacctgtctgccaatgcctccccggctttggcggacctgagtgcgaaaagctgctgtccgtcaacttcgtggatcgggacacctatctgcagttcacagaccttcagaattggcccagggccaacattaccttacaggtatccaccgcagaagataatggaatccttctctataacggcgacaatgatcacattgccgttgagctgtaccagggacatgtgagggtgtcttatgatcccggcagttacccttcctcagctatctactccgctgagactataaacgacggtcagttccacaccgtcgaactcgttgctttcgatcaaatggttaatctgtcaatagatgggggaagtcctatgaccatggataacttcggcaagcattataccttgaactctgaggcccccctctacgtgggcggaatgccggtcgacgtcaactccgccgccttccgcctttggcagatcctgaacggcaccggtttccacggttgtatcagaaacctgtatataaataacgagttacaggattttacaaagactcagatgaagccaggggttgtgcctggctgtgaaccttgccgcaaattatattgtctgcacgggatctgtcagccaaacgctacgccaggcccaatgtgtcactgcgaggcaggctgggtcggcctgcattgcgaccagccggcggatggaccttgccacgggcataagtgcgttcatgggcaatgcgttccgttggatgctctgtcttacagctgccaatgtcaggatggctattcaggagcactttgtaatcaggcaggagccctggccgagccatgtagggggttgcaatgtctccatggacactgccaggccagtggaacgaagggggcgcattgcgtgtgcgatcccgggttctcgggagaactgtgtgagcaggagtccgagtgtcgaggggaccccgtgcgggatttccatcaggtccaaagggggtacgccatctgtcagactacccggcctctcagttgggtggagtgtcggggctcttgtcctgggcaaggatgttgccaggggctgcggcttaagcggcggaagtttacattcgaatgttcggacgggacgtcatttgccgaagaagttgaaaaacccacaaagtgcggctgtgcattgtgcgcctag

SEQ ID NO: 8622 - DNA, 342 bp, Artificial Sequence
  Description of Artificial Sequence: Synthetic coding sequence
atggacagccggcaggccgccgccctgctggtgctgctgctgctgatcgatggtgggtgcgccgaagggccgggtggtcagcaggaggatcagctgtctgctgaggaggattcggagcccttgccacctcaggatgcgcagaccagtggaagcctcctacattacttgctacaagccatggagcgtcccggaagatcacaggcgtttctttttcagccgcagaggttcgggcggaatacacaggggagttggaggaacgagtggctgagccccagggctggggagggcctcaattcacaattctggagtctggcagcaccccagcggttcggaaaaaaatag

SEQ ID NO: 8623 - DNA, 2568 bp, Artificial Sequence
  Description of Artificial Sequence: Synthetic coding sequence
atggcccggcacctgctgctgcccctggtgatgctggtgatcagccctatccccggcgcattccaagactcagctctgtcacccacccaggaagagccagaggacctggattgcggccggccagagccctccgcccggatagtgggcgggtccaacgcccaacccggcacgtggccctggcaggtttctcttcaccacggaggcggtcatatttgtggcggttcactgatagcgcccagctgggtgttgtccgcagctcattgtttcatgactaacggaacccttgagcctgccgctgaatggtctgttctgctgggggttcactctcaggacgggcctttagacggcgcccacacacgggctgttgctgcgatcgttgtcccggcgaattactcacaggtagaactaggtgcagatttggccctactgcgtctcgctagccccgcctcccttggcccagctgtctggccagtgtgtctcccacgggcaagtcacagatttgtccacggcacagcctgctgggccacgggatggggcgatgtacaggaagctgaccccctgcctttaccttgggtattgcaggaggtagaattacggctgctcggggaggccacatgccagtgcctttacagtcagccaggcccgttcaaccttactcttcaaattctaccggggatgttatgtgcagggtaccctgagggcagacgagacacctgccagggggacagcggcgggccactcgtgtgcgaggaaggtgggaggtggttccaggctggaattactagtttcggctttgggtgcgggcgtcggaaccggcctggcgtgtttaccgcggtggctacatacgaagcctggatccgcgaacaggtcatggggtctgagccagggcctgcctttcccactcagccccagaaaacccagtccgatccccaagagcccagggaggaaaactgtacaatagcgctgcccgagtgtggaaaggcacctagacctggcgcctggccatgggaggcccaagttatggtacctggctctcggccgtgccatggagcactggtgtcagagagttgggtgttggcccctgcttcctgcttcctggaccccaattcctcggacagcccccctagagatctcgatgcttggagggtccttttgccttcgaggccaagggcagaacgggtcgcccgcctggtccaacacgagaatgcctcctgggacaatgcctccgacttggctcttcttcagctgcggactcctgtgaacctttcagctgcctccagacctgtttgccttcctcatcccgagcattattttctccccggcagccgctgccggctggcacgctggggtcggggagagcctgcattgggaccgggagccctcttggaagctgagttgcttgggggttggtggtgtcattgtttgtacggacggcagggcgccgccgttcccctcccaggagacccacctcacgccctgtgcccagcttaccaagagaaagaggaggtgggctcttgctggaacgactcaaggtggtctctcttatgtcaagaggagggcacctggttccttgctgggattagagatttcccgtccggatgtctgcggcctagggcattttttccccttcagacacatggcccatggatctctcacgtgacccgtggcgcctatttggaggatcaactcgcttgggactggggacccgacggcgaggaaaccgaaacacaaacttgcccgccccatacagagcacggcgcttgcggcctgcggctcgaagccgctccagtaggcgtgctctggccctggctcgctgaggtacacgtcgccggcgatagagtatgcaccggaatcctgctcgctcccgggtgggtgctggcggccacacattgtgttctccgcccaggatctacaactgtgccgtatattgaagtgtatttagggagagccggtgcaagctccctaccacagggacatcaagtgtccaggctggtgatcagcatccgcctgcctcagcacctggggctacgcccacctctcgctctgctggagctgtccagtagggtggaaccctcaccatccgctctgcccatatgtttgcatcccgctggcattcctccgggagccagttgttgggttctcggttggaaagaaccgcaggatagagttcctgtggcggcggcagtgtctattctgacccaaaggatctgcgactgtctgtaccagggcatcctgcctcctggcacactgtgtgtgttgtacgcagaagggcaggagaatcggtgtgaaatgacgtccgccccacccctgctgtgccagatgaccgagggtagttggatcctagttggcatggccgtgcagggaagtcgggagctgttcgccgccataggcccggaagaggcctggatcagccaaacagtgggtgaggccaattttttgcccccaagtggatctcctcattggccaacaggggggagtaacctctgcccgcccgaactggctaaagcatccggttcacctcatgctgtttactttctcctgctactaactcttttgatccaaagctag

SEQ ID NO: 8624 - DNA, 912 bp, Artificial Sequence
  Description of Artificial Sequence: Synthetic coding sequence
atgctgcaccccgagaccagccccggccggggccacctgctggccgtccttctggctttattggggactacctgggcagaagtttggcccccccaattacaggaacaggcgccaatggcaggagcactcaaccgcaaagaatcttttctgctgctaagcctgcacaaccgtctgagaagttgggtacagcccccggctgctgatatgcgcagactggattggtcggatagcttggcacaactagcacaagcacgagccgcactgtgcggcatcccgacaccctcgttagcctctggtctgtggagaaccttgcaggtaggatggaatatgcaacttctgccagccggcttggcaagcttcgtggaggtggtaagcttatggttcgccgagggtcagcggtactctcacgcagccggcgagtgcgccaggaacgctacgtgcactcattacacccaattggtgtgggcaacttcctcgcagctgggatgcgggaggcatctatgcagcgcaggtcagacggctatcgaagcttttgtgtgcgcttactctcctcgtggaaattgggaggtcaatggcaaaacgataattccctacaagaaaggcgcatggtgttccctctgcaccgcatcggtgtctggctgtttcaaggcttgggatcacgctggcggcctgtgcgaggtgccgcggaatccttgtaggatgtcctgccagaaccacggacgactcaatatcagcacctgccattgccattgcccacctggctacacagggcgctactgtcaggtgagatgtagtctgcagtgcgtccacgggcgtttccgcgaggaagagtgctcatgtgtttgcgatatcggatacggtgagccctctgttccgccccgttgcattttcccttctactccagtcacatag

SEQ ID NO: 8625 - DNA, 1158 bp, Artificial Sequence
  Description of Artificial Sequence: Synthetic coding sequence
atgaagatgctgcccggcgtgggcgtgttcggcaccggcagcagcgcccgtgtgctcgtacccctcctgcgggctgagggatttaccgtagaggcgctgtggggcaagaccgaggaggaagctaagcagctggctgaggagatgaatatagcattttacacctcccggaccgacgacattttactccaccaggatgtggatctggtgtgcatctcaattcccccccctctaacccgccagataagcgttaaagccctgggcatcggaaagaatgtggtctgcgaaaaggctgctacatcggtggatgccttcaggatggtcaccgcaagccgatactatcctcaactgatgtcactggtcggtaatgtcctcaggtttctgcccgctttcgttagaatgaaacagctgatctcggaacattacgtgggagctgtgatgatctgtgatgcccggatttactcaggtagccttttgagcccctcatatggttggatttgcgatgagttgatgggaggaggaggccttcataccatgggaacctacattgttgatctgctcactcatctcacggggagacgtgcagagaaggttcacgggctgttgaagacatttgtcagacagaacgcagcgattagggggattaggcacgtgacaagtgacgatttctgcttcttccagatgttgatgggcggaggcgtctgtagcacagtcaccctcaacttcaacatgccaggcgcttttgtgcacgaggtcatggtggtgggatcagctggccgcttagtagcgaggggagccgacctctatgggcagaagaattcagctactcaggaggagctcctattgcgagattcgttggccgtgggggctggtctgcctgagcaagggccacaggacgtgccgttactgtaccttaaagggatggtctacatggttcaggccctgcgccagtctttccaggggcagggggatagacggacgtgggacagaacacccgtgagcatggccgcctcttttgaggatggactgtatatgcaatccgtggttgatgcgataaagcgtagctcacggtcgggcgagtgggaggccgtcgaagtgctcaccgaagaacccgacaccaaccaaaacctctgtgaggctttacaaagaaataatctctag

SEQ ID NO: 8626 - DNA, 1470 bp, Artificial Sequence
  Description of Artificial Sequence: Synthetic coding sequence
atgcccgtgaccttcgccctgctgctgctgctgggccaggccaccgcagatccctgctatgacccacaaggacgccctcaattctgtctgcctcctgtgacccagttagctgctgtggctgcatcctgcccccaggcttgcgccctgagtcccggtaatcatctgggagcccgcgagacatgcaatgggtcgctgacactagctctgggaggcccctttttgctgacatcagttagcttacgcttttgcacccctggtccccccgccttgatactgagcgctgcctgggcctccggaggaccttggcgcctcttgtggcaccggccagcttggcctggcgctctgggaggcccagaacgtgtgaccttccacagcacacctggtccaaaggccaccgtggctgcctcacacctgcgggtcgagttcgggggccaagctggcctggccgccgctggtctgcgagggcggtgccagtgccacggccacgcggccaggtgcgcggccagggcgagaccgcctcgatgccactgtagacaccacaccaccggccccgggtgtgagagttgccggccctcccaccgcgattggccgtggaggcccgcaactccccgacacccccatccctgcctcccatgctcgtgcaaccagcacgctcgcagatgtcgattcaattccgaactgttcagactctctgggggccgatccgggggggtgtgtgaaaggtgtaggcatcacaccgctggcaggcattgccattattgccaaccaggcttttggcgcgatcccagtcagcccatattcagtcgccgtgcatgtcgggcatgccagtgccacccaattggtgctacgggcgggacttgtaatcagacttcgggccagtgcacatgtaagctaggtgtgactggtttaacttgcaacagatgcggccccggttatcagcagtcacgtagccctagaatgccatgccagagaatccctgaagctacaactactctggctacaactcctggcgcttactcttcagacccacaatgtcagaactactgcaatatgtctgacacaagagtgcacatgagtctgagacgttattgccaacaggaccacgtgcttagggcacaagttctcgcaagcgaggccgcgggtcccgcatggcagcgccttgctgtgcgagtgctggctgtctataaacagagagctcagcccgtgcggcgcggagatcaggacgcttgggtcccacgggcagacttaacctgtggttgcctccggctgcagcctggcacagattatctcttgcttggtagcgccgtgggcgatcctgacccaacaaggctaatcctggacaggcacggccttgcactcccttggcgccctcggtgggccaggccccttaagagactacagcaagaggaaagggccgggggctgtcgcggggtccgggcacccactccctcccctaggcctgaacattag

SEQ ID NO: 8627 - DNA, 8430 bp, Artificial Sequence
  Description of Artificial Sequence: Synthetic coding sequence
atgaccctggagggcctgtacctggcccggggccccctggcccggctcttactcgcttggtctgcattgttgtgcatggctggggggcagggtcgctgggacggagcgctggaggcggcaggtccagggcgggtcagaaggcgaggtagtcctgggattttgcaaggaccaaacgtgtgtgggtccaggttccacgcgtactgttgtcctggctggagaaccttccctgggcgcagccaatgcgtcgtgccgatttgcagacgggcgtgcggggagggcttttgttcacaacccaatctgtgcacctgcgccgacggaaccctcgctcccagctgcggtgtgtcccggggcagtggctgttcagtgagttgcatgaatggtggtacctgccgcggggcatcttgtctatgccagaagggatacaccggcactgtatgtggtcagccaatttgcgaccgtggctgtcacaacggagggaggtgtatcggccccaatcggtgtgcgtgcgtgtacgggttcatggggccccaatgtgaacgcgattatagaacaggtccctgttttggccaagtaggaccagaagggtgccagcaccagctgaccggactggtgtgcactaaggcactgtgttgtgccaccgtcggtcgcgcctggggactgccgtgcgaactgtgtccggcacagccacacccctgcagacgcggatttatccctaacatacacaccggcgcttgtcaggatgtagatgagtgccaggccgtccctggactttgccaggggggctcgtgcgttaatatggtcggttcatttcattgtaggtgccctgttggacatcgtttgtctgactcgagtgctgcatgcgaggactatcgagctggcgcttgcttttccgttctgttcggcgggaggtgtgcaggggacctagccggtcactatactagacgccagtgctgctgcgatcgcggacgctgttgggctgctgggccagttcccgagctgtgtccccccaggggatctaacgaatttcagcagctctgcgcgcagagactaccgctcctgccaggccacccagggttgtttcctggactgcttggcttcggctccaatggtatgggccccccgctcggaccagctcgccttaatcctcacgggtccgatgcacgaggcatcccttcactcgggcccgggaatagtaacatcggaactgctacactaaaccagacaatcgacatatgtagacactttactaacctctgtctgaacggacggtgcctgccaaccccttcttcctatcggtgcgaatgtaatgttggatatactcaggatgttagaggtgaatgcatcgacgtggacgaatgcacctccagcccttgccaccatggcgattgcgtgaatatccctggaacctatcactgcagatgttatccgggattccaagctacgccgaccaggcaggcttgcgtggacgtggacgaatgcattgtcagtggtggtctttgtcacctcggacgatgtgtgaacacagaggggagttttcagtgtgtctgcaacgctggattcgagttgtcaccggatggaaagaactgcgtagaccacaacgaatgtgctacgtcaaccatgtgcgttaatggcgtttgtctcaacgaagacgggtccttctcgtgtctgtgcaagcctggctttctattggctcctggaggccattattgcatggatatagatgagtgccaaaccccagggatctgtgttaatgggcactgtaccaacaccgaggggtctttccggtgccagtgcctggggggcctagccgtgggaactgatgggcgagtctgtgtggatacacacgtacgatcaacttgctatggagccattgaaaagggctcatgtgcacgccccttccctggaaccgtgaccaagtctgagtgttgctgtgccaaccccgaccatgggttcggagaaccttgtcaattatgtccagctaaagactctgcggagtttcaggctctttgctcatcaggactgggaattacaacagatggcagagacatcaacgaatgtgcactggatcctgaggtttgtgccaacggagtttgcgagaacctgcgtggttcctataggtgtgtgtgcaatttaggctatgaagcaggtgcgtcaggtaaggactgcaccgacgtcgacgagtgcgctctgaacagcctgctgtgtgacaacggttggtgccaaaactctcctggttcttactcctgtagttgcccacccggctttcatttctggcaggatacagaaatctgcaaggatgtagatgaatgcctctcctcaccctgtgtctccggagtctgcagaaacctcgcaggctcctacacctgcaagtgtgggcctgggtcgaggctcgatccctcaggtacattctgccttgattctaccaaggggacttgttggctaaaaattcaggaaagcagatgcgaggtcaaccttcaaggtgcctccctgaggtccgagtgctgtgctacactgggggctgcttgggggtctccctgcgaacggtgtgagatcgatcctgcctgcgccaggggtttcgcacggatgactggtgtgacttgcgatgacgtgaatgagtgcgaatcctttccaggagtgtgtccgaatgggaggtgtgtgaacacagccggctcatttcgctgcgaatgcccggagggactgatgctcgacgcgtcgggtcgcctttgcgtggacgtgagattggaaccatgctttctccgttgggacgaggacgagtgcggggtcacactgcctggcaaatatcgaatggatgtctgctgctgttccatcggagccgtgtggggggtcgaatgcgaagcgtgcccagatccggaaagcctcgagttcgcatcactgtgcccccggggtttagggttcgcatcaagagacttcctgtcggggagacccttttacaaagacgttaacgagtgtaaagtgtttccggggctgtgtacacacggaacctgtcgcaacactgtagggagtttccactgtgcttgcgctggcgggttcgccttggatgcgcaggagagaaactgcaccgatatcgacgaatgccgcatttcccctgacctgtgtggccaaggcacatgcgtgaatactcctggcagctttgaatgtgagtgcttcccagggtacgaatctggtttcatgctgatgaagaactgtatggatgtcgacgagtgcgcccgcgaccctttattgtgcagaggaggcacttgtactaatacggatggatcatataaatgtcagtgcccacccggccatgaacttactgctaaaggaaccgcgtgcgaggatatcgacgagtgcagtctgtcggacggcctctgtccgcatggccaatgtgttaatgtgattggagcatttcagtgtagctgtcacgccggatttcagtctacccccgaccgccagggttgcgtggatatcaatgaatgccgggttcagaacggtgggtgtgatgtccactgcatcaacacggagggatcctataggtgcagctgcggccagggttattctctgatgcctgacggacgggcttgtgccgacgttgacgaatgtgaggaaaatccacgagtatgtgaccaggggcattgcactaatatgcccggcggccaccgctgcttatgttatgacggcttcatggccactcccgacatgcgcacctgtgtggacgtggacgagtgtgacctgaatcctcatatttgcctgcacggagattgtgagaatacgaaaggtagtttcgtctgccattgccagctaggttacatggtgcgtaagggcgccaccggttgcagcgacgtcgatgaatgcgaggtgggggggcacaattgtgactctcatgcaagctgcctaaatattccaggctctttcagctgccgatgtctacctggatgggtgggcgacgggttcgaatgtcatgacctcgatgaatgcgtgtcgcaggagcataggtgtagcccacggggagactgcctgaatgtgccggggtcctataggtgcacctgccggcagggctttgcaggcgacgggttcttttgcgaggatcgcgacgagtgtgcagaaaacgtcgacttgtgtgacaatggacagtgcttaaacgccccggggggatatcgatgcgagtgcgaaatggggttcgacccaaccgaggaccatcgcgcttgtcaggatgtagatgagtgcgcccagggtaacctgtgcgccttcggttcttgcgagaatctccccggcatgttcaggtgtatatgtaacgggggttatgaactggatagggggggagggaactgtaccgacattaatgagtgtgcagatccggtgaactgcatcaacggggtgtgcattaatacccctggttcttacctgtgcagctgcccccaggactttgagctgaaccccagtggggtcgggtgtgtcgacaccagggccggaaactgtttcctggaaacccacgacagaggggactctggaatatcctgctcagctgagatcggggtgggggtgactagggcctcctgctgctgttcactcgggcgagcatggggaaacccttgcgagctgtgccccatggcaaacacaacagagtaccgaacactttgccccggcggagagggctttcagcctaacagaatcacagtgatactggaagatattgacgaatgccaggagctccctggcctgtgccagggaggcgattgtgtcaatacgttcggttcctttcaatgcgagtgccctcccggctaccacctgagcgagcatacacgcatctgtgaggacattgacgagtgtagtactcactccggcatatgtggtccaggcacttgctataacaccttaggcaactacacctgcgtctgtcctgcggagtacctgcaggtaaacggagggaacaattgtatggatatgcggaaatctgtctgttttcgacattacaatggtacttgtcagaatgaactggccttcaatgttacacgaaaaatgtgctgttgctcttacaatatcggacaggcgtggaatcgtccatgcgaagcttgcccgacccctatcagcccggactatcagatcctctgcggcaaccaggcaccaggcttcctgactgacatccataccggcaaacccctggatattgatgaatgtggggagatccccgctatctgtgctaacggtatttgcataaaccagatcgggagtttccggtgtgagtgccccgcaggttttaattataactccatcctactggcttgcgaagatgtcgatgagtgcggcagtagggagagcccatgtcagcagaacgcagactgcattaacatccctggcagctatcgttgtaaatgtaccagaggatataagctctccccggggggagcctgtgtggggaggaacgagtgtcgggaaatccctaatgtttgcagtcacggtgactgtatggacacagaaggcagctatatgtgcctgtgccacagagggttccaggccagtgccgaccagacgctgtgtatggacattgatgaatgtgaccggcagccttgcggcaatgggacctgtaagaacatcattggttcgtacaactgtttgtgttttccaggcttcgtcgtcactcataatggggactgtgtggattttgacgagtgcacaaccctggtgggccaggtgtgtagatttggtcactgtctaaacaccgccgggtccttccactgtctgtgtcaggatggatttgagcttactgccgatggcaagaactgcgttgatactaatgagtgtctgagtcttgccggaacctgcctacccggaacatgtcagaatctggaaggttccttccgctgtatatgtccccctggattccaggttcaatcagatcactgtatcgatatcgacgaatgtagtgaagagccaaatctctgcctcttcgggacctgcactaactccccaggctcctttcagtgcctttgtccacccggttttgttttatccgataatggccaccgctgctttgatacaagacagtctttttgctttactcgatttgaggccgggaagtgcagcgttccaaaagcctttaatacgactaagacacgttgctgttgctcgaaacggcctggggagggatggggcgacccttgtgagttgtgtccccaagagggaagtgctgccttccaggaactttgcccgttcgggcacggggccgtccccgggcctgatgactctcgggaggatgttaacgagtgcgcagaaaatccaggcgtttgcactaacggagtgtgtgtaaacacagacggaagtttcaggtgcgagtgcccctttgggtattccctcgattttacagggatcaactgcgtcgacaccgacgagtgctccgtgggccacccctgcgggcaaggcacatgcactaatgtgatcgggggattcgagtgcgcctgcgcagacgggtttgaacccggcctgatgatgacctgcgaggacattgatgaatgctcgcttaaccctctgctgtgcgcctttcgctgccacaataccgaggggtcttatttgtgcacttgtcccgctgggtacaccttacgggaggacggagccatgtgccgggacgtggacgaatgcgctgatggccagcaagactgccatgcccgaggcatggaatgtaaaaacctgataggcacttttgcttgcgtctgtccgcccggaatgcgtcctctgccagggagtggcgagggatgcacagacgacaacgagtgccacgcacaacctgatctttgcgttaacggccgctgcgttaatactgccggaagtttccggtgtgattgcgatgaagggttccagccctccccgaccctcacggaatgtcatgacatccgccagggcccctgtttcgccgaggtgctacagacaatgtgccgttcactatcttcctcatctgaggccgtcaccagagccgaatgttgctgcggaggcggaagagggtggggtcccaggtgtgaactatgccccctccccggtacttccgcctaccgaaagttgtgtcctcacggctctggatacaccgccgagggaagggatgtggatgaatgtagaatgctggctcatctctgcgctcacggcgagtgtattaactcactcggatcattccgatgtcactgccaggccggatataccccagatgcgacggcaaccacatgcctggatatggatgagtgctcacaggtgcccaagccctgcacatttctgtgtaagaacaccaaaggctccttcttgtgctcatgtccccggggctacctgctcgaggaagatggacggacctgcaaagaccttgacgagtgtacttctaggcaacataattgccaatttttatgcgtcaacaccgtcggcgctttcacatgcagatgtccaccaggattcacccagcaccaccaggcatgttttgataacgacgagtgttcagctcagcccggtccctgtggagcccatggccactgccacaataccccaggatcattccggtgcgaatgtcaccagggtttcacacttgtcagctccggacatggttgtgaagacgtgaatgaatgtgacggaccccaccgttgtcaacacggatgccagaaccagctgggagggtatagatgctcgtgcccccaggggttcacacagcactctcagtgggcccagtgcgtggatgagaatgaatgcgccctgtcccctccgacctgcggttccgcatcctgccggaacacactcgggggattcagatgcgtctgtccctcgggattcgattttgaccaggcactcggtggttgccaggaagtggacgaatgcgcaggacgaagggggccttgtagctattcgtgcgccaacacacccggaggcttcctgtgcggctgtccgcaaggatattttagagccggccaagggcattgcgtgtcagggcttgggttcagccccggcccacaagatacccccgacaaagaggagctgcttagtagcgaagcttgctatgaatgtaagattaatggtctttccccgcgcgataggcccagacgcagcgcacacagggaccatcaggtaaacctggctacactcgattccgaggccctgttaacgcttgggctcaacctgtcccacctgggcagagccgagagaatcctcgagctacgtccagccctcgaaggcctggaagggcgcattcggtacgtcatcgtccgggggaatgaacaggggtttttcagaatgcaccacctgcggggggtgtccagtctgcagcttgggagaagacggcctggtcctggtacctatcgtctcgaggtggtaagccatatggcaggcccttggggagtgcagccggaaggccagccgggtccctggggccaggccctgagacttaaggtgcagctgcagctactttag

SEQ ID NO: 8628 - DNA, 303 bp, Artificial Sequence
  Description of Artificial Sequence: Synthetic coding sequence
atggagacccggcaggtgagccggagcccccgggtgcggctgctgctgttacttctgctcctcctggtcgtgccttggggcgttcgcacagcctcaggcgtggccttacccccggtaggggtgctgagcttgagacctcctggaagggcctgggctgatccagctacaccaagaccacggcggagcctggcactagctgacgacgccgcattcagagagagagcacgcttacttgcggctctggaaaggcggcactggttaaactcttatatgcacaagttactggtgctagacgccccttag

SEQ ID NO: 8629 - DNA, 1404 bp, Artificial Sequence
  Description of Artificial Sequence: Synthetic coding sequence
atgtggcggtgccccctgggcctgctgctgctgctgcccctggccggacatcttgcgttaggggcccagcaggggagagggcggcgggaactggcgcccggcctccacctgcgcgggattcgagacgccggagggcgctattgccaggaacaggatctgtgctgtcgtggtagagccgatgactgcgccctaccttatctgggtgctatttgttactgtgatctgttctgtaatcgcacagtgagcgattgttgccccgatttttgggacttctgtctgggcgttcctccccctttcccccctattcagggttgtatgcatggaggccgaatctatcccgtactgggaacctattgggataactgcaaccgctgtacatgccaggaaaaccgacagtggcagtgcgatcaagagccatgtcttgttgatccagatatgattaaggccatcaatcagggaaattatggctggcaggccgggaaccactccgccttctggggcatgacactggacgaaggcatccgataccgattaggaactatacggccttccagcagtgtgatgaacatgcacgagatttatactgtcttaaacccaggggaggttttgcccacagccttcgaagcttctgaaaagtggccaaatctcattcatgaaccgttggaccaaggcaattgtgccggctcctgggcattctccaccgccgcagtggcgtctgacagggtttccattcactctttgggccacatgactccagtactgtctcctcagaatcttttaagttgtgatactcaccagcaacaggggtgccggggcggtcgcctggatggggcatggtggttcctcagacgacgcggtgtagtaagcgaccactgctacccattttctggtcgggagcgcgacgaagcggggcccgctcccccttgtatgatgcattctcgggctatgggaaggggaaaacgtcaagccaccgcgcactgccccaattcatacgtgaataacaatgatatttatcaagtgacacccgtgtatagactaggctctaacgacaaggagattatgaaggagctaatggagaatggcccggtgcaagctcttatggaagtccacgaggatttttttctatataagggagggatttacagccacacccctgtgagcctagggcgcccagagagatatagacggcatggtacacattccgtcaaaattactggatggggcgaggagacattgcctgacggaaggactcttaagtactggacagcagccaattcttggggaccagcatggggggagagagggcacttcaggattgtcagaggggtcaacgagtgcgatatagagtcctttgtactcggagtatggggccgggtgggaatggaggacatgggtcatcactag

SEQ ID NO: 8630 - DNA, 2205 bp, Artificial Sequence
  Description of Artificial Sequence: Synthetic coding sequence
atgttctacgtgtgcagcagctgcgtgttcctgtgcggcagcaactttccaaacttcccttttcaggtggccagcgctaaatccgcccccgaaatccctactatcgatcaggcctattcaaagctgagcaactccatcactgtggaatgggccactgtgcctggcgccacatcttatcttttgacagcagaggacggagacacagtaattgaaacaactgtggcaaactcccccgggacggtgaccggtttgaaagccgcgacgtggtatgagattaccatccgatctatcagcgcagccggtagatctcaagcgtctcctcccaagcaagcaaagacagtgctggctgcgcccatcctggaagtttcttcaccttcttctgactccatcctggtgcaatgggaagccgtctacatggccattgcattctcggtgtctatcatgagggcgaatgggctgggatccatctggaaagaaaacaccactaacacttccctgacctttacatcactcgaggctggcacgctttacaccattaaagcctacgcatggaacgccaatagaattccgggagacgacagcacctgtaatcaaaggacatctccaagagcacctgctaatattcaggtctcctttgactctggggcccttaaagcctctttctcttgggccagggccgagggggcattcaactatacggtcatggctttaagtgattcttcggaactgacttgttctaccaccttttcgagctgcaccataagcagtctacagtgtggcaccgagtaccttatttccgtccttgcctcaaatgatgccggaagcagcaaatcatcctctgcaatgacacttaagaccgtcgcatgtgcgcccggccgcgtgacaatacaggaagatccacccggacatctgagcgtagcctggagctctgtcgatcttggggactactatgtagtgttcgtaaagtcagacgatggtctagaagtccactgtaataccagtttaacacaatgcaactttctgtcagagtgtggcttcacttatttcatctcagtttttgtgtataataaggcaggccagtctcccctgggggatatcttcaactatacaaccgccccctgctgcccgagcgacattaacccggttctggtgtcctccgaccgcgttgaaattgtctggtcacctgtgaggggagccgagctctacgaaacaaaagcggtggatgggtacaatatggttgagtgtaatgacaccacccccgcgtgcacgctcagcgctctcgaatgcgacacaaaatataacatcacagtgtactccttcaatgaggtccgcggatctaatatgtcatgcactcctcaatttatcactactgcaccctgctctcccgagataaagaatgtgtctagggatgctttctcaatgattaacgtacattggaggtctaccaacgatgacgctacatatacagttacagctcaaggtgagaaaggtctttatcaatgtagctccacaggggagagctgcaccatgagagggttgccctgtggttcagtttttagcgttactgcagtggccgaaactcaggccgggcgttctcttccatcttactcagtacccctcgagaccgtcccatgctgtccaacaggattgaccgtgactcagattacccagtcagtcatcaacgttagctggaccataggaagggtggcgcagacccatgtcgctgttctagagtcccacaccggacagtccaagtgtcatacccatcagaatcattgtctcctggggtgcattacttgcggcatcaactatactgtaaccctcaaggcaatctcagccaccgggctgaccgccgattgtagctaccagtcatacttctcgggtgcatgctgcccgttgggcgttaagctttaccggctaggacccaatgggattcgcatctactggcaggccagtcgcgggtccgccaattatagcacagatctgtacggttcaaagggcatctttacatgtacgccatcagccgggctatcattttgcgatgttacagagataccatgcggcgacgtgtatactgtgatggtgtcccccgttgctaagacaggtctgaagctgacattctgcccaaaaaaaatttatagcgtaacatgctcgggatccaccttggggatggtcatctacaggggtaagcgaaacgaggagtag

SEQ ID NO: 8631 - DNA, 1098 bp, Artificial Sequence
  Description of Artificial Sequence: Synthetic coding sequence
atgctggacggcagccccctggcccggtggctggccgccgccttcgggctgacactcctgctcgcggctttacgcccctccgccgcctattttggcctcaccggctcagaaccattaacgattttgcccctcaccttagaacctgaggccgcagcccaggctcattataaggcctgtgataggttaaagctggagaggaagcaaaggcgcatgtgccgtcgggacccaggagtcgctgaaactttagtggaggctgtttctatgtctgcattagagtgccagttccagtttcggtttgagcgctggaattgcactttggagggccgctaccgagcatcactgctgaagaggggtttcaaggaaacagccttcctttatgcaataagcagcgctggtctgacccatgcgcttgccaaggcctgcagtgccggccgtatggaaaggtgcacgtgtgatgaagcccccgatctggagaatcgcgaagcgtggcaatggggaggttgcggtgataacttaaaatactcctccaagttcgtcaaggagtttctcgggcgccgtagttcaaaagatcttagggccagggtcgactttcataataaccttgttggtgtcaaggttattaaagctggggtcgaaacaacatgtaagtgccacggcgtctcggggtcttgtactgtgcgtacatgctggcggcagctggctcctttccacgaggtggggaaacatcttaagcacaaatatgaaacagctctaaaagttggttctaccactaatgaagcagcgggagaggccggggccatttcccctcctcgaggaagagcatctggtgcaggtggatccgaccccctccctcggacaccggaactcgtgcacctggatgactcaccctccttctgtttggctgggcgcttttctccaggtacagccgggcggcgatgtcatcgtgagaaaaattgcgagtccatatgctgtggcaggggtcataacacccagagtagggtggtaacacgcccctgccagtgccaggtccgttggtgttgctacgtggagtgcagacagtgtacgcaaagggaggaagtgtacacctgtaaggggtag

SEQ ID NO: 8632 - DNA, 795 bp, Artificial Sequence
  Description of Artificial Sequence: Synthetic coding sequence
atgcggctgcggcccctgcccctggtggtggtgcccggcctgctgcagcttctgttctgtgattctaaggaggtcgtgcacgccacagagggtctcgactgggaggataaggatgctccagggaccctggttggaaacgtcgtccattctcgaatcatatccccactccggctgtttgtgaaacagagccctgtgcctaagccgggtccaatggcctacgctgacagtatggagaacttttgggattggcttgctaacataacagagattcaggagcctctggcccgtaccaagcgtcgtcccatcgtgaagacgggaaagtttaaaaaaatgttcggttggggcgatttccactctaacataaagaccgtgaaactgaatcttttgattactggcaaaattgtcgatcatggaaatggaaccttcagtgtctatttcagacacaacagcaccggtctcggaaatgtgtctgtatccctggtgcccccttccaaggtggttgaatttgaggtctcaccccagtctacgcttgagacaaaagagagcaaaagcttcaattgcaggatagaatacgaaaaaactgaccgggcaaaaaaaacggcgctgtgcaatttcgacccatctaagatctgttatcaggagcagactcagagccatgttagctggttgtgcagcaagccattcaaagtcatctgcatttacattgcattctacagtgtggattataagttggtgcagaaggtgtgccccgactacaactaccacagtgagaccccttacttaagtagtggatag

SEQ ID NO: 8633 - DNA, 1125 bp, Artificial Sequence
  Description of Artificial Sequence: Synthetic coding sequence
atgaagcccctgctggagaccctgtacctgctgggcatgctggtgcctggcggcctgggttacgatagaagcctggcgcagcaccgccaggaaatcgtggataaaagcgtctctccctggtccctcgaaacatacagctataacatttaccatccaatgggggaaatttacgaatggatgagggagatttctgagaagtataaagaagtcgtgactcagcactttttgggggttacttacgagacccaccctatgtactacctgaagattagtcagccatctggaaatccaaagaaaatcatctggatggattgcggaatccatgctcgggaatggatagcacctgcattctgccagtggtttgtgaaggaaatcctgcaaaatcacaaggataatagctctattcggaaattgctgagaaatttggatttctacgtcctgcccgtgctcaacatcgacggatacatctacacttggaccacggatcggttgtggcgcaagtctagatcccctcacaacaacgggacatgcttcgggacagatctgaacaggaacttcaacgcaagctggtgctcaattggggcttcacgcaactgccaggaccagacattttgcggtaccgggcctgtgtccgaacccgagacaaaagccgtggccagctttattgaatctaaaaaggatgacatactgtgtttcctgactatgcactcttatggccagctgatcctgactccttatggatataccaagaacaaaagttctaatcacccagaaatgattcaggtgggccagaaggccgctaatgcacttaaggcaaagtatggaacaaactatcgggtgggatcttcggcagatatcctatatgcctcttctggctctagcagagattgggcgcgtgatatcggtatacccttcagttacacattcgagcttagggattctggtacttatgggttcgtgttacctgaggcacaaatccaacccacctgcgaggagacaatggaggctgtgctctccgtgttggacgatgtttatgctaaacattggcacagcgatagtgcaggtcgcgtcacatcagccacaatgctgttgggactgttggtgagctgtatgagtttgctgtag

SEQ ID NO: 8634 - DNA, 1728 bp, Artificial Sequence
  Description of Artificial Sequence: Synthetic coding sequence
atggccagctggctgcggcggaagctgcggggcaagcggcggcccgtcattgcattctgtctcctcatgatcctgagtgctatggctgtaactaggtttccacctcaaaggccttccgctggacctgatcccggacctatggaaccccagggtgtgacaggcgcccctgcgacacatatcagacaggctctttcctctagtcggagacagagggcaaggaacatgggcttttggcgctctagggccttaccccgcaactccatccttgtatgtgctgaagagcaagggcacagggcaagggttgatcggtcgagagaatccccaggaggtgatcttcgccaccctggcagggttaggcgcgacatcacactgagcgggcatccacgacttagcactcagcacgtggtgttgttgagagaagacgaggttggcgatcctggaacgaaggatctcggccatccccagcacgggtcacctattcaggagactcagtcggaggtggtcacactggtgagtccgttaccagggtcggacatggctgccctacctgcatggagagccaccagcggcctgacactctggccacataccgctgagggccgggacctgcttggtgccgaaaatcgagcactgacagggggacaacaagcagaagacccaacgctggccagcggcgcccatcagtggccagggagtgtcgagaagctgcaaggctcagtgtggtgcgatgcagagacgctgttgtcatccagtcgtactggcggccaagcgccaccctggttgacagatcacgacgttcaaatgctacgtttacttgctcagggagaagtagtggacaaagcacgtgtgcccgcgcatggccaggtccttcaggtcgggttttcaaccgaggcagccctgcaagacttgtcctctccaagacttagccagctatgttcccaagggctatgtgggttaatcaagcgtcctggcgacctgccggaggtgctgtctttccatgtcgacagggtgctgggtctgcggcggagtttgcccgcagtggctaggcgattccatagtccattgctgccttataggtacaccgatggaggggccaggcccgttatatggtgggcacctgacgtccagcatctatccgacccagacgaggatcagaacagccttgccctcggatggctccagtaccaagccctcctggcccatagctgcaactggcctgggcaagccccttgtcctggcattcaccataccgaatgggctagattagcactgttcgatttcctactgcaggtgcacgatcggcttgatcgatattgttgtggattcgagccagaacctagtgatccctgtgtcgaagagcgtttacgagaaaaatgtcagaatcctgccgaactgcgcctagtccatattctggtacggagctcggatccttcacacctggtgtatatcgataacgccggtaatctacagcatcccgaggataagcttaacttcagactgctggaaggcatcgacggattccctgagagcgctgtaaaggttctcgcatcgggctgcctgcagaatatgctgcttaaaagcttgcaaatggatccggttttctgggagtcccaagggggtgcccagggactgaagcaggtgctgcaaacgctcgagcaaaggggtcaggtgctgctcggtcatattcaaaagcacaatctcacactgttcagagatgaggacccatag

SEQ ID NO: 8635 - DNA, 1680 bp, Artificial Sequence
  Description of Artificial Sequence: Synthetic coding sequence
atgtggaccaacttcttcaagctgcggctgttctgctgcctgctggctgtgctgatggttgttgtgcttgtgataaacgtgacgcaggtagagtacctggaccacgagacagtttccgcgacattcatagattcatccggccagttcgtctctagtcaggtgactggaatcagcaggaacccatactgtgggtacgatcaacaaaccctatctagccaagagaggatggaagaggactctttattggccgcgctgcatcgacaggtaccagatgtagggccagtcccattcgtgaaatcaactgacccttcatcctcctacttcgtgattctcaattccgccgccttttttaaagttggaagccagcttgaagtgctcgtgcacgtccaggacttccagcgcaagcccaaaaaatacggaggcgactaccttcaggcccgaatccattcactgaaactccaggccggcgctgtgggtcgcgtggtcgactaccaaaatggattttataaggttttctttacccttctgtggcctggaaaggtcaaagtaagcgttagcctcgttcacccatctgaagggataagagtgctgcagcgtctgcaggaggataagccggatcgtgtctatttcaagagcctttttcggtccgggcgcattagtgagacaacagaatgcaacgtttgtctcccgggaaatcttcccttgtgtaatttcacagacctatatacaggagagccgtggttttgctttaaaccgaagaaattgccctgcagcagcaggatcacacactttaagggtggctacctgaagggtttgcttaccgccgccgaaagtgcgttctttcagtccggtgtgaatattaagatgccagtaaattcttccggtcctgattgggtaactgtgattccaagacgcattaaagagaccaactctctggaactgagtcaaggaagtggcactttcccttccggttattattataaggatcagtggaggcctcgcaagttcaagatgagacaattcaacgaccctgataacatcacggagtgtctccagcggaaggtggtacacctgttcggagattctacaattagacaatggtttgagtatctgaccacatttgtgcctgacctagttgagttcaacctcggctctcccaaaaatgtgggcccttttctcgccgtggatcaaaagcacaatatacttttgaagtatcgctgccacggacctcccatccgcttcactaccgtcttttcaaatgagttgcattacgtcgcgaacgagctgaatggaattgtgggggggaagaataccgtggtggcaattgccgtatggtctcatttcagcactttccccctggaggtttacatccgtcggttgcgaaatataaggagggctgtggtgcgccttctcgatagatccccaaagacagtcgttgtaatccgaaccgcaaatgcacaggaactgggaccggaagttagcttatttaacagcgactggtataactttcagctggacaccattctgcggaggatgtttagcggtgttggcgtctaccttgttgacgcctgggagatgacactcgctcattacctacctcacaagctccaccctgacgaggtaattgtgaaaaatcagcttgacatgtttctctcatttgtttgccctttagagacttag

SEQ ID NO: 8636 - DNA, 3624 bp, Artificial Sequence
  Description of Artificial Sequence: Synthetic coding sequence
atgcggctgacccacatctgctgctgctgcctgctgtaccagctgggattcctttctaacgggatcgtgagcgagctgcagtttgcaccggatagggaagagtgggaagtggtgtttcctgccctttggaggcgagagccagtcgaccctgctggtggaagcgggggctctgctgacccaggctgggtgcgcggggtgggagggggcggaagcgctagagcgcaggccgccggcagctcacgtgaagtgagatcagtggcccccgtgcccctagaagagcccgtggaaggcagatcagaatctcggttacgccctcccccccctagcgagggggaggaagatgaggaactagaatcccaggaattgccacggggatcctccggggccgcggccctatcccctggggcaccagcttcatggcaacccccaccacccccacagcctccgccctccccaccacccgcacagcatgccgaacccgacggggacgaagtcctgctgagaatcccggccttcagccgagacctttacctactgctcagaagagacggaaggttcctggcgccccgtttcgccgtcgaacagcggccaaatccagggccaggtcctaccggtgccgctagtgcaccacagcctcccgctcccccagacgccgggtgtttctataccggcgctgtccttcggcacccgggatctctagcgtccttcagtacatgcggtggtggtctcatgggtttcatccagctgaatgaagattttattttcatcgaacccttgaatgacaccatggcaatcacggggcatcctcatcgggtttacagacagaagagaagtatggaagaaaaggtcacagaaaaaagcgcgctgcattcccactattgtgggatcatatctgataagggccgcccacggtctcgcaagatcgctgaatccggacgcgggaaaaggtatagctacaaattgccgcaagagtataacatcgagacagtagtggttgcagaccccgctatggtatcctaccacggagctgacgctgcaaggcgttttattttaactatcctaaacatggtcttcaatctatttcagcacaagtccctcagtgtccaggtcaatctccgagtgatcaagttaattctgctgcacgagaccccacccgaactctatattggtcatcatggcgagaaaatgctggagagcttctgtaaatggcagcacgaggaattcggcaagaagaacgacattcatttggaaatgtctacgaattggggggaggatatgacctccgtggatgcggctatcctgattactcggaaagatttctgcgtgcataaagatgagccatgcgacaccgtcggaatcgcatatctaagtggaatgtgtagtgaaaagcgcaaatgcatcatcgccgaagacaacggattaaatctcgcctttaccattgcccatgaaatggggcacaacatgggaatcaaccatgacaatgaccatccttcctgcgctgatgggttgcacatcatgtctggtgaatggatcaaaggacagaatttaggggacgtgagctggtcccggtgctccaaagaagaccttgagcgttttcttcggtccaaagcttccaattgcctgctgcagaccaatcctcagtcagtaaattctgttatggtgccgtccaagctccccggcatgacttataccgccgacgagcaatgtcagattctctttggcccgctcgcgtctttctgccaggaaatgcagcatgttatttgcacggggctgtggtgtaaggtggaaggcgagaaggagtgccgtacaaaactcgatccccctatggatgggaccgattgtgacctcggaaagtggtgtaaggctggtgaatgtacaagccgaacatcagccccagaacatttggctggtgagtggagcctctggagcccatgcagcagaacctgttcggctggtatttcttcaagagaaagaaagtgcccaggcctagactcagaggcccgggactgcaatggcccccggaagcagtataggatctgtgaaaaccctccgtgccccgcaggcctccctggatttcgggattggcaatgccaagcctactcagtacgcactagcagtccaaaacacatcctgcagtggcaggccgtgttggacgaggaaaaaccctgtgctctattttgctcacccgtaggtaaagagcagccaattctgctcagcgagaaagtcatggatggcacctcttgtggttaccagggactggatatttgcgccaacggtagatgtcagaaagtcggttgcgacggcctgctgggtagcctcgcgagagaggaccactgtggggtttgtaacggaaatggaaaaagttgcaagattataaagggtgacttcaatcatacaagaggagccggttatgtggaggttttggtgatccctgcaggggcccggaggatcaaagtggtcgaggagaagcctgcccattcctacctagccctgagagatgcaggaaaacagagcattaactccgactggaaaatagaacacagtggtgcatttaacctggccgggaccacagttcattatgtgcgaagagggctatgggagaaaatctccgccaagggtcctaccacagccccccttcatctcctcgtgctgcttttccaggaccagaattatggtctccactatgagtacactattccttctgaccccctgccagaaaaccaatctagcaaggcaccggaacccctgtttatgtggacccacacgtcctgggaggattgtgatgcaacgtgtggaggcggggagcgaaagaccacagtgtcctgcacaaaaattatgagtaagaatataagcattgtggataatgaaaaatgtaagtacctgacaaaacccgagccccagatccgcaagtgcaacgaacagccctgccagacgcgttggatgatgacagaatggactccttgtagcaggacatgtggtaaaggtatgcagagtagacaggttgcctgtacgcagcaactgtccaacggcaccttaattagagcccgggagcgcgactgtatcggacctaaacctgccagcgctcagaggtgcgaaggccaagactgtatgactgtatgggaggccggcgtctggtcagaatgttccgtaaaatgcgggaagggcattcggcacaggacggtgaggtgcactaatcctcgcaagaagtgcgttctgtccacgcgcccacgagaagccgaggactgcgaggactacagtaagtgctacgtttggcgcatgggtgactggtccaaatgctccatcacttgtggcaaggggatgcagtccagagttattcagtgtatgcacaagataacaggtcgacatggaaatgagtgcttctcaagcgaaaagccggccgcctaccggccctgtcacctccagccctgtaatgagaagattaacgttaatactatcacaagcccacgactggccgctctgacttttaaatgcttgggagatcaatggcccgtatactgtagggttattagggaaaagaatctttgtcaggacatgaggtggtaccagaggtgctgtgaaacttgcagggacttttacgcacagaagctccagcagaaatcctag

SEQ ID NO: 8637 - DNA, 258 bp, Artificial Sequence
  Description of Artificial Sequence: Synthetic coding sequence
atgaagatcaccggcggcctgctgctgctgtgcaccgtggtgtacttctgctccagcagcgaagccgcctccttgtcgcctaagaaggtagattgtagtatctacaagaagtatcccgtcgtggctatcccgtgtccaatcacctacctgcctgtctgtggctcagactacataacctatggtaatgagtgccacctgtgcaccgagagtctgaaatctaacgggagggttcagttcctccacgatggttcctgttag

SEQ ID NO: 8638 - DNA, 2982 bp, Artificial Sequence
  Description of Artificial Sequence: Synthetic coding sequence
atgggcagcggccgggtgcccggcctgtgcctgctggtgctgctggtgcatgcccgggcagctcagtattcaaaggccgcacaggatgtagacgagtgtgtcgaaggaacagacaactgccacattgatgctatctgccagaacactccacgcagctacaaatgcatttgtaagagtggttacacgggagacggtaagcactgtaaggatgtggatgaatgtgaaagagaggacaacgcgggatgcgtccacgattgtgtcaatatacccggtaattacagatgcacttgctacgatggatttcacctagctcacgacggacataattgtctggatgtggacgaatgtgcagagggcaatggcggttgccaacagtcgtgtgtaaatatgatgggcagctacgagtgtcattgtcgcgaaggtttttttttgtcggacaaccagcacacctgcatccagcgccctgaagaaggtatgaactgtatgaataagaatcacggttgtgcacacatctgccgggaaactccaaagggcggcatcgcttgcgaatgccgacccggtttcgagttgactaaaaatcaaagggattgtaaattgacttgcaactacggtaacggcggatgtcagcatacctgtgatgacaccgagcagggcccaaggtgcggctgccacataaagtttgtcttgcataccgacgggaagacatgtattgaaacctgcgccgtgaacaacggcggctgtgacagcaaatgccatgatgccgccactggggttcattgcacctgtcccgtggggttcatgcttcaaccagacaggaaaacctgtaaggacattgacgaatgccgcctaaataatggggggtgcgaccacatctgtagaaacacagttgggtccttcgagtgcagttgcaaaaagggctataaactgctgatcaacgaaagaaattgtcaggacatcgatgagtgctcattcgatagaacttgtgaccatatctgtgtcaatacacccggctccttccagtgcctctgtcacagaggctacctgctttatggaattacgcactgtggagatgttgatgaatgcagcatcaatcgtggcggatgtcggtttggctgtattaatacccccggcagctaccagtgcacgtgccctgccgggcagggaagattacactggaatggtaaggattgcacggagcccctgaagtgtcagggcagcccaggcgcttccaaagccatgcttagctgtaaccggagcggtaagaaggacacctgcgcgttaacgtgtcctagccgggctagattcctgccggagagcgagaacgggttcacagtgagttgcggtactccttctccccgcgccgcaccagcgagggctgggcacaacggaaactcgacaaacagcaatcactgccacgaggcagccgtcttgtcaattaaacagagagcttctttcaaaattaaggatgctaagtgtcgcctgcacctgagaaacaaggggaagaccgaggaggcggggcgaattactggccctggaggcgccccttgcagcgagtgccaggtgacatttatccacttgaaatgtgattccagccggaagggaaaagggcggcgcgctaggaccccacccgggaaagaggtaactcgtctgacgcttgaactggaagccgaagtgagagctgaagagacgaccgctagttgtggcctgccatgtctgcggcagagaatggagcggagactcaagggctccctaaagatgctgagaaaaagtatcaatcaggatcgctttcttttgagactcgccggattagattatgagctggcgcacaaacccggcctggtcgcgggagagcgggcggagcccatggagagctgccggcctgggcagcatagggccggtacaaagtgcgtgagttgtccccagggcacatactaccacgggcaaaccgagcagtgcgtgccttgtcccgctggtactttccaggagagggagggtcagctatcgtgcgatctgtgccctggctctgacgcccacggccccctcggggcgaccaacgtgacaacctgtgcggggcagtgcccgccaggacaacattcagtggacgggttcaagccctgtcaaccatgcccccgggggacataccagcccgaggctgggcgcaccctttgctttccctgcggcggaggattaactaccaaacacgagggagcgatttcatttcaagactgcgatacaaaagtgcagtgttcacccggccactattataacacaagcattcacaggtgtattcgctgcgcaatgggatcttaccaacccgactttagacagaatttttgttctcgatgtccaggcaacacgagcactgactttgacggcagcacaagcgtggctcaatgcaagaataggcagtgcggcggcgagctgggggagtttacaggctacatagagagtcctaattatccaggaaactacccagccggcgttgaatgcatatggaacatcaaccctccgccaaagcgaaagatccttattgttgtaccagagatattcctgccttccgaagacgagtgtggggacgtgctcgttatgcgaaaaaactcaagcccgtcgagcataaccacctacgaaacttgccagacatatgagcgaccaatagctttcactgctcgctctcggaagttgtggatcaactttaaaacctccgaagccaatagtgcgcgcggattccagatcccatatgttacatatgacgaggactacgagcagctagtggaggacatcgttagagatggtagactttatgctagcgagaatcaccaggagatactgaaggacaaaaagttgattaaagctttttttgaggtcttggcccacccccagaactactttaagtatactgaaaaacataaggagatgctgcctaaaagttttattaagttgctcagatctaaggtctcatcgtttctgaggccttataagtag

SEQ ID NO: 8639 - DNA, 4773 bp, Artificial Sequence
  Description of Artificial Sequence: Synthetic coding sequence
atgcccggcggcgcctgcgtgctggtgatcgccctgatgttcctggcctggggagaggcccaggaatgttccccggggggacaccaattcctgaggtccccctaccggtctgttaggtttgatagctggcatctgcagcagtctgctgtccaagacctgatttgtgaccactccctgagccctggctggtaccgatttctgattttggataggccagccgagatgccaacaaagtgtgtggagatgaaccattgtgggactcaggctccgatatggctatccctcagggactctgaaacgctcccatccccgggtgagattaaacagctcacagcctgtgctacatggcaattccttttcagcacaacgaaggattgctgcctcttccagatacctgtcagcgtaaggaactgtggaaatttctctgtttatcttcttcaaccaactcaggggtgcatgggctattgtgcagaagcaatcagcgacgcccgtctgcacccatgcggctcagacgagacggaaactggaggggactgtgtacggcagctcgctgcctcacttccacccccgccagctggccgacctgaggttctcgtcgaactcatcgaatcccgactgttctgcagatgtagcttcgacgtcccagccacgaaaaacagtgttggatttcacatagcatggtcccgtctgtcatcccaggaggttaaggaggagcttacacaggagactacggtccaggctttctctctgttggagttggatggaatcaatcttcgccttggggaccgaattttctgttctgcgtcggtcttcttcctggagaatccacacgtgcaaagcgtcgcgatcgaatctcaggagttcttcgccgggtttaaattgcaacccgagctcagtaccattagtgaagacgggaaggaatactatttgcggatagagtccactgtgcctattatttgtagcgagttcagcgagttggaccaagaatgcaaaatatccctgaagctcaaaaccatcggtcaggggagggagcatctcggactcaaccttgccttatcatcatgccacgtcgacctcctacagacctcaagctgcgcaaatggcacctgttcacacacgttcgtgtactacacagccgtcaccgatttcagcagagacggagatagagtcagcaacatcgtcgtccagcctattgtgaacgaggactttctgtggaataactacattccagatagtatccagatcaaagttaaggacgtgccaaccgcctactgctacacttttaccgacccacatataatcacatttgacggtcgtgtgtacgataattttaaaaccggcacattcgtcctctacaaatccatgtctcgggacttcgaggtgcacgtgaggcagtgggactgtcggtctctgcattaccccgtgtcatgcaactgcggattcgtggcccaagagggtggggatatcgtcaccttcgacatgtgtaacggtcagctgagggagtcacaaccttatcttttcatcaaaagccaggatgtgacccgaaacatcaagatctccgagtcataccttggaagaaaagtaacgatctggttttcttctggagcgttcataagggcagacttgggggagtggggaatgagcttaacgattagagcgccaagcgtggactatagaaatacactcggcctctgtgggactttcgatgagaatcccgaaaacgattttcacgacaaaaatggcatgcagatagaccagaatttcaataactatgttgccttcatcaacgagtggagaatcctcccaggaaagtcgatgagcgacaccctcccggtcagtatgacatcccctgggaaacctagctattgtagctgtagcctcgacaccgcagcttatccgtcttctgaggacttggactcagtctctcggtcagaaatcgccttggggtgcaaagacttaaatcatgtgtctttgagttcactgatccctgagttggatgttacctctgagtatattaactcagacacccttgtgagggagatcaacaaacacacatcacccgaggaatacaatctcaacctgttcctccaggagaaaaaacacatcaatcttaccaagcttggcctcaatgttcagaagcatccagggaatgagaaggaggattccctacagtatttggccaacaagaagtacacccagggtcgggggagtcactctcaggagatgcgctataaccgtcagaatcgctggaaaaggcagaacttccatgagtttcccccccttttcgcttttccgtcattgtcccagaccgacctggaagaactaacctacttcttcccagaagatcatgctgaggacgttcagcaagagtttttcccctcttggcctacacctagcggcttaaccgagtactcaaccctgactctgtgccaagagacactcgctaactcatcaatcggaaggctttgtctggcgtttctggggaagcgcttagacagcgttatagagatgtgtgtaaaagatgtcctgctgaaggacgacttatcttgggcagaagctggtgtagccctgctggagaacgaatgtgaaaaacgcattgtggaggagggcaaatacaacacagaggaatatggcacatcaatcgaggacatcttatctgtgctgaagtgccccaacctctgttccggcaacggacagtgcatggagtggggctgtgcctgctcgccgagctttagttcatacgactgtagcgatagttacgacaaagctcctgaaattactgaattaggaaatgccggattttgtgatgttcaaaagtataactgtatgatggttcgggtcttcgggaaaggcttcaaggaacttcccagcatcaaatgcgaggtaaccaaactgcaatataacagcagtgagtggatgcctggcgagccgatttatactcaaactgtctttcacaattcccgcgccgttgactgtcagctgcctactgatgtccagcagttcgacaccatggacctggttggtggcaagcccaccgggaaatggcagctgaaggtgagtaacgacgggtataaattttcgaaccctaagatcactgtgatttacgacggagcttgtcaagtttgcggcctatataaaaacgatagctgcacgatcaaagagaacgtgtgcattattgatggcttgtgttacgttgagggggacaagaatccaacctctccatgtcttatctgcagacccaaaattagcaggttcacttggagcttcttagaaaacaaccaaccaccagtgattcaggcgctgcaggataagctccagacattctacggagagaactttgagtaccagtttgttgcgtttgatcccgaaggttcggacatccactttactctggattctggcccagagggagcttcagtgtcttcagccggcctgttcatgtggaaaactgatctattgacaacccagcagataacagtgcggctcaacgacgattgcgacgctgagacgagagtgactatagaggtgaccgtgaagtcctgtgattgcttgaatgggggatcttgtgtatctgaccgcaatttctctcctgggtcgggcgtctacctgtgtgtctgcttaccaggattccacggcagcctctgcgaagtagacatttctggctgccaaagtaatccttgcggactgggctcatatattagtggtttccacagctactcttgtgattgcccacccgagctgaaggttgaaacacagttcgttaatcagttcaccacacagacagtcgtcctaacccgaagcgacaagtccgttaataaggaggaggatgacaaaaatgcccaagggcgaaaacgacacgtcaagccgacatcaggaaatgcattcactatctgcaagtatccatgcggcaaatctcgagaatgcgtggctccgaacatctgcaagtgcaagcccggttacatcgggtccaactgtcaaaccgccctctgtgaccctgattgcaagaatcatggaaagtgcatcaagccaaacatctgtcaatgcctgcccgggcacggcggggctacttgcgacgaagaacactgcaatcccccgtgccagcacggtgggacttgtctggcagggaacctgtgcacttgcccctacggattcgtgggaccccgatgcgagaccatggtgtgtaacaggcactgcgagaatggcgggcagtgtttgacaccagacatttgtcaatgtaagcctggctggtatgggcccacctgttcgaccgccctgtgtgaccctgtgtgtctgaacggcggttcctgcaacaagcccaatacctgcctgtgtccaaatggctttttcggtgagcattgccaaaatgcgttttgccaccccccctgcaagaatggcggtcattgcatgagaaataacgtgtgtgtctgccgggagggctacaccggcaggcgattccaaaagagcatttgcgaccccacatgtatgaacggcggtaagtgcgttggcccgagcacctgttcctgtccctcaggctggagcggtaagcggtgcaatacgcctatctgcctccagaagtgtaaaaacgggggggaatgtatcgcaccttctatctgtcactgtccgagctcttgggagggcgttagatgtcagattccaatttgcaatcccaagtgtctctacggcgggcgctgtatctttccaaacgtttgctcctgccggacagaatattccggggtaaaatgcgaaaaaaaaatccaaatccggagacactag

SEQ ID NO: 8640 - DNA, 624 bp, Artificial Sequence
  Description of Artificial Sequence: Synthetic coding sequence
atgagcaccaagcccgacatgatccagaagtgcctgtggctggagattttaatgggcattttcatcgcaggcactctgtccctagattgcaatttattaaacgtgcatctcagacgcgtgacatggcaaaacctccggcacctctcctctatgagtaactcttttcctgtggaatgtctaagggagaatatcgcctttgagcttccacaggaatttttgcagtatactcagccaatgaagcgggacatcaagaaagcattttatgaaatgagccttcaggccttcaatattttctctcaacatacattcaaatactggaaagaacgccatctcaaacagatccaaataggcctagatcagcaagcagagtacctgaatcagtgtctggaagaggacaagaacgagaacgaagatatgaaagaaatgaaagaaaacgaaatgaaacctagcgaagcccgggttcctcagctcagcagcctggaacttaggcggtacttccaccgaattgataatttcttgaaagagaagaagtattctgactgcgcctgggagatcgtgcgagtggaaatccgacgttgcctgtattacttttataagtttacagcgctgtttagaagaaagtag

SEQ ID NO: 8641 - DNA, 939 bp, Artificial Sequence
  Description of Artificial Sequence: Synthetic coding sequence
atggagagcgccctgcccgccgccggcttcctgtactgggtgggcgccggtacagtggcctatctagctctgagaattagctatagcctgttcaccgccctaagggtatggggagttgggaacgaggcaggcgtggggcctggactgggagaatgggccgtggttacagggtcaacggatgggatcggtaagtcctacgccgaagagcttgccaagcacggtatgaaggtagtgctaatttcccgtagcaaagataaactcgaccaggtgtcctctgaaattaaggagaaatttaaagttgagacacgaactatcgctgtggacttcgccagtgaggatatttatgataagatcaaaaccgggcttgctggattagagatcgggatcctggtaaacaatgtggggatgtcctatgagtatcctgagtacttcctcgatgttccggacttagataatgtaattaagaaaatgatcaatattaatatattgagtgtctgtaaaatgactcagctggttctacccggcatggtggagaggagcaagggcgccatattgaacatctcatctggctcagggatgctgccagtgcctctgcttacaatttactctgctactaagactttcgtggacttcttttcccagtgcctccacgaagaatatcgctccaagggcgtgttcgtccagagtgtgttaccatactttgtggctaccaagctggccaagattagaaagcccacccttgacaaaccttcccccgaaactttcgtcaaaagtgccattaagactgtaggtctgcagtcccgaactaacggttatttgattcatgccctgatggggagcatcatctctaacctgccaagttggatttacctcaaaatcgttatgaacatgaacaagagcaccagggcccactatctgaagaagactaagaaaaactag

SEQ ID NO: 8642 - DNA, 2214 bp, Artificial Sequence
  Description of Artificial Sequence: Synthetic coding sequence
atggagctgggctgctggacccagctgggcctgaccttcctgcagcttctgttaatcagctctctgcctcgcgaatataccgtgatcaatgaggcttgcccaggtgcagaatggaacattatgtgtcgggagtgctgcgaatatgaccagattgaatgcgtgtgccccggtaaaagagaggtcgtgggttacaccatcccctgttgccggaacgaagagaacgagtgtgatagctgccttattcatcccggatgcactatcttcgaaaattgcaaatcttgccggaacgggtcctggggcgggactctggatgatttctacgtaaaaggtttttactgtgctgagtgcagggcaggctggtatggtggggattgcatgcgctgtggccaggtcctccgtgctccaaaaggacagattctgctggaatcctatcccctcaacgctcactgtgagtggacaatacacgcaaaaccagggtttgtgatccagttacggttcgtgatgctgagcttagaattcgactatatgtgtcagtatgattatgtcgaagtcagggatggggacaacagagatggacaaattatcaagagggtctgcgggaacgaaagaccagctcccattcagtcaatcggaagctcccttcatgtgctcttccacagcgatgggagcaagaactttgacggatttcatgctatttatgaagaaatcacagcgtgtagctcttccccgtgtttccatgacggcacctgcgtgcttgacaaggcgggctcatataagtgtgcatgcctggctgggtatactgggcaacgctgcgagaatctgctcgaggcgggtaagagtaagatcaaggcctcggaggactctttatccgtgcttgaggaacgcaattgttctgaccctggtggacctgttaatgggtatcagaagatcacggggggacctggtctaataaatggacgacatgcgaagattggaacagtcgtctcatttttctgcaacaatagctacgtcctgagcggtaatgagaagaggacctgtcaacagaatggtgaatggtctggaaaacagccaatctgcattaaggcatgtagggaacctaagatcagtgatctggtaagacgtcgcgtgctgcctatgcaggtgcagtcacgggaaacccccctacaccaattgtactcagccgcattctctaagcaaaaattacagtcagctcccactaagaagcctgctctgccatttggagacctgcccatgggctaccagcatctgcatacacagctacaatatgagtgtatcagtcccttctatcgccgcctgggctctagcaggaggacttgcctcagaacggggaaatggtcaggcagggcgccttcctgcatccccatctgcgggaaaattgaaaatataactgcaccaaaaacacaggggctgcgctggccctggcaggcagccatttataggagaacatctggagtccacgatggaagccttcataaaggagcctggtttctggtttgcagcggcgccctggtcaatgagaggacagtcgtggtcgcggcccactgcgtcacagatctcggtaaagtgactatgattaagactgcagacctgaaggtggtgctaggaaagttttacagggacgatgaccgggacgaaaagaccatacagagcctgcagatttcagccattatcctgcaccctaattacgaccccattctcctagacgctgacatcgcgatccttaagctccttgataaggcgaggattagtacgcgtgtgcagcctatttgcttagccgcgtctagagacttaagcacctccttccaggagagccatatcacagtggccggctggaacgttctcgcagatgtcaggtcccccggctttaagaatgacaccttgcgatccggcgtcgtttcagttgtggactcattgctgtgtgaagagcaacacgaagatcatggcatccctgtctctgtaaccgacaacatgttttgcgccagctgggagccaaccgctcctagcgatatttgtacagctgaaacgggcggcattgctgcagttagcttccctgggagagcctcacctgaaccgcgctggcatttaatgggcctggtgagttggtcttacgacaagacttgctcccatcggttgtccaccgcctttaccaaggttctgcccttcaaagactggatagagcggaatatgaagtag

SEQ ID NO: 8643 - DNA, 1503 bp, Artificial Sequence
  Description of Artificial Sequence: Synthetic coding sequence
atgggcaccgcccggtggctggccctgggcagcctgttcgccctggcggggctcttagaaggacggctcgtcggcgaagaggaggccggcttcggtgaatgcgacaagtttttttacgctggaactccacctgctggtctggccgctgattcgcacgttaaaatctgtcaaagagctgaaggcgcagagagattcgctacactgtactctacccgggatcggatccctgtgtattccgcttttcgggctccccggcctgctcccggtggggcagagcaaagatggctcgtggagccccagattgatgatccaaactcgaatctggaagaagcaatcaacgaagcagaggctataacatccgtcaacagtctaggtagtaagcaggcactgaacaccgactatttggatagcgactaccagcgtgggcaactataccccttctctttgtcatctgacgtccaggtcgctacttttactctaacaaacagcgccccgatgactcaatccttccaggaacggtggtacgtaaacctgcatagtctgatggatcgggcactgactccacagtgtggatcaggcgaggacttgtacattctgaccggaacagtgcccagcgattaccgggtgaaggacaaggtggcggtgccagagttcgtttggctcgctgcttgctgcgccgtccctggaggcgggtgggcaatggggtttgtgaagcacacgcgggattccgatattattgaggacgttatggtgaaagatctacagaagctactgcccttcaacccacaactatttcagaataattgcggggagacagagcaggatacggaaaaaatgaaaaagatacttgaggtggtcaaccaaatccaggatgaagaaagaatggtgcaatcacagaaatcaagcagcccactgagctcaacccgcagcaaacggtcgacactcttgccgccagaggccagcgaaggcagttccagtttccttggaaaattaatgggctttatagccaccccattcattaaactgttccagctcatctactatctggtcgtggcgatactcaaaaatatagtgtacttcttgtggtgcgtgactaagcaggtcattaatggaatcgagtcttgcctgtacaggttagggagcgcaaccatctcgtacttcatggcaataggcgaggagctggtcagcattccatggaaggtcctgaaggtggttgctaaggtgatacgggcccttctgaggattctctgctgtctcttgaaagctatctgtagagtcctatcaatccctgtgcgggtgctggtggacgtagccacgtttcccgtctacaccatgggcgcgatccctattgtatgcaaggatatcgcccttggccttggcggcacagtcagcctcttatttgatacggctttcgggaccctcggaggcttgttccaggtggtgtttagcgtatgcaaacgaatcgggtacaaagtaacattcgacaatagcggcgaactttag

SEQ ID NO: 8644 - DNA, 300 bp, Artificial Sequence
  Description of Artificial Sequence: Synthetic coding sequence
atgaagagcgccaagctgggcttcctgctgcggttcttcatcttctgttcactaaatacactgttactgggtggcgtgaacaaaatcgccgagaaaatttgtggtgacctcaaggatccgtgcaagctggatatgaatttcggctcctgctatgaggttcacttcaggtacttctataatcgcacatcaaaaagatgcgagacgtttgtgttctcagggtgcaacggcaatctgaataatttcaaactgaaaattgaacgggaggtggcctgtgttgcaaagtataagccaccccggtag

SEQ ID NO: 8645 - DNA, 390 bp, Artificial Sequence
  Description of Artificial Sequence: Synthetic coding sequence
atgcccatggccagcccccagaccctggtgctgtacctgctggtgctggccgtgactgaggcgtggggtcaagaagctgtgatccctggctgtcatctgcacccatttaatgttaccgtcagatctgacagacagggtacatgccaggggtcccatgttgcgcaggcttgtgtgggtcattgcgaatcctccgcctttccatcgcggtactctgtcctggtcgcatccggatacaggcacaacattacctccgttagccaatgctgtaccattagcggattgaagaaggtgaaggtgcaactgcagtgtgtgggcagtaggagagaggagctggaaattttcactgcacgcgcatgtcaatgcgacatgtgtcgcctgtctcggtattag

SEQ ID NO: 8646 - DNA, 1965 bp, Artificial Sequence
  Description of Artificial Sequence: Synthetic coding sequence
atggccaagttcggcgtgcaccggatcctgctgctggccatcagcctgacaaaatgcctcgagtcaaccaagcttctggccgacctgaaaaagtgcggtgacctggagtgcgaggccctcataaaccgggtctcagcaatgcgcgactaccggggaccagactgtagatatctgaatttcactaagggtgaggagatctctgtctatgtcaagctcgctggtgaacgtgaagacctgtgggctggatcaaagggaaaagagttcgggtactttcctcgcgatgcagtccaaatagaagaagtgtttatttcagaggagatacagatgtcaacaaaggaatccgattttttgtgcctattgggcgtcagctataccttcgacaatgaggattcagagttaaacggtgattacggtgaaaacatctatccatacgaggaggataaagacgaaaagagctcaatatatgaatctgacttccaaattgaacctgggttctacgctacctacgagtcaactctcttcgaggaccaggtcccggcactggaggcccctgaggatatcggctctacgagcgaatccaaggattgggaagaggttgtagtagaaagtatggaacaggatcgcattccagaagttcacgtaccacctagtagtgctgtgagcggtgtgaaagagtggtttggactgggcggggaacaagctgaggaaaaagcatttgaaagcgtgattgagcccgtccaagaatcctcttttagaagccgtaagatcgccgtggaggatgagaacgatctggaggaattgaataatggggagccccagaccgaacaccagcaggaatctgaaagtgaaattgattccgtgcccaagacccagtccgagcttgcgagtgagtccgagcacatccccaaaccgcagtccacaggttggttcggtggtggcttcacctcttatctggggttcggtgacgaggatacgggcttggagcttattgcagaagaatctaatccgcctctgcaggattttcctaactctatcagctccgacaaagaggcgaccgttccttgcactgaaattctgaccgaaaaaaaagacaccatcacaaatgattcacttagcctgaaaccgtcatggttcgatttcggcttcgcgatcctgggtttcgcctatgcaaaggaagacaaaattatgctggacgaccggaaaaatgaggaagatggcggagccgacgaacatgagcatcccttaaccagtgagctggatcccgagaaggagcaggagatagagactatcaagattatagaaacagaggaccaaatcgacaagaagccggtatctgagaaaacagatgaaagcgacaccatcccctacctgaagaagttcttatacaatttcgataatccctggaatttccaaaatatccctaaggagacggaactcccgtttcctaaacagatactggatcaaaataatgttattgagaatgaagagactggagagttttctattgacaattacccaacagataacacaaaagtgatgatctttaaaagctcttactccctatccgacatggtttctaatatcgagttgcccaccagaatacatgaagaggtgtacttcgaacccagcagctctaaggattcagatgaaaattctaagccctccgtggacaccgagggccccgcattggtcgagatagatcgcagcgttgaaaacactctcctaaattctcagatggtctcaacagataacagcttgagcagccagaactacatatctcaaaaggaggacgcgtcggaattccaaattctgaaatatctgttccagatcgacgtgtatgatttcatgaacagcgcgttctcacccatcgtgatcctcaccgagcgtgtgagcctgcccttcaagcctttcgctatcatcttgccgatcctactaaatattagagtcgccactaagtacgtttag

SEQ ID NO: 8647 - DNA, 1152 bp, Artificial Sequence
  Description of Artificial Sequence: Synthetic coding sequence
atggccggcatccccggcctgctgttcctgctgttcttcctgctgtgcgccgtgggccaagtgtccccttacagcgccccctggaaacctacttggccagcttatcggctgcccgtggttctcccgcagagcacattgaacctcgctaagccagactttggggctgaggcaaagttagaagttagttcctcgtgcggtccccagtgccacaagggcacccctctccccacatacgaggaggcaaagcagtacttaagttatgaaacgttatacgccaacgggagcagaacagaaacccaggtggggatctatattttgtcgtccagtggcgatggggcccagcatcgcgatagcggctcaagcgggaaatcgcggcgcaagcgacagatctacggctacgacagcaggtttagtatatttggaaaagatttcctgctcaactacccattctccacatctgtgaaactgagcactggttgcacggggaccttagtggccgaaaagcacgtgctgacagccgcccattgtatccacgatgggaaaacctatgttaagggtacacaaaaattgagagtgggattcttgaagccgaaattcaaggatgggggtcgtggtgccaatgactcaaccagcgccatgcccgagcagatgaaatttcagtggatcagagttaagaggacccacgttccaaaaggatggatcaagggaaatgccaatgacatcggcatggactacgattacgccctcctcgagctcaagaaaccacataagaggaaatttatgaagatcggtgtatccccgccagccaagcagctgcccggcggccgaatacatttcagtggctatgacaacgataggcccggcaatctggtgtatcgcttctgtgatgtgaaggatgagacctacgacttgctgtaccaacaatgcgacgctcaacccggagcttcgggaagtggcgtgtatgtgcgcatgtggaaacggcagcagcagaaatgggaaagaaaaataatcgggatcttctctggccatcagtgggtcgatatgaatgggtccccccaggattttaatgtcgctgtgagaattacccccctgaaatacgcccagatctgctattggatcaagggaaactatctggactgccgcgaaggatag

SEQ ID NO: 8648 - DNA, 1662 bp, Artificial Sequence
  Description of Artificial Sequence: Synthetic coding sequence
atgaagtggtgctggggccccgtgctgctgatcgccggcgccaccgtcctaatggagggcctgcaagctgcccagagggcatgtggccagcgaggccccggaccacccaagcctcaggaaggcaacaccgtcccaggggagtggccttggcaggcctctgtgcggcggcagggagcacatatttgctccggctccctcgtagccgacacttgggtgttaacagccgctcactgcttcgagaaggccgcggcaaccgagttaaactcatggtctgtcgtgctgggttccctccaaagggagggactgtccccaggtgccgaggaggtgggtgtcgccgcccttcaattgccacgagcatacaatcattactcccagggaagtgatcttgccctcttgcagctggcccatcccacgacccacacccctctatgtttgccccagcccgcacaccggttcccttttggggcgtcctgctgggccactggctgggaccaggatacttccgacgcaccaggaacgctccgcaatttgcgtttgcgcctaatttctaggccgacctgtaattgtatttacaatcagctgcaccagcggcacttgtccaaccctgcccgtcccggtatgctctgcggtggcccacagcccggcgtccaggggccctgccagggtgattcggggggccctgtgctttgtcttgagccagacgggcactgggttcaggcgggtattatttcatttgctagttcatgcgctcaagaggacgcccccgtattgctgaccaataccgctgcacattcctcttggctgcaggctcgtgtgcagggcgcagcattcctggcccagtctccggagactcccgaaatgtcagatgaagatagctgtgtcgcatgcgggagtctgcggacggctggaccccaggccggagccccttccccttggccctgggaggctcgtttaatgcatcaggggcagctcgcgtgcggcggcgctttggtgtcggaggaagctgttctgacagcagcacactgctttatcggacgccaggcacctgaggagtggtctgttggtctcggaacccggcccgaggaatggggtctgaagcagctcatcctgcacggggcttacacacatcccgaagggggttatgatatggctcttctgctgcttgcccagccagtgactcttggagcgtcactgcgtcccctctgtttgccctatcccgaccaccatctacccgacggagaacggggatgggttctgggtagggcacgcccaggcgctggcatttcctccctccagacagtaccagtcacactgctgggacctcgtgcatgttccaggctgcacgcagcccccggaggagatggcagccccatcctcccaggaatggtgtgcacttccgccgtcggcgagctgccatcttgcgagggactgtctggcgcccctcttgttcatgaggttcgcggaacctggtttctggccggtctccacagcttcggcgacgcatgccaaggtccagcccggcccgcagtattcacggccctcccagcttatgaggactgggtgagcagtcttgactggcaagtctactttgccgaggagcccgagcccgaagcagaaccagggagttgcctcgccaatattagtcaacccacttcctgctag

SEQ ID NO: 8649 - DNA, 936 bp, Artificial Sequence
  Description of Artificial Sequence: Synthetic coding sequence
atgggcatcatccagagcatcctggccaccagccgggactgctacagctttaagaagaagcccattccgaaaaaacccacaatgctggccctggccaaaattctcctaatttccaccctcttctattctctcttgtctggtagtcatggcaaggagaatcaggacattaacacaacccagaacatcgcagaggtcttcaagaccatggaaaataaacctattagtcttgagagcgaggccaacctaaactccgacaaagagaacattactacaagcaacctaaaggccagccacagcccacccctcaatctgccgaacaactcacacggcattactgacttttcatctaatagctccgccgagcacagtctggggtccttgaaaccaactagtactatcagcacaagcccgcctcttatccacagttttgtctctaaggttccttggaatgcccccattgccgacgaagaccttctccccatttccgctcatcccaacgcaacacctgccttaagttctgagaattttacatggtccctcgttaatgacacagttaaaacgcctgataattcaagcatcaccgtgtcgatcctgagctctgagccaactagccctagcgtaacccctcttatcgttgaaccaagcggatggctgactacaaacagcgacagctttacaggtttcaccccctatcaagagaagactacccttcagcctaccttgaaattcaccaacaattctaaattatttcctaataccagcgatccacagaaggtcctgcggctggataatgcaccagaaccttacgatgtatcctttgggaattcctcgtattacaaccccactcttaatgattccgccatgcctgaaagtgaagagaatgctagggatggaatccctatggatgacatccctcctttaagaacttcagtgtag

SEQ ID NO: 8650 - DNA, 3120 bp, Artificial Sequence
  Description of Artificial Sequence: Synthetic coding sequence
atgcagagccggctgctgctgctgggcgcccccggcggccacggcggccctgcctccaggaggatgagactgctgttacgacaggttgtccagcgccggccgggcggtgacaggcagcgacccgaagtgcggctgctgcatgccggttcaggcgccgatactggtgatacggtgaatatcggggatgtgagttataaattaaaaatccccaaaaaccccgaactggtgccacagaattacataagtgattcattggcacaaagcgtggtgcagcaccttcggtggatcatgcaaaaggatcttctgggccaggatgtgttcctcattgggccgccgggacctctccgtcgatcgatcgcaatgcagtacctcgaattgacgaagagggaggttgaatatatagctctgtctcgtgacacaaccgagacagacctgaagcaaaggcgggagattagggctgggactgccttctatatcgatcagtgcgcggttagggcagctacggaaggcagaacgttaattctcgaaggcctcgagaaggcagaaaggaatgtgctgcccgtgctaaacaatctacttgaaaaccgcgagatgcagctcgaggatggacgattcctgatgtcagccgaaaggtatgacaaactgttgagagatcacactaaaaaagagctagactcctggaagattgtgcgcgtctcagaaaatttcagagtgattgcactgggactaccggttccacgctacagtggcaacccactggatcccccgctccgatctcggtttcaggccagggatatttattacctgccattcaaggatcagcttaagctgctgtattccattggcgcaaatgtcagcgctgagaaggtctcccaactgctaagctttgctacaacgctctgcagccaggagagctctacactcgggcttccggactttccgttggatagtcttgccgccgctgtacagatcctggacagtttccccatgatgcccatcaaacacgcaattcagtggctttatccatattctatcctcctaggacacgagggcaagatggctgtggaaggcgtgcttaaaaggtttgagctgcaggactctgggtcctcattgcttccaaaggagattgtgaaggttgaaaaaatgatggagaatcacgtaagccaggcctcggtgactatcagaatagccgacaaggaggtcacaatcaaagttcctgcaggcaccaggctgctctcacagccctgcgccagcgaccggtttattcaaactctcagccataaacagctgcaggccgaaatgatgcagtcccatatggtgaaagatatctgcctaataggaggtaaagggtgtggaaagaccgttatcgctaaaaactttgctgacacccttggctataacattgagccaattatgctgtaccaggacatgaccgcaagggacctgcttcagcagagatatacactgcccaacggtgatacagcttggcggtctagtcccttagtcaatgccgccctggagggaaaactggtgctcctcgatggcatacaccgggtcaacgctggcacgctcgctgtgctgcaacgcctgatccacgatcgggaactgagcctgtatgacggttctaggctgctgcgcgaagacagatatatgaggctgaaagaggagctgcaactttcagatgaacagttacagaagagatctattttcccaatccatcccagcttccggattatcgcactcgccgagcctcctgtaatcggttcaactgcacaccagtggctgggccctgagttcctaaccatgttctttttccattacatgaagcccctggtgaagtccgaggagatccaggtgattaaggagaaggtccccaatgtgcctcaggaagcccttgataagcttctgagcttcacgcataaactgagagagacccaagatcctacggcacaatcattggctgcttctttgagcaccaggcagctgttgagaatctctaggagacttagccaatatcccaacgaaaatctgcattcagccgtcactaaagcctgtctatcacgtttcctccctagcctcgcccgctctgctcttgaaaagaatctggctgacgctacgatcgaaatcaacacggacgataatttggagccagagctcaaggactacaagtgcgaggtgacttccggaacactgaggatcggggctgtgtcggcccctatttataatgctcacgagaaaatgaaagtgccggatgttctgttctacgacaatatccagcacgtcatcgtcatggaggatatgctaaaagatttcctgctcggcgaacatctcttgttggtgggtaaccagggagtgggaaaaaataagatcgtggaccgtttccttcacctcctgaatcgccccagggagtacatacagctgcacagggacaccactgtccagaccctaactctacaaccctctgtcaaggatggcctcatcgtgtacgaagatagcccactcgttaaggctgtgaagctgggccatattctggtagtcgatgaagccgacaaggcacccaccaacgtgacttgcatactcaagaccttagtggaaaatggggagatgattctcgctgatgggcggaggatagtggccaattccgcgaacgtcaatggccgggagaatgtggtcgttattcatcctgactttagaatgatcgttttagccaaccggcccggctttccattcctggggaatgatttttttggtacactgggggatatcttctcctgtcacgccgtggataatcctaaaccccactcagagcttgagatgctgcggcagtacggaccaaatgttcccgagccaatcctccagaagttggtggctgctttcggcgaactacgcagcctcgccgatcaggggattattaattatccatattccactcgcgaggtggtaaatatagtaaaacaccttcaaaagttccctaccgaaggcctgagcagtgtagtccgcaacgtgttcgatttcgactcttataacaatgacatgcgggaaatcctgatcaacactctgcataaatacggtattcccattggggccaagccaacatcggtgcaactcgcaaaggagtag

SEQ ID NO: 8651 - DNA, 801 bp, Artificial Sequence
  Description of Artificial Sequence: Synthetic coding sequence
atgcggctgctgttcctggccgtgctgcggccccacaccggcaacgccgtgacggctcagcgcgtccgcgctcacttagaggccgccggacatgtctgcgttctgaaagatgctttcgacttcgagtcccggtcagaaatagccaacctgattttggcagaaaactgtgaagcagctttggctctccacctgtataggggaggtcgattgctacagggacacagaatccccttcggcgtgattttcggtggcacggatgtgaatgaagacgccaatcaggccgaaaagaatactgtcatgggaagggtgctagaagaggcaaggtttgcggttgcttttactgaatctatgaaagagatggctcaagcgcagtgggtggatccggttttcacccgcgaagtcaaggctaaggtcaagagagccgcaggcgtccggttaattggtgaaatgccacaggaggacctccacgctgtagtgaaaaattgcttcgcagtggtgaacagcagcgtctccgagggaatgtcggccgcaatcctagaggcaatggacctggaagtgccggtgttagcccgcaacattccaggtaacgctgcggtggtgaagcacgaggtcaccggactcctcttcagcaaccctcaggagttcgttcatctggccaaacgcttggtatctgaccccgccctagaaaaggagatcgtcgtaaacggcagagagtatgtgcggatgtaccactcatggcaggtggagagggacacataccaacagttgataagaaagttggaagggtctacggaagactag

SEQ ID NO: 8652 - DNA, 2478 bp, Artificial Sequence
  Description of Artificial Sequence: Synthetic coding sequence
atgttcagcggcttcaacgtgttccgggtgggcatcagcttcgtgatcatgtgcatattttatatgcccaccgttaattctcttccagagctgagcccccagaagtactttagcactctccagccgggaaaggccagtctggcttacttttgccaggccgactcaccccgcacatcagtcttcctggaagagctaaatgaagccgtccgacctctgcaggattacggtattagcgtggctaaggttaattgtgtgaaggaggaaatttctagatactgcggcaaagagaaagatttgatgaaggcttacttattcaaagggaatattctgctccgtgaatttcctacagacacactttttgatgtcaacgccattgtcgcgcatgtcctgttcgcgctcctcttttcagaagtgaagtacataaccaacttggaggacctacagaacattgagaatgcactgaagggcaaggccaacattatattctcctatgttcgtgctatcggcattccggagcacagggccgtcatggaggccgccttcgtgtacggaaccacctaccaattcgtcctgactacggaaatagccctattggaatccattggatcagaagatgtggagtacgcgcacctttacttcttccactgtaaactggttctggacctcacccaacagtgtaggagaacattgatggagcaacctctcaccaccttaaacattcatctcttcattaagacaatgaaagcccccctgctgacggaggtagcagaggatccacaacaagtgtccaccgttcacttgcagctgggtcttcctctcgtgttcattgtttcacagcaagcaacctatgaggctgatagacgcaccgccgaatgggtcgcttggagattgctgggtaaggcgggagtccttctcctgcttcgagactcactggaggtgaacatcccacaagacgccaatgtcgtctttaaacgcgctgaggagggggtgccagtagagtttctggttctgcacgacgtggacctgataatatctcacgtggaaaacaatatgcatatagaggaaatccaggaggacgaggacaatgacatggagggaccggacatcgacgtgcaagacgacgaagtggcggaaacggtgtttcgagatcggaaacgaaagctccccctcgagcttactgtcgaactgacagaggagacctttaacgccacagtgatggcctccgacagcatcgtgcttttctacgctggatggcaggccgtgtctatggcattccttcagtcgtatatagacgtcgccgttaagttgaagggtacatccactatgttattaactaggattaattgcgcagattggtcagacgtttgtactaaacagaacgtgactgaatttccaataattaaaatgtataaaaaaggagagaaccctgtgagctacgcaggaatgttgggtacagaagacctgctaaagtttatccagctgaacaggatttcttacccagtcaacataactagcatccaagaggccgaggaatatctctctggggaactctacaaggacctgatcttatacagcagcgtgtccgtcttaggcctctttagcccaacaatgaaaaccgccaaggaagacttttcagaagccggcaattaccttaaggggtatgtgattaccggaatttattctgaggaagatgtgctgctcctgtccacaaagtatgcagcctccctgccagccttactgctagccagacataccgagggaaagatcgagagtatcccactggcgagtacacatgcacaggatattgtacagatcatcaccgacgctcttctggagatgttccccgagattacggtggagaacttgccctcctattttaggcttcagaagcctctgctcattcttttctccgatggcacagtaaatccccaatacaagaaggccattttaaccttggtgaaacagaagtatctggactcattcaccccttgctggctgaatctcaagaacacccctgtgggacgtgggatcctcagggcatattttgacccccttccccccctgcccttacttgtgttagtcaatttgcactcgggaggtcaggtgtttgcattcccctccgatcaggcgattatagaagagaatcttgtgctttggcttaaaaaactggaagcaggcctggaaaatcatatcaccattctaccagctcaggaatggaagccaccactccccgcatacgacttcttgtctatgatcgatgcagctacgtcccagagaggcactcgtaaggttcccaaatgcatgaaagagactgacgtccaggagaacgataaggaacaacatgaagacaaaagtgccgtgaggaaagagcccattgagactctgcgaatcaaacattggaatcgcagtaactggttcaaggaggcagagaagtcttttaggcgggataaagagttggggtgctctaaagtaaactag

SEQ ID NO: 8653 - DNA, 672 bp, Artificial Sequence
  Description of Artificial Sequence: Synthetic coding sequence
atgacctggcggcaccacgtgcggctgctgttcaccgtgagcctggcacttcagattatcaacctgggcaattcttaccagagagaaaagcataatggaggtcgtgaagaggtaaccaaagtggctacccagaagcaccgccagtctcccctgaactggacctcgagccactttggggaagtgacaggttctgccgagggttggggtccggaggaacctctcccttatagctgggccttcggcgagggggcttcagcgagacctagatgctgtcggaatgggggaacttgcgtacttggttcattttgtgtgtgccctgctcatttcacaggccgctattgtgagcacgaccaacgacgctccgaatgtggagcccttgagcacggggcctggaccctgagagcttgccatctgtgtcgttgcatcttcggagctctacactgcctgcccttacaaacccctgatagatgcgaccctaaagattttcttgccagccatgctcatggcccctcagcaggtggcgccccctctctcctactccttcttccctgcgcgttgctccacagactccttagaccagacgcacctgctcacccacgcagcctggtgccaagtgtgttacagcgagagcgccggccctgtggaaggcccggattgggacacaggctctag

SEQ ID NO: 8654 - DNA, 1320 bp, Artificial Sequence
  Description of Artificial Sequence: Synthetic coding sequence
atgcccgccatcgccgtgctggccgccgccgccgccgcctggtgctttcttcaagtggaatcacgtcatctcgatgcactggcagggggagctggcccaaatcatggtaactttctcgataatgaccagtggctgtcaactgtgtcacagtatgaccgcgataagtactggaaccggttcagagatgacgattacttcagaaattggaatcccaacaagccattcgatcaggccctcgacccctctaaggatccatgtctgaaggtcaagtgctctcctcacaaggtttgtgtcacccaggactaccagactgcactgtgcgtgtccagaaagcacttgctccccaggcaaaagaaaggaaatgtagcccagaagcactgggtcggaccttccaaccttgtgaaatgcaagccctgcccggttgctcagtcggccatggtgtgtggtagcgacggccactcttatacctcaaaatgtaagctcgagttccatgcctgcagtactggtaaatcactggcaaccctgtgtgacgggccatgcccttgcctacccgagccggaacctcccaagcacaaggcggaaagaagcgcatgcaccgacaaggagcttagaaacttggcatctaggttgaaggattggtttggggctctgcatgaggacgcaaatcgggtcatcaagccaactagctccaatacagcacaaggaagattcgacacatctatcctgccgatctgcaaggatagcctgggctggatgttcaacaaacttgacatgaactatgacctgttgctcgacccaagtgaaattaatgccatttacctggacaagtatgaaccgtgcatcaagccacttttcaactcctgcgattcattcaaggatggcaaactgtctaacaacgaatggtgttattgcttccagaagcccggcggcctgccatgtcagaacgagatgaacaggattcagaaactgtccaaaggcaaatccctcctgggagcttttatcccccgttgtaacgaagaggggtactataaagccacacaatgtcatgggagcaccggacagtgctggtgtgtggataaatacgggaatgaattggcaggttcaagaaaacagggcgccgttagctgcgaggaggagcaggagacaagtggcgacttcggtagtgggggatcagtcgtgcttctcgacgacctggagtacgagagagagctcggacccaaggacaaagaaggcaaactgagagtgcacacaagggcagtcactgaggacgatgaggatgaagacgacgacaaagaagatgaggtgggctacatttggtag

SEQ ID NO: 8655 - DNA, 7872 bp, Artificial Sequence
  Description of Artificial Sequence: Synthetic coding sequence
atgaaggtgaagggccggggcatcacctgcctgctggtgagcttcgcggtgatttgtctggtggccacaccaggggggaaggcgtgtccgagacggtgtgcttgttatatgcccacagaagtccactgtacctttcgatacctgacatccatccccgattctatcccccctaacgtcgagagaatcaatttaggctataactcccttgtgcgtctgatggaaaccgatttctctggtctcacaaaactcgaactgcttatgctgcacagcaacggaatccataccatccctgataagacatttagcgatctccaggcactgcaggtactgaagatgagttacaataaagtgcgtaagctgcagaaggatactttctatggtcttagaagcctcacaagactccatatggaccacaataatatcgaatttatcaatcctgaagttttctacggcttaaatttcttgcgcttggtgcacctggagggcaaccaactaacgaagctgcaccccgatacattcgtaagcctgtcttatctgcaaatattcaaaatcagtttcatcaaattcctgtacctcagcgacaacttcctgactagccttccccaggagatggtgtcgtatatgcccgatttggattcactgtatctgcatgggaatccatggacatgcgactgccatcttaaatggctgtcagattggatccaggaaaagccggacgtcattaaatgcaaaaaggaccgtagtccgagctcagcgcagcagtgccccctctgcatgaacccccggacaagtaagggtaaacccctagccatggtctccgctgcagcatttcaatgtgctaaaccaaccattgatagctccttgaagtctaaatccctgacaattctcgaagactcaagctctgccttcataagcccacaaggttttatggcaccattcggctccctgacccttaacatgacagaccagagtggaaacgaggccaatatggtgtgcagtatccagaagccctcccgcacgtcccccatcgccttcacagaggagaatgattatattgtgctgaacaccagcttctccacgtttctggtttgcaatatcgactacgggcatatccagcctgtgtggcagatcctcgccctatactcggacagtccccttattctcgaacgttcccatcttctaagcgaaacaccccagctctactataaatataaacaggtggcccctaagcctgaggacattttcaccaacatagaagcagatctgagagcagatccttcatggttaatgcaggatcagatttcattacagctgaacagaacagccactacgttttcaaccttacaaatccagtattcatcagatgctcagattactctccctcgcgcagaaatgaggcccgtcaaacacaaatggaccatgatctctagagataataacacgaaactggaacacaccgtccttgtgggaggcacagtcggcctaaactgccctgggcagggggatcctaccccacatgtggattggctgcttgcggatgggtcgaaagtccgtgccccgtacgtgtccgaagacggaagaattctaattgataaaagtggcaagcttgaacttcagatggccgacagtttcgacacaggtgtatatcattgcatttcctccaactatgacgatgcagatattctgacctatagaatcactgtcgtggagccccttgtcgaggcttatcaagagaacggtatccaccacacagtgtttataggagagaccctggacctgccatgtcacagtactggcatccccgatgcgtccatatcctgggtaatccccgggaacaatgtactctatcaatcatctagggataagaaggtgctgaataacggcaccctgcggatcctgcaggttacaccaaaagaccaggggtattataggtgcgtggccgctaatccttcaggcgtggactttcttatatttcaggtgtctgtcaagatgaaaggacaacgaccgctcgagcatgatggggaaaccgagggtagtggattagatgaaagcaatcccattgctcatttgaaggagccacccggcgcacagctgaggactagcgccctgatggaggccgaggtaggcaagcatacttcttccacttctaagagacataattaccgggagttaactctacagaggcgcggagacagcactcacagaagatttagagagaaccggcggcatttccctccttccgcaagacgcatcgatccccagcactgggcagctttactagagaaagctaagaagaatgccatgcctgacaaacgcgagaataccaccgtgtcacccccccctgtggtcacgcaattgccaaatatccctggagaggaggatgatagttctggcatgttggcacttcacgaagagtttatggtgcctgccacgaaggctctgaaccttccggcaaggacggttactgccgatagcaggacaatttcggattcccccatgaccaatattaattacggcacagaattttctcctgtggtaaattcacaaatcctgccgcccgaggaacccactgatttcaaactcagcaccgcaattaagaccaccgccatgagtaaaaatatcaatcccaccatgtcctcccagattcagggaacaacaaatcagcattcatcaactgtcttccctctcctcctgggcgctacggagttccaagattctgaccagatgggtcgcggccgagaacattttcagtctagaccccccatcacagtgaggacgatgatcaaggatgtgaacgtgaaaatgctgtcctctactacaaacaagctgctcctggagtcagtgaacactactaattctcatcaaacctcggttagagaggtgtcagagcctcggcacaatcacttttactcacacactactcagatactgagtacgtccaccttcccctctgaccctcataccgccgcacatagccaatttcccatccctcgcaacagtaccgtcaatatccctctctttagacggtttggcagacagaggaaaatcggcggccgcggccgcataatctcaccttaccggacaccagtcttgaggagacatagatactccatttttcgcagcaccacgcgggggtcatcagagaagtctacaacagcatttagcgctacagtactgaatgtcacgtgtcttagctgtcttccgcgcgagagattgacaactgctaccgccgctttgtcctttcccagcgccgccccaattacctttcctaaagccgatattgctcgagtcccctcagaggagagcaccacattagtgcagaaccctttactcttactggaaaataagccctccgtagagaaaactactccaacaatcaagtacttcagaacggagatctcgcaggtgaccccgaccggcgctgtaatgacatatgctcctaccagcatcccgatggaaaaaacccataaggtgaacgctagctatccccgcgtttcaagtaccaacgaagcaaagcgcgacagcgtgattacttccagcctgagtggggcaattacgaaacctcccatgaccattatcgcgatcaccagattctccagaaggaaaataccctggcagcagaactttgtgaataaccataaccccaaggggcgattgagaaaccagcacaaggtctctctgcagaaatctacagcagtgatgttgcccaagacctcaccagcgctcccgagagacaaagtgtctccttttcatttcacaactttgagtacgtctgtgatgcaaataccttccaataccctgaccacagcccaccacacaaccaccaagacccacaatcctggttcgctccccacgaaaaaggagctgccattccctcccttaaatcccatgctgcctagtatcatcagtaaggatagtagtaccaagagcattatctcaacccagaccgccattccggcaacaactccaacctttcctgcatcagtgataacttatgagacacagactgaacgaagccgcgctcagacaatccaacgtgagcaggaaccgcaaaagaagaaccgcactgatcccaatatcagtccagaccaaagttctggttttactacgccaactgccatgacaccacccgttctgaccactgctgaaacttcagtgaaaccctcagtcagcgcatttacccactccccacccgagaatactactgggatctcctcaaccattagctttcactccaggaccctaaacctgaccgatgttattgaggaacttgctcaggcatccacccaaactctaaaaagtacaattgcgtctgagacgacgctgagttctaagtcgcatcagagcacaactacccgtaaggcaattatccggcatagcacaattccacctttcctgtctagcagcgcaaccctgatgcccgtgcctatctccccacctttcacacaaagagccgttaccgacaacgtggctacacctattagcgggcttatgactaacacagtggtgaagctccatgaatcttcccgccacaatgccaagcctcagcaactcgtggcagaggtggctactagcccaaaggtgcacccaaatgccaagttcacaatcgggacaacccacttcatatacagtaaccttctgcacagcacccccatgcccgcattaacgacggttaaatctcagaacagtaaactcacaccgtccccctgggccgagaatcaattctggcataagccctattccgagatcgctgagaaagggaaaaagccagaagtctccatgctcgcaaccaccgggctatccgaagccacaaccttggtgtctgactgggacgggcagaagaatactaaaaagtccgacttcgataagaagcccgttcaagaggctacaacctcgaaactcctccctttcgactccctcagcaggtatatatttgaaaaacccagaatcgtggggggtaaggccgcctcgtttactatcccagctaattccgatgcctttcttccgtgtgaggccgtcggtaatcctctccccaccattcactggactcgcgtaccttcagggctggatctgtccaagcgcaagcagaactcccgggtgcaagtccttccaaacggcacgttatccattcagcgagtggaaattcaagaccggggtcagtacctgtgtagtgcctccaatctcttcggcaccgaccatctacatgttaccttgtcagtagtgtcttacccacccaggatcctggagcgtcgtactaaagaaattactgtccactccgggtctacggtggaactcaagtgccgcgccgaaggtcgcccatcaccgacagtgacttggattttggctaatcagacagtggtaagtgagtccagccagggctcacgccaggccgttgtgacggttgacggtaccctggttctccataacctgagtatctacgaccgtggcttctataagtgtgtggccagcaatcccggcggccaagacagcctgctcgtgaaaattcaggtgatagcggcgccacccgtgatccttgaacaacgcaggcaggtcattgtgggtacttggggggagtccttgaaactcccctgtacagccaaaggcacaccacagccctctgtctactgggtcctaagtgatgggaccgaggtgaaaccactccaatttactaatagtaagcttttcctgttctctaatggaactctttatattcgcaatttggcttcaagcgatcgggggacttatgaatgtatcgccactagtagcaccgggtccgaaaggcgtgtagtgatgctcaccatggaagagagagtcacctctccaaggattgaggccgcgtcccagaagcgaaccgaggtgaattttggcgataaactgttgcttaattgttcagcaacgggcgaacctaagccacagattatgtggcggttgccatcaaaggcagtggtggatcagcagcatagggtgggatcatggatacatgtctatccaaacggaagcctgttcatcggaagtgtcactgaaaaagacagtggcgtctatctgtgcgttgcccggaacaagatgggggatgacctcatccttatgcatgtgagcctgagattgaaacccgctaaaattgaccataaacagtatttcaggaagcaggtactgcatggcaaagactttcaggttgattgcaaagcttctggctctcccgttcctgagatctcctggagcttaccggatgggacgatgataaataatgctatgcaggccgacgatagcgggcacagaactaggagatataccttgtttaataatgggaccctgtattttaacaaggttggagttgctgaggagggcgactatacctgttacgcacagaacacccttggaaaagacgagatgaaggtgcacttgacggttatcactgctgcccctaggatccggcaatccaacaaaactaataagagaattaaggccggcgatacagctgtgctggactgtgaggtaacaggggaccccaagcccaagattttttggctgctaccctccaatgatatgattagcttttcgattgataggtatacattccacgcaaatggctctctgaccataaacaaggtcaaattgttagactcaggggaatatgtgtgcgtcgctcgaaacccctccggggacgacacaaaaatgtacaaactggacgtggtgtctaaacctcccttgataaatgggttgtatacaaaccgaaccgtcataaaagcaactgcagtgcgccattctaagaagcacttcgattgcagggccgaaggaaccccttctcccgaggtaatgtggatcatgcctgacaatatttttttgaccgcaccctattatggcagcagaattacagtgcataagaatgggaccctggagatcagaaatgtaaggttgagcgactcggctgatttcatctgtgtcgcgcgaaatgaaggcggagagagcgtactcgttgtgcagcttgaagtgttggagatgctaagaaggcccacctttcggaacccatttaatgaaaagatcgtggcccagctgggaaaatcaacggccctgaattgttccgtggacggtaatcctccgcctgaaatcatctggatactccccaatggaacccggttttctaatggcccacagtcctatcagtacttgattgcttcaaacggaagtttcataatctcaaagacgacacgggaagacgcaggtaaatacaggtgtgcagcacgaaataaggtggggtatatagagaaactcgtgatccttgaaatcggccagaaacccgttattcttacatatgcccccggaaccgttaagggcatctctggcgaaagcctctcgttgcattgcgtatccgacggcataccaaagcccaacatcaagtggaccatgcctagcgggtacgtagtcgacagaccgcagataaacgggaagtacatcttacacgataatggtacactggtaattaaggaagccaccgcttacgataggggaaattacatatgcaaggcacagaattcggtaggacacacactcatcacagtccccgtgatgatcgtcgcatatccgccaagaatcaccaacaggccacctcgttctattgtcaccagaacgggagctgcttttcaactacattgtgtggctctgggggtgccaaagcccgaaataacttgggagatgcccgatcactcgctgttgagtacagcatccaaagaacggactcatggaagtgaacagctacacctgcagggaacactcgtgatccaaaacccgcaaacatctgatagcggcatctacaagtgtactgccaagaatccacttggaagcgactatgccgctacctacattcaggttatctag

SEQ ID NO: 8656 - DNA, 1995 bp, Artificial Sequence
  Description of Artificial Sequence: Synthetic coding sequence
atgaagaccggcctgttcttcctgtgcctgctgggcaccgccgccgcaattccaacaaacgctagactgctctccgaccacagcaagcccacagccgagacagttgccccggacaacactgcgattccatccctcagggccgaggctgaagaaaacgaaaaagaaaccgcagttagtactgaggacgatagccatcacaaggccgagaaatcatcggtcctcaaatctaaggaggaaagccatgaacagtctgcggaacagggaaagagttcctcccaagagcttggcctaaaggatcaagaggatagcgacggccatctgtctgtgaatcttgagtatgcccccacagaaggaacacttgacatcaaggaagatatgtctgagcctcaagagaagaagctatcagaaaataccgatttcctcgccccaggtgtgtcctctttcaccgactctaaccaacaggagtccatcactaagagggaggaaaaccaggaacagccccggaattacagccatcaccagctgaaccgctcctccaagcactcccaaggcctccgcgatcaggggaaccaggagcaggatcccaacatcagtaatggtgaggaggaggaagagaaagagcctggcgaggtgggaacccataacgacaaccaagaaagaaagactgagctccccagagagcatgctaacagtaaacaggaagaggacaacactcagtccgacgacattcttgaagagtcggatcaacctacacaggtatccaagatgcaagaggacgagtttgatcaaggcaaccaggaacaggaggataactcaaacgccgaaatggaagaggagaacgcaagcaacgtaaacaagcacattcaggagactgagtggcagtctcaggagggaaagacaggactggaggccatctcaaatcacaaagaaactgaagagaaaactgtatctgaggctttactgatggagccgaccgacgacggcaacacaacccctagaaaccatggtgtggatgacgacggtgacgatgatggcgacgatggaggcaccgatggtccccggcatagcgctagtgatgactatttcatcccatctcaagcttttctggaggcagagagagctcagagcatagcataccacctcaagatagaagagcagcgcgaaaaagtacacgagaacgagaatatcggcaccaccgagccaggagaacatcaggaagctaagaaggctgaaaactcctccaatgaagaggagacaagtagcgagggcaatatgcgtgtgcatgcagtggacagctgcatgagcttccagtgcaagcgaggacacatctgtaaggcggaccagcaaggcaagccccattgtgtgtgtcaagacccagttacgtgtccccctacaaaacccctcgaccaggtctgtggaaccgacaatcagacatatgccagctcctgccacctgttcgctacgaaatgtcgcctggaggggactaagaagggtcatcaacttcaactcgactacttcggcgcatgtaaaagcatccccacctgtaccgatttcgaagttatccagtttccccttcggatgcgtgattggcttaagaatatccttatgcagttgtatgaggcaaacagtgagcatgcaggctacttgaacgagaaacagaggaataaagtcaagaagatttacctggacgagaagaggctgctggcgggagaccacccaatcgaccttctcctcagggacttcaaaaagaattatcatatgtacgtctaccctgtgcattggcagttcagcgaactggatcagcatccgatggatcgtgtgttgacccactccgaactggctcccctgagggcctctctcgttcctatggagcactgtatcacaaggtttttcgaggagtgcgatcccaataaagacaagcatatcactttaaaagaatggggtcactgcttcggcatcaaggaggaagacatcgacgagaatctgctgttttag

SEQ ID NO: 8657 - DNA, 1254 bp, Artificial Sequence
  Description of Artificial Sequence: Synthetic coding sequence
atgctggccctgctggtgctggtgaccgtggccctggccagcgcccatcacggcggagaacatttcgagggagagaaggtgttccgtgtcaacgtagaagatgagaaccacataaatattatccgagagcttgcttctacaacccagattgacttctggaaacccgactccgttacccagattaaaccacacagcaccgtggactttcgggtgaaggcggaagatacggtaaccgtagaaaatgtgctcaaacaaaacgaactgcaatacaaggtgctaatcagtaacctgcgtaacgtcgtggaggcccagttcgacagtagagtccgcgcgacaggccatagctacgaaaaatataataagtgggagaccattgaagcctggacacaacaggtcgcaactgaaaacccagctcttatttctcgtagtgtgatcggcactacatttgaaggaagggcgatttaccttcttaaggtggggaaggccggccagaacaagcccgctatttttatggattgtggttttcatgcacgtgagtggataagccccgcgttttgccagtggttcgtgcgagaagcagtccggacatatggccgagagatccaggtgactgaactcctcgacaaactggatttctatgtgctccccgttctgaacattgatggatacatttacacctggaccaagtcaaggttctggcgcaaaactagaagcacgcacaccggctcctcctgcattggcacagatccaaaccgcaatttcgacgccggatggtgcgaaattggagcctcaagaaacccgtgcgacgagacatattgtgggccagctgccgagtctgaaaaagaaactaaggcactggccgattttataagaaacaaactatccagtataaaagcgtacttgaccatacacagctacagccaaatgatgatatatccttattcctatgcctacaaactgggagaaaataacgctgaattaaacgcgctcgcgaaggcaacagtgaaagagctcgcctccttgcatggcacaaagtatacttacggacccggtgccaccacaatctaccccgcagccggaggaagtgatgattgggcctacgatcaagggattcggtactcgttcactttcgagttgagggatactggacggtacggcttcctgctgcccgaaagccagattcgtgcaacctgcgaagagacattccttgcgatcaagtacgtcgctagctacgtcttagaacatctctactag

SEQ ID NO: 8658 - DNA, 588 bp, Artificial Sequence
  Description of Artificial Sequence: Synthetic coding sequence
atggccgtgagccagggcgacggcaccctgtgcttcgtgctgctgctgtgctgttggcaggagaccgaattaaggccaagaaccgttatacccggttcccccactgaaattccatttagttctaagcaggaggatatgtccgaactactggatgagattctggtgcaagaaattctcgacctgaataaaacaacccctagcgagatgccatcaactgcttcaaccttgagcacgcccctgcacgccggaatagacgaaaattatcaggcaggcggcagtgagaactatcacgagttactggagaatctccagtttagtcctggaattgaagttaagatcagcaatgatgaggcgaacgccaatgctaatctccacggcgatccatccgagaattaccgtggtcctcaagtgtcgccaggtagcgagaagagtgtgagttccaaagagaagaactctaagaatacacagtatgagaacctgagcatcctcgatcagatcctccagaacataggtaggtcttctggaaatatcttccacaaagagcaacaaagaactagcgctcaaagacggtcacagggcagccagtag

SEQ ID NO: 8659 - DNA, 2334 bp, Artificial Sequence
  Description of Artificial Sequence: Synthetic coding sequence
atgaacgccaacaaggacgagcggctgaaggcccggagccaggacttccacttatttcccgctctgatgatgctaagcatgacgatgctgtttttgccggtcacaggaaccctcaagcagaatatcccacgtctgaaactgacctacaaggacctgctgttgtccaacagctgtatcccatttttggggagctccgagggactagatttccaaactctgctactcgatgaggagcgtggaaggctgcttctgggcgccaaggaccacatttttctgttgtccctggtggacctgaataagaattttaagaagatctactggcccgccgctaaagagcgtgtggagctgtgcaagctggccgggaaagatgctaatacagaatgcgcaaattttatacgagttttgcaaccttataataagacccacatatacgtctgtgggacaggagcctttcatcctatatgcggttacatcgacctgggtgtctacaaagaagatattattttcaaattggatacacacaacctcgagagtggtcgtctaaagtgcccattcgacccccagcagccttttgctagtgtcatgactgacgagtacctgtactccggcactgcttccgacttcctgggcaaagacaccgccttcacaagatctctgggtcctactcacgatcaccattatattcgcactgatatttccgagcactactggctgaacggagctaagtttattgggaccttcttcattcccgatacttataatcccgacgacgacaagatttacttcttttttagggaaagttctcaagaaggctccacctccgataagaccattttgagcagagtcgggcgtgtgtgtaaaaacgatgtcggtggccagcgaagcctgattaacaagtggactaccttcctgaaagctcgtttgatctgttccattcctgggtctgatggggccgacacctactttgatgagctccaggacatttacctgcttccaacgagggatgagcggaacccagtggtgtacggtgtattcacaacaaccagttcaatcttcaaggggtcggccgtgtgcgtgtatagtatggccgatattagagctgtgttcaacggaccttatgcccataaggagtcagctgatcatcgctgggtgcagtacgacggtcgcataccttacccgcggccaggaacctgtccatctaagacttatgatcccctcatcaagagcaccagagacttccccgatgacgtaatatcatttatcaagcggcactctgtaatgtacaagtccgtatacccggtcgccggcgggccaacttttaaacgcattaacgttgactacaggctgacacagatcgtcgtagatcacgtcatcgcagaggacggccaatacgacgtgatgttcctaggcacagatatcggcaccgttctaaaagtggtctctatctccaaagaaaagtggaacatggaagaggtggtgcttgaagagctgcagatctttaagcactctagtattatattgaatatggagcttagcctcaaacaacagcagctctatatcggaagccgcgacggactcgtccagctctctcttcataggtgcgatacctacggaaaagcctgcgccgattgttgtctggccagggatccttattgtgcctgggatggtaacgcatgttcccgctatgccccaaccagtaaaagaagagcacgtcgccaggatgtgaaatatggcgatccgattacacagtgttgggacatcgaagatagcatttctcatgaaaccgccgatgagaaagtcatcttcggcatagaatttaacagtacttttcttgaatgtataccaaagtcacagcaggccaccatcaagtggtatatccagcgcagtggggacgagcatcgggaggagctgaaacctgatgaacggatcatcaagaccgagtatgggcttcttattaggtcgctgcagaaaaaagattctggcatgtattattgcaaggcccaggaacatacatttatccatactatagtaaaactgactttaaatgtgatcgaaaacgaacagatggaaaatacccagagagccgaacatgaggaggggaaggtaaaggacttgctggccgaatccagactccgttacaaggactacattcagatactatctagccccaatttctcactggaccagtattgtgagcagatgtggcaccgggaaaagaggagacaacgcaacaagggtggcccaaaatggaaacatatgcaggagatgaagaaaaagaggaacaggcgccaccatcgcgacttggacgaactgccacgtgctgtggcaacctag

SEQ ID NO: 8660 - DNA, 1332 bp, Artificial Sequence
  Description of Artificial Sequence: Synthetic coding sequence
atgcagcccagcgagatggtgatgaaccccaagcaggtgttcctgagcgtgctaatatttggggttgcaggtctcctactgttcatgtacctccaggtgtggatagaagaacagcacactggtagagtggaaaaacgccgggagcaaaaggtcacctcaggctggggcccagttaaatacctgagacccgtacctcgcattatgagcacagagaagatacaggagcacattactaaccagaacccaaagttccacatgcctgaggatgtgcgggagaagaaagaaaatctcttgctcaacagcgagcgctcgactcgcctgttgacgaagacatctcactcccagggcggggaccaggcacttagcaaatccacagggagcccaaccgagaagttgatagagaagcggcaaggggccaaaacagtgttcaacaaattctccaacatgaattggccagtcgatatccacccgctcaataagagccttgttaaggacaataagtggaagaagaccgaagaaacccaggagaagcggcgctcgttcttgcaggagttctgtaagaaatacggtggagtgtcacatcatcagtctcatttgtttcacactgtctcaaggatttatgttgaggataaacacaaaatcctatattgtgaagtgcccaaggcaggctgcagtaattggaagaggatcttgatggtgttaaacggattggcaagctctgcgtacaacatctcacacaacgcggtgcattacggcaagcacctgaaaaagctcgatagcttcgatctaaaaggcatttacaccaggctaaacacctataccaaggctgtgttcgtgagggacccaatggagcgactggtctcagcattccgtgacaaatttgagcaccccaattcatattaccaccccgtgttcgggaaggcaataattaaaaaataccgccccaacgcatgcgaagaggctctgattaacggctccggggttaagtttaaggagttcatccattatctgttagattctcaccggcctgtgggcatggacatccactgggaaaaagtgtctaaactctgttatccatgcctcattaactacgactttgtcggtaaatttgagaccctggaagaggatgccaattactttctgcagatgatcggggcccctaaagaactgaagttccccaattttaaagatcgccacagctcggacgaaaggaccaacgcgcaggtggtgcggcaatatctgaaggatctgactcgcactgaacgccagctcatctatgatttctattatctagattatcttatgttcaactatacaaccccatttctgtag

SEQ ID NO: 8661 - DNA, 3228 bp, Artificial Sequence
  Description of Artificial Sequence: Synthetic coding sequence
atgcggggcggcaagtgcaacatgctgagcagcctgggctgcctgcttctctgtggaagcattacgctggccttgggcaatgcccagaagcttcccaaggggaagagacctaatttaaaggtgcacatcaacacaacctctgatagcatcctattgaagttcctgcgtccgagtccgaatgtgaagctggagggcctgctgctcggatacggatctaatgtgagtcctaaccagtattttcctttgcctgcagagggcaagttcaccgaagccattgtagacgccgagcctaagtatctcatcgttgtacggcctgctcctccaccttcccagaagaaatcctgtagcgggaagacccgctcacgaaaacccttgcagctagtggttggaaccctgacaccttctagtgtgttcctatcttggggttttctgataaacccccaccacgactggacgctcccatcccactgccccaacgacaggttttatacaatcagatatagggagaaagacaaggagaagaagtggatcttccagatttgtcccgcgaccgaaacgattgtggagaatctgaaacctaacaccgtgtatgagtttggagtgaaggacaacgttgaggggggtatctggagtaaaatcttcaaccacaagaccgtggtggggtccaaaaaggtcaatggaaagatccagtcaacctacgatcaagatcacacagtgcccgcctacgtgccccggaaactgataccaatcaccatcatcaaacaggtgattcaaaatgtgacccataaggatagcgctaagtcccctgagaaggcccccctgggaggtgtgatcctggtacatctaattatccctggactgaacgaaactacggtcaagttaccagccagtctcatgtttgaaatcagcgacgcactcaagacccagctggctaagaacgaaactttagctttacctgcagaatctaaaacccccgaagttgagaaaatttccgctcgtcctacgactgtcacccccgagaccgtcccacggtctacaaagcccaccaccagcagtgcattagatgtaagcgagactaccctggcgagtagcgaaaaaccatggattgtccctactgccaagatctccgaagactctaaagtgttgcagccacagacagcaacttatgacgtgttctcatccccaactacatccgatgagcctgagatttctgatagctacacagccacatcagatcggatcctggattccatcccccctaaaactagtcggacactggagcagcctagggctacgttggccccgagtgagaccccctttgtgccccagaaacttgagatttttacaagccctgaaatgcagcctacaactcccgctccccagcagaccacttctatcccctccacaccaaaaaggcgacctcggcccaaaccaccacgcacaaaaccagaacggaccacttcagctggaaccatcacccctaaaatctccaagtccccagagccgacttggaccactccagctccagggaaaacccaattcatttccctgaagccgaagattcctctgtctccagaagtgacacatactaagcccgcccctaaacagactcccagggcgccaccaaaaccgaagacctctcctcgacccagaatcccccagacccagcctgtacccaaggttcctcaaagagtgacggctaagccaaaaacttccccctccccggaggtgtcctatactacccctgcacccaaggatgtcctcctgccccacaagccttaccccgaagtttcacagagcgagcccgcaccacttgagacgcggggcattccctttattcccatgattagcccctccccctctcaggaggaactgcagacaacgctggaagaaaccgaccagagcactcaagagccttttaccactaaaattccacgaacgactgagttggcaaaaaccacacaggccccgcaccgtttttacactaccgtcagaccacgcacatcagataagccccacattagaccaggcgttaaacaggcacctagaccaagtggggcggatcgaaacgtttccgtcgattctacgcatccgaccaagaaacccggtactcgccgaccacctttgccgccaagacctacccacccacgcaggaagcctctgccccctaacaatgtcaccggtaagcccggtagcgcaggcataatcagctctggacccatcaccacaccccccctacgctcaacccccaggcctacgggaaccccgctggaacgtatcgagaccgacatcaagcagccaaccgtgcctgccagcggcgaagaactcgaaaacattaccgatttttctagttctcccacacgtgaaacagacccgctgggaaagccccggttcaaaggccctcacgtacgttacatccaaaagcctgataactcgccatgtagcattacggactcggtcaagcgcttcccgaaggaagaggccacagaaggtaacgctacctctccgcctcagaaccctccgacgaacctcaccgtcgtcaccgttgagggttgcccttccttcgtgatcttggactgggagaagcccctgaatgataccgtcactgagtacgaggttatctctcgggaaaatgggtcctttagcggtaaaaataagtctattcagatgacaaatcagaccttttcaaccgttgagaatctcaagccgaatacatcttacgagtttcaggttaagccgaaaaatccattgggcgagggtccagtttctaacaccgtagcattctcaacggaatccgctgaccctagggtttctgagcctgtcagtgccggaagagacgcaatttggaccgaacgcccctttaacagtgatagctatagcgagtgtaagggcaaacagtacgttaagcgaacttggtacaaaaagtttgtcggggttcagttatgcaacagtctgcggtacaagatatatctgtcggattctttgacaggaaaattctataatattggcgaccagcgggggcacggggaggaccattgccaattcgtcgattcctttctggatggtaggaccgggcaacagttgaccagcgaccagctacctattaaagagggctattttcgcgctgtgagacaggagcctgtacagttcggtgagatcggaggccacacccagatcaattatgtgcagtggtatgaatgcggtaccacaatcccaggaaagtggtag

SEQ ID NO: 8662 - DNA, 483 bp, Artificial Sequence
  Description of Artificial Sequence: Synthetic coding sequence
atgctgcccttcctgttcttcagcaccctgttcagcagcatcttcacggaggcccagaaacagtactgggtgtgtaatagttccgatgcatccatcagctacacctattgcgacaagatgcagtaccctatctccatcaacgtaaatccatgcatcgagttgaagcgcagcaaaggccttctgcacatattttacattccaagacgtgacttgaagcaactctatttcaacctgtatatcacggtaaatacaatgaatcttccaaagaggaaggaggtaatttgtagaggtagtgacgacgactattcattttgccgcgcactaaagggtgaaaccgtgaacactacaatctctttctcattcaagggaatcaagttttcaaaaggaaaatataaatgcgtcgtagaagccattagcgggagcccagaagagatgttgttctgtctcgagtttgtgatactgcaccagccaaatagcaattag

SEQ ID NO: 8663 - DNA, 780 bp, Artificial Sequence
  Description of Artificial Sequence: Synthetic coding sequence
atggccgccctgatgcggagcaaggacagcagctgctgcctgctgttactggcggcggtgctcatggtggagtcgagccagatcggttctagccgcgctaagttgaacagcatcaaatcatccctggggggggagacaccaggtcaagctgctaacagaagtgccggcatgtaccagggcctcgcctttggtggatccaagaagggtaaaaatcttgggcaagcctacccctgcagctccgataaagagtgcgaagtggggaggtactgccacagtccgcaccaaggctccagtgcctgcatggtgtgtagacggaagaagaagcgctgccatcgggacggaatgtgctgcccttccactagatgcaacaacgggatatgcattcctgtcaccgagagcatactgaccccgcacatacccgcccttgacggcactcgccatcgggatcgtaatcacggacattattctaaccatgacctcggttggcaaaatttaggtcgtccacacaccaagatgtcgcacattaagggccacgaaggagatccctgtttgcgctcttccgattgtattgaagggttctgctgtgctcggcatttctggacaaagatctgcaagccggttctacatcagggagaggtctgcactaaacagcgtaagaagggctctcacgggctggaaatctttcaaaggtgtgactgcgcaaagggccttagctgtaaggtttggaaggacgccacgtactcatctaaagcacgcctccacgtgtgccaaaagatctag

SEQ ID NO: 8664 - DNA, 3030 bp, Artificial Sequence
  Description of Artificial Sequence: Synthetic coding sequence
atgggccagctgtgctggctgcccctgctggcccccctgctgctgctccggcccccaggcgtccaatcagccggacccatcagggcttttgtcgtaccacactcccacatggacgttggatgggtgtataccgtgcaggagtcaatgcgcgcctacgccgcaaatgtctatacctctgtcgtggaggagcttgcccgcggacagcagcgcaggttcattgctgttgagcaagagttcttccgattgtggtgggatggcgtagcgtccgaccagcagaaatatcaggtgcgtcaactcctcgaagagggaagactcgaattcgtcatagggggccaagtgatgcatgatgaggccgtgacccatctggacgatcagatcctgcagcttaccgaaggccacggattcttgtacgaaacctttgggatccggccccagttctcatggcacgtggatccttttggggccagcgctacaaccccaacactgttcgccttggccggatttaatgcccaccttggaagtaggatagactacgacttaaaggcggcaatgcaagaggccagagggctgcagttcgtttggcgcggtagccccagtctcagtgagaggcaggagatcttcacccacatcatggatcaatacagctattgcacaccttcccatatccctttcagtaacagaagtggattctactggaacggggtggctgtcttcccaaagccccctcaggatggcgtttacccaaacatgtccgagcctgtgacaccagcgaatatcaatttgtacgctgaggccctggtagccaatgtgaaacagcgggctgcctggttccgtacaccacacgtgctgtggccctgggggtgtgacaagcagtttttcaatgcgagtgtgcagttcgctaacatggatcctctgttggaccacatcaatagtcatgcagctgagttaggagtgtccgtccagtatgcaaccctcggcgattacttccgcgctctccatgctctaaatgtaacatggcgcgtaagggatcatcatgactttttgccatatagtacagagccattccaggcatggaccgggttttacacctctcgctcctctctcaaggggctcgcccgcagggcatccgcattattgtatgctggtgaatctatgttcacgagatatttgtggccggctccccgtggccatctggaccctacatgggcgttgcagcaactccagcagctcaggtgggcagtgagtgaggttcagcatcacgacgcgatcacaggaaccgaaagccctaaggtcagagacatgtacgccacgcatctagccagcggaatgctcgggatgcggaagttgatggcttccattgtgcttgacgaactccagcctcaagcccccatggcagctagtagtgacgccgggcccgcaggccatttcgcttctgtctacaatccgttggcatggactgtgacaacaatcgtgacattgaccgtgggttttcccggtgtccgggttactgatgaggctgggcatccagttccttctcagatacagaacagtacggagactccatctgcgtatgaccttctcattcttaccactattcctggcctgtcctaccgccattacaatatccggcccactgctggtgctcaggagggtacgcaggagcccgccgctactgtggcctcgaccctccagttcggaaggcgtctgcggaggaggacttctcacgccggcagatatttggttccagtggcgaacgactgttatatcgtactgcttgaccaggacaccaacctgatgcattctatctgggaaagacagtcaaatcgaactgtgcgggtcacacaggaattcctagagtatcatgtcaacggggatgtgaagcagggaccgatcagtgataattatctatttacccccggtaaggccgctgttccagcttgggaagctgtggaaatggagattgtcgcaggacagttagtgacagagatccgtcagtatttttaccgtaacatgactgcacagaattatacctacgctataaggtctcgactaacccacgtcccgcagggccacgacggagaattgctgtgccatcgaatcgaacaggaataccaggctggccctcttgaactgaatcgagaggccgtgctgcgcacgagcaccaatctgaacagtcagcaggtcatctactctgacaacaatggctatcagatgcaaaggcgcccatatgtgagctatgttaacaactctatcgcacggaactattatcccatggtgcagagtgccttcatggaggatggtaaaagccgcctagtccttctcagtgaaagggcgcacgggatttcttcgcagggtaatggacaggtcgaagtcatgctgcatagacgcttgtggaacaacttcgactgggacctcggatacaacctgacgctgaatgatacaagcgttgtgcaccctgtgctttggctgcttcttggatcatggagcctgaccacggcactcagacaacgcagtgcccttgccttgcaacaccgtccagttgtgctgtttggcgatctggccggtacagcccccaagctgccgggccctcagcagcaagaagccgtgacattacctcccaacctccatctccaaattctctctatccccggttggagatattcctctaaccacacagagcactctcagaacctgagaaagggacataggggggaggcccaggcagacctgcggagagttctacttcgactgtatcacctgtacgaagttggcgaggatccagtgctttctcagccagtaacagtgaatttagaagcagtcctgcaggcactgggcagcgttgtagctgttgaggagaggagcctcactggcacctgggacttgtcgatgctccatcggtggtcatggaggactggcccaggcaggcacaggggagataccacttcaccctcaagacctccaggaggcccaataataaccgtccatcccaaagaaataaggacttttttcattcattttcagcagcagtag

SEQ ID NO: 8665 - DNA, 1443 bp, Artificial Sequence
  Description of Artificial Sequence: Synthetic coding sequence
atgctgttccggaaccggttcctgctgctgctggccctggccgccctcctggcattcgtctctctgtctcttcagttttttcatctcatacccgtgtccaccccaaagaacggaatgagttctaaatcaagaaagaggattatgcccgaccccgtgacagagcccccagttactgacccagtctatgaggctctgctctactgcaacattccatccgtcgcagaacgatccatggagggtcatgctccccatcattttaaactcgtctccgtgcatgtgtttatcagacacggggaccggtacccactgtacgtcattcccaaaacaaagcgcccagagatcgactgcaccctagtcgccaacaggaagccctaccacccaaaactggaggctttcattagccacatgtccaaggggagtggtgcctctttcgagtctcccctcaacagcttgcccctctaccccaatcatccactatgcgagatgggggagcttacccagactggtgttgtgcagcatcttcagaatgggcagctgctccgggatatttatttgaaaaaacataagctgctgcctaacgactggtctgccgaccagttgtaccttgagacaaccgggaagagcaggaccctgcaaagtgggctggccctgctttacggatttctaccagactttgactggaagaagatatactttcggcatcaacccagcgctcttttttgctccgggtcctgctactgcccagttaggaaccaatacctggaaaaggaacagagacggcagtacctgctgaggttgaagaactctcaattagaaaaaacttacggagaaatggctaagatcgtggatgttcctacaaagcagctaagagccgcgaatccaatagacagtatgttgtgccacttctgccacaacgtttcttttccttgtactcgaaacgggtgcgtggatatggagcatttcaaagtaataaaaacccaccagatagaggacgaaagggagaggcgggagaagaaactgtactttgggtactcacttttaggggcccacccaattcttaaccagaccattggacgcatgcaacgtgccacagaggggagaaaggaggagctctttgccctctattccgcacacgacgtgaccctgtcacccgtattaagcgccctgggccttagcgaagccaggttccctcgcttcgctgctagactcatatttgagctgtggcaggaccgggagaagccttcagaacattctgtccggattctgtacaatggtgtagatgtcacttttcacactagcttctgtcaggatcatcataaaagatcaccaaagcccatgtgtcccctcgaaaatctggtgaggtttgtgaaaagagatatgttcgtggccctcgggggatccggcaccaattattatgacgcgtgtcaccgggaaggcttttag

SEQ ID NO: 8666 - DNA, 1341 bp, Artificial Sequence
  Description of Artificial Sequence: Synthetic coding sequence
atgctgcaccccgagaccagccccggccggggccacctgctggccgttttgctcgcactcttggggacggcatgggccgaagtctggcctcctcagctgcaggagcaggccccaatggccggcgccctgaaccgcaaagaaagcttccttctgctatccctgcacaacaggctgagatcttgggttcagcccccagccgccgatatgcgcaggttggattggtctgattcattggcgcagctggcccaggcaagggccgccctgtgcggcactccaaccccctccctggcaagtggcctttggagaactctgcaggtcggatggaacatgcagctgttaccagcaggcctagttagctttgttgaagtggtctccctatggtttgccgaaggccagaggtattcacacgctgcaggcgaatgtgctagaaacgctacatgcactcattacactcagctcgtctgggctacttcctcacagttgggctgtgggcggcatctgtgctctgcaggtcaagccgccatagaggccttcgtttgtgcatactcgccccgaggcaactgggaggtgaacggtaaaactatcgttccttacaaaaagggagcctggtgctcgctgtgtaccgcaagtgtcagcgggtgtttcaaagcctgggaccacgctggcgggctgtgcgaagtgcctcggaatccctgtcgtatgagttgtcagaaccacggccgccttaatatctcaacctgccactgccactgcccacctggttacactgggagatactgccaggtccgctgctcgcttcagtgcgtccacggcaggtttcgagaggaggagtgctcttgtgtgtgcgacatcggatacgggggcgcgcagtgtgcaaccaaagtgcactttcctttccacacgtgcgatttgcgtattgacggggattgctttatggtctcatcagaagcagatacatattatcgtgcacgcatgaaatgccagcggaagggtggcgtcttagcgcagataaaatcacagaaggtgcaagatatccttgcattctacctcggtcgtctagaaaccaccaatgaagtcattgattctgattttgagaccaggaacttttggatcggcctcacctacaagactgccaaagattcattcagatgggccacaggcgagcaccaggctttcacaagctttgcgttcgggcagcctgataaccatggttttgggaactgtgtcgagctgcaggcctcagctgccttcaactggaacgaccagcgctgcaaaactagaaataggtacatatgtcagtttgcccaagaacacatttccaggtggggcccaggatcctag

SEQ ID NO: 8667 - DNA, 2313 bp, Artificial Sequence
  Description of Artificial Sequence: Synthetic coding sequence
atggtggagagcgccggccgggccggccagaagcggcccggcttcctagaaggaggccttctgctcctcctgttgctggtcacagcagccttagtggccctcggcgtgttatacgctgaccgcagaggtaaacagctgccgcggctggccagccggctgtgcttcctgcaggaagagagaacctttgtgaaacgtaaaccacgaggaatacctgaagcacaggaggtcagcgaggtatgtaccacaccaggttgtgtcatagccgctgctcgcattctgcaaaatatggaccccaccacggaaccttgtgacgacttctatcagtttgcttgcggcggttggctgcgccgccacgtgatccccgaaaccaattctcgctacagcatttttgatgtgctgagggacgagttagaggttatcctgaaggccgtgctggaaaatagcactgccaaggatcggcccgccgtggaaaaggcgcggaccctttatcgttcttgtatgaaccagagtgttattgagaagcgcgggagccaacctctcctcgacattctggaagtagtgggaggttggcccgtcgcgatggaccgttggaacgaaaccgttgggctggaatgggagctcgagcggcagctcgcgctcatgaatagccagttcaatcggcgggtcttaatcgatcttttcatctggaatgacgatcagaacagctcccgacatataatctacattgaccaaccaactctgggcatgccttcccgagagtactacttcaacggggggtccaatagaaaagttagggaagcttacctccaattcatggtgtccgtcgcgactctgttgagggaggacgccaacctgcctagggatagttgtttggtacaggaagacatggtgcaggttcttgagctggagacacagctggctaaggcaaccgtgccacaggaagagcggcatgatgtgattgccctgtatcaccggatgggtctggaggagctgcagagtcagtttggactgaaaggctttaactggaccctgtttattcagacagtactgtcaagcgttaagataaagttactgcctgatgaagaagtggtggtgtacggtatcccatacctgcaaaacctggagaacatcatcgacacttacagtgctcggacaatccagaactatttggtctggaggcttgtgcttgacagaataggatccctatctcaacggttcaaagatacacgtgtgaactataggaaagcacttttcggaaccatggttgaggaggtacgttggcgtgagtgtgtgggatatgttaactcaaacatggagaatgctgtcggttctctgtacgtgagagaggcattccctggagattctaagtctatggtcagggaactgatagataaagttagaaccgtgtttgtggaaacacttgacgagctcggctggatggatgaagaatccaagaaaaaggcccaagagaaggccatgagtatacgagaacagatcggccaccccgactatattctggaggagatgaatagacggctggacgaggagtactctaacctgaacttctcagaagacctgtatttcgagaacagcttgcagaatctgaaggtcggcgctcagaggtcactgagaaaacttcgcgagaaagtggatccaaacctttggatcattggagcagctgtcgtgaacgccttctactcacccaatcggaaccagatcgtgttcccagctggtattttgcagccgcccttcttctctaaagaacagccccaggcgttaaatttcggcgggattgggatggtgattggacacgaaattacccatggctttgatgacaatgggaggaatttcgataaaaatggaaatatgatggactggtggtcaaattttagcactcagcactttagggaacagagcgagtgtatgatctatcagtacggcaattatagctgggatctcgccgacgaacagaatgtgaacggattcaataccctgggtgagaatatcgcggacaacggcggagtgcggcaagcttacaaagcctacctgaagtggatggctgagggaggtaaagaccagcagttgccaggccttgatctcacccacgaacagctttttttcatcaattacgcacaggtttggtgcgggtcctaccgccccgagtttgccatccagtcaatcaagacagatgtacattcgccactgaagtaccgagtgttggggtccctccagaatctggccgcctttgccgatacatttcactgtgcacgcggcactcctatgcatccgaaagaaagatgtcgggtctggtag

SEQ ID NO: 8668 - DNA, 1317 bp, Artificial Sequence
  Description of Artificial Sequence: Synthetic coding sequence
atgagcaagcgggacaaggccggcaaggacaccgcccggggcaaggggaaggacatatctaagtatggatcagttcaaaaatctttcgccgacaggggactacccaaacctcccaaggagaagctccttcaagttgaaaagctaagaaaagagagcggcaaaggatcatttctgcagcctacagccaaacctcgggcactggcacaacaacaggccgtcatcaggggctttacgtactataaagcgggtaagcaggaggtcaccgaggctgtggcagataatacgcttcagggaacctcttggttggagcaactgccgcctaaggtggaggggcggagtaactccgccgaacctaattcagcggaacaggatgaggcggagccgcgttccagtgaacgcgtggacctggccagcggtaccccaacctcaattcccgcaacaacaacaacggctacgactacccccacacctaccacttccctgctacctactgaaccaccatcagggcctgaggtatccagccagggccgcgaagcctcatgtgagggcacacttagagccgtggacccaccggtccgccaccatagctatgggagacacgagggcgcctggatgaaggacccggcagctcgtgatgaccggatatacgtgaccaattactactatggcaatagcctggtcgaattcaggaatcttgaaaatttcaaacagggacggtggagcaatatgtataagctgccctataactggatcgggaccggtcatgtggtctatcagggagccttctactataatagagcctttactaagaacatcataaagtacgatttgcggcaacgcttcgtcgcatcatgggccttactgcctgatgtagtctacgaagacacaaccccatggaagtggcgggggcacagcgatatcgacttcgccgtcgatgagtcagggctgtgggtaatttaccctgcggtagatgatagggatgaggctcaaccggaggtcatcgtactttctcgcctcgaccccggcgatctctcagtgcacagggagaccacgtggaaaaccaggctgcgtagaaattcctatgggaattgctttttggtctgtggcatcttatacgctgtggacacatataaccagcaggaaggccaggtcgcctatgcctttgatacccacactggcaccgatgcgagaccccagctgccctttctgaacgagcatgcatacacgacccagatcgactataaccccaaggagcgcgtcctgtacgcatgggacaatggtcatcagctgacctacactttgcacttcgttgtttag

SEQ ID NO: 8669 - DNA, 3570 bp, Artificial Sequence
  Description of Artificial Sequence: Synthetic coding sequence
atgcccggcctgctgaactggatcaccggcgccgccctgcccctgacggcttctgacgtgaccagttgtgtatctggctatgcgctgggtttgacggccagtctcacatatggaaacctggaggcacagccatttcaaggtctgtttgtgtacccactcgatgagtgcacaaccgttatcggattcgaagcggtgatcgcagaccgcgtagtgaccgtccagatcaaggataaggctaagctggaatcaggacatttcgatgcctctcacgtgcggtctccaaccgtgaccggcaatatcctccaggacggcgtgagcatcgctcctcattcctgcactccaggcaaggtgaccttggatgaggatctcgagcggattctctttgtagcaaacttggggaccatcgcccccatggagaatgtgacgatcttcatatcaacaagcagcgagctgcctactttgccttcaggggccgtgcgcgttttgctaccagctgtttgtgcgcctactgtgccccagttctgcacaaagtctactggcacttccaatcagcaggcacagggcaaagatcggcattgctttggagcctgggctcctggctcctggaacaagctgtgtctcgccaccctgctgaataccgaggtatcaaacccgatggaatacgaattcaactttcagcttgagattcgaggcccttgtttactggctggtgtggagtcaccaacccatgagattagagcggacgctgctcctagcgcccgctccgcaaagtctattattatcaccttagcgaataagcacacatttgacaggcccgtggagattctgatccacccaagcgagccccacatgccacacgttctgatcgaaaagggtgatatgactctgggagaatttgatcaacatctgaaggggcgcaccgatttcataaaaggaatgaaaaaaaaaagcagggccgagcggaaaacggaaatcattagaaagcgcttgcataaggacataccacaccattcagtcataatgctgaacttctgccctgatttgcagagtgtgcaaccatgcttgcgcaaggcacacggcgagtttatctttctaatagacagatcttccagtatgtccggaatcagcatgcatagagtgaaagatgccatgctggtggcccttaaaagtttgatgcctgcttgtctgtttaatattattggctttggatcgacttttaaaagcctctttccttctagtcagacttattccgaggatagccttgcaatggcctgtgatgatatccaacggatgaaggctgacatggggggaaccaatatcctgtcccctttaaagtgggtgatcaggcagccagttcaccggggacatccacgcttactgtttgtgatcacagacggcgcagtgaataacaccggcaaagtgctagagctggtgcgcaaccatgcttttagtacccgctgctactcctttggcattggcccgaacgtgtgtcaccggttggtcaagggcctcgcctcagtgtccgaaggctctgctgaattgctgatggaaggtgagcgcctgcagcctaagatggttaaatcgctcaaaaaggcaatggcccctgttctctcggatgtgacggttgagtggatcttcccggagacaaccgaggtgctggtgagccccgtctctgcgagcagtctgttcccaggagagaggttggtcgggtacggcattgtgtgcgacgcttcattgcacatctcaaacccacggtccgataagagaaggcggtactccatgctgcatagccaggagtcggggtccagtgtgttttaccactctcaggacgatggtcctggactggaaggtggggattgtgctaagaattccggagcccctttcatcctaggccaggcaaagaacgctcgtcttgctagcggtgattcgaccacaaagcatgacttgaacctgtctcaacgcagacgtgcatactccacaaatcagatcacaaatcataagccactgccaagggctactatggcttccgacccaatgcccgcggccaaaagatacccgcttcgtaaggcccgcctccaggacttaactaaccagacaagcctggacgtacagcgatggcagatagacctccagcctctcctgaactccggacaggacctgaatcagggcccaaagctgcggggtccgggagctcgtcggccatcactcttgccccagggatgccaaccattccttccctggggccaggagactcaggcatggtcaccagtacgggagcgtacctcagattctagaagcccgggggatctggagccatcccatcacccgtcagcttttgagaccgaaaccagcagtgactgggacccccctgctgagtcgcaagagcgagcctccccttctagaccggcaaccccagctcctgtgctcgggaaggccctcgttaagggattacatgatagccagaggctacagtgggaggtcagcttcgaacttggaactccaggacctgagcgaggaggcgctcaggacgccgacctctggtcagagacatttcaccacctagcagcccgggccatcatccgagactttgagcagcttgcggaacgtgaaggtgaaattgaacagggatcgaatagacgttaccaggtcagtgccctacacactagtaaggcctgcaacattatctccaaatatacagcattcgtccccgtggatgttagcaaatcccgatatctgcctacggtggtagaatatccaaattccgcggccctgaggatgctcgggtcacgcgctcttgcccagcagtggaggggtactagctcagggttcggaaggcctcagacaatgttaggtgaggatagtgcccctggaaatggccctcagcggtcactggcaaccaatacattgtcatccatgaaagcctccgagaacctgttcggaagttggctgaacctgaacaagtctaggctcctcacccgtgctgccaaaggctttctttccaagccactgatcaaggctgtggagagcacgagcgggaatcagagcttcgactatatcccgctggttagcctgcagctggccagcggagctttccttctgaatgaggcattctgcgaggctactcatattcccatggaaaagctcaagtggacaagcccctttacttgtcacagagtgagccttaccactagacccagtgagagtaagacaccaagtccacagctatgtacttcctcacctcctcgccatccctcctgtgactccttcagcctagaaccattggctaagggcaagctggggcttgagccacgcgcggtggtggaacacacaggtaagttgtgggcaactgtggtaggattagcttggctggaacattcaagtgcctcctatttcacggagtgggagcttgtggctgcgaaggcaaattcctggctggagcaacaggaagtgccagaagggaggactcaggggactctgaaagcggccgctcgacagctctttgtgcttctgcggcactgggacgagaatctggaatttaatatgttgtgctacaatcctaattacgtgtag

SEQ ID NO: 8670 - DNA, 1344 bp, Artificial Sequence
  Description of Artificial Sequence: Synthetic coding sequence
atgccccacgtgctgatcgagaagggcgacatgaccctgggcgagttcgatcagcatctcaaagggcggaccgatttcatcaaaggaatgaagaagaaatcacgtgcagagcgtaaaacagagatcatccggaagcggctccacaaagatattcctcatcatagcgttattatgttaaatttctgtccggacctgcagtctgttcagccgtgtttgcgcaaggcacacggcgagttcatcttccttatagaccgcagttcgagtatgtcaggcataagcatgcatcgtgttaaagatgcaatgttagtggctttgaaaagcctcatgcccgcctgcctctttaatattatcggattcggatccaccttcaaatccctgttcccttcgagccagacctattcagaggactctctcgccatggcatgcgacgatattcagcggatgaaagcggatatgggaggcactaacatcttatcacccctgaaatgggtgatcagacagcccgtgcacaggggacaccctcgtctcctattcgtgatcactgatggcgccgtgaacaataccggtaaggtgctggaactggtacgcaaccatgcgttctccactaggtgttactcattcgggataggtcctaacgtttgccaccgactggtgaagggcctggccagtgtgagtgagggctccgccgaactgttaatggaaggggaacgattgcagcctaagatggtcaaatcactgaagaaagctatggcccccgtactgtcagatgtcactgtggaatggatttttccggaaacaaccgaggtgcttgtgtcacccgttagcgctagcagcctgtttccgggagagcgcctggtgggttacggcattgtatgcgacgctagtctccacatttcgaaccctcgaagtgataagcggcgcagatactccatgctgcacagccaagagtcaggatcttccgtcttttatcattcccaggacgatgggcccgggctcgagggcggggactgcgccaagaattccggggccccttttatcctcgggcaggcaaagaatgcccgactcgcctccggggacagcaccaccaaacatgatctcaacctgtcacagagacgtagagcttattctactaatcaaattaccaatcataaaccgttgccaagggctacaatggcctccgaccctatgccggcagcgaagcggtaccctctgaggaaggccaggctgcaagacctcactaaccagacttctttggatgtgcaaaggtggcagattgatctgcaggccttcatctgcttaacttccgaagacacattccagatccgcacccccaccggccaatag

SEQ ID NO: 8671 - DNA, 726 bp, Artificial Sequence
  Description of Artificial Sequence: Synthetic coding sequence
atgtggaccgtgcggaccgagggcggccacttccccctgcacagccccactttttcatggagaaatgtggctttcctgctgctgctttccctggcactggagtggacatctgcaatgcttacgaagaagatcaagcacaaaccagggttgtgtcccaaagagcggttaacctgtacaacagaactgcctgatagttgtaatacggactttgactgtaaagaatatcagaagtgttgcttttttgcctgtcagaaaaagtgcatggatcccttccaagaaccttgtatgctgcctgtccgacatggcaactgcaatcatgaggcacagcgctggcattttgattttaaaaactacaggtgcacccctttcaaatatcgaggatgtgaaggtaatgccaacaattttctgaacgaagatgcctgtcggaccgcgtgcatgcttatcgtgaaagacggacagtgccccctgtttccctttacggagagaaaagagtgtcctccgtcttgtcactcagacatcgactgcccgcagaccgacaaatgctgtgagtctagatgtggctttgtctgtgcacgtgcctggacggttaagaagggattctgtcccaggaagccactcctgtgcaccaaaatagataagccaaaatgcctccaagacgaagagtgtcccctggtcgagaaatgttgcagccattgcggcctcaagtgtatggatccccggcgctag

SEQ ID NO: 8672 - DNA, 1074 bp, Artificial Sequence
  Description of Artificial Sequence: Synthetic coding sequence
atgcggcccccccccgccctggccctggccggcctgtgcctgctggccttgccagctgctgcggcttcttattttgggctgaccggaagagaggttctcaccccctttccaggcctgggaaccgcggctgccccagcccaaggtggggcccacctcaaacagtgtgaccttctgaagctttctcgaaggcagaaacagctgtgtcgccgcgaaccaggcctggcggagactctgcgggacgcggcccatctgggactgctcgagtgccaattccagtttcggcatgagagatggaattgctcactagaaggccgaatgggacttcttaagcgtggctttaaggagactgcctttctttatgccgtcagcagcgctgctttgacccacactctggctagggcttgcagcgcagggagaatggaaagatgcacctgtgacgacagtcctggcctagagtccaggcaggcctggcagtggggcgtgtgcggtgacaatctgaagtatagcaccaaattcctgtcaaatttcctgggtagtaaaagagggaacaaagacctgagagcccgcgccgacgcccataacacccacgtcggcataaaggctgtgaagtctggtctacggaccacatgtaaatgtcacggagtgagtgggagctgtgccgtgcgtacatgctggaaacagcttagtcctttccgcgagactggtcaggttctcaaattgcggtatgattcagcagtcaaggtctctagcgctacaaacgaagctctgggccggctcgagttgtgggcccctgcccgccagggctccctaaccaagggtttagcccctcgtagcggcgatctggtgtatatggaggattcaccgtctttctgcagaccttctaagtactctcctggcactgcaggacgcgtctgctcaagagaagcttcatgctctagtctctgctgcggaagggggtacgatacacaaagcagactggtcgccttcagctgccattgccaggtgcaatggtgctgttatgtcgagtgtcagcagtgtgtacaggaagagctggtctatacttgcaaacactag

SEQ ID NO: 8673 - DNA, 810 bp, Artificial Sequence
  Description of Artificial Sequence: Synthetic coding sequence
atggtgcggtgcctgggccccgccctgctgctgctgctgctgctggggtcagcgagcagcgtaggaggaaatcgttgtgttgacgcggctgaagcctgtacagccgacgcccgctgtcagaggctcagatccgaatacgtggcccaatgtctcggcagggcagcccagggcgggtgtccgagagcccgctgtcgccgagctctcagaaggttctttgctaggggtcccccagcactaacccatgctctgctcttttgtccttgcgctgggccagcctgtgcagagcgcagacgacagaccttcgtgccttcgtgcgccttctccggccccggaccagctccaccaagttgtctggaaccgctgaatttttgtgagaggtctagggtctgcaggccaagactgctagcatttcaggtcagctgtactccagctccttctgcccccgacgggtgtttgcttgaccagggagctagatgtttgcgcgcgtatgcaggactggttggaacagcagtgactccaaattacgtcgacaacgtgagcgctagagtggcaccttggtgtgactgcggggcaagtggaaatagacgagaggattgtgaagccttccggggccttttcactaggaatcgctgtctagacggagctatccaggcgtttgcctctggatggcccccggtactacttgatcagctgaaccctcagggagacccagagcatagcttgcttcaagtctccagcacaggccgcgcactcgagaggaggtctctcctgtctatcctccccgtgctggcactgcccgctcttttgtag

SEQ ID NO: 8674 - DNA, 1728 bp, Artificial Sequence
  Description of Artificial Sequence: Synthetic coding sequence
atgagcggcaactgggtgcaccccggccagatcctgatctgggccatctgggtgttagccgcgcctaccaaagggccatcagcagaaggcccacaacgtaacactagactcggctggattcaggggaagcaggtgacagtcttgggtagcccagttcctgttaatgtgttcctaggagtgccctttgcagccccgccactgggctcactccgctttactaatccacagcctgctagcccttgggataaccttcgagaggccaccagttatccaaacctgtgcctacagaactctgaatggctcttgctcgatcagcacatgttaaaagtgcattaccccaaatttggcgtatcagaggactgtttatacctgaacatttacgccccagctcacgctgatactggatccaagctgccagtgctggtgtggttccctgggggcgccttcaagacaggtagcgcatccatctttgatgggtccgcactcgctgcctacgaggacgtgcttgtggtggtggtacaatatagactgggaatttttgggttcttcacaacctgggaccagcatgcaccggggaattgggctttcaaagaccaggtggctgccctcagctgggttcaaaagaacatcgaattcttcggcggggacccttcctccgtgaccattttcggcgaatccgctggcgccatttcagtcagctcgctgatcctttcaccaatggctaaggggctgtttcataaggctatcatggagagcggcgtcgcaatcatcccttatcttgaagcacatgactatgagaaaagtgaggacctgcaagtggtagcgcatttttgcggaaacaacgcatccgattccgaggcattactgcggtgtttgcgaaccaaaccctcgaaagaattgctgactctctctcaaaagaccaagagtttcaccagagtggttgatggagccttttttcctaatgagcctctcgatctcctgtcccagaaggcattcaaagcaattccgtccataattggagtgaataaccatgagtgcggctttcttctgcccatgaaagaagctccggagatcttgtccggctccaataaatccctcgcgttgcatctgatacagaatatccttcacatcccccctcagtatttgcatctggtggccaacgagtacttccacgacaaacactccctgacggagattcgcgattcgttactggacttattgggcgatgtgttctttgtggtgcctgccctaattactgcccgatatcatcgcgacgcaggcgcacccgtgtatttctacgagtttcgccacagaccccagtgctttgaagataccaagccagcatttgtgaaagccgaccacgcagatgaggtgcgcttcgtattcggcggggctttcctcaagggcgatatcgtgatgttcgagggggccaccgaggaggagaaactgctttctcgaaagatgatgaagtattgggctacctttgccagaaccgggaatccaaatggaaacgacttgagcttgtggccagcttataatctcaccgagcagtacctgcagctagacctcaatatgagtctggggcagcggctgaaagagcctagggtggatttttggacctcaactataccactaattctatctgcatccgatatgctgcacagtcctctgtcaagtcttactttcttgtccctgctccagcccttctttttcttttgtgccccttag

SEQ ID NO: 8675 - DNA, 1026 bp, Artificial Sequence
  Description of Artificial Sequence: Synthetic coding sequence
atgggcaccctgccctggctgctggccttcttcatcctgggcctgcaggcatgggacacacccactattgtaagcagaaaagagtggggtgcacggcctctcgcatgtagggcacttctcacactgcctgtagcctacataataactgatcagctcccaggtatgcagtgtcagcagcaaagcgtgtgttctcagatgctccgagggctgcagagtcactcggtatacaccataggctggtgtgatgtcgcgtacaacttcctcgtgggagacgatggacgagtctacgaaggggtaggctggaacattcagggcctgcatacgcaagggtataataacatttcgcttggtatcgcttttttcggaaacaagattgggagtagcccatctcctgccgcactgtccgctgccgaagggctgatctcttacgccatccagaaagggcatctgtcaccaagatatatccagcccctcctcctcaaagaggaaacctgtctcgatccccaacaccccgtgatgccacgaaaggtctgtcctaacatcatcaaacgcagcgcatgggaagcccgtgagactcactgtcccaaaatgaacctgcccgccaaatacgtaatcatcatacacactgccggaacctcttgtacggtgagtacggactgccagacagttgtacggaatattcagtcctttcatatggatactcggaacttttgtgacattggatatcacttcctggtaggccaggacggcggcgtatatgaaggagtcggatggcacattcaggggagccacacctatggctttaacgacattgctctcggaatcgcctttatcggatactttgtggagaagccgcccaacgccgccgctctggaagctgcacaggatctgattcagtgtgccgttgtggaagggtacttgacaccgaactatctcttaatggggcactccgacgtggtgaatatcctgtcaccaggtcaagccctatacaacataataagcacgtggcctcattttaaacactag

SEQ ID NO: 8676 - DNA, 897 bp, Artificial Sequence
  Description of Artificial Sequence: Synthetic coding sequence
atgggcatcgtgtgcgcccagtgcagcttcatcctgctgctgagcatcattagagcaaggcccccaccgtttctcttctgccctctcagttcacagaggaccgaaagcccctataagcccgtccacttgggactcggccctactgacaaagtggccgcgatcgccatggcaagaataatagacttggttccgtgggatgacggttcaacccatgtctatgccagtcctgcaatcttgcttccaatggagcgccagcgcaaccaacttgctggtgtgaaacagcaactgtaccaccctgccctgcccactttgagacacatggaccgcgacacagtcaaagcatgtctgccagatgagcattgtcagtctacaacgtattgccggaaggacgaattcgataatgcacattttactctgctcggtgttccgaacaaacccctgcagtgtctggacatcaccgccacgggacagaagctgcgaaatcgataccatgaagggaaacttgctcccatcgccccaggcattaaccgagtcgactggccctgctttacccgcgcaatcgaagactggtcccatttcgtgagctctgcaggtgagttcaagcttccatgccttaggaagcgggccgaagggctcagcggctacgccgtacggtatctgaagccagatgtgacacaaacttggcgccaagaggctctttgcggggcgtgggccggccgcccttgttctcccgattctcccagaccgtacccctgctgcccaccccagtactgcctgagtcagaacccttcactggataggtacggccagaaacccttgccttttgacagtctgaacacatttagatcattcggttcctcctactctcgggtcaactacctgaccccatggcattag

SEQ ID NO: 8677 - DNA, 5799 bp, Artificial Sequence
  Description of Artificial Sequence: Synthetic coding sequence
atggcccccggcgccctgcggggcggctgcgagcagcgggcccccggtgggggcgctcgcactgctgctttaggcccatggccgtggcctagtcctgggccagccccctccccaggtgctgcaccacccagaagcagaaagatgagtggagcattgctgtggcccctgctgcctctgcttttgctgctgctcagcgcccgcgacggcgtgcgggccgcccagcctcaggcgcctggttacttgatcgcagccccgagcgtgttcagagcaggagtagaggaggtcattagcgtcaccattttcaattctcctagagaggtgacagtccaggcccagctggtggcgcaaggagaaccggtggtacagagccagggggctatacttgacaaggggacgattaaactgaaagtgcctaccggtctgcgcggccaggccctccttaaggtttggggaaggggatggcaggccgaggaaggtccactgtttcataatcagacctcagtgacagtcgacgggagaggcgctagtgtttttatccaaaccgacaagcctgtgtacaggccccagcatcgggtactgatctccatctttaccgtgagtcccaacctgcggccagtcaacgaaaagcttgaggcttacattctcgacccccgcggctcaaggatgattgaatggagacacctgaaaccgttttgctgcgggatcaccaatatgtccttccctttgtctgatcagcccgtgctgggcgaatggttcatattcgtagagatgcaggggcacgcttataacaaaagtttcgaagtgcagaaatatgttctgccaaagttcgaactgcttattgatcccccccgctacatccaggatctagatgcgtgcgaaaccggcacggtgcgggctagatacactttcggaaagcccgtggctggcgcactcatgattaacatgaccgttaatggtgttggttattatagccatgaggtggggcgtccagtgttgcggactacgaaaatcctaggctctagggactttgatatttgtgtgcgggacatgattccagcagatgttcctgagcatttccgtggtcgtgtgagcatctgggccatggtgactagtgtggacgggtcccagcaggtggcttttgatgactcgactcccgtgcaacggcagcttgtagatatccgctattctaaagacacacggaaacagtttaaacctggactcgcctacgtcggcaaggtggagctgagctatcccgacggttcccctgcagaaggtgtgactgtgcagattaaggccgagctcacaccgaaggataatatatacacgtctgaagtggttagccagcggggtttggttggatttgagatcccttccattcctacttccgcccagcacgtgtggctggagacaaaggtcatggccctcaacggtaaacctgtgggcgcacagtaccttccatcttacttgagtcttgggtcctggtactcaccctcccagtgttacctgcaactccagccaccctcccaccccctgcaggttggtgaggaagcttacttttctgtgaaatctacctgcccctgtaacttcaccctgtactatgaggttgcagctaggggtaatatagtgctctctgggcagcagccagctcacaccacccagcagcgcagcaagagagctgccccagcactagaaaagcctatacggcttacacatctgtccgagacagagccccctcctgcccccgaggccgaggttgatgtatgcgttacttcactgcatctggcggtaacaccgtcgatggtacctttaggtcgtctgctagtgttctacgtccgcgaaaacggagagggagtggcagacagccttcaatttgcagtggagacattctttgaaaatcaggtctcagtgacctactccgccaacgaaactcaaccgggtgaagtggtggatcttagaatacgggcggcccgtggtagttgcgtgtgtgtcgcagccgtcgataagagtgtgtacctccttaggtcaggctttagactgacaccagctcaggtgtttcaagaactggaggactacgatgtgagcgactcttttggggtgtcccgagaggacgggccgttctggtgggccggactcactgcccagagaaggagacgatcaagcgtgtttccttggccttggggaattacaaaagattccggctttgcctttacagagacaggtctcgtcgtgatgaccgatagggtcagcctcaatcacaggcaggatgggggcctctatacggatgaagcggtccccgctttccagccacatacggggtcacttgtggctgtcgctccctctcggcaccctccaagaacagagaagcggaagaggactttcttccccgagacctggatctggcactgtctgaatatcagtgacccttcaggcgaagggactctatcagtcaaggtgcccgactctattacctcctgggtaggcgaagctgtcgcactgagcacgagtcagggactcggcattgcggagccttctctgcttaagacttttaaacccttttttgtagacttcatgctgcctgccctgattattaggggagagcaggtcaagattcctctgtcagtgtacaattatatgggcacttgcgcagaagtgtacatgaaactctcagtgcctaaaggcatccaatttgtcgggcatccaggaaagaggcacgtcacaaagaagatgtgcgtggcacccggggaggccgaaccaatctgggtggtcctcagtttctcggacctgggactcaacaacataactgcaaaggccttggcctacggagatactaattgctgtcgcgatggacgaagttctaaacaccccgaggagaaccacgcagataggcgcgtgccaatcggggtcgatcacgtcaggcggagtgtgatggttgaggccgagggggtcccccgagcttacacctacagcgcattcttttgcccaagcgaaagggtacatattagcacccctaataaatacgaattccagtacgtccaaaggcctttgcggctgacccggttcgatgtggctgttagagcacacaacgacgcaagagtcgccctgtcaagcgggccccaagacactgccggcatgatcgagatcgtgctgggcggccaccagaacacccgctcgtggattagtactagcaaaatgggtgagcctgtcgcatccgcccacaccgcgaagatattgtcatgggacgagtttcggacattttggattagctggcgtgggggattaatccaggtcggtcatggccctgagcctagtaacgagtcagttattgtggcgtggacactcccacgccccccagaagtgcagttcattggattttcaaccggatggggaagtatgggagagttcagaatttggaggaagatggaggttgacgagtcctattccgaggcctttactctgggtgtcccacacggagctatccccgggtctgaacgggccaccgcttccataataggggacgtgatgggccccactctgaaccatctgaataatcttttgcggctgccatttgggtgcggggaacaaaatatgatccactttgcccccaacgtgttcgttttgaaatatttgcaaaaaactcagcagctgtccccggaagtggaacgcgaaaccactgattatctggtgcagggataccagagacagctgacctacaagcgacaggatggctcttactccgcttttggagagcgtgacgcaagcggctctatgtggctcaccgccttcgttctgaaatcattcgcacaagcaagatcattcatctttgtagaccccagagagctggccgcggccaagtcgtggatcatccaacagcagcaggccgacgggtcattcttggctgtgggcagggtccttaataaagacattcaaggaggcattcatggtaccgtcccgctcacagcctatgtcgtcgtggctcttctggaaacaggcactgcatcagaagaagagagagggtctacagataaggcccgacatttccttgaaagcgctgcccccctcgcgatggatccttattcgtgcgccctcacaacctatgcactgactcttttgaggtctccagctgctccggaggcattacggaagcttcgctcattggctatcatgcgcgacggcgtgacccattggtccctgagcaacagctgggacgtggataaaggaaccttcttatcattttccgaccgggttagccaaagcgtcgtatctgccgaagttgaaatgaccgcctacgcactccttacttatacactcctaggcgatgtggccgcagcgctgccggtggtaaaatggctttcccagcagcgcaacgctttgggcggttttagcagtacacaagatacttgtgtagctctgcaagccctggccgagtacgctattctgtcctatgctggaggcatcaatctgacagtttctctggcgtctaccaatttggactatcaggagacgttcgagctgcacaggaccaatcaaaaggtgcttcagaccgccgccatcccaagccttcctacaggtctctttgtgtcagccaagggcgacggctgttgcctcatgcaaatcgacgtaacatacaacgtccccgacccagtggcgaaaccggccttccaactactcgtcagtctgcaggagccggaggcccaagggagaccccctccaatgcccgcttctgctgctgaaggctccagaggagactggcctccagccgatgacgacgatccagccgctgaccagcaccatcaggagtataaggtcatgctggaggtgtgtactcgttggctgcacgctggaagctcaaacatggccgtcttagaggttcccctgctgagtgggtttcgagctgatattgagtccctcgagcagctgctgttagataagcacatgggaatgaagagatacgaagtggctgggaggcgcgtgctcttctactttgatgagatcccctcaaggtgcttgacctgtgtgcgatttcgagccttgagggagtgtgtggttggccgaaccagtgcactgcccgtttcagtttatgactactacgaaccagcattcgaggctaccaggttctataatgtgagcacacatagcccgttagcacgcgagctctgcgctggtcctgcctgtaatgaagtggaaagagctcctgctcggggcccaggatggtttcctggcgagtctggccccgccgtcgcccctgaagagggcgcagcaatagctcgatgcggatgtgaccacgactgtggggcacagggcaatccagtctgtggtagcgatggggtcgtttacgcctcagcctgccggcttcgggaggcagcgtgtaggcaggctgcgcccctggaaccagcacctccaagttgttgtgccctggaacagaggctcccggcctcttcatcttcaacttatggagatgacctggcctctgtggctcccggacctctgcagcaggacgttaaactcaatggggctggtcttgaggtggaggattctgaccccgagcccgaaggagaggcagaggatcgggtgacagccggtcctaggcctccagtgagttcgggtaacctggagtcatccacacagagtgcaagtcccttccaccgctgggggcagactccagctccacagcgtcactccggaagagtggtaggggcccacagacccggactgctgagtccggtgttcgtttatagccccgcctttcagtcaggcggggaagaaggtctctggatgagcaatacctgcacactgcgttag

SEQ ID NO: 8678 - DNA, 1209 bp, Artificial Sequence
  Description of Artificial Sequence: Synthetic coding sequence
atggtgtgcgcccgggccgccctgggccccggcgccctgtgggccgccgcttggggcgtcctcttgttgaccgcaccagccggcgcacagcgcggtcgcaaaaaagtggtgcacgtgctcgagggagagtcgggatcagtcgtcgtgcaaactgcccccggtcaggttgtgtcacaccgaggtggcactattgtacttccgtgcagataccactatgaggccgctgctcacggccatgacggggtgaggttaaaatggaccaaggtggtcgacccactcgcctttactgatgtctttgtggccttaggcccacaacatagagcctttggctcatacagaggacgggcagagttgcaaggagacgggccaggcgacgcaagtctagtgctccgaaatgtgactctccaagattacggccgttatgaatgcgaagtcacaaacgagctggaggacgacgccggcatggtgaagttggatctggaaggggtggtgttcccatatcatccgagaggagggcgatataagcttacctttgcagaggctcagcgggcatgcgccgagcaggatggtatccttgcgtctgccgaacagctgcacgcagcctggagagatggcctggactggtgcaatgccggatggcttcgggacggctcagtccaataccctgttaacaggcccagagagccatgcggtggtctaggaggaaccgggagcgccggcggcggcggcgacgcgaacggtggactgcggaactatggctatcggcataatgctgaggaacggtatgacgctttctgctttacctcaaacctccccggacgagtcttcttcctgaagcccttacgacctgtcccttttagcggagctgcaagagcctgtgcagcgcgcggcgctgccgtcgctaaagttggccagctgttcgcggcttggaagctccagttactggaccgctgtactgcaggatggttagccgacggcagcgctcgatacccaattgtgaaccctcgtgctaggtgtggcggtcgccggcctggtgtgcggagtttaggattcccagacgccacacggcgcctatttggtgtgtattgttatcgagctcccggtgcgcccgatcctgcaccaggcggatggggctggggatgggccggggggggagggtgggcaggtggggctcgcgaccctgctgcttggacccccctccacgtgtag

SEQ ID NO: 8679 - DNA, 1740 bp, Artificial Sequence
  Description of Artificial Sequence: Synthetic coding sequence
atgagcgccctgcggcccctgctgctgctgctgctgcccctgtgccccgggccaggacctgggccaggctctgaagcaaaggtgacccgctcctgcgctgaaacgcgccaggttctgggcgccagagggtattcgctgaatctaattccaccggcactgattagcggggaacatctcagggtatgccctcaagagtacacttgttgctccagcgagaccgaacagcggcttatccgcgagactgaagctacctttcgcggtctagttgaagactccggtagtttcctggtgcacaccctggcagcacggcataggaagtttgacgaattttttctggagatgctctcagtcgcgcagcactccctgactcagctgttcagccatagctatgggcgcctgtatgctcagcacgcattgatttttaacgggctcttcagcaggttgcgtgacttctatggagaaagcggggaagggttggacgacactctcgcggacttttgggcccaactgttggaaagagtcttccccttgctgcacccacagtactccttcccacctgactacctactctgtctgagccggctggcttctagcacagacggttccctccagccttttggcgatagtccaaggaggctgcgactccaaatcactaggaccctggtagccgcccgggccttcgtgcagggattggagacaggacgtaacgtggtgtccgaggctctcaaggtgccggtctccgagggctgttctcaggctcttatgcgccttatcggttgccccctgtgtaggggcgtaccgtcccttatgccctgtcagggtttctgtctgaacgtcgtccgcggctgcctcagttccagaggactggaacccgattggggcaactatctggacggcctcctgatcctcgcagataaactgcagggcccattctctttcgaactgacagccgagtctatcggagtgaaaatcagtgaggggctgatgtacctgcaggagaactcagccaaagtgtctgcccaggtctttcaagaatgcggccctccggaccccgtgcctgccaggaacagacgcgcccctcccccccgggaagaggcagggcgcttatggtcaatggtgaccgaggaggaaaggcctacaaccgctgcaggaacaaacctgcatcgtctggtgtgggagcttcgggaacgcttagcccggatgaggggcttttgggctcggctcagtctgacagtttgcggtgactcacggatggcggccgacgctagtctggaggcagcaccttgttggacaggtgcaggccgcggccgatatcttcctccagtggtgggagggagccccgcagagcaagtcaataatccagaacttaaggttgacgccagcggccctgatgttcctacgagaaggaggcgcctgcaattgcgggctgccacagctcgcatgaaaacagcagccctggggcatgacttagacggacaggacgccgatgaggatgcaagtggatcaggcggcgggcaacagtacgccgacgattggatggcaggcgccgtggcaccacccgcgagacccccaagacctccttaccctccgcggagagacggctctggaggcaagggtggcggtggctccgcacgctataatcagggaaggtctaggagtggaggagccagtataggcttccacacccagacgatcttaatcctgtccctgagcgctctggctttgctcggtcccagatag

SEQ ID NO: 8680 - DNA, 498 bp, Artificial Sequence
  Description of Artificial Sequence: Synthetic coding sequence
atggccctgctggccctgctgctggtggtggccctgccccgggtgtggacggatgccaacctcacagctcggcaacgagaccctgaggattctcagcggacagatgagggggataaccgcgtgtggtgccatgtctgtgagcgggaaaacacctttgagtgtcaaaatcctcgtcgctgtaagtggactgaaccatattgcgtcatagcagccgttaagattttcccccgtttcttcatggtcgcgaaacagtgcagtgctggctgcgccgctatggagcgaccaaagcccgaagaaaaacgattcctccttgaggagcctatgccatttttttacctgaaatgttgcaaaatccggtactgtaacttggaggggccaccaatcaacagctcagtattcaaggaatatgccgggagcatgggcgaatcttgcgggggtctatggctggcaattcttctcctgctcgcaagcatcgccgctgggctgtcgctttcgtag

SEQ ID NO: 8681 - DNA, 933 bp, Artificial Sequence
  Description of Artificial Sequence: Synthetic coding sequence
atgaacggcctgagcctgagcgagctgtgctgcctgttctgctgcccaccctgtccaggccgtatcgccgccaagcttgcattcctgcctccagaagccacttattccctggtgcctgagcctgagcctggccccggtggagccggggctgcccctctgggtactctgagggcctcctctggggccccgggaaggtggaagctgcatttgacagaaagggccgacttccagtattcacagcgggagttggacaccatcgaggtgtttcccaccaagagcgccagagggaacagagtctcttgcatgtacgtgagatgcgtccccggagcaaggtacactgtgctgttctcccatggtaacgccgtggatctgggccagatgagttccttctatattggactcgggtcaaggcttcactgtaatatttttagttacgattactcaggttacggcgccagctctggcagacccagtgagcggaacctttatgctgacattgacgccgcctggcaagcattaaggacacgctacggcataagccccgattctataatactctatggtcagtctatcgggacagtccccaccgtggatcttgcaagtaggtacgaatgtgcggcagtggtcctgcactcgccactgacctccggaatgagagttgcttttcctgataccaagaaaacttattgttttgatgcgttccctaacatagaaaaagtctccaagattacgtctcctgtcctcattattcatgggacagaggatgaagttatagacttttcccacggcttggcattgtacgagagatgtcccaaggccgtcgaacccctgtgggttgagggcgccggccacaacgacatcgagctatattcacagtacctagagcggcttcgaagattcatctcacaggagctccccagccagcgggcctag

SEQ ID NO: 8682 - DNA, 1905 bp, Artificial Sequence
  Description of Artificial Sequence: Synthetic coding sequence
atggcccagggcgtgctgtggatcctgctgggcctgctgctgtggagtgacccagggaccgcgtcgcttcctctcctgatggacagcgtgatccaggcactcgctgagttagaacagaaggttcctgctgcaaaaacacgccatacggcctcagcttggctgatgagtgcacctaacagcggacctcacaatcgtttgtaccactttttgctgggtgcttggtcgcttaacgccactgaactcgacccttgcccgctgtctccagagctgctggggctaactaaagaggttgctaggcatgacgtgagggagggaaaagagtatggggttgtgttggctcccgacggctctacagtggcagtcgaacctctgctcgctggtctggaggccgggctccagggtcggcgtgttatcaatctgcccctggactctatggctgcaccatgggaaacaggggacaccttcccagacgtggtggccattgctcccgatgtccgggcaacaagttctccaggattacgagacgggagccctgacgtgacaaccgctgatatcggagctaatactcctgacgcaacaaaaggatgccctgacgttcaggcatctctgcccgatgccaaggcaaagtctccccctaccatggtcgacagcctgctggctgtgaccctcgcgggaaacctcggcttgacctttctcaggggaagccaaacacagtctcaccccgatttaggtaccgaaggttgctgggaccagctgagtgccccccgcacctttaccctgctggatcctaaggcgtctctcttaacgatggcatttctgaacggggccctggatggtgtgattttgggtgactacctgagcagaacaccagaaccaaggcccagtctgagtcacttgctgtcccagtattacggagctggtgttgctcgcgacccgggctttcgttcaaactttcgccgacagaacggcgcagccctgacaagcgcttcaatactcgcccaacaggtatgggggacactggttcttttacagagactggaacccgtgcacctccaactccagtgcatgtcccaagaacagctcgcacaggtcgccgctaatgcgacaaaagaatttactgaagcattcttggggtgtccagcgatccacccccgatgtcgctggggcgccgccccataccggggccggcctaagctattgcagctgccattgggctttctctatgtgcaccacacctatgtgccagcccctccttgcacggattttaccaggtgcgccgccaacatgagaagcatgcagcgctaccaccaggacacacagggctggggagacattgggtatagctttgtcgtaggctccgatgggtatgtttatgaagggcggggatggcattgggtgggcgcccacactctgggccacaacagtcggggtttcggcgtggctatagtaggcaattataccgccgccttaccaactgaggctgctctgaggactgtgcgggatacactccccagttgtgcagtgagagcgggcctgctccgccccgactacgccctcctgggtcatcgacagctggtccgcactgactgtccaggcgacgccctgtttgatctgcttagaacttggccccatttcacggcagtatccctcagaagtctgcactacacggcgcgtcgcccttccgtgtacactagcagcacccggccccttccaccggcttgtaacagctgcgctagaactgcctctgctaggccccccacctccagacgccacgtgtatagcggaaatctgggacctgcattcgccggacactctgcgggaaacattcctgaccctgtgaccagcgcctatgccgctagcgctcagccccaaacccagcctgcttgtccgttcccctcttcctag

SEQ ID NO: 8683 - DNA, 777 bp, Artificial Sequence
  Description of Artificial Sequence: Synthetic coding sequence
atgctggtgctgtacggccacagcacccaggacctgcccgagaccaacgcaagagttgttgggggaacggaggcggggcgcaattcttggccttcacagatcagtttgcagtacaggtctggtggctctcgctatcacacttgcggtggcactcttatccgtcagaactgggtgatgacagccgcccactgcgtagactatcaaaaaacattcagggtggtggcaggtgaccataatctaagccagaacgacgggacggagcagtacgtcagtgtgcaaaaaatagtcgttcacccttattggaattctgataatgtggccgccgggtatgacattgcactgctccgtctagcccagagtgtaaccttgaattcctatgtgcagctaggcgttctgcctcaggagggagcaatcctagccaacaattctccttgttacattacagggtggggcaagacaaagactaacgggcagttggcccaaaccctacagcaggcgtacctccccagcgtcgattatgctatttgctcatcttccagctattgggggagcaccgtgaagaatacaatggtgtgtgcagggggcgatggggtcagaagtggttgtcagggtgactccggcggtccactgcactgtctggtgaatgggaaatactctgtgcatggcgtaacatcatttgtgtcttctcggggttgcaatgtttctcggaagccgactgtgttcactcaggtgagtgcttatattagttggataaacaatgtaattgcctcaaattag

SEQ ID NO: 8684 - DNA, 993 bp, Artificial Sequence
  Description of Artificial Sequence: Synthetic coding sequence
atggccgcccggcggagccagcggcggcggggccggcggggcgagcctggtacggcacttcttgtccctcttgccttaggactggggttagcactcgcgtgtctcggactgctgctggccgtggtgtctctgggatcccgagcttcgctttctgcccaggaacccgctcaggaagagttggtcgctgaagaggaccaggacccatctgaattgaatcctcagactgaagagtctcaggaccctgcaccatttcttaaccgactggttcgcccgagacgctccgcccccaaaggacggaaaacgcgcgcacgcagagccattgctgcccactacgaagtgcacccacgccccggccaggacggcgcccaggcaggtgtggacggaacagtgtcaggctgggaggaagcacgcattaacagcagtagcccgttgcgatacaatcgacagattggtgagttcattgtaacacgagcagggctctattacctctattgccagtcctcagatgccctggaagcctgggagaacggcgaaagaagccggaagcgtcgagcagtgctcactcagaagcagaagaagcagcacagtgtcctgcatctggtcccaatcaatgctaccagtaaagacgactctgacgtgacagaggttatgtggcagccagccctacggcggggccgtggacttcaagctcagggctatggtgtcaggatccaagacgctggcgtgtacctactgtattcacaagtgctgttccaggacgtcacctttacaatgggtcaggtagtgtcaagagagggccagggccgccaggagactttgtttaggtgtatcagatcaatgccgagtcacccagatcgggcctataattcttgctattcggccggagtgttccaccttcaccagggtgatatcctgtctgtcatcatacctagggcgcgggccaagctgaatctcagtccccacggcacctttctgggatttgtgaagttatag

SEQ ID NO: 8685 - DNA, 2253 bp, Artificial Sequence
  Description of Artificial Sequence: Synthetic coding sequence
atggccaagccccggctgctggtgctgtacttcgccctgatcgtggtgcccgcgtgggtgtcttccattgtgctaactggtacctcagagccccccgatgcacaaaccgtcgcgcctgcggaggacgagacacttcaaaacgaagcagataaccaggaaaatgtgctttcccagctgctgggggattatgacaaggtgaaagcaatgagtgaagggtctgactgccagtgcaaatgtgttgttcgccccttaggaagagatgcctgtcagcgtatcaacgccggagctagtaggaaggaagatttttacaccgtggagaccatcaccagtgggtcgtcatgtaagtgtgcatgcgttgctcctcctagcgctcttaacccctgtgaaggagacttcagattacaaaagctgagggaggctgactcccaagatctgaagctttctaccatcatcgacatgctggagggtgctttctacggactcgaccttctaaagttgcactctgttactacaaaattggtcggtagagtggacaagctggaggaagaagtgtctaaaaatctgaccaaagaaaatgaacagataaaagaggacatggaggagatacgaaccgagatgaataagcgcggcaaagagaattgctccgagaatattctggattccatgcctgatattagatccgccttacagcgagatgcagctgccgcttatgcccatccagagtacgaggagcgatttctacaggaagaaactgtttctcagcagataaacagcatcgagctgctccaaacacggccactcgctcttccggaggtggtcaaaagccagagaccactacagaggcaagttcacctgcggggaaggccagcttcccagccaactgtcattagggggattacctactacaaggcgaaggtgtcagaggaggagaatgacatcgaggagcagcaggacgaatttttctctggcgacaacggggtggacctgcttatcgaggatcagctcttgcgtcacaatggactgatgacctcagttacaagacgtccagctgctactagacagggccactctactgccgtgacctccgatcttaacgctagaacagcgccctggtcaagcgccctgccccagccctctacatccgacccatctattgccaaccatgcctctgtgggacccacactgcagacaacaagcgtgtcaccagacccaactcgagagagcgtgttgcagccatccccccaggtgcctgcaacgacagtagctcataccgcgactcagcaacctgccgcccccgctccacctgccgtctcacctagagaggctctgatggaggcaatgcacaccgttccagtgccaccaacaaccgtaaggacagatagtttgggcaaagacgcgcccgccgggtgggggaccacacccgcatctcccaccttaagtccagaagaagaggatgatatcaggaacgttataggtcggtgcaaagatacgctgtcaaccatcactggtccaactacacagaacacttatggtcggaatgaaggcgcttggatgaaagaccccctcgccaaggatgagcgaatctacgttactaactattattatggcaacaccctggtcgaatttcggaatctcgagaactttaagcaaggccgctggtctaattcctacaagttgccgtactcttggataggaacaggccatgtggtgtataatggggcgttttattataatagagccttcaccagaaacatcatcaagtatgatttaaaacaaagatacgtagccgcgtgggctatgttgcatgacgttgcttatgaggaggccacaccgtggagatggcaaggccacagcgatgtggatttcgccgtcgacgaaaacggactttggttaatctatcccgctttggatgacgagggcttctcccaagaagtaatcgtgctctcaaagctgaacgccgcagatcttagtactcagaaagagacgacatggcggactggcttgcgccggaacttctacggaaattgcttcgtcatctgtggagttctgtacgcagtggactcatacaatcagagaaatgcaaatataagctacgccttcgacactcataccaatacacaaattgtcccccggctcctcttcgaaaacgaatactcatacaccacacagatcgactataaccccaaggacagactgctgtacgcctgggataacggccatcaggtgacataccacgtaatcttcgcttattag

SEQ ID NO: 8686 - DNA, 678 bp, Artificial Sequence
  Description of Artificial Sequence: Synthetic coding sequence
atgaagctgggctgcgtgctgatggcctgggccctgtacctgagcctcggtgtgctgtgggtcgctcagatgctcctagcggctggctgtcacgccgaactgttccctgcaccgattctgcgcgccgtgcctagtgccgagccacaggctgggtcacctatgactctaagctgccagaccaaacttcccctgcagagatccgccgcacgattgctttttagcttctataaggatgggagaatcgtgcagtcacgaggactctctagtgagttccaaatcccaacagcaagcgaagaccactccggatcatactggtgcgaagccgccaccgaggacaaccaggtgtggaaacaatcccctcagttggagattcgtgttcaaggtgcctcctcttcagccgccccccccacacttaacccggctcctcaaaaatccgccgccccaggtacagcccccgaggaggctccagggcccttaccacccccccccaccccaagttccgaggatccgggcttttcttccccgctcgggatgccggacccccacttatatcaccagatgggattgttactgaagcacatgcaggatgtgcgagtcctgttaggccatctgctaatggagcttcgcgaactgtccggccataggaagccgggcacgacaaaggccacagccgaatag

SEQ ID NO: 8687 - DNA, 891 bp, Artificial Sequence
  Description of Artificial Sequence: Synthetic coding sequence
atgagccggcaggagcccaagatgttcgtgctgctgtacgtgacctccttcgcgatctgcgcctcggggcaaccccgtggcaatcagctgaagggcgaaaactatagtccgagatacatctgttccatcccaggcctaccaggaccacctgggccaccaggcgctaatgggtcgcctggtcctcacggcaggataggcctgccggggcgcgatggccgagacggccggaaaggggagaagggggaaaagggcaccgccgggctgagaggcaagaccggccctctgggcctggctggcgagaaaggggaccagggggagactggaaaaaagggacctatcggccccgagggggagaaaggcgaggtcggaccaattggtccacctggacccaaaggagacaggggggaacagggagaccctggcctgccgggggtatgtcgatgtggcagcatcgtgcttaaatccgccttctcggtgggcattaccacgtcttatcccgaagaaagattgcccattatctttaacaaagttcttttcaatgagggtgaacactacaatccagccacaggtaaattcatttgtgccttccctggaatctattacttttcctatgacataacgcttgcgaacaagcatctcgccattggccttgtccacaacgggcagtaccgcatcaaaacatttgacgcaaatactggtaatcacgacgtggcgtccggcagtaccgtcatttatcttcagcctgaggacgaggtctggctggagattttttttacagaccagaacggcctgttttcagacccaggctgggctgattcactattctccggcttccttctctacgtcgatactgactatttagactcaattagcgaggacgatgaactgtag

SEQ ID NO: 8688 - DNA, 1275 bp, Artificial Sequence
  Description of Artificial Sequence: Synthetic coding sequence
atgggcagcctggtgctgaccctgtgcgccctgttctgcctggccgcatatcttgtgagcggttcaccaataatgaatctggagcaatctcctcttgaggaagatatgtctctattcggagatgtgtttagcgagcaggacggagtggactttaacacattactgcagtcaatgaaagacgaatttttaaaaacccttaacctgagcgacatcccaactcaagatagcgcaaaggtggacccacctgaatacatgctggagctatataataagtttgccacggaccgcacatctatgccatccgccaacattatccggagcttcaaaaatgaggacctattctcccagccggtctcttttaatgggctcaggaagtacccacttctctttaatgtcagtatcccacaccacgaggaggttattatggccgaactgcggctctatactttggtccaaagagacagaatgatctatgacggggtggatcgaaaaattaccatattcgaggtgctggagtccaagggggacaatgaaggtgaaagaaacatgctcgtgcttgtgtcaggagaaatctatggaaccaatagcgaatgggagacgttcgatgtgactgacgccataaggcgttggcagaagagtggcagcagcacacaccagctcgaagtgcacatcgaatctaaacatgacgaggccgaagatgcttcctctgggcgactggagatcgacacatctgcccagaataagcacaacccactactgatagtgttcagtgatgaccaaagctccgataaggagaggaaagaggagctgaacgagatgatcagccacgagcagctgccggaactggacaatctgggcctggacagcttctcttcaggcccgggcgaggaggccctcctacagatgagaagtaacatcatctatgattctaccgctagaatccgtcggaatgcgaaggggaactactgcaagagaacccccctttacatcgacttcaaagagatcgggtgggatagctggattatagcccctccgggctacgaagcatacgagtgcaggggcgtgtgcaattaccccctagcggaacatctcactcctacaaagcatgccatcatccaggctctggtgcacctgaaaaatagccagaaggcttctaaagcctgctgcgtgccaaccaagctggaacccatctcaattctatacctggacaagggggtggtaacttacaaatttaagtatgaagggatggcagtgagcgagtgtgggtgcagatag

SEQ ID NO: 8689 - DNA, 381 bp, Artificial Sequence
  Description of Artificial Sequence: Synthetic coding sequence
atgcacctgagccagctgctggcctgcgccctgctgctgaccctgctgtcattgcggccctctgaggcaaagcccggtgccccaccaaaagttcctaggactcctccagccgaagagctggcagagccccaggctgcaggtggaggacagaaaaaaggcgacaaagcgcccggaggtggtggcgctaacctcaaaggcgatcgctctaggctgctgcgagacctccgcgttgacactaagtcacgtgctgcttgggcaagattgctgcaggaacacccgaacgccaggaagtataagggagcaaataagaagggccttagcaagggatgttttggcctcaaattagacaggattggtagcatgtctggactaggctgctag

SEQ ID NO: 8690 - DNA, 423 bp, Artificial Sequence
  Description of Artificial Sequence: Synthetic coding sequence
atgcggagcccccggatgcgggtgtgcgccaagagcgtgctgctgagtcactggttgttcttggcgtacgtgctcatggtgtgttgcaaactgatgtccgcttcaagccaacacctcagaggtcacgctggacaccatcaaattaaacagggcacatgtgaagtcgtcgccgtccatcggtgttgcaataaaaaccggattgaagagaggtcccagaccgtgaaatgttcctgtttcccaggccaagtggctgggacgactagggcccagccctcatgcgtggaagccagcattgtcatacagaagtggtggtgccacatgaatccgtgcttggaaggggaggattgtaaggtgctgccggactactcaggatggtcttgcagctcgggcaataaggtcaagactacaaaagtaaccagatag

SEQ ID NO: 8691 - DNA, 1332 bp, Artificial Sequence
  Description of Artificial Sequence: Synthetic coding sequence
atgctgatgctgttcgtgttcggcgtgctgctgcacgaggtgagcctctcgggacagaacgaagctccaccaaacacacactccatcccgggggaacctctctataattacgcgtcaatccgtctaccggaagaacatatccccttctttttacataacaacaggcatattgccactgtctgccggaaggattcactttgtccgtacaaaaagcatttggagaagctcaagtactgctgggggtacgaaaaatcctgtaagcccgaatttagattcggctaccccgtgtgttcatatgtggacatgggttggactgatactctggaatcggccgaggatattttctggaagcaggctgatttcggctatgcacgggaaaggctggaggagatgcacgtgctatgtcaaccgaaagagaccagtgattcgtccttggtgtgttctcgatatctgcagtattgtcgggctacaaatctgtacctcgatctgcgaaacatcaaacggaaccatgaccgtttcaaagaagacttttttcagtccggcgaaatcggtggccattgcaagttagatattcgcaccctgacctccgagggacaacgcaaaagtccgttgcagtcctggtttgccgagctgcagtcttacacacaactcaacttccggcctatcgaggacgccaagtgtgatatcgtcatagagaagccaacttactttatgaaactagacgcaggcgtcaatatgtaccaccacttctgtgattttattaatctatatatcacacagcacgtgaataattctttcagcactgatgtctacatcgtcatgtgggatacggacggtaagatccgggtcacaatactggcccgtagcactgagtaccgcaagattctgaaccagaacgagttagtgaacgctctaaaaacagtatcgaccttcgaggtccagatcgtggactacaaataccgggagctgggattcctcgaccaattgcggattactcataacacagatatctttatcgggatgcacggagccggcttaactcatcttcttttcctgcctgactgggctgcggtcttcgagctgtacaattgcgaggatgaaaggtgttaccttgacctggccagactgagaggcgtccactatatcacatggcggcggcagaacaaagtgttcccccaggacaaaggccaccatccaacgctaggggagcacccaaaattcactaactactcgtttgatgtagaagagttcatgtatctagtgttacaggccgccgatcacgtgctgcagcatccaaaatggcctttcaagaagaagcacgacgagctctag

SEQ ID NO: 8692 - DNA, 336 bp, Artificial Sequence
  Description of Artificial Sequence: Synthetic coding sequence
atgggccccagcagctgcctgctgctgatcctgatccccctgctgcagctgatcaatccaggttcaacgcagtgcagcctggacagcgttatggataaaaagataaaagacgtcctgaattcgctggaatattccccatctcctatctctaaaaaactctcttgcgcatcagtgaagtcgcaaggccgtccatctagctgccccgctggcatggccgttaccggatgcgcgtgtgggtacggttgcggatcctgggacgtgcagcttgaaaccacctgtcattgccagtgcagcgtggtggactggaccacagctaggtgttgccacctcacttag

SEQ ID NO: 8693 - DNA, 1965 bp, Artificial Sequence
  Description of Artificial Sequence: Synthetic coding sequence
atggcccccaagaagctgagctgcctgcggagcctgctgctgcccctgtctttaacattactattgccacaggcggacacacgatcatttgtggttgatagaggccatgatcggttcctcctggacggcgccccctttcggtatgtatcaggatcccttcactatttcagagtgccacgcgtcctgtgggcggatcgccttttaaaaatgagatggagcggtctgaatgcaatccagttctacgtgccgtggaactatcacgaaccacaaccaggggtatacaatttcaatggcagccgcgacctaattgctttcctgaatgaggcggcgttggcaaatctgctggtgatccttcgtcccggaccctacatctgtgctgagtgggaaatgggcggattgccgagttggcttctgagaaagcctgaaattcatctccgcacgtctgatccagatttccttgccgccgtcgacagctggttcaaggtgctgttgcccaagatctatccatggttatatcataatggaggcaacataatctctatccaggtggagaatgaatacgggtcttacagagcatgtgacttctcatacatgaggcaccttgcagggctgtttcgggctctgctaggtgagaagatcctgctcttcacaaccgatggtccggagggtcttaaatgcggaagtctccgcggtttatacaccactgttgactttggtcctgcagacaatatgacgaaaatctttacactgctgcggaaatacgaacctcacggcccattagttaattctgagtattacacaggctggcttgattattgggggcaaaaccacagcacacggtccgttagtgctgttacgaaggggctggagaacatgctaaagctcggagcttccgtgaatatgtacatgtttcacggtggcactaattttgggtattggaatggtgcagataagaaaggcaggtttctgcctatcaccacgtcatacgattacgacgccccaatcagtgaggcaggtgatcccacccccaagctattcgctttgagggacgtcatctccaaatttcaggaggtgcccctgggccccctccctccaccctccccaaaaatgatgctaggtccagttaccctgcacctggtgggacacctgttggcatttctcgatctgctgtgcccccgggggccaattcatagtattttacctatgacctttgaggccgtcaaacaggatcacggttttatgttatacagaacctacatgacccataccattttcgagcctacacccttctgggtgcccaacaatggagtgcatgaccgcgcctatgttatggtagacggagtgtttcagggcgttgtggagcggaatatgagggacaaactgttcttgactggcaagctgggatctaaactagacatactggtggaaaacatggggcgtctcagtttcgggagcaatagcagtgactttaaaggtttactgaagccaccaattctgggacaaaccatactgacgcagtggatgatgtttccgctgaaaatagataatctcgtgaagtggtggttccctctccaacttccaaaatggccctatccacaggctccctccggaccaaccttctatagtaagacctttcccattctgggctctgtcggggacacatttctttaccttcctggctggacaaagggccaggtttggatcaacgggtttaacctgggacggtactggactaaacaaggtcctcaacaaacactttacgtccctcgcttcctgctgttcccacgcggcgcattgaacaagataactcttctcgagctcgaggacgtgcctttgcaaccacaggtgcaattccttgacaagcccatcctgaactcaacaagcacattgcataggacacatatcaattcactgagtgctgatacactaagtgcatcagagcccatggaattgagcggacactag

SEQ ID NO: 8694 - DNA, 2502 bp, Artificial Sequence
  Description of Artificial Sequence: Synthetic coding sequence
atgaacatggagatcggccacccccacgagggcaaggacgacctgggcgacaaacgcgtcatcatgggcaccaagttccccatggagttaggaatcagggtgggactggggaaggaggattctagatgcggcgaaagtcccgtggtctctaataaatgcgaaggtcgaatggccccacctgaaacaaagtttcccctgtcgaaggggctagagatgggtcttgaacggcagaacatttcacgcacagtgatgcaaaggggctccttaggagtggatagcgtgtccgcaagtcaagggacaaaaccaagcttgctacccggccgaatgggactggagaatgaatctctcttggctggctacacacacgagcggataatccagccacccttgggacgcgtatgcggctcatcacaagcagcgggcagtaggagagccccacttgcttcgggccccgaaggtgtcgaggaactggtgggaaagcctgctttcgtgatggaaccgaggcaggagatggaaaaggaaagtacctgtgtcctgatgaaacctaataccgaaatcaagctgccagtcgaggtggatataggcctgacacaggcggaagggcccgacgaaacaaaaaataccgaaccacagatggggcttgtgatcgagcctccccagtgccagttcgcccagcagcacgagcagcggaaggaggctggcaatattgaaagcggggtcgagcctccagaccgcatccgcccaatctattcaggcaagttctttgatcggacaccttgttggccctctgccggcaaagttattcctgtgggttaccgcgtggctacctgcctaacagagaaactgccccggctcatcacacccccagaggctaaaaagtattttaattttagatatccccctgccggcgtcgaacgtgtcttctacgggagagccaatgaccctcagatcgccccgtacctcactcacggtattaggagcaaaatttccgtgctggccaacacactgatcaaccctcagccaataaccactttccagcagaaaattaaggacaaaaaagagtccatatatctgagcaatagacgagctcctctgggcaaatctcatgatcaagcgccaggcctccctaaagggatggacactactaataccacattcggcacggccgtgattaaagaatactctgcgaaggatgtggtcaatcctcccaaatcctacgaggaagtttttaaggaagggaatgagggtcatgatctgtatgtggtgagccacaacgactattatgcgggtgaggccaaaaatcgcaaatacaatccctccagcttccaccgctgctctgtctatggcgtgccaaccccgcattttaatgacggcagagctatggccaagtcactctattggctccacgaactgcaaatgaagcgtggagcaaagttcgtgtccaagcgggcagacgactttaaggagaagttccaacacaagctgggaagagttctggatcctattgctgagaccatgaatgtgccacccgattgtacattcggtgcatgtttgaggccagaggagtacggggtgggcgacctaatccacaacagactccctgacgagtacctccgcgggaaagatcggcagagagctctgattgcggcagtcagacaccatttgaagaaggtgaactaccagaagttcgataccttgctcgctgccttcagacattacgataaaaagggcgatggaatgattgacaaagacgagctgcaggaagcctgtgatcaggcaaatctgtccctggatgataaattgcttgaccaactcttcgattattgcgacgttgacaacgatggattcatcaactacttggagtttgccaacttcctcaattggaaagataaaatgttacttaaggaatacgaggaaagagtcatcatcaaaggaaggaagcccgactgtgttaatccaacggaggccaatgttgaggagcctgagcagacccttctcattaagcctgaagacatcgtgctgaaagaggcgggatctaccgaaaagaccctgagaaccttgcttcggccttcggataaggtgagtaattattacaagaccacatctagcgagataaatgcaatagtaggtgcgatccccagcacatgctaccccatctgcggagtgcccacaatccgctctgacatcccagcaccgcgcataaggaggattagcgatcgcaccaactacggcgaggaaggatccgcctacagcctgctctacccgaccatttttgccagaaaaggggtgtttgagagggatttcttcaaaacccgctctaaagaggaaatagcggagatcctctgtaacataggcgtcaagttatccgacgaggagtttgaaaatgtgtggaatctcgcaagtaagaagcaccatcgaggggaggtgtgcgtggaaaacataagaaacgtgctggacgaacttcgacacgcagacagaatcaagtgcaagacactcatgtag

SEQ ID NO: 8695 - DNA, 2004 bp, Artificial Sequence
  Description of Artificial Sequence: Synthetic coding sequence
atgggcagcagccggctggccgccctgctgctgcccctgctgctgatcgtgatcgatttatccgactcagccggcatcggttttcgtcatttaccccactggaacactcgctgtccattagcctcccacacagatgattcatttactgggtcttcagcttacatcccttgccgcacctggtgggccctgttcagcactaagccgtggtgtgtcagagtctggcattgtagccgctgtttatgccaacatctgttaagcggtggatcgggactgcaacggggcttgtttcacctgttggtgcagaagagcaaaaagtctagcacgtttaagttttaccgccgccacaagatgcccgcaccagcacaaaggaaactgttgccaaggcggcacctcagtgagaagagccaccacatttccattccatctcccgatatatcgcacaagggattgagaagtaagcgtactcagccctcagaccctgagacatgggaatcattaccaaggctagactctcagaggcacgggggcccggaattctcctttgacttgctcccggaagctagagctatccgggtgaccatcagtagtggccccgaagtcagtgtgagattatgtcaccagtgggctctggaatgcgaagaattatctagtccatacgacgttcagaagatcgttagcgggggacatactgtcgagcttccatacgaatttctcctcccttgtctgtgcatagaggcatcctacttgcaggaggataccgtacggcgcaagaaatgcccatttcaaagttggcccgaggcctacggcagcgacttctggaaatctgtccattttacagattattcacagcacacacagatggtcatggctctgactctgaggtgccccttgaagttggaagctgccctctgccagaggcatgattggcatactctttgtaaggacctgcctaatgcaactgcacgcgagagcgatggatggtacgtgcttgagaaagttgacctgcacccgcaactgtgctttaaattcagcttcggcaacagttcccacgtggagtgtccccatcagacaggcagtttgacatcctggaatgtctctatggatacacaagcccaacagttgatccttcacttcagctcccggatgcacgccacctttagcgctgcctggtcgcttcccggcttaggccaggatacgctcgtccccccggtatataccgtctcacaggccagagggtctagtcccgtttctttagatctcatcataccctttctccggccagggtgctgtgtgctggtttggcgaagtgatgtgcaatttgcctggaaacatctgttgtgccccgacgtgagttacagacatctgggcctgttgatattggctttgctggctctcctcacattgttgggcgtggtgttggccctcacttgccggcggcctcagagcggcccaggcccagcaagacccgtccttctgctccatgctgctgattccgaggcgcagcgtcggttagtgggcgccctggcagagttgttgcgagccgccctgggcggcgggagagatgttattgtggacctctgggaggggagacatgtggctcgcgttggtcctctgccatggttatgggctgcacgtacgagagtggccagagagcaggggacagtcctcctgctgtggtctggagccgatctccgtcccgtgagtggacccgacccccgggctgccccacttctagcattattacacgcggccccccgaccactgcttctgctcgcatacttcagccgtctgtgcgctaagggtgatatccccccgccacttcgggctctgccacgctaccggctgctgcgcgacctgccacgcctattgagagccttagacgccaggcctttcgcagaagccacttcttgggggcgcctcggggcaaggcagcgcaggcaaagtcgcctggagctgtgctctcgtcttgaacgagaggccgcccggttggcagacctcggatag

SEQ ID NO: 8696 - DNA, 609 bp, Artificial Sequence
  Description of Artificial Sequence: Synthetic coding sequence
atggagctgtggggcgcctacctgctgctgtgcctgttcagcctgctgactcaggtaacgacagagccccctactcagaaaccaaagaaaatagtcaacgctaaaaaagacgtagttaacacaaaaatgttcgaggaattgaagtcaagactggacactctggcccaggaagtagctctgctgaaagaacaacaggccctccagaccgtctgtctgaagggaaccaaggtgcacatgaaatgtttcctggcgttcactcaaacaaagacctttcatgaggcatcagaggactgcatttcgagaggaggaacacttgggactccacaaaccggatcagaaaacgacgccctctacgagtacctgcggcagagcgttgggaatgaggcggaaatatggctcgggctgaatgatatggctgccgagggcacttgggtggacatgacaggtgcgcgaatagcctacaagaattgggagacagagataaccgcacagccggacggagggaagactgagaattgcgcagtgctgagtggcgccgcgaacggcaaatggttcgacaaaagatgtcgcgatcagctgccctacatttgtcaatttggcatcgtatag

SEQ ID NO: 8697 - DNA, 1839 bp, Artificial Sequence
  Description of Artificial Sequence: Synthetic coding sequence
atgctggagggcctgggcagccccgccagcccccgggccgccgccagtgcttccgttgctggaagcagcggccctgctgcttgctcgcccccttcctccagcgcgcctagatcacccgagtctcctgcccctcgtcggggtggcgttagagcatccgtcccccagaaactggccgaaatgctcagttctcaatatggcctgattgtcttcgtcgccgggctcttgttactgctggcatgggccgtgcatgcagccggcgtttccaaaagtgacttattatgctttctgaccgccttgatgctcctgcagcttctgtggatgctgtggtacgtcgggaggtccagcgcacaccgccggctttttcggctgaaggacactcatgcaggcgccggatggctgagagggtccattacactgttcgccgtcatcacagtcatcctcggatgcctcaaaatcggttacttcattggttttagcgagtgtctttccgcaacagaaggggtcttcccggtgactcattctgtacatacgttgctgcaggtgtacttcctgtggggccacgctaaggacattatacagtcatttaagactttggagaggttcggcgtgatccactccgtattcacaaacctgctcctttgggccaacggcgtgttgaacgagtccaagcaccagctgaacgagcacaaagagaggctgataaccttagggtttggcaacatcaccaccgttctagacgatcatacccctcagtgtaattgcacccctcctaccttgtgcacagccatttcccatggtatctattacctatatcctttcaatattgaataccagatactggcgtcaaccatgctctatgtactttggaagaacatcggaagaaaagtagactctcatcagcatcagaagatgcagtttaagagtgatggtgtcatggttggcgctgtcttaggcctcacagtcctagctgctaccatcgccgtcgtggtcgtgtaccttatccacattggtcggagtaaaacaaagtcagagagcgctcttatcatgttttacctgtacgcaatcacgctgttgatgttgatgggggcagctggattagccggaatacggatttacaggatagatgaaaagagtctggatgagtctaaaaatccagcccggaagctggacagtgacctcctcgtcggtacggcttctggctcttggctgatttcatggggaagcatccttgcaatcctttgcgcagagggccatcctcgctatacttggtacaatttgccatacagtatcctggccattgtggagaaatatattcagaatctcttcattttcgaatcaattcacagggagcctgaaaagttgagcgaagatatccaaacacttcgagtagtgactgtgtgcaatggcaatacaatgcccctggccagttcttgccctaagtccggcggcgtggcaagggacgtagcgccacaagggaaggatatgccacctgccgccaatgggaacgtctgcatgcgcgagagtcatgataaggaggaagagaagcaagaggagtcgagttggggcggctccccttcacctgtacggctcccaagattccttcaaggcaatgcaaagagaaaggtgcttcgcaatatagccgcttttctgtttctgtgtaacatcagcctgtggattccacctgcctttggctgccgccctgaatacgacaacggtctcgaagagatagtttttggatttgagccttggatcatagtcgtgaaccttgccatgcctttcagcatcttctacaggatgcatgcagccgcttcactgtttgaagtgtattgcaaaatatag

SEQ ID NO: 8698 - DNA, 786 bp, Artificial Sequence
  Description of Artificial Sequence: Synthetic coding sequence
atggagctgctgcaggtgaccatcctgttcctgctgcccagcatctgtagcagcaactccacaggagtgcttgaggctgccaacaacagtctggtcgtcaccacgacaaagcctagcattacgacacctaacactgagtccctgcagaaaaacgtagtcacgcccactaccgggactacacctaaaggcacaatcacaaatgaactgcttaagatgtctttaatgtcaacagccactttcctgacatctaaagacgaaggcctcaaggccaccacaaccgacgtgcggaaaaacgactctattattagcaatgtgactgtcacctctgttactctgccgaatgctgtgagcacattacagagtagcaaacccaagactgagacgcagtcaagcatcaaaactaccgagatccctggctccgtcctgcagcctgatgcgagcccgagcaagaccggaaccctgaccagcatccccgtcactatccccgaaaatactagccagtcccaggtaattggcactgaaggcggcaaaaacgcttccacaagtgctactagtcgcagctattcttctatcattctgcctgttgttatcgccctcatagttataaccctgagcgtgtttgtgttggttgggctttatagaatgtgctggaaagctgatcccggcacccctgagaatggtaatgatcagccccaatctgacaaggaatctgtcaaattacttaccgtcaagaccatatctcatgaatcgggagagcacagcgcccagggaaagaccaagaactag

SEQ ID NO: 8699 - DNA, 6408 bp, Artificial Sequence
  Description of Artificial Sequence: Synthetic coding sequence
atgcccgccctgggccccgccctgctgcaggccctgtgggccggctgggttctcactctgcagccgctgccccccactgccttcactcctaacgggacatacctccaacacctcgctcgggatccaactagcggtactctttacttaggcgctactaacttcctcttccagctgagtccagggttgcagcttgaagctacagtcagcacaggtcctgtgctggatagcagagattgtctgcctccagtcatgccagacgaatgtccacaggcacagcctacgaataacccaaatcagctgctgctcgtctctcccggggctctagtggtgtgtggttctgtgcatcagggagtgtgtgaacagagacgcctgggccagttggagcaactgttactccgtccggagaggccgggcgatacgcaatacgtggccgccaatgatcccgcagtgtccacagtgggactcgttgcacaaggtctcgctggcgaacccctgctgttcgtcggacggggctacactagtcgaggcgttgggggaggtatacctcccatcactacgcgcgccttgtggccacccgatcctcaagctgcattcagctacgaggagactgctaaactggctgtgggccgtctcagcgaatacagtcaccatttcgtaagcgccttcgccaggggcgctagcgcgtatttcctgtttctccgccgggaccttcaagctcagtcccgggcattccgggcctatgtgtctcgcgtatgtttaagggaccagcattactatagctatgtcgaactccccctggcctgcgagggaggacgctacggacttattcaggcggctgctgttgcaactagcagagaagtggcccacggggaggtcctgttcgcagccttctcctcagcagcccccccgacagttgggcgcccgccctcagccgccgcaggtgcttcaggagcttcagcgctatgtgccttccccctagatgaagttgatcgactggctaaccgcacccgcgatgcctgctatacgagggagggtcgcgctgaagacggtaccgaagtggcctacattgagtacgacgtgaatagcgactgtgcccagttgcccgtcgacactctagacgcctacccatgtgggagcgaccacaccccgagccccatggcttctcgtgtgcccctggaggctactccaattctggagtggccgggaatacagctcacagcagtagcggtaaccatggaggacgggcataccatcgcgtttttgggagacagtcaagggcaactgcacagagtgtatcttggccccgggagcgatggacacccctacagcacccagagtattcagcaagggtcagccgtgtccagagatctaacatttgacggtacgttcgaacacttatatgtcatgacccagtcgacacttctaaaagtgcctgtcgccagctgtgcacaacacctggattgcgcaagttgtctcgctcatcgggatccctattgcggctggtgtgtgttgttaggcagatgctctagacggagcgagtgctccagaggccagggccctgaacaatggttgtggtctttccagcccgaactggggtgcctgcaggtcgcagctatgtctcccgccaatattagtagagaagaaacacgggaagtttttctctctgtgcctgacctgccccctctgtggcctggcgaatcttactcctgtcacttcggcgagcatcagtcccccgctcttctgactgggagcggcgttatgtgtcccagccctgacccaagtgaggcacccgtcctccccaggggggctgactatgttagtgtgagcgtggagctgaggttcggcgccgtagtaatcgctaagacctctctgagtttctacgactgtgtcgctgtgaccgaactacggccctctgcccaatgccaggcttgtgtgagttctaggtgggggtgtaactggtgcgtgtggcagcacctgtgtacccacaaagcaagctgtgacgctggccccatggtcgcaagtcaccaaagccccctggtttcccccgatccccctgcccgcggaggtccgagtccctccccgccaacagcccccaaggcgctcgccactcctgcacctgacaccctgccggtggagcctggagcccctagtaccgcgacagcttctgatatttcaccaggagcaagtccgtcacttctaagcccttggggcccctgggctggctcaggtagcataagtagcccaggatcaaccggaagtccccttcacgaggagccaagccctccctctccccaaaatggccccgggactgccgttccggcacctacagactttagaccctctgcaacccctgaggatctattagcctcacctctgagtccttctgaggtggccgcagtgccccctgcagatccaggccctgaagctctgcaccccaccgtgcctttggacctacctcccgccactgtacccgctacgacttttccgggcgcgatgggaagtgtgaaaccagctcttgactggcttaccagggaggggggtgaactgcccgaagcagatgagtggactggcggggacgctcctgccttttccaccagtaccttgttgagcggggacggagattcggccgaactggaaggaccacccgctccattgattttgccctccagcttagactaccagtatgacacacccggattatgggaactggaagaagccacactgggcgcaagttcctgcccatgcgtggaatcagtgcagggttccacactgatgccagttcacgtcgagagagagattcgtttacttggtcgaaacctccacctgttccaggacggccctggcgacaatgagtgtgtcatggaattggaggggttggaggttgtggtggaggctcgtgtcgagtgtgagcctcccccagacacacaatgtcatgttacctgtcagcagcaccagttatcatatgaagccctccagcctgagctcagagttggtttattccttcgcagggctggacgcctgagggtggacagcgctgaaggcctgcacgtagttctttatgattgttctgtgggccatggggattgtagtcggtgtcaaactgctatgccccagtacggctgtgtatggtgcgagggagagcggccccgctgcgtgaccagggaggcttgcggagaggccgaagctgtggcgacgcagtgtccggctcccctcatacattccgtggaacctctgaccgggcctgtcgatggaggtaccagggtgaccatcaggggctcaaacctggggcagcatgtgcaggacgttcttggcatggtcactgtggctggagtgccttgtgccgttgatgcccaggaatatgaagtaagctcaagtttagtgtgcataaccggcgccagcggagaagaggtcgccggcgccaccgcagtggaggtacccggtagaggcagaggcgtctctgaacatgattttgcataccaggaccccaaggtgcatagtatttttcccgcccgggggccgcgtgcaggtggtacgcggttaaccctgaatggctcaaaactgcttactggaaggttagaggacatccgcgttgtggtgggtgatcagccttgtcacctgctccctgaacagcaatccgaacagctgcgctgcgagaccagccctagaccaactcctgcaacgttgcccgtggccgtgtggttcggagccacagaaagacggcttcagaggggacaattcaaatacaccctagaccctaatattacctcggccgggccaaccaagagtttcctctccggagggagggagatctgtgtgagagggcagaatcttgatgttgtgcagactccgcgtatccgtgttactgtggtgagtaggatgcttcagccctctcagggcttggggcgccgtcgcagggtggtacccgaaacagcatgcagccttgggccaagctgtagtagccaacagtttgaagaaccctgtcatgttaattctagccaactgataacatgtaggacccctgctctacctgggctcccagaagatccatgggttagagtggagtttatcctcgataacctggtcttcgactttgcaactttaaatcctacccccttttcgtatgaagccgatccaacactgcagcctctgaatccggaggatcccacaatgcccttccggcataagccaggcagcgttttttctgtcgagggagagaacctcgacctggcaatgagtaaggaggaagtcgttgcaatgataggggacggaccgtgtgtggtgaaaactttaaccagacaccacctctattgtgagcccccagtggagcagccgctgccgcgccatcacgccctgagagaggcccccgatagcctgccagagtttacagtccagatgggtaacctgagattctctctaggacatgtgcagtatgatggcgagagtccgggggcatttcctgttgccgctcaagttggcttgggcgtgggcacaagtctgttagctctgggagtcatcataatagtgctgatgtatcgacgcaagtcaaaacaggcactgagagattacaagaaggtgcagatacagttggaaaatcttgaatctagcgtgagggacagatgcaagaaggagtttactgatctcatgaccgagatgaccgatctgacttcggatctgcttgggagcggaatccctttcctggactataaggtttatgcagaacggatcttcttccccggccatcgagaatcacccctccatagagatctcggtgtccccgagtctagaaggcctactgttgaacaggggctgggacagctgtctaacttactgaactcaaagctgtttctgaccaagttcattcacactctcgaatcccagcgcactttctctgccagggacagagcatatgtcgcctcccttttgactgtcgcactacatggaaaactagaatattttacggacatactgagaactttgctctccgaccttgttgctcagtacgtcgcaaaaaatcccaaactcatgctgaggagaacagaaaccgtcgttgaaaagcttctgacaaattggatgagcatatgtctctacacatttgtaagggactccgtcggggagcctctctatatgcttttcagaggtataaaacaccaagtggataaaggcccagtggactctgtgacgggaaaagcaaaatataccttaaacgacaaccggctgcttcgggaggacgttgagtaccggcctcttacgctgaatgccctgctggccgtgggtcccggagccggcgaggcccaaggggtccctgtgaaagtgctggactgcgacaccatttctcaagcgaaggaaaagatgctcgatcagttatacaaaggagttcccctaacccaacgccctgatcctcgcactctagatgtggaatggcgatccggggttgccggccatcttatactcagcgacgaggacgtgaccagcgaggtgcagggcctctggaggcggctgaatacccttcagcattacaaagtacctgatggcgccaccgtcgcactggtgccttgtcttacaaagcatgtgctgcgcgagaaccaagattatgtgcctggggaacgaacccccatgctggaagacgtggatgaagggggtatccgcccctggcatctagtgaagccttcagatgagcccgagcccccgcgccccagacgtggctccctgcggggtggggaacgggaacgcgccaaagccatcccggagatatatctgacccggttgctgtctatgaagggtacattacagaaatttgtggatgacttgtttcaggttatcctgtcaacttcgagacctgtgccccttgcagtgaagtacttcttcgatctcttggacgagcaggctcagcagcatggcatcagcgaccaggatacaatccacatctggaaaaccaacagcctcccactgcgattttggatcaatattataaagaaccctcagttcgtattcgacgtgcaaaccagtgataacatggacgccgtcctcctggtgatcgctcagaccttcatggacgcctgcaccctggcagaccataaactgggccgcgacagtcctatcaataagctgctgtatgcccgcgacattcccaggtataagcgcatggtagagaggtactacgctgacatcagacaaaccgtacctgctagtgaccaagaaatgaactctgttcttgcggagctcagttggaactattccggcgacctgggggccagagttgcacttcacgaattgtacaagtacattaataaatattacgaccaaattattactgcactggaggaagatgggacagctcagaagatgcagctaggctatagattgcagcagattgcagcagctgtagaaaataaggtcacggacctgtag

SEQ ID NO: 8700 - DNA, 297 bp, Artificial Sequence
  Description of Artificial Sequence: Synthetic coding sequence
atgaagctgatggtgctggtgttcaccatcggcctgaccctgctgttgggcgttcaggccatgccggccaacaggctgtcttgctatcggaagatacttaaagatcacaattgtcataacctgccagaaggggttgcagatcttactcagatcgacgtgaacgtgcaggaccacttctgggacggcaagggatgcgagatgatctgctattgtaatttctccgagctactttgttgtcctaaagacgtgttttttggacccaagataagcttcgtaataccatgcaacaatcaatag

SEQ ID NO: 8701 - DNA, 1443 bp, Artificial Sequence
  Description of Artificial Sequence: Synthetic coding sequence
atgaagcggagcgtggccgtgtggctgctggtgggcctgagcctgggtgtgccacagtttggaaagggggacatctgtgaccccaacccttgcgagaatggcggcatttgtctgccaggtctcgctgacgggagtttttcctgcgaatgccccgatgggtttaccgatcctaactgttcatccgtcgttgaagtggccagcgatgaggaggaacccacctcagccggcccgtgcactcccaatccctgccacaacggcggaacctgcgaaattagcgaggcctatcgcggtgacacatttattgggtacgtttgtaagtgtccgcgggggttcaacgggatccattgccagcataacatcaatgagtgcgaggttgaaccttgcaaaaatgggggtatatgtaccgatctggtggcaaattattcgtgcgagtgtccaggagaattcatgggtcgcaattgccagtacaaatgctctggccccctcggcatcgaaggtggcatcatttcgaatcagcagatcactgccagcagcacccatcgggcactgtttggactgcagaagtggtacccctattacgcccgcctgaacaagaaaggactcattaatgcctggaccgctgctgaaaatgacaggtggccttggattcagattaatctgcagcgaaagatgagggttaccggagtgattacacagggcgcgaaacgcatcggaagccctgaatatataaaatcatacaagatcgcatactccaacgacggcaagacatgggcaatgtataaagtcaagggcactaacgaagatatggtgtttcgcggcaacatcgataataacaccccttacgcaaactcctttacccctccaattaaagcccagtacgtgcggttatacccacaggtgtgccgcagacactgcactctgcggatggagctcctcggatgcgaactttccggctgctctgagccgctgggaatgaagtctggtcacatccaggactaccagatcactgcaagtagtatattccgaaccctgaatatggatatgttcacctgggaaccccgcaaggctcgtctcgataagcaggggaaggtcaacgcctggacaagtggccacaacgatcagtcgcagtggctgcaggtggacctcctggtgcctaccaaagtgaccggcatcataacgcagggcgccaaggacttcggccacgttcaatttgtgggatcatacaaactggcttacagcaatgacggagagcattggactgtctatcaagacgaaaagcaacggaaagacaaggtgtttcaggggaactttgataacgacacacaccgtaagaatgtcatcgatccccccatctacgctaggcacattcgaattttgccatggagctggtacggcagaatcactttgaggagcgaactacttggttgcaccgaggaagaatag

SEQ ID NO: 8702 - DNA, 1323 bp, Artificial Sequence
  Description of Artificial Sequence: Synthetic coding sequence
atggccgtgaagctgggcaccctgctgctggccctggccctgggcctggcgcaaccagcttcggccaggcggaagcttctggtgttcctcttggacggatttaggtcagactatatttccgatgaggctctcgaatcccttccaggtttcaaagaaatcgtgtcaaggggcgtgaaagtcgactaccttacaccagactttccctcgctcagctacccaaactactataccctgatgactggacggcattgcgaggtgcatcagatgatcggaaactatatgtgggaccctactactaacaaatccttcgacatcggcgtgaacaaagatagcttgatgccgctctggtggaacggtagcgagccactgtgggttactttaactaaagcaaagcgcaaagtttatatgtactattggccgggctgtgaagtggaaatcctcggtgtgcgccccacgtattgcctagaatacaaaaatgtcccaaccgatatcaactttgcgaatgccgtctcggatgctctggactcattcaagagtgggcgggctgacctcgctgctatctatcatgagcgcatcgatgtggagggacaccattacggccctgcttcaccccagcggaaggatgctttgaaggctgtcgataccgtgttgaagtatatgacaaagtggatacaggagagaggtctgcaggaccggttgaacgtcattattttctcagaccacggcatgaccgatattttttggatggataaggtgatcgaactgaacaagtatatttctcttaacgatctgcagcaagtcaaggataggggaccggtggttagcctatggccggccccaggtaagcacagcgagatttacaacaaattgagcactgtcgagcatatgaccgtgtatgagaaggaggccatacccagccgattttattataagaaagggaaattcgtgagtcctctcacactggtggcagacgagggctggttcattaccgaaaacagggaaatgctcccattctggatgaattcaacaggcaggagggaaggctggcaacgaggctggcacggctacgataatgagttgatggacatgcgagggatatttctcgctttcggacccgactttaaatccaacttcagagcagcacctattcggagcgtggatgtgtacaacgtgatgtgcaacgtagtgggcatcacccccttgcccaataatggaagctggtctcgggtaatgtgcatgctgaagggcagggcctctacagccccacccgtctggccttcacactgcgctcttgccctgattctcctctttctgcttgcttag

SEQ ID NO: 8703 - DNA, 351 bp, Artificial Sequence
  Description of Artificial Sequence: Synthetic coding sequence
atggagagcagccgggtgcggctgctgcccctgctgggcgccgcccttctgctcatgctcccgctgcttggtaccagggctcaggaggacgcggaactccagcctcgagcgctcgatatctacagtgctgtcgatgatgcttctcacgagaaggagttaattgaggcactgcaggaagtactaaaaaaactgaagtccaagcgggttccaatctacgagaagaagtacggccaggtgccaatgtgcgacgccggagagcaatgtgcggttcggaagggcgcacgtattggaaaactgtgtgactgtcctaggggcacctcgtgtaattccttcctactgaaatgtctgtag

SEQ ID NO: 8704 - DNA, 1365 bp, Artificial Sequence
  Description of Artificial Sequence: Synthetic coding sequence
atggcccggcccaacaagttcctgctgtggttctgctgcttcgcctggttgtgttttcctattagtcttggatctcaggcatctgggggggaggcccagattgcagccagtgctgaactggagtctggggccatgccatggtcgctccttcagcacatcgacgaacgggatcgggcgggccttctgcctgccctctttaaggtgttgagtgtgggtaggggaggttcaccacgactgcagccagattcccgcgcactgcattatatgaaaaagttgtataagacatacgcaaccaaggagggcatccccaaaagcaatcggtctcatctgtataataccgtgcgcctgttcaccccttgcactcgacataaacaggcccccggcgaccaagtgacaggaattctgcctagtgtcgagctattgttcaaccttgaccgcatcacaactgtggaacacttactcaagagcgtgttgctgtacaacattaacaattccgtgtccttttccagcgctgtgaagtgcgtttgcaatctgatgatcaaggagccaaaaagttctagtagaaccctcggacgagccccctattccttcacttttaacagtcaattcgagttcggcaagaagcataaatggatccagatcgacgtcacttcacttcttcagccgcttgtggcttctaataagaggtcaattcatatgtccattaactttacttgcatgaaggaccaattagaacatcccagcgctcagaatggattgttcaacatgactttagtcagtccctcccttatcctttatctgaatgatacttcagcgcaggcttatcattcttggtactcactgcattacaagcgtaggccgtcccaaggcccagaccaagaaagatccttgtctgcctacccagttggcgaagaggcagctgaggacgggcggagttcacatcaccggcataggagaggtcaggaaacagtgtcatcagagcttaagaagccactcgggccagcatccttcaatctaagcgagtacttcaggcagttcctgctaccccagaacgagtgtgagctccatgattttcgcctgagctttagtcagctgaagtgggacaactggatcgtagccccccaccgctataatcctcgctactgtaagggtgattgccctcgagcggtcggccaccgctatggatcaccggtgcacaccatggtgcaaaatattatctacgagaaactagactcctctgtcccgagacctagttgtgtgcctgctaagtactcccccctatccgtgctcacaatcgagcctgacggcagtattgcctacaaagagtacgaagatatgatcgccaccaagtgcacatgtcgatag

SEQ ID NO: 8705 - DNA, 234 bp, Artificial Sequence
  Description of Artificial Sequence: Synthetic coding sequence
atgtggcacctgaagctgtgcgccgtgctgatgatcttcctgctgctgctgggccaaatcgacggctctccgattcccgaagtctcaagcgccaagcggcggcccaggagaatgacgcccttctggaggggcgtgtctttgagacccatcggcgccagttgtagggacgactctgagtgtatcacaaggctatgtcgcaagagaagatgttccctttccgtggcacaggagtag

SEQ ID NO: 8706 - DNA, 912 bp, Artificial Sequence
  Description of Artificial Sequence: Synthetic coding sequence
atgagcgagccccagcccgacctggagcccccccagcacggcctgtatatgctttttctgcttgttctggtgttctttctgatgggacttgtgggcttcatgatttgccatgttttaaagaagaaaggttatcgctgtaggacaagtcgtggaagcgagccagacgacgcccaacttcagcctcccgaggacgacgatatgaatgaagacacagtggaaagaattgtgcgttgtatcatccagaacgaggccaatgccgaggcccttaaagagatgctcggcgatagcgagggagagggtacagtccagctgtcaagcgtggacgccacatcatctttacaagatggggctccttcgcaccatcacacggtgcaccttggaagtgcggcaccatgtctccactgtagccgctcaaaaagacctcccttggttcgtcaaggcaggtccaaagaaggcaaatctcggcccaggaccggggagaccaccgtgtttagcgtggggcgcttccgcgtaacacatattgagaaacggtatgggctgcatgagcaccgtgacggcagccccaccgaccgctcatggggctcaggaggcggccaagatccggggggaggtcaaggatcagggggaggacaacctaaggcagggatgcccgccatggaaagacttccacctgagcgaccacagccccaggtgcttgcctctcctcccgtccagaatggaggcctgcgcgactcatcacttaccccccgtgctttggagggcaatccgagggcctccgcagagcctacgctccgcgctggtgggagaggcccttcacctggccttcctactcaagaggcaaacggccagccatccaaacctgataccagcgaccaccaggtttccttaccacagggtgccggatcaatgtag

SEQ ID NO: 8707 - DNA, 795 bp, Artificial Sequence
  Description of Artificial Sequence: Synthetic coding sequence
atgcggaccctgtggatggccctgtgcgccctgagccggctgtggccaggtgcccaggccggatgcgccgaggccgggcgatgctgcccaggtcgggatcccgcgtgttttgcccgcggatggaggttggacagagtctacggcacctgcttttgtgatcaagcctgcagatttacaggtgattgttgcttcgattatgatcgggcctgtccggcacgaccctgttttgtcggagaatggtcaccgtggagcggctgcgccgatcagtgtaagccaaccaccagagttcgccggagaagcgttcaacaggaaccacaaaatggcggcgccccctgccctccgcttgaagagagggcagggtgcctggaatattcaacaccccaaggtcaggattgtggtcacacctacgtacccgcttttattacaaccagcgccttcaacaaggagcgaacacggcaggccacctcacctcactggtcaacacacaccgaagatgccggctactgcatggagtttaaaactgagtctcttactccacactgtgccctcgaaaactggcccctcaccagatggatgcagtacctgcgagagggctataccgtctgcgtggattgtcagccccctgctatgaactctgtctccttgaggtgttccggggacggcctcgattcagatggtaatcaaaccctgcactggcaggccattgggaaccctcgctgccagggcacttggaaaaaagtgcgtagagtggatcagtgttcttgccctgccgtgcatagctttatctttatctag

SEQ ID NO: 8708 - DNA, 312 bp, Artificial Sequence
  Description of Artificial Sequence: Synthetic coding sequence
atgcggcagcggctgctgcccagcgtgaccagcctgctgctggtggccttactctttccaggatcctcacaagcccgacacgtgaaccactccgccacagaagcactcggtgagctaagagagcgggctcctggacaaggtaccaacggcttccagctgctgcgccacgccgttaaacgcgatcttctgccaccccgcacacctccatatcaggtgcatatcagtcatagagaagcaaggggccctagctttagaatctgtgtggactttctgggaccccggtgggctaggggctgctccacaggtaattag

SEQ ID NO: 8709 - DNA, 3867 bp, Artificial Sequence
  Description of Artificial Sequence: Synthetic coding sequence
atggccagcgtggcctgggccgtgctgaaggtgctgctgctgctgccaacgcagacctggagtcccgtaggtgctgggaaccctccagattgtgatgcacctctggcctcagcactaccaagaagttccttctcttcatcatcggagctgagtagttcgcatgggcctggcttctcgcggttgaatcgccgggacggcgctggggggtggacaccgcttgtttccaacaagtaccagtggctgcagatcgatctaggagagcggatggaagtgaccgcagtggccactcagggcggctatggcagcagtgactgggttacctcataccttctgatgttctcagacggtggccgaaattggaaacagtaccgcagagaagagagcatatggggcttccctggaaatacaaatgcagactccgtggtgcactatcgattacagcctccttttgaagcccggtttttgaggttcctcccattggcgtggaatcctaggggacgcatcggcatgagaattgaagtctatgggtgtgcttacaagagcgaagtggtgtacttcgacggtcagagcgctctgttgtatagactcgataaaaaacccctgaaacctatcagagacgtgatttctttgaaatttaaggctatgcagtccaacggcattctacttcatcgggaaggccagcacggaaaccatatcacacttgagctgatcaaagggaagctggtgttctttctgaatagcggcaacgctaaactgccatccacaatcgccccagtgacactgactctcggctcacttctcgatgatcagcactggcactccgttctcatcgaattgctcgacacacaggtgaatttcactgtggataagcacacacaccacttccaagctaagggcgatagctcttatttggaccttaatttcgaaattagtttcggaggaatacctactcccggaagatccagagccttccgtcgcaagagctttcacggttgtcttgagaacctgtattacaacggggtcgacgttactgagctcgcaaagaagcataagcctcagatccttatgatgggcaatgtttctttctcctgtcctcagccgcagactgttcccgtaacgttcttaagttcacgctcttatctcgcccttcccgggaattctggcgaggataaggtgagtgtgactttccagttccgaacctggaaccgcgccggtcacctgctgttcggtgagctccgccgaggttctggctccttcgtgctgttcctgaaagatggaaaactgaagctcagtcttttccagccgggacagagtcctagaaatgtgacagctggcgcgggtttgaacgatgggcagtggcactccgtgtcgttttccgctaagtggtctcatatgaacgttgtcgtcgacgacgataccgcagttcagcctttggtcgccgtgctaatagattctggagacacctattattttgggggctgcttggacaactcttccggaagcggttgtaagagtcctttgggtggatttcagggatgtttaaggctgattacaatcggtgataaggctgtggatcctatattggtgcaacagggagcactgggcagctttagggatttacaaatcgattcatgcgggatcacggacaggtgtctgcccagctattgtgaacacggcggcgaatgctcccagagctgggatactttttcctgtgactgcctgggcactggttacacaggagaaacatgccatagctcgctttatgagcagtcctgcgaagcacataagcatcggggtaatccatccggactgtactacatcgatgcagacggaagcggacccctcggccctttcctcgtatactgcaatatgacagccgacgctgcctggactgtcgtccagcacggtgggccggacgcagtgaccctgagaggtgcccccagcggacaccccagatccgcagtctcctttgcttacgcagctggcgccgggcagctgcgctccgcggtgaacttggctgaaaggtgcgaacaaaggctggccctgagatgtgggacagcaagacgaccagattctcgggacggaacccctcttagttggtgggtcgggcgcaccaatgaaacccacacttcatggggggggagtctgcctgatgcacaaaagtgcacctgcgggttagaggggaactgcatcgactcacagtactattgtaattgcgacgcgggtcggaatgagtggacgtccgatacaatagtgctgagtcaaaaggagcacttgcccgtgacccagattgtcatgaccgatgccggcagaccacattcagaagccgcgtatactctggggccccttctgtgcagaggagatcagtctttctggaattccgccagtttcaatacagaaacgagttacctccactttccagctttccacggagagctgacagccgacgtctgcttcttcttcaaaacaaccgtgagcagcggcgtgttcatggagaacctgggcattaccgatttcattcggattgagctgagggccccaactgaggtcactttttcgttcgacgttggtaacggcccttgtgaagtgaccgtacagtctcccaccccctttaatgacaatcagtggcaccatgtgcgggcagagcgaaatgtgaaaggcgcatccttgcaggtcgatcagcttccccagaaaatgcaacctgccccggcggacggacatgtgcggctgcagctgaacagccaactatttattggaggcacggccacccggcaacggggatttctgggatgtattaggtccctgcagctgaatggggtcgccctcgatcttgaagaaagggccaccgttacacccggcgtcgagcctgggtgcgcaggccattgctctacctacggacacctctgcagaaacgggggtaggtgtcgcgagaaacgccgcggcgtgacttgcgactgtgcattcagcgcatatgatgggccattctgttccaatgagatttcggcctacttcgctaccggttccagtatgacatatcattttcaagagcattatacgttaagcgaaaatagttcctcgctggtctcctcccttcatagggatgtgacactaacgagagaaatgatcacattaagttttagaactaccaggaccccctcactgcttctgtacgtgtccagcttctacgaagaatacctgtcagtgatcctggcgaataacggatctctacagatcagatacaagcttgacaggcatcagaaccctgatgccttcacttttgattttaagaacatggccgacggacagctgcaccaggtgaaaatcaacagagaagaggccgtggtaatggtggaagtaaaccaaagcaccaagaaacaggtcatattgtcttccgggactgaatttaatgcagtcaagtccctaatacttgggaaagtgttggaagcagcaggggccgatcccgacacccggagggccgctacttccggtttcactggatgcctgtccgccgtacggtttgggagagccgcccccctgaaggctgcactgaggccatcggggccctctagggttacagtccgtgggcacgtggctccgatggccaggtgtgccgccggggcagcaagcggttcaccagcgcgcgaactggctccccggctggctgggggagcagggagatctggacccgctgatgagggagaaccccttgtcaatgccgacagaagggacagtgcggtcattggaggagtaatcgcagtggttatctttattctgctgtgcattaccgcaatagctattcgtatatatcagcaaaggaagctcagaaaggaaaacgaatcaaaggtcagcaagaaagaggagtgctag

SEQ ID NO: 8710 - DNA, 369 bp, Artificial Sequence
  Description of Artificial Sequence: Synthetic coding sequence
atggtgcccggcccccccgagagcgtggtgcggttcttcctgtggttctgctttctattaccccccacccggaaagccagctgtgaccctagggacctgaagtcttgtaataggccctgtgtttggtcaaggctgctgaagccaaactcctctctgagtaatctggagaccgcctactttccgcagatcctaagatttctgcgaccatggtacttctcacggtcacacttgaactatcatcagaaggcccctgccagatgggaatggctctactcgatttaccgaaaaggcactaaggcacagcgacgcaatgtacttcggtcaccttgcgcaccgccccagccgtcgtggccttgcagcgtgatatag

SEQ ID NO: 8711 - DNA, 1887 bp, Artificial Sequence
  Description of Artificial Sequence: Synthetic coding sequence
atggcccccagcgccgaccccggcatgagccggatgctgcccttcctgctgctgctatggttcctccccataaccgaaggttcccagagggcggagcccatgtttacagccgtgacaaacagcgtgttgccacctgactatgattccaatcctacacagctaaattacggagtagcggttacggacgtcgaccacgatggagacttcgaaatcgtcgtggccggatacaacgggcctaacctggttttgaaatacgatcgcgcccagaagcggctggtgaacattgcggtagacgagcggtcctcaccttactatgccctgcgggaccgacagggaaacgccatcggcgtgacagcttgtgacatagacggtgatggcagagaggagatctattttctgaataccaacaacgctttcagcggagtcgccacttacacagataagctcttcaagtttagaaacaatagatgggaggacattctgtccgatgaagttaacgtggccaggggagtcgcttctctctttgcaggccgcagcgtggcctgtgtggataggaagggctcaggacgctactcgatttatattgcaaattacgcctatggcaacgtgggccccgacgctctgattgagatggaccccgaggcctctgacttgtccaggggtattctggccctgcgcgacgtcgcagccgaagccggtgtgtcaaagtacaccgggggacgaggtgtgagcgtgggtccaatcctgagcagttctgccagtgacatcttttgcgataacgaaaacggtcctaatttcctgttccataaccgtggcgacggcacgtttgttgacgccgctgcgtcagctggggtcgacgacccgcaccagcacggacgcggcgtggctctggcagactttaaccgcgatggcaaagtagatatagtttatggcaattggaacggccctcacagactctacctccaaatgtcgactcatggaaaggttcggttccgggacattgcctccccgaaattttcaatgccctcccctgtcaggactgtaattaccgccgatttcgacaacgatcaggagcttgaaatttttttcaacaacatcgcgtatcgctcaagcagcgcgaatcgcttgttcagggtgatacgaagggagcatggtgatccactgatcgaagaattgaacccgggcgacgcgctggaaccagaggggcggggcaccggaggcgtggtgactgatttcgatggggatgggatgcttgacttaattttgtctcatggggagagcatggcgcagcccttgtccgtcttccgagggaatcagggctttaataataactggctgagagttgtgcctcgaactcgctttggcgcattcgcccgcggcgccaaggtagttctttataccaaaaaaagcggggcccacttaaggattattgatgggggcagcggatatctctgcgaaatggaacccgtcgctcacttcggtcttggcaaggatgaagcatccagcgtggaagtgacttggcctgatggcaaaatggtctcaagaaatgtagcctccggggaaatgaacagcgttcttgagatcttataccctcgggacgaagacacgctccaagatcctgctcctctggaaacaccaatgaacgctagctccagtcactcctgtgcgctcgagacctccccctacgtgtctacaccaatggaggctaccggagctggacccacaagaagcgctgtaggagcgacatcacctaccaggatggcacagcctgcatggggactcagtgcatcacacagggcgcccgcacccccacctcctcccctgttgctcccattgcctctcctactgccactgttggagctgcccctgcttcaccggtccagttag

SEQ ID NO: 8712 - DNA, 1008 bp, Artificial Sequence
  Description of Artificial Sequence: Synthetic coding sequence
atgcagggccagggccggcggcggggcacctgcaaggacatcttctgctcaaagatggctagttacctctacggagtgctcttcgcggtcgggctgtgcgctcccatctattgcgtgtcccccgccaacgcccctagtgcgtatccgcgcccctcctccacaaaatccactcctgcaagtcaggtgtactccttaaacaccgatttcgcatttcgtttatatagacgccttgtgctggagacccccagtcagaacatctttttttcccccgctcgcatcaactcccatgtgaagaaaaagacacaggggaaggtcgtggatattattcagggtctcgacctgctaacagcgatggttttagtgaatcatatattttttaaagccaaatgggagaaaccattccacccagagtacactcgaaaaaactttccatttctggttggagagcaggtaacagtgcacgtccccatgatgcatcagaaggagcaatttgcctttggtgttgataccgagttaaattgcttcgtcctgcagatggactacaagggcgacgctgtggcttttttcgtgctgccgtcgaaaggcaagatgaggcagctggagcaggccctctctgcaaggacgctgagaaagtggagccacagcttgcagaaaagatggattgaggtcttcattccaagatttagcatcagtgcctcatataatttggagactattctccccaagatgggaattcagaatgtgtttgataaaaatgctgatttttcggggatcgcaaagcgagacagcctccaggttagcaaggccactcacaaggcagtacttgacgtgagcgaagaggggactgaggccacggctgccacgaccacaaaatttatcgtgagaagtaaagatggcccaagctactttacagtctccttcaacagaacctttctcatgatgataaccaataaagccacagatggcatcctgtttctgggcaaggttgagaatccaacaaagtcatag

SEQ ID NO: 8713 - DNA, 768 bp, Artificial Sequence
  Description of Artificial Sequence: Synthetic coding sequence
atggtgctgctgctggtgatcctgatccccgtgctggtgagcagcgctggtacatccgcccactacgaaatgctcggcacatgtcgaatggtatgcgacccctatggcgggaccaaggctccatctaccgcagctacccccgacagagggcttatgcaatctctgccgacatttatccaggggccgaaaggggaagctggaagacccggaaaagccggcccgaggggccctccaggagaacccggccccccaggtccaatgggaccacccggggagaaaggtgaaccaggccgccagggtctgcctgggccaccaggcgcgccggggctcaacgcagcaggagccatcagcgcagccacgtatagcacggtccctaaaatcgccttctatgcaggcctgaaaagacagcacgagggatatgaggtactcaaattcgatgacgtagtgaccaacctgggaaatcattacgatcccactacagggaagtttacctgtagcattccaggcatttatttctttacataccacgtactgatgcgcggaggcgacggcaccagcatgtgggccgacttatgcaagaataatcaggtccgcgccagcgctatagcccaggacgcagaccagaactatgactacgctagcaactctgttgtgctgcatctggagccaggggacgaagtgtacattaaactagatggcggtaaagctcacggaggtaacaacaacaagtactcaacattcagcggctttataatttatgctgactag

SEQ ID NO: 8714 - DNA, 1617 bp, Artificial Sequence
  Description of Artificial Sequence: Synthetic coding sequence
atgagcttcagcgccaccatcctgttcagcccccccagcggcagcgaggcacgctgttgttgttgcgcttgtaaatccgagaccaatggggggaataccggatcgcagggcggaaacccacctccatctacaccaatcacagtcaccggacacggtctggccgtccagtcatccgagcagttactccacgtgatttatcagcgtgtggacaaagcagttggcctggcagaggctgctctgggccttgcaagggctaataatgaactcctgaagcggttacaagaagaggtgggagacctacggcaggggaaagtctcaatcccggatgaagacggggaatctcgagcccatagctctccaccagaggaacccgggccactgaaagagagcccgggggaggcttttaaggctctcagcgccgtggaggaagagtgtgactccgtcggcagcggagttcaagttgtgattgaagaactaaggcaactcggggcggcttccgtggggcctggcccactgggtttcccggctactcaacgggatatgcggcttccaggctgcaccttggcggcgtccgaggccgctcctctcctcaaccctcttgtcgacgactatgtggcctcggagggagctgttcagagagtactggtgcctgcctacgctaaacaacttagccctgctacccagctagcgattcagagggccacccctgagaccgggccagaaaatgggaccaagttgcctcccccccgtccggaggacatgctgaacgccgccgcagctctcgactccgcactggaggaatccggaccagggtctacgggcgagctgcgccattcattggggctgacagtctctccatgccggacccgagggagcggacaaaaaaattcaagacgcaagcgagacctggtgctgtctaagctcgtgcacaatgtacacaatcatattactaacgataagcgcttcaacggctcggagtccatcaagtcttcttggaatatcagcgtggtcaaatttcttctggagaagctgaaacaggagcttgtcacaagcccccataattacacagacaaggagctcaagggcgcttgcgtggcatactttctgaccaaaaggcgcgagtacagaaactccttgaacccgtttaaggggctgaaggagaaggaggagaaaaaactgcggtcgagaagatacaggttgtttgccaaccggagcagtattatgcgccacttcggtcccgaggaccagcgactgtggaacgatgtgactgaggagctaatgtcagatgaagaagattctctcaacgaacccggcgtgtgggtcgcacgcccccctcgattccgcgcccagcgactgactgagctgtgctaccatttggatgctaattcgaagcatgggaccaaggcaaatcgagtgtacggcccacccagcgaccgactcccttccgccgaggcgcagctactgccccccgagctgtacaatcccaactttcaggaggaagaggatgaggggggtgacgagaacgctccggggagtccttcctttgaccagccgcacaaaacctgttgcccagacctaaatagcttcatcgagattaaagttgagaaagatgaatag

SEQ ID NO: 8715 - DNA, 2853 bp, Artificial Sequence
  Description of Artificial Sequence: Synthetic coding sequence
atgctgctgctgggcatcctgaccctggccttcgccggccggaccgcaggcggctcggagcctgagcgagaggttgtcgtgccaatccgcctggacccagacatcaacggccgccggtattattggaggggccccgaagatagcggtgaccagggcttaatattccagatcactgcctttcaggaagacttctacctgcacttaactcccgatgcacaatttttggcccctgctttcagtaccgaacacttaggagtaccacttcagggtttgaccggcggaagtagcgatctgcggagatgtttctatagcggagacgtgaacgctgaacccgattcattcgccgctgtctctctatgtggggggctccggggcgcatttggataccggggggcagagtacgtgatatctccactaccaaatgcctccgccccagcagcccagagaaactcccagggcgcacatctcttgcagagaaggggagttcctggtggcccttcaggggacccaacgtccaggtgtggcgtggcctccggttggaaccccgccatcctccgggcgcttgacccctacaagcctcgaagggccggctttggggagagtcggagccgacgacgcagtgggcgggctaagcgctttgtttccatccccagatacgtggagaccttggtagtggccgacgagtccatggttaaattccacggcgctgacctggaacattatttgcttaccctgctcgcgactgcagctcgactgtatcgtcatccctccatcctaaaccccatcaatatcgtcgtcgtgaaggtactgctcctgcgggatagagacagcggcccgaaggtcacaggaaatgctgccctcacgctcaggaacttctgcgcatggcagaaaaagctaaacaaggtgagcgataagcaccctgagtactgggataccgccatcctgttcacacgtcaggacctttgtggcgcgaccacttgcgatacattgggaatggcagacgtcgggaccatgtgcgacccaaagcggtcctgcagtgttattgaggatgatggattgccctcagccttcactactgctcacgagctgggtcacgtgttcaatatgccacacgacaatgtcaaggtatgtgaagaggtcttcggaaagctgcgggccaaccacatgatgtccccaaccctaatacagatagaccgggccaatccatggtctgcatgttctgctgcaatcattactgattttctggactcaggccacggcgattgtctccttgaccagccttctaagccaattagccttcctgaagatcttcccggcgcctcatacacgctttcccagcagtgtgagctggccttcggggttggatctaagccttgcccttacatgcagtactgtaccaagttatggtgcaccggaaaagcaaagggccaaatggtgtgccagacaagacatttcccatgggccgacgggaccagttgtggtgaaggcaagttgtgcctcaagggggcttgtgtagaacggcacaatttgaacaagcaccgggtagacggtagttgggcaaaatgggatccctacggcccgtgttcccgcacttgtggcggcggagtccagttggcccgccgtcaatgcactaaccctacacccgctaatggcggtaaatactgcgaaggtgtgagggtgaaatatcgaagttgtaacttagaaccctgtccttcttctgcttctgggaaatcatttcgggaggaacagtgcgaagccttcaatggctacaatcactccaccaatcgactgacactggccgttgcttgggtccccaagtacagcggtgtatcgcctcgggataaatgtaaactcatatgtagagcaaatggcacagggtacttctatgttttggcccccaaggtggtggacggaaccctatgctctccggactcaacgagcgtttgcgtgcagggtaagtgcatcaaagccggctgtgacggcaacctgggcagtaagaaaaggtttgataagtgcggcgtgtgcggcggagataacaaaagttgcaagaaggtaacaggtctgtttaccaagcccatgcacggatacaactttgtcgtcgcaatccctgcaggcgcctcctcaatagatatcaggcagagaggctataaaggactgatcggagatgacaactacctcgcactgaaaaattcacagggaaaatatctgttaaacggccatttcgtagtcagcgctgtcgaaagagacctggttgtcaagggctcactgctgaggtacagtggtaccggaactgcagtggagtcactgcaggcctctaggccaatcctggagccccttacagtggaagtgttgagtgtgggtaagatgacaccccccagggtccggtacagcttttacctccctaaggagccgcgagaggacaagtcttctcacccaaaggaccctcggggaccctcagtcttacacaacagcgtgttgagcctcagtaaccaggtcgagcagcccgacgaccggccccctgcacggtgggttgctggctcatgggggccctgctctgcatcttgcggttctggtttgcagaagcgtgctgtggattgccgcggaagcgccggccagcggacagtacctgcttgcgatgctgctcatcgccctgtggagacccaggcttgcggggaaccatgtccaacatgggagcttagtgcgtggtccccatgcagcaaatcatgcgggcgcggcttccagcgtcgcagcctgaagtgtgtgggccacggcggacgtcttcttgcccgggaccagtgcaacctgcaccgtaaacctcaggagctggacttctgtgttttgcgcccctgttag

SEQ ID NO: 8716 - DNA, 1521 bp, Artificial Sequence
  Description of Artificial Sequence: Synthetic coding sequence
atgaccagcaagccccacagcgactggatcccctacagcgtgctggacgacgagggacgcaatctccggcagcaaaaactggacaggcagcgcgctttgctggagcagaaacaaaagaaaaagcgccaggagccactgatggtccaggccaacgccgatggacgccctcgcagcaggagggcccgtcagagtgaagaacaggccccgctggtagagtcttacctgtcttctagtggctctacttcataccaggtccaggaggctgattctctggcgtccgtgcagctgggggcgacccggccaacagcgcccgcttctgctaagcgcacaaaggccgctgccaccgccggcgggcagggcggagccgcgcgcaaagaaaaaaaagggaagcataagggaacctccggacctgcagccctcgccgaggataaaagcgaggcacaggggcccgtgcagatacttacggttggccagtcagatcacgctcaggacgctggcgaaactgccgctggaggcggtgaaagaccatctggacaagacctgcgggccaccatgcagagaaagggcatcagcagtagtatgtctttcgatgaagacgaggaagacgaagaggagaactcctctagcagctcacaactgaacagtaacacgcggccaagcagcgccacttccaggaagagcgtgcgagaagctgcttccgcacccagtcctaccgcgcccgaacaacctgtggatgtcgaggtgcaggacctggaggagtttgcgctgcgtcctgctcctcaaggaattacgataaagtgcaggatcactcgcgataaaaaggggatggatcgtggaatgtaccccacatactttctgcacctggacagggaagacggaaaaaaagtctttctgctggctggaaggaaacgaaaaaagagcaaaactagtaactacttgatttccgtggacccaaccgatctgagtcgcgggggtgattcttatatcgggaagctgaggtcgaatttgatgggcaccaagttcacagtgtacgataatggcgtgaatcctcagaaagcctcaagctccactctggaatcgggcaccctgcggcaggagctggcagccgtgtgttacgagacaaacgtgctggggttcaaaggacccaggaagatgagcgtcattgtgcccgggatgaatatggtgcatgaacgagtatctatacggcctaggaacgagcacgagactctcctagctcggtggcaaaataagaataccgaaagcattatcgaactgcagaacaaaaccccagtatggaacgacgacacgcagtcctacgtgttaaactttcacggccgggtcacgcaggccagtgtcaaaaactttcaaataatccacggaaacgacccagattatattgtgatgcagttcgggcgtgtggctgaagacgtgtttacaatggactacaactatcccttgtgtgcactgcaagcatttgcaattgctctcagctcgttcgacagcaaattagcctgcgaatag

SEQ ID NO: 8717 - DNA, 594 bp, Artificial Sequence
  Description of Artificial Sequence: Synthetic coding sequence
atggccaagaacggcctggtgatctgcatcctggtgatcaccctgcttctggaccagactacctcacacaccagtcgcctgaaagctagaaaacactcgaagcgaagggtcagggataaggacggcgacctcaagactcagattgagaaactttggacagaggtaaacgccttgaaagagatccaggccttgcagaccgtgtgcttgcgaggcaccaaggtccacaaaaagtgttatcttgcgagcgagggtctgaagcactttcatgaggcaaatgaggactgcatttctaagggcggcatattagtgatcccccggaacagcgatgaaattaatgcgttgcaggattacggcaaaaggtctttacctggcgtgaatgatttttggctgggcataaacgacatggtcaccgagggtaaatttgtcgatgtcaacggcatcgcaatatcctttttgaattgggatagagcccagccgaacgggggaaaacgcgaaaattgcgtcctctttagccagtcggcacagggcaagtggagcgacgaagcgtgtagatccagtaagcgctacatttgtgaattcacgatcccccagtag

SEQ ID NO: 8718 - DNA, 2424 bp, Artificial Sequence
  Description of Artificial Sequence: Synthetic coding sequence
aagaagaagcggaagatcagcctgctgcccaagccccccaagcacgatgccccactgaccattgagttcccaaatctcgacaagacaagtgccgaatggctcaaggtcaacggcctcaaggcaaaaaaattgtcactctatcaggtgctcgcaccaaacgccttctcaccagtggaagaatttgtccccatacttcaaaaaactgtgtcctccacaatacacgagaaagctatgatccaattcgaatggcatgacggcacagttaagaatatccatgtcgaccccccgttcctgtacaaatatcaacagcagctgagccgcgctatgcggatgtacgagaggcgcattgaatggctgtcacttgcttcacgcaggatttgggggactgtatgtgaaaagcgcgttgtggtgttgctcgacattagcgctaccaatagtatgtatatcatccatattcagcattccctgaggctcttgctggaggaacaactgagtaacaaagactgcttcaatctgatcgcttttggaagcacaatcgaatcctggagacctgaaatggtgcccgtttcccacaataatcttcagtctgcttggagatgggccctcaaccttagatgtcgaggatctagaaacgtgctgtctgccctgaggaaggctgtggaagtggattttaaagacaaggacaaacaccagtctcaggggatttacctgttcacgggggggatacctgaccaggacatgcccacgctgtccgcttacatggccgaagcatgcgggggatgtgatttgcagttaaatgtatgtctgttctacgtcggagagcccaagatggataccacccctcccgcccggtacgcgtctcacacagatactgccgcagcctataaggaggtgacaagagccgccggcggaaggtttcattggttcggcgatacaggtatatacgaaagcgacgacatcaattccatcatgtcagagatggagaaggctctgaactactcccagaagtgtgcgttcctcatggcatcattgaagaatcattctggcaaggtacttggttcgagtgccctcccaaaagagaagccaaagaccctgcagctgcgctctcaaccgaagaagctgtgtccacctcgacccaccgtcccactaggcgccaggatgtcaatcaaggatgatcccgatcgcgagaagagcccccctctgaagagcttgaagtggcggccattgagttcgagggtgggcatttctccggcagcggctcaaccaaccaaggaggggatgatggaactgcgtagaaaaactaaatcacgggaggccgagacctcgctactgctcttttacaccgaaaagggaaacgatgtggggagtgtgtataagaagtacccacagggtcgcggactccgacggacttcaagttcaatagacttgccccgtaaagacaccgtttgctctagtcaggaatgggtcgccaagtacggactgaagaagctgaagcttgaaatatctcgctgcatgggtcctaactgcacccatcaaaaatcaggccaaagatccgctagcgcaaagcattgttccatcttcccttctgtcgagatccacggagtggtgaggcacatccaatggaccccgcgggaaatggaggtatacattaggcacctggagaaagtgcttaggcggtacgtgcagcggctacaatggctgctgtctgggagcagaaggctcttcgggactgttttggagtcgaaggtttgcattctactagacacatccggaagcatgggaccttaccttcaacaggtgaagaccgaactggtgctactgatctgggaacagctccgcaagtgctgtgactcgtttaatctgctctcttttgcggaaagtttccagtcttggcaggataccctcgtggaaaccaccgacgccgcatgtcatgaagctatgcagtgggttacccacttacaggcgcaggggtccactagtatccttcaagctctattgaaggccttctccttccacgatctcgaaggtctttatctgcttaccgacggaaagccagataccagctgcagcctagttctgaacgaagtgcagaaactgcgagaaaaaagagacgtgaaagtgcatacaatttccctcaattgttcggaccgtgcggctgtcgagtttctgagaaaactcgcgagctttactggcggcagataccactgcccggtgggggaggatactctgagcaaaatccatagtctgttgactaagggatttataaacgagaaagaccctacactaccccccttcgagggcgatgaccttcggattttagcccaagagattactaaggctcgttcgtttttgtggcaagcccagtcctttcggagccagctacaaaaaaagaacgatgccgaacccaaggtgaccctgtcctag

SEQ ID NO: 8719 - DNA, 639 bp, Artificial Sequence
  Description of Artificial Sequence: Synthetic coding sequence
atggtgagccggatggtgagcaccatgctgagcggcctgctgttctggttagctagtggctggacgcctgcctttgcctactcgccgagaaccccggacagagtatcagaagctgatattcaacgactgctgcacggggtgatggagcagctgggcattgctagaccccgggtcgagtacccggcccaccaagcgatgaatctggtggggccccagtcgatcgagggtggagctcacgagggcttacaacatctaggtcctttcggcaatatccccaatatcgtagccgagctgacaggtgacaacatcccaaaggacttctcagaggatcaaggttatcctgaccctcccaacccctgccctgtgggcaaaacggctgacgatggctgtctggagaacacccctgacacggccgaattttcccgcgagttccaactgcaccagcatttgttcgaccctgagcatgattaccccgggctggggaaatggaataagaaactcctctatgagaagatgaaaggcggtgaaagaagaaaaagacggagcgtcaacccttacctgcagggacagagactcgataacgtcgtagccaagaagtccgtgccacacttctccgacgaagacaaagatcctgaatag

SEQ ID NO: 8720 - DNA, 1524 bp, Artificial Sequence
  Description of Artificial Sequence: Synthetic coding sequence
atgtgcaccaagaccatccccgtgctgtggggctgcttcctgctgtggaacctctatgtgtcaagcagccagaccatatatccaggcataaaggctagaattacccaacgggcacttgactacggggtgcaagcaggcatgaaaatgatcgaacagatgcttaaggagaagaaactacccgacctctcaggcagcgagtctcttgagtttcttaaggtggactacgtcaactataacttcagcaacataaaaatttctgccttcagcttccctaatacaagcctggcctttgttccaggagtgggcatcaaggcactcacgaaccacgggactgccaacattagtacggactggggttttgaaagccccctttttcaggatacgggcggggccgatcttttcctctccggggtgtattttactggcataatcattctgacacggaatgacttcggacacccgaccctgaagttgcaagactgctacgcccagttaagccatgcgcatgttagtttctccggggaattatctgtcctttataattcattcgcagagcctatggaaaagccaattctcaagaatttaaatgagatgttatgcccaatcatcgcgtctgaagtcaaagctttgaatgctaatctgagtactctggaagttctgactaagattgacaactatactctgctggattacagcttaatctcgtcccccgagatcacagagaattacttagacctgaacctgaagggagttttctaccccctggagaacctgacagatccccctttttcaccggtcccatttgttctccctgaacgttcaaacagcatgctgtatatcggcattgcagaatatttcttcaaaagtgcaagctttgcccatttcaccgcaggtgtctttaacgtgactctctccactgaagagattagtaaccattttgtgcagaattctcaagggctggggaacgtgttgtcacgaattgccgagatttacatactctcccagcctttcatggtacggatcatggccacagaaccccccatcattaatctccagcccggcaactttactcttgacataccagcttccattatgatgctcactcagccgaagaacagtacagttgaaacaatagtgtccatggacttcgtggcctccacttcggtgggattggtgatcctggggcagaggctggtctgcagcctgtctctgaatagattccgactggccctccccgagtccaacagaagcaatattgaagtcctcagatttgagaacatactgtcaagcatcctccattttggcgtcctacctctggccaacgcaaaactccagcaaggatttcctcttagtaacccacataaatttctgtttgtaaactccgacattgaggtgctagagggatttcttctgatctccacggacctgaagtatgagacttctagtaagcagcagccctccttccacgtatgggaaggccttaatctgatttctcgtcaatggcgcggcaaaagcgcaccctag

SEQ ID NO: 8721 - DNA, 474 bp, Artificial Sequence
  Description of Artificial Sequence: Synthetic coding sequence
atgcacccctggctgggcagcgccctgggcttccccaagtgccggggtatccacctttgcgcctgcggcaatgggtggacgccaggagagacactcagtcagaacaagaccgagatcaccaaaaacaaggtgacatgctggcgacctcacggttgtgagcccaacacaggcttgggatatcagggctcacatacaagcaaatacactcttctgccctggaatctgctgaaaaccaaaccacttcccccctcacacggcaaggagggggggaaggaggccaaagtaccatctggtgacaattccgggcggggtgaagtcccgcgagctcaggagggtcaggctgcctgtggtcgcgcagcttctggagactctcaggaggggatgagacgcgggtatgaggagcgggccaccgcccagcgtcccgctgtccgttctgcagaaactactgctcatggcacctggatttacccatag

SEQ ID NO: 8722 - DNA, 213 bp, Artificial Sequence
  Description of Artificial Sequence: Synthetic coding sequence
atgagcaacaacatggccaagatcgccgaggcccggaagaccgtggaacagctcaaattggaggttaacatcgacagaatgaaggtgagccaggcagcagccgagctactggctttctgcgagacccacgccaaggatgacccactggtgacccctgtccccgcggccgagaaccccttccgtgacaagagactgttctgtgtcctgttatag

SEQ ID NO: 8723 - DNA, 645 bp, Artificial Sequence
  Description of Artificial Sequence: Synthetic coding sequence
atggccctgctgctgtgcctggtgtgcctgaccgccgccctggcccatggatgtctgcactgccactcaaacttttctaagaagttttccttctacaggcatcacgtcaattttaagtcttggtgggtgggtgacattcctgtgagcggcgccctgcttaccgattggtcagatgacacgatgaaggagctgcatctagccatccccgccaagattactcgggagaagctagatcaggtggccaccgctgtgtatcaaatgatggaccagctctaccagggtaagatgtattttcctggatatttccccaacgagcttaggaatatatttcgagaacaggtgcatcttattcaaaacgcaatcattgagtccagaatcgactgccagcaccggtgtggtatttttcaatacgaaacaatctcttgcaataactgcaccgactctcatgtcgcctgcttcggatacaattgcgagagttctgcccagtggaagagcgccgtgcaaggcctgctcaattacatcaataactggcacaagcaggacacctccatgagccttgtgtctcccgcacttaggtgtttagagcccccacacctcgctaaccttacgctcgaggacgccgccgaatgtttgaaacaacactag

SEQ ID NO: 8724 - DNA, 459 bp, Artificial Sequence
  Description of Artificial Sequence: Synthetic coding sequence
atgagcccccacctgaccgccctgctgggcctggtgctgtgcctggctcagaccatccatacccaagagggagcactcccaaggccgtcaataagtgcagagcccgggaccgtgatcagccccggatcccacgtgacctttatgtgccgcggtcccgttggtgtacagacgttcagacttgaacgggaagaccgggcgaaatataaagactcttataatgtcttcaggctggggccctccgagagcgaggcgcgcttccatatcgacagtgtctcggaggggaatgctggactctatcgttgtctctactataaaccccctggctggagtgagcacagtgacttcctcgagctgctggtcaaagagtcgagcggcgggcccgactcccctgacacggaaccagggagttccgccgggacagtgcccggcacggaggccagcgggttcgatgcgccgtag

SEQ ID NO: 8725 - DNA, 900 bp, Artificial Sequence
  Description of Artificial Sequence: Synthetic coding sequence
atggccccctggagccaccccagcgcccagctgcagcccgtgggcggagatgcagtctcgccagcgctgatggtgctcctttgtctgggcttgtccctggggccccgcacccacgtgcaggcgggtaatttgtctaaggcaacactctgggcagagcctggaagcgttatttcccgagggaactcggttaccatcaggtgccagggaaccctggaagcccaggagtataggctggttaaggaggggagcccggagccatgggatacccagaaccctctggagccaaagaataaagccagattcagcattccttcaatgacggaacatcatgccggtcgctataggtgctactactactcgcccgcaggatggtcagaacccagcgatccactagaactggtagtgaccgggttttataacaagcctaccttgtcagccctgccaagcccagtggtcaccagcggtgaaaatgttacgttgcaatgtggatcacgtcttagatttgatcgtttcattcttacggaggaaggagatcacaagttatcgtggacactggattctcagctgactcccagcggtcagttccaagcgttgtttcctgtgggacccgttaccccaagtcacaggtggatgctgagatgttacggttctcggcgtcatattctgcaggtgtggtcggagccaagcgatctcctagaaattcccgtgagtggagccgccgataatttatcaccttctcaaaacaagagcgatagcggcacagctagccatctccaggactacgccgtggaaaatctaattcgcatgggaatggctggcctaatcttggtcgtgttggggatcctgattttccaagactggcatagccagagatcacctcaggccgccgccggcagatag

SEQ ID NO: 8726 - DNA, 618 bp, Artificial Sequence
  Description of Artificial Sequence: Synthetic coding sequence
atgaaggtgctgctgctgaccggcctgggcgccctgttcttcgcctattactgggatgacaacttcgatcccggtgggctagactatctggtgctgaaccacatcggcggggcaccagcaggcacacgcgctcgctccccccaggccacccgatggctcatgcaggtgaatttcgttagttatgttcaactgaccagcagggccctaccctctctgacagatagtaagggctcgcttgttgtggtgtcgtcacttctgggcagggtgccgactagtttttccactccctattccgctgccaaattcgctttggatgggttcttcgggtccctgagaagggagctcgatgtccaggacgtaaacgtggcgataactatgtgtgttcttggtctccgggaccgcgctagtgctgccgaggccgtgcggggggtgacacgggtgaaggccgctcctggccccaaggctgctctggccgtcatcaggggtggagcaacccgggcagcaggtgtgttttacccatggcggtttcgcctgctgtgcctcttacggagatggctgccacgcccacgcgcatggtttattcggcaggagctcaatgttaccgccgcagctgcgtag

SEQ ID NO: 8727 - DNA, 795 bp, Artificial Sequence
  Description of Artificial Sequence: Synthetic coding sequence
atgctgcggtgcggcggccggggcctgctgctgggcctggccgtggccgcagccgcagtgatggctgctcggttaatggggtggtgggggcctagagcaggctttaggctgtttatcccggaagaactgagcagatatcgtggtggccccggggatccaggcttatatctggcgctgctgggacgggtttacgacgtgtcctccggacgcaggcattatgaacctggttcacattacagcggctttgccgggcgggacgcctccagagcctttgtaaccggcgactgttccgaagccggcctagtggatgatgtgtctgatctttccgccgcggagatgctgactctgcacaattggttaagtttttacgagaagaattacgtttgtgtcgggagggtgactgggcgcttctatggcgaagatggactgcctactcctgctctcacacaggtcgaggctgctatcaccagagggctcgaggccaataagcttcagctgcaggaaaagcagacattccccccatgcaacgcggagtggtcctctgctcgagggtcccgcctgtggtgtagtcagaagtccggcggtgttagtcgcgactggatcggtgtaccgcgaaagttgtataagccaggcgcaaaagagccccgctgtgtttgtgtgcggaccacgggccccccatccggacagatgcccgataatcctccccatcgcaacaggggtgatctggatcaccccaacctggctgaatataccggatgccctcctctggccataacttgctcattcccgctttag

SEQ ID NO: 8728 - DNA, 468 bp, Artificial Sequence
  Description of Artificial Sequence: Synthetic coding sequence
atgagcaagcggctgctgctgctgctgctgctgagcatgggcggcacttgggcctccaaggagcccctgcgaccccgctgccgaccgattaacgccaccttggccgtggaaaaagagggctgtcccgtgtgcattaccgtgaataccactatttgcgccggctattgtcctacaatgaccagagtactccagggtgtactaccggccctgcctcaggttgtctgcaattatcgagatgtgcggttcgagagtattcgacttcccgggtgtccacggggcgtcaaccccgttgtgagttacgcggtggccctctcttgccagtgcgccctctgcaggcggagcacaacagactgcgggggccctaaggaccacccattaacatgcgatgacccccggttccaggatagcagctcctccaaggccccgccacccagcctgccgagcccttcgagactcccaggcccatag

SEQ ID NO: 8729 - DNA, 498 bp, Artificial Sequence
  Description of Artificial Sequence: Synthetic coding sequence
atggagatgttccagggcctgctgctgctgctgctgctgagcatgggaggcacatgggcatccaaggagcccctcaggcctcggtgccggcctatcaacgccaccctagccgtcgaaaaggaagggtgtccagtatgcattaccgtgaatactactatctgcgccggatactgccctaccatgactagggtgctgcaaggagtcctcccagccctgcctcaagtggtctgcaactacagggacgtcagattcgaaagtatcaggctacctggctgcccccggggcgtcaatccagtggtgtcatatgctgtagctctgagttgtcagtgcgcgttgtgtagacgctccaccacggactgcgggggcccaaaagatcatccactgacttgtgacgacccccgattccaagacagctcaagctcaaaggctccccctcctagtctcccttctccgtcccggctgccaggtccttcagatactcctatattaccccaatag

SEQ ID NO: 8730 - DNA, 990 bp, Artificial Sequence
  Description of Artificial Sequence: Synthetic coding sequence
atgctgcccctgctgctgggcctgctgggccccgccgcctgctgggccttaggccctacacccggacctggctctagcgaactccgatctgctttctctgctgccagaacaaccccgttagaagggacctctgagatggctgtgaccttcgataaggtgtacgtcaacatagggggcgactttgatgtggccactgggcagttccgatgcagggtgccaggcgcctactttttttcatttaccgctggtaaggctccccacaaaagtctgagtgtcatgcttgtgagaaacagagacgaggtgcaggcactagcattcgacgagcaaaggcgtcctggggccagaagggccgcttcccagtccgccatgctgcagctggactacggtgacacagtttggttacggttacacggcgccccgcagtacgccctcggggcccctggagccaccttctcaggctacctagtctatgccgatgctgatgcagatgctccagcccggggacctcctgctcctcccgaacctaggtccgcatttagcgcggctcgaacgcggtctctggtggggtccgacgccggtcctggccctcgtcatcagcccctggcttttgacaccgaattcgtgaatattggaggcgactttgacgccgctgctggagtgtttcgttgtcggctgcctggtgcgtacttctttagctttacactgggcaagttgccaaggaagactctgtctgtaaagctgatgaaaaaccgggacgaagtccaggcaatgatttatgacgatggcgctagccgccggcgcgaaatgcagtctcagagtgtcatgttggcactgcgtaggggcgatgccgtgtggcttctgagtcatgaccacgacggatatggggcctacagtaatcacgggaaatacatcaccttttccgggttcttggtgtaccccgatcttgcaccagccgcgccccctggccttggcgcctccgagctcctctag

SEQ ID NO: 8731 - DNA, 873 bp, Artificial Sequence
  Description of Artificial Sequence: Synthetic coding sequence
atgcggcggcccgccgccgtgcccctgctgctgctgctgtgcttcggcagccagcgggccaaggctgctaccgcctgtggaagaccccgcatgctgaacaggatggttgggggccaggatactcaggagggtgagtggccttggcaagtctccatccaaagaaacggctctcacttctgcggaggcagccttatcgctgagcagtgggtcctgaccgcagcacactgttttaggaatacctctgagacttccctataccaggttttgctcggagcccggcagctggtgcagcctggaccccacgcaatgtatgccagggttcggcaggtggaaagtaacccactgtatcagggaaccgcctcatccgccgacgtggccctggttgagctggaagcaccagtcccattcactaactacatcctacccgtgtgcctgcccgatccctctgttattttcgagaccggcatgaactgttgggtgactggctggggcagtccgagcgaggaggatttgctgccggaacccaggattctgcagaagctggcagtccctattattgatactccaaagtgtaacttgctgtatagtaaggacaccgagttcggttaccagcctaaaacaattaaaaacgatatgttgtgtgccggctttgaagagggcaaaaaagacgcttgtaaaggcgactcgggggggccactcgtttgcctcgtgggccagtcatggctgcaggcgggcgttatatcctggggggagggctgcgcgagacagaacagaccgggggtctacattcgggtgacggcgcaccataactggattcaccggatcatcccgaagcttcagtttcagccagctagattgggcgggcagaagtag

SEQ ID NO: 8732 - DNA, 792 bp, Artificial Sequence
  Description of Artificial Sequence: Synthetic coding sequence
atggccttcctgtggctgctgagctgctgggccctgctgggcaccacttttggctgcggagtcccagccatccaccccgtcctgtcgggacttagtcggattgtcaatggcgaagacgcagtgccggggtcctggccctggcaagtgtccctgcaggataaaaccggattccatttctgcggggggtccctgatttctgaagattgggtggttacagcggctcattgcggcgtccggacttccgacgtggtggtggcaggggagttcgaccagggcagcgacgaagaaaacatccaagtgctcaagatcgcaaaggtgtttaagaatcctaaattttctattttgacagtgaacaatgacattacactgctaaaacttgctacacctgcacgcttttcccaaacggtcagcgcagtgtgcctgcccagtgcagatgacgattttccagccggcaccctgtgtgccacaactggctggggcaaaacaaagtacaacgcaaataagactcctgacaagttgcagcaggccgctctgcccctactgagtaatgccgagtgcaagaagagttggggaagaagaattaccgacgtcatgatttgtgcgggcgcgagtggagtgtcctcttgcatgggagactctggagggcctctggtgtgtcaaaaagacggggcctggaccctcgtgggaatcgtaagttgggggagccggacctgctcaactacgactccggccgtgtatgcccgcgtggccaagcttattccgtgggttcagaaaatcctggccgccaactag

SEQ ID NO: 8733 - DNA, 228 bp, Artificial Sequence
  Description of Artificial Sequence: Synthetic coding sequence
atgggcgccgccatcagccagggcgccctgatcgccatcgtgtgcaatggccttgtgggttttctattgctgctcctgtgggtgatcctgtgttgggcttgccacagtaggtcagctgatgtcgacagtttgtccgaaagccggacacaggagagtgcttgcctagagttagatcccgccgctcagtcgttggcttccctcgcccctataggagcgcagtggccctag

SEQ ID NO: 8734 - DNA, 762 bp, Artificial Sequence
  Description of Artificial Sequence: Synthetic coding sequence
atggcccggagcctgctgctgcccctgcagatcctgctgctgagcctcgccttagaaacagcaggggaggaggctcaaggtgacaaaataattgacggcgcaccatgcgccagaggctcacacccgtggcaggtggccctgctgagcgggaaccagctgcattgcggtggtgtgctcgttaacgagaggtgggtcctgacagccgcccactgtaagatgaacgaatacacagtgcacttaggctctgacaccctgggcgaccgccgggcgcagcgaatcaaagcatccaaatccttccgacacccagggtactctacccagactcatgtgaatgatttgatgctggtcaagctgaattcccaagccagactgtctagtatggtgaaaaaggtgaggctgccaagcagatgtgagccccctggcacaacatgcacagtgtcaggatggggaactactacatcccccgacgtgacttttccatctgatctgatgtgtgttgacgtcaaactcattagtccgcaggattgtaccaaagtgtataaggacctgctcgaaaactcaatgctgtgcgccggtattccagatagtaagaaaaatgcctgtaatggggactctggcggtccactcgtgtgtcggggtacacttcagggactggttagctggggtaccttcccatgcggtcagccaaatgatcctggcgtgtacacacaggtgtgtaagttcacgaaatggattaacgatacgatgaagaaacacaggtag

SEQ ID NO: 8735 - DNA, 480 bp, Artificial Sequence
  Description of Artificial Sequence: Synthetic coding sequence
atgaaggcctggggcaccgtggtggtgaccctggccaccctgatggtcgttacagtggacgcaaaaatctatgaacgatgcgagctcgccgcgcgcttagagagggccgggctgaatggatacaaaggatacggggtcggggattggctgtgcatggctcattacgagtccggtttcgataccgccttcgtggaccacaaccctgatgggagcagcgagtatggaatcttccaattaaattctgcctggtggtgtgacaatggaattacccccacaaagaacctgtgccacatggactgccacgacctgctcaaccgacacatactggatgatattcgctgcgccaaacagattgtatcttcgcagaatggtctgtctgcatggaccagctggcggctgcactgctctggccatgatctttcagagtggctgaagggttgcgatatgcatgtcaaaatcgatcctaaaatccacccctag

SEQ ID NO: 8736 - DNA, 501 bp, Artificial Sequence
  Description of Artificial Sequence: Synthetic coding sequence
atggcccagaccaacagcttcttcatgctgatcagcagcctgatgtttctttctctcagtcagggccaggagtcacagaccgagttgcccaaccctcggatctcatgtccagagggaaccaacgcctatcgctcctactgctattatttcaacgaagacccagagacatgggtcgatgccgatctctactgccagaatatgaattctgggaatcttgtgtcagtccttacccaggctgaaggagcattcgtcgcctccctgatcaaggagagctcaaccgacgactctaacgtttggatcggactacacgatcccaagaagaataggagatggcactggtcttccgggagtctcgtaagctacaaatcttgggacaccggcagtcccagctctgccaacgcaggttactgtgcatccctgacctcctgttccggctttaagaagtggaaagacgagtcatgtgaaaagaaattcagtttcgtgtgtaaattcaagaactag

SEQ ID NO: 8737 - DNA, 528 bp, Artificial Sequence
  Description of Artificial Sequence: Synthetic coding sequence
atgctgccccccatggccctgcccagcgtgagctggatgctgctgagctgccttatgctcctgtctcaggtgcaaggcgaagagccacagagggagctgccttcagctaggattaggtgcccaaaggggtcgaaagcctacggcagccattgttatgcattgttcctgtcccccaagtcctggactgatgccgacctggcatgtcagaaacggccctcaggcaacctggtttccgtactgagcggagccgaaggctcctttgtgagctccctggttaagagcatcgggaactcttacagttatgtgtggattggactgcacgatcctacgcaaggaactgaacctaatggcgagggttgggaatggagctccagtgatgtcatgaactacttcgcttgggaacggaatcctagcaccattagttctcccgggcactgtgcctccttatcaaggtcaaccgcttttcttcgctggaaggactacaactgcaacgtgcgactgccctatgtgtgcaaatttaccgattag

SEQ ID NO: 8738 - DNA, 1686 bp, Artificial Sequence
  Description of Artificial Sequence: Synthetic coding sequence
atgggcgcccggacccccctgcccagcttctgggtgagcttcttcgcagaaaccgggatactgtttcctggagggacaccttggccaatggggtctcagcactcgaaacagcacaggaagccggggccactgaagcggggccaccgacgcgatagaaggaccacccgaagaaagtactggaaggaggggcgcgaaatcgcccgcgtgctggacgacgaggggcgcaatctcagacagcagaagctggacaggcaaagagcactgctagagcagaagcagaagaagaaacgacaggagcctctcatggtccaggccaacgccgacggacgcccacgctcacggagagcgaggcagtccgaagagcaggcacctctcgtcgaatcttatcttagtagttctggtagtactagctaccaggtgcaggaggccgacagccttgcctcagtgcagctgggggcaactcgccctacagcgccagcttccgccaagcgcaccaaagccgccgctaccgctggggggcaaggtggagcagctcgcaaagagaagaaaggaaagcacaagggcaccagcgggcccgccgcccttgccgaagacaagtccgaggcccaaggacctgtccaaattcttactgtgggacagtcagatcacgcacaagacgccggcgagaccgccgctgggggcggtgagaggcccagcgggcaggatcttagagccaccatgcaacgaaaggggatcagcagttctatgtcttttgacgaagatgaggaggacgaggaggaaaatagctcttctagcagtcagttaaatagtaatactaggcccagtagcgcaaccagcagaaagtcagtacgggaggccgcaagcgccccctccccaaccgctcccgaacagcccgttgatgtggaggtgcaggatctcgaagagttcgcccttcgtccagcccctcaaggaattacaataaagtgtaggataacgagagacaaaaaaggcatggaccgtggcatgtacccaacatactttctgcatctcgatcgggaagacggaaagaaggtttttctgttggcaggaaggaaaaggaagaagagcaaaaccagtaattatctcatatccgttgaccccaccgatctgtcaaggggaggtgactcctatatagggaagttgagatccaatttaatgggaaccaagtttaccgtgtatgataacggtgttaatccccagaaggccagttctagtactcttgagtcggggactctccgacaggaactggctgcagtgtgctatgagaccaatgtcctcgggttcaaggggcccaggaaaatgagtgtcatcgtgcctggaatgaatatggtgcacgagagggttagcatccgaccgcgtaacgaacacgaaactctccttgcccgttggcagaataagaacactgagtctattattgagttgcagaataagacgccagtgtggaatgacgatacacaatcctatgtgctcaattttcacggccgcgttacccaggcttctgtcaagaatttccaaattatacatgggaacgatccagactatatcgttatgcagtttggtcgagtggcagaagacgtcttcaccatggattataactatccactttgtgcgttgcaggcttttgcgatagcactatcctcattcgatagtaaattagcatgcgagtag

SEQ ID NO: 8739 - DNA, 1272 bp, Artificial Sequence
  Description of Artificial Sequence: Synthetic coding sequence
atgatgtaccggcccgacgtggtgcgggcccggaagcgggtgtgctgggagccctgggtcatcgggctggtgatcttcatctcgttgattgttctagccgtctgtatcggactgacagtgcactatgtgaggtacaaccagaaaaaaacatataactactatagtacattgtctttcactacagacaagttatatgcggaattcggacgggaagccagcaacaacttcaccgaaatgtcacagcgtttggagtctatggttaaaaatgctttctataaatctccactgcgcgaggagttcgtgaagtcgcaggtcatcaagttttcccagcagaagcatggcgtgctggcccatatgctcctgatctgtagattccacagcactgaggatcctgagacggtggacaaaatcgttcagttggttctgcacgagaagttacaggacgccgtcgggcctccaaaggttgatccccacagcgtcaagatcaagaaaattaataaaaccgagaccgactcttacctgaaccattgctgtggtaccaggaggtctaagacacttggacagagcctgagaatagtggggggtaccgaggttgaagagggtgaatggccatggcaggcaagtcttcagtgggacgggtcgcatagatgcggcgcaactctcatcaacgccacatggctggtgtccgcagcacattgctttactacctataaaaatcctgcccgctggacagcctccttcggagttaccatcaagccatcaaagatgaagcgcgggcttcggaggatcatcgtccacgagaaatataaacatcccagtcacgactatgacatttccctggccgaacttagttcccccgtaccgtacacaaacgctgtccacagggtctgccttccagacgcatcgtatgagttccagcccggcgatgtgatgtttgtcaccggctttggggctttaaagaatgacggttactcccagaatcatctaaggcaggcccaggtgacgctcatcgacgctacgacttgcaacgagccacaggcttacaatgacgcgatcaccccccgaatgctatgtgcgggcagtctggaaggtaagacagacgcctgccagggtgactcagggggccctcttgtaagcagcgatgcacgggatatctggtaccttgcaggcatcgtgagctggggagacgaatgcgcgaagcctaataaaccaggagtgtataccagagtgaccgcactcagagattggatcaccagtaaaacaggtatttag

SEQ ID NO: 8740 - DNA, 282 bp, Artificial Sequence
  Description of Artificial Sequence: Synthetic coding sequence
atgaagcccgtgctgcccctgcagttcctggtggtgttctgcctggctttgcaacttgtgccaggtagccccaagcagagagtgttaaaatatattctggagccaccaccatgtatatccgcccccgaaaattgtacccacctctgtaccatgcaggaagactgcgagaagggattccagtgctgcagctccttttgtgggatagtgtgctcctcagaaactttccagaaacgcaacaggatcaaacacaagggatcagaagtcattatgcccgcaaattag

SEQ ID NO: 8741 - DNA, 1530 bp, Artificial Sequence
  Description of Artificial Sequence: Synthetic coding sequence
atggacttcctgctggccctggtgctggtgagcagcctgtacctgcaggcagcagccgagtttgacgggaggtggccgcgacagattgtctcttccatcggtttatgccgctacggtggtagaatcgattgctgttggggctgggcccgccagtcttggggccagtgtcagcctgtgtgccagccccggtgcaaacacggagagtgcattggcccaaacaagtgcaagtgccacccaggctatgcaggtaaaacatgtaaccaggacctgaatgaatgcggactcaagccccggccgtgtaagcatcgctgcatgaatacttacggttcttataaatgttactgcctgaacggctacatgctgatgccagacggcagttgcagttccgctctcacctgctccatggcaaattgtcaatacggatgtgatgtagttaaaggacaaatccggtgtcagtgtccgtcccctggactgcagttggctcccgatggcagaacctgtgtggacgtggatgagtgtgccacaggccgggccagctgcccacgttttcggcaatgcgtgaatacctttggctcttatatctgtaagtgtcacaaagggttcgatcttatgtatatcgggggaaagtatcagtgccacgacatagatgagtgctcccttggccagtatcaatgttcaagcttcgctcggtgctacaacatcaggggttcctataaatgtaagtgtaaagaaggataccagggcgatggtttaacatgtgtttatatccccaaggttatgattgagccaagtgggcccatccacgtacctaaaggcaacggaaccattctgaagggcgacacgggtaataacaactggatacctgatgtcggctcgacctggtggccaccgaagacgccttacattccgcctattattaccaatcgccctacctccaagcccaccacgaggccaacgcccaaacctacacctattcccacccccccacctccgccacccctacccacagagctgagaacgcctctcccccctaccacacctgaacgcccaaccacgggactgacaactattgctccagccgcctctactcctcctggaggtattacagtggacaaccgcgttcagaccgatccacagaaacctcgaggtgacgtctttagtgtgctggtccattcgtgcaactttgaccatggcctttgtggctggattcgcgagaaagacaatgatttgcactgggaacccattcgagatcctgccggtggccaatatttgacagtgtcagcggccaaagcacccggcgggaaggccgcccggttagtgttacccttgggccggttaatgcatagtggcgatctgtgtctcagcttccgccacaaggtgactgggctacacagcggtacactccaggtgtttgtgcgcaaacatggtgcccacggagctgctctctggggcagaaatgggggccacggatggagacagacgcagatcacactgcgaggggcagacattaaatccgaaagtcagaggtag

SEQ ID NO: 8742 - DNA, 381 bp, Artificial Sequence
  Description of Artificial Sequence: Synthetic coding sequence
atggacaagagcctgctgctggagctgcccatcctgctgtgctgcttccgggcattgtctggatccctctccatgaggaatgacgccgtaaatgaaattgtggctgttaagaacaactttccggtgattgagatagtgcaatgccgtatgtgtcacctgcagtttccaggcgagaaatgctcacggggtagaggcatttgcactgccacaacagaagaggcctgtatggtgggtagaatgtttaaacgcgacgggaacccttggttaacattcatgggatgcctgaagaactgtgccgatgtcaagggtatccgatggtcagtctacctggtgaacttccggtgttgccggtcccacgatctatgcaacgaagacctgtag

SEQ ID NO: 8743 - DNA, 537 bp, Artificial Sequence
  Description of Artificial Sequence: Synthetic coding sequence
atggagctgctgcaggtgaccatcctgttcctgctgcccagcatctgctccagtaacagcactggcgtgttggaggctgccaataatagcctcgtggttactaccacaaaaccgtccattactacgccgaataccgaaagtcttcaaaaaaatgtagtcactccaaccaccgggaccactccaaaaggcaccataaccaatgagctgctcaagatgtcattaatgtcaaccgcaacgttcctgacatccaaggacgagggtctgaaggccacgacaactgatgtacggaaaaatgatagtatcatctctaatgtcaccgtgactagcgtgacattacccaatgctgttagcaccttacaaagttccaagcctaaaactgaaacccagtcgtcaatcaagactacagagatcccgggaacccctgagaacggaaatgatcagccgcagagcgataaggagtctgtgaagctgctcaccgtgaaaaccatctcccatgagtctggagaacatagcgctcagggaaaaaccaagaactag

SEQ ID NO: 8744 - DNA, 2544 bp, Artificial Sequence
  Description of Artificial Sequence: Synthetic coding sequence
atgttcaagtgctggagcgtggtgctggtgctgggcttcatcttcttggaatccgagggccgcccgacaaaagaaggagggtacggcctcaagtcctatcagccccttatgcgcctaagacacaaacaggagaaaaaccaggagagcagcagggtgaaaggcttcatgatccaggacgggccctttgggagctgtgagaataagtactgtggcctgggccggcactgcgtcacgagcagagagactgggcaggcagaatgcgcatgtatggatctctgcaaacgacattacaaacccgtctgtgggagcgacggggaattctacgagaaccactgtgaggtccatagggcagcctgtctcaaaaagcagaaaatcactatcgtacacaatgaagactgtttttttaagggggataaatgcaagaccaccgaatatagcaaaatgaagaacatgctgttggatctgcagaaccaaaaatacattatgcaagagaatgaaaaccccaacggagatgatattagccggaaaaagttgcttgttgatcagatgttcaagtacttcgacgccgacagcaacggcctcgtggacatcaatgaactcacacaggtgatcaagcaagaggagctgggcaaggacctgtttgattgcactctttacgtgctgctgaaatacgacgactttaatgcagacaaacatctagcgctcgaggagttttacagggcctttcaagtaatccagctgtctcttccggaggatcagaaactctcaattactgcagccactgttgggcaaagcgctgttctctcctgtgctatacaggggacactgagaccacccattatttggaaacgaaataatattattcttaacaatcttgatctagaagacattaacgactttggtgacgacggcagtctgtacataaccaaggtcacaacgactcacgtaggaaactacacatgttatgctgacggatacgagcaggtttatcagactcacatctttcaggtcaatgttcccccagtcatccgggtgtaccctgaaagtcaggctcgggaaccgggggtaaccgcgtcactgagatgccacgcagaggggatcccaaaaccccagctgggatggctcaaaaatgggattgatatcacccctaaattgtccaagcagttgacattacaggccaatggttccgaggtccacatctccaacgtaagatacgaagacaccggcgcctacacttgcatagccaaaaatgaggcgggggttgatgaagatataagcagtctgttcgtcgaggattcggcccgcaagacattggctaacattctgtggagggaagagggactcggcattggtaatatgttctatgtcttctacgaggacggcattaaggtcatccagccaattgagtgtgaatttcagagacatatcaagcccagcgaaaagttattgggtttccaagacgaagtttgcccgaaggctgagggagatgaagtgcaacgctgtgtatgggcttccgccgtgaatgtaaaagacaaatttatttacgtggcacagccaacgcttgatcgggtgttaattgttgatgttcagagccaaaaagtggtccaggctgtgagcaccgaccctgtgcctgtgaagctccattatgacaagagtcacgatcaggtgtgggtcctgtcttggggaactctggagaagaccagccccacactccaagtgataaccttggcctcaggtaacgtgcctcaccatactattcatacccagcccgttggcaagcagttcgatcgagtcgatgatttttttatccctacaacaaccctgatcattacacacatgagattcggcttcattcttcataaagatgaagcggccctgcagaagattgacctggagaccatgagctatattaagaccataaatctgaaggattacaagtgtgtccctcaaagtcttgcctacacacatctgggtgggtactattttatcggatgcaagccagattccacaggtgcggtgtccccacaggtgatggttgacggggtgaccgactccgtgattggctttaactcagacgttaccggaaccccctatgttagccccgacgggcactacctggtctccatcaatgatgttaaaggtctcgtaagggtccagtatatcactatcagaggcgagatccaggaagcattcgatatttatacaaacctacacatttccgatcttgcctttcaaccttccttcaccgaggcccaccagtacaacatctacggatcatctagtacgcagactgacgtcctcttcgtggaactgagctccggcaaggtaaagatgataaagtctttaaaggagcctctaaaagcagaggagtggccctggaatcgcaaaaatagacaaattcaggatagcggactctttggccagtatttgatgacgcctagcaaggactcactttttattcttgatggccgactcaataaactgaattgcgaaattacagaagtcgagaagggaaacacggtaatctgggttggtgatgcctag

SEQ ID NO: 8745 - DNA, 273 bp, Artificial Sequence
  Description of Artificial Sequence: Synthetic coding sequence
atgcggctgagcgtgtgcctgctgctgctgaccctggccctgtgctgttacagagcaaatgctgttgtgtgtcaggccctgggatccgagatcactggctttctgttagccggaaagcctgtttttaaattccagttggcgaaattcaaggccccacttgaggctgtcgcggctaagatggaagtaaagaaatgtgtggacacaatggcatacgaaaaacgcgttcttataaccaaaacattgggcaaaatcgctgagaaatgcgaccggtag

SEQ ID NO: 8746 - DNA, 1044 bp, Artificial Sequence
  Description of Artificial Sequence: Synthetic coding sequence
atgagcagctggagccggcagcggcccaagagccccggcggcatccagccacatgtttctagaaccttgttccttctgctgctgctggccgccagtgcatggggggtgactctgtcaccgaaggattgccaggttttccgatccgatcacgggagctcaatctcttgccagcctcctgcggaaattccaggctatcttcccgcagatactgtacacctcgctgtcgaatttttcaatctgactcacctgccagcaaacctgctgcagggggccagcaagcttcaggagcttcacctctcctctaacggcctggagtccttgagccctgagttcctacgaccagtcccacagctccgggtcctcgatctgaccaggaatgctttgaccggactaccaccaggcctcttccaggcttctgccaccttggatacacttgtgcttaaggagaatcaacttgaggtgttggaggtgtcttggctgcacggtcttaaggctttggggcacttggatcttagtggcaatcgccttaggaaactgccacctgggttactggcgaacttcaccctgctcaggactcttgacctcggcgaaaatcagctggagaccctgcctcctgatcttctcagagggcccttgcagttagagaggctgcacctggaaggaaataagttacaggtgcttggaaaggatctcctgctgcctcaaccagaccttagatacttgttcctgaacggaaataagcttgcgcgagttgctgccggcgcctttcaagggttgcgccaacttgatatgctggacctttctaataatagtctggcaagtgtgcccgaaggcctgtgggcgagcctgggccagccaaactgggatatgcgagacggatttgatatctccggcaacccatggatctgcgaccaaaatctttctgatctctaccgttggctccaggcccagaaggataagatgtttagccagaacgacacaaggtgcgcaggacccgaggccgtgaagggtcagaccctgctggctgtcgctaagtcccagtag

SEQ ID NO: 8747 - DNA, 1407 bp, Artificial Sequence
  Description of Artificial Sequence: Synthetic coding sequence
atgcccccctggggcgccgccctggccctgatcctggccgtgctggctctgctcgggctgcttgggccacggctgcgaggaccatgggggagggcagtgggggagcgtaccctacccggtgcccaggatagagacgacggggaggaggctgacggtggaggaccagccgatcaattttccgatggacgtgaacccttgccgggaggatgttccctcgtttgtaagccaagtgctctggctcaatgcctgttgcgagcactcagacggtccgaggcactagaggctggtcccaggtcctggtttagtggtccgcacttgcagactctctgtcattttgtgctacccgtggccccgggcccggagttggcccgggagtatttgcagctcgccgacgacggcctcgtagcgttggactgggtggtgggtccctgtgtacgcgggagacggataactagcgccggtgggttaccggccgtgcttcttgtaatcccaaatgcatggggacggcttacgaggaatgtgcttgggctgtgtctgctcgcactggagcggggatactatccagtcatatttcaccgccgaggccatcatggatgtcctctggtcagtccaagacttcaaccattcggcgacccgtcagatttaaaggaagcagtgacatacatcagatttaggcatccggcggcacccctctttgctgtgtccgaaggctccggcagcgccctgctactgagctacctgggcgagtgcggttccagcagctacgtgacaggagcagcttgcatcagtccagtactgcgttgccgtgagtggttcgaggccggcctgccatggccatacgaaagagggtttttgctccaccagaagattgcactctcacgctacgcaaccgccctggaggacacagtagacaccagcaggctgttccgttctcgttccctgcgggaatttgaagaggcactgttctgccataccaaatcattccctatttcatgggatacgtattgggaccggaacgacccactccgcgatgtcgatgaagctgcagtccctgtgctgtgcatatgcagtgcagatgatcccgtgtgcggccctccagaccacacactgaccacagaactgttccattcaaacccctacttcttcctcttacttagtagacacgggggtcactgcggatttctgcggcaggaaccgctgcctgcttggtcacatgaggtcattctggagtcattccgtgctctgaccgaatttttccgcacggaggaaaggatcaaagggctctcacgacatagggcttcgttcctgggtggcaggaggagaggtggcgctctgcagagacgggaggtatcctcctccagtaacctcgaagagatcttcaactggaagagatcatacacaaggtag

SEQ ID NO: 8748 - DNA, 423 bp, Artificial Sequence
  Description of Artificial Sequence: Synthetic coding sequence
atgttcttcaccatcagccggaagaacatgagccagaagctgagcctgctcctcttagtgttcggcttgatctggggtcttatgttgctccactatacgttccagcagccacggcatcaatccagcgtgaaactgcgggagcagatcctggatctttccaaaaggtacgtcaaagcactggctgaagagaataagaatacggtggacgttgagaatggggcatcgatggcaggctatgccgatttgaaaagaactattgcggtcctgctcgacgacatcctccaaaggctggtcaaacttgaaaataaagtagactacatcgtggtcaacggttctgctgctaataccaccaatggcacctccgggaatctggtccccgtcactaccaacaagcgaactaacgtctctgggagcattcgctag

SEQ ID NO: 8749 - DNA, 993 bp, Artificial Sequence
  Description of Artificial Sequence: Synthetic coding sequence
cggggcgccctggtgggcgccccccggagcgcccgggccagctgcttgagagggcgccggcctgggcggcggcagccatgtggaagatgcccagaccctcctagaagtggccccgggcaggctgggagagcaaggtgcgccagggacgtggctgcgcagaccgcgctggctcctcgcgccctggctctaggggcaggggccgctggccccggctggaggggtgcagtgcctcgcaggcccgctgcgagagtgtcacgggcggctcagaggcaggaacaggaattggtcagactccaccgcgaacaggagtgcgaattgcaacccgagccggcgcctccccggccatcaggccccgctactgcagaggatcccggtcggcgtccagtcctcccccagcgaccccctgaggaacgaccccctcagccacccggtagcacgggcgtgatcgctgagaccgggcaggccgggccccctgcaggcgcaggtgtctcagggtatccgaagtctccgcccgttgcatcacctggcgcccctgtcccttctctcgtgtccttcagcgccggactgactcagaagccttttcccagcgatggaggtgttgtcctttttaacaaagtactcgtgaacgatggggacgtgtacaatccatcaacaggggtgtttaccgcaccttacgacggtcggtacctgatcactgctaccctcacccccgagagggacgcgtatgtggaggccgtcctctcagtgtccaatgcctcagttgcccagctgcatacagcgggctatcggcgcgagttcctggaataccacagacctcctggggcactgcacacatgtggcgggcctggagcctttcatctgatcgtccacctgaaagccggagatgccgttaacgttgtcgtgaccgggggcaaattagcccacactgatttcgacgagatgtactcaacctttagtggcgtgtttctgtatccgttcttatcacatctgtag

SEQ ID NO: 8750 - DNA, 585 bp, Artificial Sequence
  Description of Artificial Sequence: Synthetic coding sequence
atgagcgccctgtggctgctgctgggcctgctggccctgatggacctgtctgagtcatcaaactggggctgttatggcaatattcagtcgcttgacacgccgggagcttcttgcgggatcggaaggaggcacggtctgaactattgcggagtgcgcgcatcagaaagactagctgaaattgacatgccttatctgctgaaatatcagcccatgatgcagaccataggacagaaatattgtatggaccccgcagtgatcgctggggtcctgtcccggaaatcgcctggcgacaaaatcctggttaatatgggggacagaacaagcatggtccaagatcctggatctcaggcccccacatcatggatctcagagtctcaggtcagccagaccactgaggtcttaactacccgcatcaaagagatccagcgacgtttccctacatggacacccgatcagtacctacgtggtggcctgtgtgcttacagcggtggggctggatacgtgaggtctagtcaagacttgagttgcgacttctgtaatgatgttctggccagagccaaatatctgaaaaggcacgggttctag

SEQ ID NO: 8751 - DNA, 273 bp, Artificial Sequence
  Description of Artificial Sequence: Synthetic coding sequence
atgaagttcctggccgtgctggtgctgctgggcgtgagcatcttccttgtatctgctcagaacccaacaacagctgcccccgccgacacctatcctgctaccggacccgctgacgacgaggctcccgatgccgaaaccactgcagccgcaaccacagcaactactgccgctcccacaacagctaccacagctgcgtctacgaccgcccgtaaggacataccggtcttacccaaatgggtaggtgatctgcctaatgggagggtctgtccctag

SEQ ID NO: 8752 - DNA, 1914 bp, Artificial Sequence
  Description of Artificial Sequence: Synthetic coding sequence
atgagccggatgctgcccttcctgctgctgctgtggttcctgcccattacggaggggtctcaacgcgctgagcctatgtttaccgccgtgaccaactccgtgctgcctcccgactacgattctaacccaacccagctcaactatggcgtcgctgtcaccgatgttgatcacgacggtgatttcgagatcgttgttgccgggtacaatggccccaatttggtgttaaaatatgatcgtgcccagaagagactcgttaatatcgctgtggacgaaaggtcctccccctattatgcactgagggaccgtcaggggaacgctattggagttacggcatgcgacattgacggagatgggcgcgaggagatctactttctcaatacaaataatgcgttctctggcgtggccacctatactgacaaactatttaaattccgtaacaatcggtgggaggacatcctgtccgatgaagtgaacgtggcgaggggcgtcgcgagcctcttcgccggtcgatcggttgcatgcgttgaccggaagggtagcggaaggtattccatctacatagcaaattacgcctatggcaatgtcggtccagacgccttgatcgagatggaccctgaagcctctgacctgtctcgtgggatcctggctctgcgggatgtggccgcggaggcaggcgtgtctaagtatacaggagggcgcggggtgtccgttggacctatcctttcctccagcgcctctgacatattctgcgacaatgagaatgggccaaatttcctcttccacaaccggggggacgggacctttgtcgatgccgccgccagcgctggcgtcgatgatcctcaccagcatggacggggtgtcgcactagcggattttaaccgggatggtaaggtggacattgtgtacggaaattggaacgggccacacagactgtacctccaaatgtccacccacggtaaagtcagattccgcgacatcgcttcaccgaaattttccatgcccagccccgttcgtacagttataaccgcagatttcgataacgatcaggaacttgagatttttttcaacaacattgcctaccgctcatcttctgccaataggctgtttagagtgatcagacgggaacacggcgatccactcattgaggagcttaaccccggagacgcactggagcccgaaggccgcggtactgggggcgtggtgacggactttgacggggacgggatgctggatctgatcctttctcatggagaatcgatggcacaaccacttagcgtctttaggggcaaccagggctttaacaacaactggttgcgggtggtcccccgcacacgcttcggagcgttcgctagaggcgcgaaggttgtcctgtacacaaaaaaaagcggagcccacctgcggatcattgatggtggttctggctatctatgcgagatggagccagtggcccacttcggcctggggaaagatgaggcttcctctgtagaggttacctggcccgatggcaagatggtgtctagaaatgtggcaagtggcgagatgaattccgtattggaaattttatatcctcgggatgaggacactctgcaggatcctgcaccattagagtgcggccaggggttttcccagcaggaaaacggtcattgcatggatactaatgagtgcattcagtttccatttgtgtgtccgcgcgataagcccgtgtgcgtaaacacctacggatcttaccggtgcaggactaacaagaagtgcagccgggggtatgaacccaacgaagacggcaccgcctgtgttgcccaagtcgcctttcttgggggatactcttcagccgcctcacgcatctccgaaccgctgtcgagggcttcctacctttccctaggactcggcctgtgcttgcagttgtatgccctttag

SEQ ID NO: 8753 - DNA, 600 bp, Artificial Sequence
  Description of Artificial Sequence: Synthetic coding sequence
atggccctgaacggcgccgaggtggacgacttcagctgggagccccccaccgaagctgagactaaggtcctgcaggccagaagggagagacaggacaggatcagcagattaatgggggattacttactgcggggctatagaatgctcggcgaaacatgcgccgactgcggcactattctcttgcaagataagcagagaaaaatctattgcgtcgcctgtcaggaacttgattcggacgtggataaggataatcctgcccttaatgctcaggcggcacttagccaagcccgggagcaccagttggccagtgccagtgaactccctttgggatcaaggccagcaccgcagccacccgttcctagacccgaacattgcgaaggcgctgcagcgggacttaaggcagcccaggggccacccgcccctgctgttccaccaaatacagacgtgatggcatgtacccagaccgctctgctccagaagttgacatgggcttccgcagaattaggctcttccactagcctggaaaccagtattcagctgtgcggattgatccgggcttgcgccgaagctttgcggtcactacagcaactgcaacactag

SEQ ID NO: 8754 - DNA, 813 bp, Artificial Sequence
  Description of Artificial Sequence: Synthetic coding sequence
atgaagctgggctgcgtgctgatggcctgggccctgtacctgagcctgggggtcctctgggtggctcagatgctcctcgccgctagctttgagaccctgcagtgcgaaggccctgtgtgtacagaggagagcagttgtcacactgaggatgatctaaccgacgccagagaggccgggtttcaggtcaaggcgtacactttcagcgagccatttcatctgatcgtgtcttacgagctgtttcctgcgcctatccttagggccgtcccctccgcagaaccccaagccggctctcccatgaccctgtcttgtcaaacaaaattaccactccagcgctctgccgcccgcctcctgttcagtttctataaggacggcaggattgtccagtctcgaggtcttagtagtgagttccaaatcccaactgcctctgaggatcacagcggaagctattggtgtgaagcagccactgaggacaatcaggtatggaagcagagcccacagttagagatcagagttcaaggtgcgtcatctagcgctgcgccccccaccctgaatcccgctcctcagaaaagcgctgcccccgggacggcccccgaggaggcgccgggacctctgcctccaccacctacaccatcctcagaggatccaggattttccagccccctgggcatgccagacccccacttgtaccatcaaatgggtctgctcttgaaacatatgcaagacgtgcgggtattgctgggccatctattgatggagttacgcgagctgagtggacacagaaaacctggcactaccaaagcaaccgccgaatag

SEQ ID NO: 8755 - DNA, 2421 bp, Artificial Sequence
  Description of Artificial Sequence: Synthetic coding sequence
atgcggctgagccccgcccccctgaagctgagccggacccccgccctactggcactggcactgccgctggccgccgctcttgcattcagcgacgagaccttggacaaggtaccaaaatcagaaggctattgttcacggatacttcgggcccaggggacgaggagagagggatatacagagttcagcctcagggttgaaggcgatccagatttttacaagcccggtacctcctaccgcgtgactctaagcgcagcgcccccttcttatttccgagggtttacacttattgccttgcgggagaatagggaaggagacaaggaggaagaccatgcaggcacatttcagatcattgacgaggaggagacccagttcatgagcaattgtcctgtcgctgtcacagagagtacaccccggcggaggactcgcatccaggtgttttggatcgcacccccagcaggcactggatgtgtcatacttaaagcctcaattgtccaaaaacgaataatctattttcaggacgagggatccctaacaaagaagctttgcgaacaggattctacgtttgatggcgttacagataagcccattctggactgctgttgtggcacagctaaatacaggttaacattctacggcaattggtctgagaaaacacaccccaaggactacccacggcgggccaaccattggagcgcgattatcggaggcagtcatagcaagaactatgtgctctgggagtatggaggatatgctagcgagggcgtcaagcaggtagcagagttggggtccccagtgaaaatggaagaagagattagacagcagtctgatgaagtgctgaccgtgatcaaggccaaggctcagtggcctgcttggcagccgttaaacgtgagggctgcgccaagcgcagagttctccgtcgatcgtacccggcacctgatgagcttcctgacgatgatgggcccttccccagattggaacgtgggcctttcagccgaggacctgtgcaccaaggaatgcggctgggttcagaaggtggtgcaggatctgatcccatgggacgccggaaccgactctggagtcacctatgagtcgccgaataaacctactatcccgcaggaaaagattcgtccccttaccagcctcgatcacccccaatccccattttatgaccctgaaggagggtctattactcaggttgcccgggttgtcatcgaacgcattgcacggaagggcgaacagtgtaacatcgtgccagacaatgtggatgatattgtggccgatttagcaccagaggaaaaggatgaggacgacactcctgagacctgcatttacagcaactggtctccatggtctgcatgctctagctcgacttgtgacaaaggtaagcggatgagacagcggatgttgaaggcccagcttgatctgtcagtgccttgcccagatacacaggatttccagccatgcatgggacctggatgctccgatgaagatggatccacttgcacaatgtcggaatggattacgtggagtccgtgttctatatcatgcggcatgggtatgcgcagccgggagagatatgtgaagcagtttccagaggacggttcagtgtgtacattgcccactgaggagacagagaagtgtacggtgaatgaagagtgctctccctccagttgcttaatgacagagtggggcgagtgggatgagtgctcggccacttgcggaatgggaatgaagaaacgccataggatgatcaaaatgaatcccgcagatggctccatgtgcaaagccgagacctcgcaggcggaaaagtgcatgatgcccgagtgccacacaattccttgccttctgagcccttggtccgagtggtcagactgttccgtgacttgtggaaagggcatgcggacacgccagcgcatgctgaagtccctagctgagctgggagactgcaatgaggacctcgaacaggtagagaaatgtatgttaccagagtgcccaatcgactgtgagctgaccgaatggtctcagtggtctgagtgcaataaaagttgtggaaagggacatgtaatcagaactcggatgattcagatggaaccccagtttggcggagccccatgccccgaaaccgtacagaggaagaagtgccgaatcagaaaatgtctaaggaatccttctattcagaaacttaggtggcgagaggcacgtgagtccaggaggagtgagcagctgaaggaggagagcgaaggtgaacagttcccaggatgtcgcatgagaccttggacagcttggtctgagtgtacgaagctttgtgggggaggaatccaggaacggtacatgactgtcaagaagaggttcaagagctctcagttcactagctgtaaggacaaaaaagaaataagagcctgcaatgtgcacccctgttag

SEQ ID NO: 8756 - DNA, 4242 bp, Artificial Sequence
  Description of Artificial Sequence: Synthetic coding sequence
atgcggcacggcgtggcctgggccctgctggtggccgccgccctgggactgggtgccagaggcgtgaggggggccgttgccctcgcggatttttacccatttggagctgagcgcggggatgctgttactcccaagcaagacgacggaggcagcggtttaagacctctcagcgtgccatttcccttcttcggagccgaacactcaggtttatatgtcaacaacaatgggatcattagtttccttaaagaggtgtcccagtttaccccggttgccttccctatcgcaaaagaccgctgtgtggtggcggcattctgggcggacgtcgacaaccggcgtgcaggagacgtatactatcgcgaggcaactgatcctgctatgcttaggcgtgcgaccgaagacgtgagacactatttcccagagctcctggacttcaatgcaacatgggtcttcgtggccacatggtaccgggttactttcttcggcggtagctcctcgtccccggttaacacctttcagactgtcttgataaccgatggcaagctgagctttaccatcttcaattatgagagtatcgtctggaccaccgggacacacgcgagctcgggaggaaacgccacaggtttgggcggcattgctgcccaggccggttttaatgcaggagacggacagagatacttcagtataccgggttcaaggacagctgacatggctgaagtggagactaccactaacgttggggtccctggcagatgggcttttcgaatagatgacgcccaggtccgagtaggcggctgtggccacacgactagcgtttgtcttgctctgcgaccttgcttgaacggaggcaagtgtatcgatgattgcgtgacaggcaacccaagttatacatgctcctgtctgtctggttttacaggacgcaggtgtcacctggacgtgaacgaatgcgcctcccaaccttgccaaaatggcggcacttgcacccatggtattaattctttcaggtgccagtgtcccgccggctttggcggtccaacgtgcgaaacagcccagagcccctgcgatactaaggagtgtcagcacgggggacagtgtcaagtggagaacggaagcgcagtgtgtgtttgccaggccggatacacaggggcagcctgcgagatggacgttgatgattgctccccagacccatgccttaatggcggatcctgcgtggatttggtgggcaattatacatgcctctgtgcggaaccatttaagggcctgagatgcgaaactggcgatcaccccgtgcctgacgcctgcctatcggccccctgccacaatggcggcacatgcgtcgacgctgatcaaggatacgtctgcgaatgccccgagggtttcatggggctggattgtagggagcgggtgcccgatgactgcgaatgtagaaacggcggcagatgcctgggggcaaatacaaccttatgtcagtgcccgctgggcttttttggcctgttgtgcgagtttgaaattactgccatgccttgtaatatgaatactcagtgtccggacgggggctactgtatggagcacggaggatcatacttatgcgtttgtcacactgatcataacgccagccatagcttgcctagtccgtgtgactctgacccgtgcttcaacggcggttcttgcgatgcacatgatgatagctatacatgcgagtgcccccgagggttccatggaaagcactgtgaaaaggcacgcccgcacctctgttcttccggtccttgcagaaacggcggcacttgtaaggaggccgggggcgaataccactgtagctgtccttatcgttttacaggccggcactgcgaaattggaaaaccagattcatgcgcatcagggccatgtcacaacggcggaacctgtttccattatatcggtaaatataaatgcgattgccccccaggtttcagtggccgccattgtgaaatagcgccttcaccatgcttccggtccccatgcgtgaacggtgggacatgcgaggatagggatacagactttttctgccattgccaggccggctacatgggacgcagatgtcaagctgaagtcgactgtggcccccctgaggaagtgaaacacgctactctgcgtttcaatggcacccgtttgggggctgtcgccctgtatgcttgtgacagggggtactccctcagcgccccctctagaattagggtctgccaaccacatggagtgtggtccgaaccgccccagtgcctggagatcgatgagtgccgatcccagccctgtcttcacggcggatcttgtcaggacagggtagctgggtacctatgtttgtgtagtactggttacgagggcgcacattgcgaactcgagcgagacgaatgcagagcccatccgtgtcgaaatggcggaagctgccgcaatctgccaggggcctatgtgtgtaggtgtcccgctggcttcgtgggtgtccattgcgagaccgaggtagacgcgtgtgacagttctccatgccagcatggcgggcggtgcgagtcaggcggaggcgcctatctatgtgtgtgcccagagagtttctttggctatcactgcgaaaccgtgtccgatccgtgtttttcaagcccttgtgggggtaggggctattgcctcgcctccaatggatcccatagttgcacatgtaaagtcgggtatacaggcgaggactgcgctaaggagctctttcctccaaccgcactgaaaatggaaagagttgaagagtccggggtaagcatctcttggaacccccctaatggcccagccgcgaggcagatgctcgacggatacgctgttacctatgtttccagcgacggaagctaccgccggacagattttgttgacaggactcggtctagtcaccaattacaggccctggctgcaggacgagcctataatatcagtgtattttcagtgaaaaggaatagcaacaataagaatgacataagccggccggcagtgctgcttgcacggacgaggccaagacctgtggaaggctttgaagtaacaaacgtgacagcaagcaccatttctgtgcagtgggctctgcaccgcatcaggcacgcgactgtgtccggcgttcgcgtatctattcggcacccagaagctctgagagaccaggcaacggatgtggaccgatccgtggaccgatttacattccgggccttgcttccagggaaaaggtatacgatccaattgaccaccttaagcggattacggggcgaggagcaccccaccgaaagtctggcaaccgcaccaacccacgtttggacccgccccctgcctccagccaacctgaccgccgcccgggtgacggccaccagtgcacacgtcgtgtgggacgcacccacccccgggtcattactcgaagcgtatgtaatcaacgttactacaagccagagcacaaaaagcagatacgttccaaatgggaagctcgcctcctacacggtccgggacctgctcccaggtcgcaggtaccagctttccgtcattgctgtacagtccacagagctgggaccgcaacactccgagccggcccacctatacataatcacgtctccccgggacggagctgatcggcgatggcatcagggtggtcaccacccgcgggttctaaaaaatcggccaccccccgctcgcctacccgagctgcgactgctgaacgaccatagcgccccggagaccccaacccaaccaccacggttttctgagcttgtggacggccgcgggcgtgtgtccgctagattcggaggctctccaagtaaggccgccactgtgcgttcacagcccacagccagcgctcagctggaaaatatggaggaagcccccaaaagagtcagcctcgctttgcagttgcccgaacatggctcaaaagacattggcaatgtgcctgggaattgctctgaaaatccctgccagaacgggggcacttgtgtgcctggcgcagatgcacactcatgcgattgcgggccaggattcaagggtagacgctgcgagctggcttgcatcaaagtttcgcgtccatgtactcggctgttttccgaaactaaagccttccccgtgtgggaaggcggtgtatgtcatcacgtctataagcgtgtttaccgtgttcatcaggatatctgttttaaggagtcctgcgagtctacaagcctgaagaaaacccccaaccgcaaacagagcaagtcgcagaccctggagaaaagctag

SEQ ID NO: 8757 - DNA, 1008 bp, Artificial Sequence
  Description of Artificial Sequence: Synthetic coding sequence
atgttcctggccaccctgagcttcctgctgcccttcgcccacccctttggcactgtgagttgcgagtacatgcttggaagccccctctcatctctcgcacaagtgaatctctctccattctcccaccctaaagtgcatatggacccgaattattgccacccaagtacgtccctgcatttatgttctctcgcttggtcctttacacggctgctgcatcccccccttagccctgggatctcccaggtggttaaggaccacgtgaccaaaccaacagccatggcacaaggccgagtcgcacatctgatagaatggaagggatggtcaaagccatcggacagtccagcagcactggaatcagccttcagcagttacagcgacttaagtgagggagaacaagaagccaggttcgcagccggtgtggccgagcagttcgctatagctgaggctaagctgcgggcctggagttccgtggatggtgaagacagtacggacgacagctacgacgaagattttgcagggggcatggatacagacatggctggacagctgcctctggggccacacctgcaggatctttttaccgggcacaggttctctcgacctgtcagacagggctccgtggaacctgaatcggattgctcccagactgtgagcccagacactttgtgttcctctctttgcagcctggaagacggactccttggcagccccgcccgactggcctctcagctcctgggcgatgaacttctgttggccaaactgcccccctcccgtgagtccgcttttcgctccttgggaccactagaggcccaggattctttgtataatagcccgttgaccgaatcatgcctcagccccgctgaagaggagcctgccccgtgcaaagattgccagccattgtgcccccctctgactgggtcctgggagcgtcagcgtcaagcaagcgacctcgcttccagcggagtggttagccttgacgaagatgaagcagagcctgaggaacagtag

SEQ ID NO: 8758 - DNA, 828 bp, Artificial Sequence
  Description of Artificial Sequence: Synthetic coding sequence
atgcagccccccggcccccgggaccccctgatccggctgtgcttcttcagggaggagggcacaaatgtggtacagaaaatctgcttctcaactcagattattagacacttcgaatctaaactgtccgacaccatcgaggtttaccaagaacgaatccagtggttaaccgagaacagcaaaaaagcctttgggctgataaaaggcgcaagagtgtcaatccttatcgacgttagcgccatcagtagtgggccccagaaagaggaattccagaaagaccttatgagcttaatcgatgagcagctgagccacaaagagaagttgttcgtactgtctttcggcacaaacgctgggtccctctggccagaccccatggaggtctccgccagtaccctgcaggagctaaaattgtgggtcaaaaccctccagcccgatggtggtagcaacctcctccaggccttgaagaaaatctttaccctaaaaggacttgacagcttggtggccatcatgcgatcatgtcctgatcagccaagcgaaatcttatccgattacatccagcaatctactatggggcgtgatctgatcatccatttcattacgtaccgttgtgatgaccagatgcctccggctgtcctgaaaaatctggccgaagccgtcaggggctattatcactgctattcccctaaaatggaacactacacctctagggatatggacgagttactggccgagattcagaaggctcagtcactgctatctcatgtccaggccctgcagcatagctccccatgcgaggctctcacatgcacaatggaggaacctcgcaactag

SEQ ID NO: 8759 - DNA, 438 bp, Artificial Sequence
  Description of Artificial Sequence: Synthetic coding sequence
atgctgacccggctggtgctgagcgcccacctgagcagcaccacctcaccaccatggacccacgccgccatcagttgggaactggacaatgtgcttatgccctcgcccaggatttggccgcaggtcaccccaaccggaagaagtgcttccgtgagatccgagggcaacacctcgtccctgtggaacttctctgccggacaggacgtgcacgcaattgtcacacgaacatgcgagtcagtcttgtcctctgcggtctacacccatggttgtggctgcgtccgctccgccacaaacatcacctgtcaatccagcggccagcagaggcaagcagcccgccaggaggaggagaacagtatatgtaaggctcacgattcgcgggaggggcggttaggttaccccctctccgcccatcagccggggagcggcggacccaactag

SEQ ID NO: 8760 - DNA, 777 bp, Artificial Sequence
  Description of Artificial Sequence: Synthetic coding sequence
atgaccccccccaagctgcgggccagcctgagccccagcctgctgttgctgttaagcggatgtctactagctgcggctagacgcgagaaaggcgcagcctcgaatgttgctgagccggttcccggacccactggcggcagctctgggcgcttcctgtctcctgagcagcatgcttgttcatggcaactcctactgccagcgccagaggccgccgctggatcagagttggccctcagatgccagagcccagacggcgctagacatcagtgcgcatacaggggccacccggagcgatgcgccgcgtatgctgcacggagagcacacttctggaagcaggtgcttggcggcctgaggaaaaaaagaaggccttgtcacgaccccgcacctctgcaagccaggctatgtgccggtaaaaagggccacggggcagagctcagactggtgcctcgggctagtccacctgctcgaccgacggtcgccggattcgcaggcgaaagcaaaccaagagcgaggaaccgcgggaggaccagggaacgcgcatctggcccggcagctggtacccccccaccccaatccgcccctccaaaagaaaatcccagcgagcggaaaactaacgagggtaaacggaaggcggccctggtgcctaacgaagagagaccaatgggaaccggccctgatcctgatgggcttgacgggaatgcagaactgaccgagacttattgtgcggaaaagtggcactccctctgcaacttcttcgtcaacttctggaacggatag

SEQ ID NO: 8761 - DNA, 393 bp, Artificial Sequence
  Description of Artificial Sequence: Synthetic coding sequence
atggcccggcggcactgcttcagctactggctgctggtgtgctggcttgttgtcacagtggcagaaggccaggaggaagtgtttacgcctccaggggattcccaaaacaacgccgatgcgactgattgtcagatttttactttaactcctccccccgcccctcgcagtccggtgacccgcgcacagccaatcactaagactccgagatgtcccttccacttttttccgcggagacccaggatccattttcgctttcccaaccgcccttttgtgcccagtcggtgcaatcaccggtttccttttcagccattctattggcctcaccggtacctcacctatcggtacttcccccgaaggcgcttacagcgcgggtccagcagtgaggagtcctag

SEQ ID NO: 8762 - DNA, 600 bp, Artificial Sequence
  Description of Artificial Sequence: Synthetic coding sequence
atgtaccccgccaccgccgtgccccagatcaacatcaccatcctgaagggcgagaaaggggaccgaggggatcgagggttacaaggcaagtacggcaagacaggctccgcgggcgcgcgtgggcacacgggcccaaaaggccagaagggcagcatgggcgcaccgggtgaacgctgtaaatcccactatgcagcattttctgttggtcgcaaaaaaccaatgcacagtaatcactactaccagaccgttattttcgataccgaattcgtcaatctatatgatcattttaacatgtttaccggcaagttctattgttacgtacccggactttacttcttttctctgaacgtgcatacttggaaccagaaggaaacctatttgcatatcatgaaaaacgaagaggaagtggtgattctgttcgctcaggtcggggaccggtctataatgcaatctcagtccttgatgttggagttgcgagaacaagatcaggtatgggtacgactctacaagggcgagagagaaaacgcgattttcagcgaagagctagatacctacattaccttctccgggtatctggtgaagcatgccacagagccttag

SEQ ID NO: 8763 - DNA, 702 bp, Artificial Sequence
  Description of Artificial Sequence: Synthetic coding sequence
atggccctgaagaacaagttcagctgcctgtggatcctgggcctgtgcctcgtggccacgacaagctccaagatcccatcgatcactgacccacatttcattgataactgtattgaagcccacaatgaatggagagggaaagttaatccgccggccgcagacatgaaatacatgatttgggacaaaggactggcaaaaatggcaaaggcctgggcaaatcagtgtaaattcgagcacaatgactgcctggacaagagttataagtgttatgcggcgtttgagtatgtgggagagaacatctggttaggcggcatcaaaagttttactccgaggcatgccattactgcctggtataacgaaacacagttttatgacttcgactccttgagttgctctcgggtgtgtggccactacacacagttagtgtgggccaatagtttctatgtgggctgtgcagtcgctatgtgtcccaacctgggaggggcgtccacagctatttttgtgtgtaactatggtcctgccggcaattttgcaaatatgcccccctatgtccgcggggaaagttgcagcctatgttccaaagaggaaaaatgtgtcaaaaatctatgtaaaaatcccttcctcaagcccacaggccgcgcaccccaacagaccgctttcaatccatttagccttggtttcctgctcttgaggattttctag

SEQ ID NO: 8764 - DNA, 669 bp, Artificial Sequence
  Description of Artificial Sequence: Synthetic coding sequence
atggccctgcacatccacgaggcctgcatcctgctgctggtgatcccggggctcgtcaccagcgcagccatatcgcacgaggattaccccgcagatgaaggcgaccagatttcttctaatgacaacctgatcttcgatgactaccggggtaagggatgtgtggacgatagcgggtttgtctacaagctgggagaaagatttttccctggccactctaactgcccttgtgtgtgcgctctagatggacccgtgtgcgatcagcccgaatgccctaagatccatccgaagtgcactaaagtcgagcataacggatgttgccctgagtgtaaagaagtcaaaaacttctgcgaatatcatggcaaaaactacaagatactcgaagagtttaaaccctcaccatgcgagtggtgtagatgcgagccatcaaatgaggtgcattgcgtggtcgccgactgcgccgtaccggagtgcgttaacccagtgtacgaacctgagcagtgctgtcccgtgtgcaagaacggccctaactgtttcgccggcacaaccattatccctgccggaattgaggtgaaagtcgatgagtgtaacatctgccactgccataacggcgattggtggaaacccgctcagtgctctaaaagggagtgtcagggcaaacaaacggtctag

SEQ ID NO: 8765 - DNA, 957 bp, Artificial Sequence
  Description of Artificial Sequence: Synthetic coding sequence
atgctgcccctgaccatgaccgtgctgatcctgctgctgctgcccaccgggcaggcagcaccaaaagatggcgtgactaggcccgacagtgaggtgcaacaccagttgctccccaacccattccagcccgggcaggagcagctgggcttacttcagtcttatttgaagggccttggacgaacggaggtgcagcttgagcacctgagcagggaacaggtcctattgtacctgtttgcccttcatgactacgaccagagcggtcagctagacggcttagagctgctgtctatgttgactgctgcactcgcccccggcgccgccaattcacctacgactaatccggtcatcctgatcgttgacaaggtactcgagacccaggacctcaacggggacggactgatgaccccagctgagcttatcaattttcctggagttgcgctccgccatgtggagcccggggagcccctggcccccagcccacaagagcctcaggcagtgggcagacagagcttgctagctaaatcaccactgaggcaggagacccaagaagcaccaggacctagagaggaggccaagggacaagtagaggcacggcgggaatccctggatccggtgcaggagccaggtggccaggctgaggccgatggtgatgtgccaggccctcggggggaggcggagggccaagccgaggccaagggggatgcacctggcccccgcggggaggccggcggccaagcagaggccgagggagatgctcctggccctcgaggagaagccggcgggcaggcagaggccgagggcgacgccccaggcccccgaggagaggctggaggtcaggcagaggcccgagagaatggcgaagaagcaaaggagctgccaggggaaacactcgagtccaagaacacacagaacgactttgaagtccatattgtgcaagtcgagaacgatgagatctag

SEQ ID NO: 8766 - DNA, 393 bp, Artificial Sequence
  Description of Artificial Sequence: Synthetic coding sequence
atgctggcccccctgttcctgtgctgcctgcggaacctgttccggaaattgatcagcttccagccaccccagctgggcaggaccaatatgcattacagcaaacttccccggaccgccattgaaacggagttcaagcaaaacgtaggacccccgcctaaggacctgacggcagaagtgtactttccttctataaagagtaggtcacacctccccgccgttttttataaccagtactttaaacacccaaaatgcgtaggggaatatggaccaaaaaacggggctgagcgtcagatcgaggagagaaaagtgctgccgactacgatgatgttttcaatgttagccgattgcgtgctgaagtcgaccccaatccccatcttgggcgtcgcaatgtag

SEQ ID NO: 8767 - DNA, 4362 bp, Artificial Sequence
  Description of Artificial Sequence: Synthetic coding sequence
atgatgctgccccagaacagctggcacatcgacttcggccggtgctgttgtcaccagaacctcttctctgctgtggtgacatgtatactactacttaatagctgctttctcatctccagcttcaacggcacggatttggaacttagactggttaatggcgacggcccatgctcagggacggtggaagtgaaatttcaggggcaatggggcacagtgtgcgacgatggatggaataccaccgcttcaaccgtggtgtgcaaacagctcggttgtccatttagcttcgcaatgttccggttcggccaggctgtcacgcggcacggcaagatctggctcgatgatgtgagctgttatggcaatgaaagtgctctgtgggaatgtcaacaccgtgagtggggctctcataactgttaccatggtgaggacgtcggggtgaactgttacggcgaagccaatctcggcctccgtctcgtggacgggaataacagctgcagcggaagagtcgaggttaagtttcaggagcgttgggggaccatctgcgatgacggatggaacctgaatacagcagctgtggtctgtcgacaactgggctgcccctcttcctttatttctagtggagtggttaattcccctgctgtgttgcgtccgatatggttggatgacatcttatgtcagggtaatgaacttgccctgtggaactgcagacacaggggctggggtaaccacgactgcagccacaatgaggacgtaactctgacctgttacgatagctcagacctggaactgcgcctcgtgggcgggactaaccgatgcatggggcgagtcgagctgaaaattcaaggccggtgggggacagtctgccatcataaatggaacaatgctgcagcagatgttgtgtgtaagcaactgggctgtggtactgccctgcatttcgccggactgccccacctgcagtcaggatcggatgttgtgtggctggatggggtcagctgttccggtaatgaatcatttctctgggactgtcggcatagtggcacagtgaatttcgattgtctccatcaaaacgatgtgtctgtgatatgcagcgacggggccgacctagagttaaggttagccgatggatcaaataactgcagtggcagggttgaagtacggattcacgagcagtggtggacaatctgcgaccagaattggaaaaacgaacaggccctggtggtgtgtaagcagctgggatgtccatttagcgtgttcgggtctcgcagagccaagccatctaacgaggccagagatatatggatcaactccatttcttgcactgggaatgagagcgccctctgggattgtacctacgacggaaaagctaagagaacctgtttccggagatcagatgcaggagtcatttgctctgacaaagccgatctcgacctgagactggttggggcccactctccttgctatggtcgtctagaggtgaagtaccaaggcgaatggggaactgtctgtcacgataggtggtccactaggaatgccgccgtggtgtgcaagcagctggggtgtggaaaacccctgcatgtgttcggtatgacgtatttcaaggaggcctcaggccctatctggctggatgacgttagctgcatagggaacgagtccaatatttgggactgtgaacattccggctggggcaagcataattgcgttcaccgagaggatgtgatagtgacatgtagcggggacgcgacctggggccttagactggttggaggctcgaatcgctgtagcggacggctggaagtgtactttcaggggcggtggggaaccgtgtgcgatgacggctggaattccaaggctgccgccgtcgtgtgcagccagttggattgtcccagctccattattggaatgggtctgggcaacgcttcaaccggttatggaaagatttggctggatgatgtgagctgtgatggagacgaaagcgatctatggtcctgtcgcaattcggggtgggggaataatgattgttcccacagtgaagacgtgggcgtgatctgttccgacgctagcgatatggaactgcgactggtcggggggagctcacgttgtgctggtaaagtggaagtgaatgtgcaaggtgctgtgggaattctctgcgcaaacggatggggcatgaatatcgcagaagttgtatgcagacagttggagtgcgggagtgccataagggtgtcaagagaacctcactttaccgagcgcacactgcacatcctcatgtctaattctgggtgtactggcggcgaagcctcactatgggactgcatccggtgggagtggaagcagacagcatgtcacctcaacatggaagcatccctcatttgttccgcacaccgtcaaccaaggctggtgggtgcagatatgccatgttcaggacgggtcgaggttaaacacgctgacacatggcggtctgtgtgtgactcggatttctccctgcacgctgctaacgtgctttgcagggagctgaactgcggggacgctatatcactgagtgttggagaccatttcggtaaaggaaacggtttaacctgggccgagaaatttcagtgtgaaggttccgaaacccaccttgctctgtgcccaatcgtccagcaccctgaggatacttgtattcatagccgggaagtcggggtagtttgttcacgctacacagacgtccgcctggtaaatggcaagagtcagtgtgacggtcaggtggaaatcaacgttctaggccattggggttcactgtgtgacacccactgggatccagaggatgcccgcgtcctgtgtaggcaactttcctgtggtaccgccctgtcgacgacaggcgggaaatacattggagaaaggagcgtacgtgtgtggggtcacagatttcattgtctgggcaatgagtccctgctcgacaactgccaaatgaccgtactgggtgctcccccatgcatccacgggaacactgtcagcgtcatctgtacaggtagtctgacccaacccctgttcccctgcctggccaatgtaagcgatccttacctgtcagccgttccagaaggtagcgcactcatatgcctggaggacaaacgtctgcgactggtggacggagactcaagatgtgccggacgagtggagatctaccacgacggtttttggggcactatttgtgatgacggatgggacttatcagatgcacacgtggtgtgtcagaaactcgggtgtggggtcgctttcaatgctaccgtgtcagctcacttcggggagggcagtggaccaatctggctagatgacctcaactgcactgggatggagtcacacctctggcaatgtccgagtcgaggctggggccagcacgattgccgacacaaagaagatgcaggcgttatttgctcggaatttaccgctctcagactttatagtgagaccgagaccgagtcctgcgccggaaggctggaggtgttttataacggtacctggggctcagtcggcagacgtaacattacaaccgccatcgctggcatcgtgtgtcggcagctaggctgtggtgaaaacggcgtagtctccctggcccccctcagcaagacagggtctgggtttatgtgggtggatgatatccagtgtcccaaaacccacatcagtatttggcagtgcctgagtgcaccctgggaaaggagaatttcttctcctgcggaggaaacatggatcacgtgcgaagaccgaatacgggtccggggaggcgacaccgagtgtagcggccgcgtggaaatctggcacgcaggcagttgggggacagtttgcgatgattcctgggacttggccgaggcagaagtggtgtgtcagcagttggggtgtggctcagctctggcagctctcagggatgccagttttggccaggggactggcactatctggctggacgatatgagatgcaagggaaatgagtcattcctttgggactgtcacgccaaaccatggggccagtctgactgtggtcataaagaggacgccggagtcagatgttcgggacagagcctgaagagcctgaacgcaagctccggccacttagcactgattctgagtagcattttcgggctgctgctgcttgtgctttttattctctttctgacatggtgtagggtgcagaaacaaaaacatctgccattacgcgtgagcacaaggcggcgcgggagcctcgaggagaatcttttccacgaaatggaaacttgcctgaaaagagaagacccacatggcacacgcacttccgacgatacccccaatcatggatgcgaggacgcatctgacacctcccttttgggggtactgcccgccagtgaagcaaccaaatag

SEQ ID NO: 8768 - DNA, 759 bp, Artificial Sequence
  Description of Artificial Sequence: Synthetic coding sequence
atgctgccccccccccggcccgccgccgccctggccctgcccgtgctcctgctcctgctggtggtgctcacaccgccccccacaggcgccagaccatcaccggggcctgactaccttcgtagaggatggatgagactgctagctgaaggagaaggatgtgcaccctgtaggccggaagaatgcgccgctccgagaggctgcctagcgggtagagttagagatgcttgtgggtgttgttgggagtgcgctaacttagagggccaactgtgtgacctcgacccgagtgcccacttctacggccactgcggggaacagctggagtgcaggcttgacacaggcggggatctgtctcgtggtgaggttccagagcctctctgcgcttgccggagtcagtccccgctatgtggtagcgacggtcatacttactctcagatttgtaggctgcaggaagctgctcgggccagaccagacgccaacctgactgtggcacatccaggcccctgcgagtccggacctcaaatcgtcagtcacccttatgatacttggagaggcccccgattacaaacactgggcaccgaagacaccctgaccacactggtgggggcgggtgggatggcacgcgccgtggcttgtggggaagcccccggcgaacatctggcactgcaggtcctgtgcctgtcaggcaagcgaaggcacctgtggcaagtaggcagcaccggctcaagcgaaggagtgcctagtgggggctcgttttggtag

SEQ ID NO: 8769 - DNA, 1323 bp, Artificial Sequence
  Description of Artificial Sequence: Synthetic coding sequence
atgaagctggccctgctgctgccctgggcctgctgctgcctgtgcggttctgcattggccaccggcttcctttacccgtttagtgcagcggcactccaacaacacgggtaccctgaaccgggcgctggctcacctggatcaggatacgcatccagaaggcattggtgccaccataccgtcacgagaacagtgtcctgtcaggttcaaaatggttcagagaccgttgtgcagcgggtatatcagtcatgtcgttggccaggcccttgcgccaacctggtatcttatcgtactctcatacggcccacgtaccgtgtgtcatatcggacagttacagttctggagtggaggtgttgtcccgggttcacaggctcgaactgtgacgaggaatgcatgaattgtacccgccttagtgacatgagtgaacggctcaccactttggaagcgaaggtgctgcttctcgaggctgccgaacggccatcctctcccgataatgatcttccggctccagagtcaacaccaccaacgtggaatgaggacttcctccctgacgcgatccccctcgcccatcccgtacctaggcaacggaggccaactggccccgcaggaccacctgggcagaccggcccccctggtcccgctggcccccctggaagtaaaggcgatcgtggccagaccggcgaaaaaggccctgctggtccacctggcctgcttggccccccaggaccacgtggtttgcccggggagatgggtcgtcctggcccgcccggacctcccggcccagccggcaatcctggcccttcccctaatagccctcagggcgctctgtacagcctgcagcccccaaccgacaaagataacggggattcccggttagcctccgctattgtagacacagtgttggccggagttccaggccccaggggtcctcctgggccacccggccctccaggtccacgcgggcctcctggccctcccggcacaccaggatcccaggggctggccggtgaacgcggtaccgtggggccatcaggggagcctggcgtgaaaggggaggaaggggaaaaagcagccactgctgagggagaaggggtgcaacaactccgcgaagccctcaaaatcctagccgagagagtcctgatcttggaacacatgataggcattcatgatcccctagccagtcccgagggctcaggccaggatgccgctctgcgcgcaaacctgaaaatgaagcgcggcggcgcccagcctgatggcgtactcgccgcgctgttggggcccgaccctggccagaaatcagtggatcaagctagctcccgcaaatag

SEQ ID NO: 8770 - DNA, 1341 bp, Artificial Sequence
  Description of Artificial Sequence: Synthetic coding sequence
atgctgcaccccgagaccagccccggccggggccacctgctggccgtcttgctcgcccttttgggaactgcctgggcagaggtgtggccaccgcagcttcaagagcaagccccaatggcaggtgccttgaataggaaagagtcattcttactcctgtccctccataacaggctcaggtcgtgggtgcaaccaccagccgccgatatgaggcggcttgactggtcagactcactcgcgcagcttgcacaggcgcgggctgcactctgtgggatccccactccaagcctggcatccggactatggcgaacactccaggttggctggaacatgcaactattgcccgctggtttggccagtttcgttgaagtagtgagcctgtggtttgctgaaggacagaggtactcccatgcagccggtgagtgcgcgagaaatgcaacttgtacacactatacccagcttgtctgggcaacatcatctcagttgggctgtgggaggcacctctgctctgctggccaggccgccatcgaagcattcgtgtgcgcctatagccccagagggaactgggaggtcaatggaaagacgattgtgccttataagaaaggcgcgtggtgctctttgtgtacggcctcagtgagtgggtgtttcaaggcctgggaccacgctggcgggttgtgtgaggtgccacgtaacccgtgtcgcatgtcatgtcagaatcacgggcgcctgaatatcagcacctgtcattgtcactgtccccccggctatacgggcagatattgtcaagtgaggtgctccctgcagtgtgtgcacggccggtttcgagaagaggagtgctcttgtgtctgcgacataggttacggcggggctcaatgcgccacgaaagtgcattttcccttccatacttgtgatctgcgtattgatggtgactgctttatggtctctagcgaggctgatacctactatcgtgcccggatgaaatgtcagcgcaagggcggggttctggcccaaatcaagagtcagaaggtccaggacattctagctttctacttgggaaggctggagacgaccaacgaggtaatcgacagcgattttgagaccaggaacttttggatcggtctgacctacaagactgctaaggattcctttcgctgggccacaggagaacaccaagccttcaccagctttgctttcggacagccggataaccacggcttcggaaactgtgtagaactccaggcctccgctgctttcaactggaacaatcagcggtgcaaaacacgcaatcgatacatatgtcaatttgctcaagaacatatttctaggtggggtcctgggtcctag

SEQ ID NO: 8771 - DNA, 219 bp, Artificial Sequence
  Description of Artificial Sequence: Synthetic coding sequence
atgcagcggctggtgctgctgctggccatcagcctgctgctgtaccaggaccttccagtgaggtccgagtttgaactagatcgcatttgcgggtacggcaccgcacgatgcagaaagaagtgtcgaagtcaggaataccggatcggaagatgccctaacacatacgcctgttgcctaaggaaatgggatgagtccctgctgaaccggaccaaaccttag

SEQ ID NO: 8772 - DNA, 2349 bp, Artificial Sequence
  Description of Artificial Sequence: Synthetic coding sequence
ctgtggctgctgctgtgggccgccgcctggcggctgggcgccagcgcttgcccagccctctgcacctgcacgggcaccactgtggactgtcacggcaccggcctgcaggctatccctaagaacattccgcggaatacagagcgcctcgagctgaatggcaacaatataaccaggattcacaaaaatgattttgctggccttaagcaactccgggtgcttcagctcatggagaaccagatcggagcagtggaaagaggagcctttgatgatatgaaagagctggagcgtcttcgcctaaatagaaatcaattacatatgctgcccgagctcctgtttcagaacaatcaggcactaagccgcctcgatctatccgagaatgccatacaggctatcccacggaaagcctttaggggcgccaccgatctcaaaaatctccagctcgacaaaaaccaaatcagttgtatcgaggaaggtgcattcagagccctgagaggcctggaggtgttaacactcaacaataacaatatcaccacaattccagtgagctccttcaatcacatgccgaaactgcggacgttccgacttcactccaaccacctgttttgcgattgtcatctcgcctggctgagccagtggctcagacaaagacctactatcgggcttttcactcagtgcagtggcccagcttcgctccgaggtctgaacgtggccgaggttcagaaatcggaattttcttgctcaggccaaggcgaagccggcagagtgccaacgtgcactttgagtagtggatcttgtcctgccatgtgcacctgctcaaatggtattgtggactgtaggggtaagggtctcacagcaattccggcaaacctgcctgaaactatgaccgagatcaggcttgagctgaatgggatcaaatccattccacccggtgccttctctccatataggaaactgcgccgcatttgccccctgagcttctgctcaccctgtcgtgatctgtccaataatcaaatcgccgagattgcaccagacgcctttcaggggctcagaagcttaaactccctggtgttgtacgggaataaaataacagatctacccagaggtgtctttggtgggctttacaccttacaattgttgctactcaacgctaataaaattaattgtatccgtccagacgcctttcaggacctgcaaaacctgtcgctgctctctctctacgacaacaaaatacagagtttggcaaagggcactttcacgtctcttagggcgattcagacgttacatctcgcccagaaccctttcatttgcgactgtaatctgaagtggttggccgacttcctccgaactaaccccattgagacatctggcgctagatgcgcttcccctcggcggcttgccaataagcggatcggtcagatcaaatccaagaaattcaggtgcagcgccaaagaacagtatttcataccagggacagaagattatcaattgaactctgagtgtaatagtgatgtggtgtgcccccataagtgtagatgtgaagccaacgtggtggaatgctcctctctgaaactgaccaaaatcccagaacgaatcccacagagtacagccgagctgcggctcaataacaacgaaatcagcatccttgaagcaaccgggatgtttaaaaagctgacccatttaaaaaagattaatctcagtaacaataaggtcagtgaaatagaggacggagcctttgagggcgccgcgtcagtgagcgagctgcaccttacggccaatcaacttgagtccatccgctctggcatgttcagggggctggacggactgagaaccctcatgttgcgcaataacagaatcagctgcatacacaacgattcttttacgggtttgcggaacgtacgcttgctgtccctttacgacaaccagattacgaccgtgtcccctggtgcctttgacacactacaatccctgagcacacttaatctgcttgccaacccttttaactgcaattgccagctggcctggcttggtggctggctccgtaaaaggaagattgtgacaggcaacccgcggtgccagaaccctgacttcctgcgccaaatacccctgcaggatgtcgcttttcctgatttccggtgtgaggaaggccaggaagaggggggatgtctaccccgccctcagtgccctcaggagtgcgcttgtctagacacagtggtacgctgtagtaataaacacttgcgcgcattgccgaagggtattcccaagaatgttactgaactctacctagacggcaatcagttcaccctggtcccaggccagttgagtactttcaaatacttgcaactagtgtag

SEQ ID NO: 8773 - DNA, 411 bp, Artificial Sequence
  Description of Artificial Sequence: Synthetic coding sequence
atgagcaacgtgccccacaagagcagcctgcccgagggcatccggcccgggacagttctgcgtatccgtggcctggtgccacccaatgcatctagatttcacgtgaatctcctttgcggcgaggaacagggcagtgacgccgcccttcacttcaatccgcgccttgacacgagcgaagtcgtgtttaatagtaaggaacaagggtcatggggccgcgaagaacgcggacctggagtaccttttcaacggggccaaccattcgaagtgctaattattgcaagcgatgacggctttaaagccgtagttggcgacgcacagtaccaccattttagacaccggctacctttggcccgcgttagattggtcgaagtcggaggtgatgtccagttggacagtgtgcgcattttctag

SEQ ID NO: 8774 - DNA, 1926 bp, Artificial Sequence
  Description of Artificial Sequence: Synthetic coding sequence
atgcccccccccctgcccctgctgctgctgaccgtgctggtggtggctgccgccagacccgggtgcgagtttgaacggaacccagccgcaacttgtgtcgatctgcagctcaggacttgttccgatgcagcctataatcatacaacctttccaaatcttctgcaacacaggagctgggaggtggttgaggcctcctctgaatacatacttctgtctgttctgcaccagctgctggagggccagtgcaaccccgacctccggttgctaggatgcgctgtgctggctccccggtgcgagggcggttgggtcaggcgcccatgtcggcacatctgcgaggggctcagagaggtgtgccagcctgcgtttgacgcaatcgatatggcctggccttactttctagattgccaccggtacttcacacgggaagacgaagggtgttatgatccactcgaaaaacttaggggtgggctggaagccgatgaggcactcccatccgggctacctcctacgttcattcggttttctcaccacagctatgcccagatggtacgcgttctccgacgcacagcctctagatgcgcccatgtcgcccgaacgtactctattggacggagtttcgatgggagagaactcctcgtgattgaattcagtagtcgcccggggcagcatgaactgatggagccagaggtgaagctgattgggaatattcatgggaacgaagttgcgggtcgtgaaatgcttatatacttagcacagtacttgtgctctgagtatttactcggaaatcccaggatccagcggctcttgaacaccaccagaatccacctgctgcccagcatgaaccctgatggatacgaagtcgcagccgcggagggggctggctataacgggtggacgtctggacgtcagaatgcccaaaaccttgacttaaaccggaatttccctgacctcacttccgaatactacagactcgcggagacgagaggtgcacgcagtgatcatatacccattccccagcactactggtggggcaaagtggctcctgagactaaggcaatcatgaaatggatgcagaccattccattcgtgctctctgctagcctgcacggtggagatctggttgtctcttacccgttcgacttctcaaagcatccgcaggaagagaagatgttctcacctacccctgacgagaagatgtttaagctgctctcccgggcttatgctgatgtgcacccgatgatgatggatagatccgagaatagatgtggtggcaactttctgaagaggggatccatcatcaacggcgcggactggtattccttcaccggggggatgtcagatttcaactacttgcatactaactgcttcgagataactgtggaattgggctgcgtgaaattccctccagaagaagccttatacatcctgtggcagcataataaagagtctctgctgaacttcgtggaaactgtccatcggggcattaagggggtggttactgataaatttggcaaaccggtgaagaatgcgagaatctctgttaaagggattcgtcacgacatcacgactgctcccgacggggattattggagactgctaccccctgggatccacattgtgatagcccaagcacccggctacgccaaagtgatcaaaaaggtgatcatcccagctcggatgaagagggctggacgggtagatttcatcttgcagcctctgggtatgggaccgaagaattttatccatggattgagaagaacagggcctcatgatcccctgggcggtgcttctagcctaggggaagcaacagagcccgaccccttacgggcaaggcggcagccctctgcagatgggtctaaaccatggtggtggtcctattttacgtccctgagcacccatcggcccaggtggctcctgaagtactag

SEQ ID NO: 8775 - DNA, 1305 bp, Artificial Sequence
  Description of Artificial Sequence: Synthetic coding sequence
atggccagcctgggcctgctgctgctgctgctgctgaccgccctgcccccattgtggtcttcatctcttcctggcctggacactgcagaaagtaaagcaaccattgcagaccttatcttaagtgccctcgaaagggccacagtgtttttagagcagaggcttcccgagatcaatcttgatgggatggtaggtgtccgggtcctggaagagcagctgaagtctgtgcgcgaaaaatgggcacaggagccgctactgcagcccctctctctgagggttggaatgctgggtgagaaattggaggcagcaatccagcgcagcctgcattacctcaagctatccgaccccaaatatctacgcgaatttcagctgacactccagcccggtttttggaaactgccccacgcttggatccacactgacgcaagtctagtttatcccacgttcggcccccaggatagcttctccgaggaacgttccgacgtgtgccttgtccagttgctaggcacggggacggatagctccgaaccctgtgggttatcggacctgtgccgatccttaatgactaaacctggctgttctggttactgcctgtctcatcaactgctctttttcctgtgggccaggatgcgcggctgtacccaaggaccactccagcagtctcaggattacatcaacctcttctgtgccaatatgatggatctcaacaggcgagccgaggccattggctatgcttaccctaccagagacatttttatggagaataatgtaaccggtcaccccgtattctacctccccctgtgcgattcatttctgcccccaaaggctgctccagtcacggagctgtacacggacgggcccgtaatgttctgtggcatgggtggatttagtgacttctataagttgaggtggctagaggctatcttatcctggcaaaagcagcaagaaggctgcttcggagagcctgatgccgaggacgaagaattgagtaaggccatccaataccagcagcatttcagccgccgggtaaaacggcgtgaaaaacagttcccagattcacgcagcgttgcccaggcaggtgtgcagtggcgcaatcttggatcccttcaacccctcccacccgggttcaaacagttctcatgtctgatcctcccttcatcgtgggactacaggtccgttccgccatatcttgcaaacttctacatctttctggttgaaactggcttccaccacgtggctcatgcaggcttggaattacttatttctcgcgacccaccaacaagtggatctcagagcgtgggactctag

SEQ ID NO: 8776 - DNA, 555 bp, Artificial Sequence
  Description of Artificial Sequence: Synthetic coding sequence
atgatgagcttcctgctgggcgccatcctgaccctgctgtgggccccgaccgcccaggctgaggtgttgctccagcccgattttaatgcggagaaatttagcgggttatggtatgttgtgtccatggccagcgactgccgcgtgttcctgggtaaaaaagatcatctgagcatgtcaactcgggctataaggcctacagaggagggggggttacatgttcatatggagtttccaggagctgacggctgtaaccaagtcgatgccgagtacctgaaggtggggagtgaaggccacttcagggtacctgccctgggatacttggacgtccgaatcgttgatacggactactcatcttttgctgtgttgtatatctataaggagctcgaaggtgctctatccaccatggtgcagctatactctcgcactcaggacgtgagccctcaggccctgaagtccttccaagacttctatccgactctgggcttgccaaaggatatgatggtgatgttgcctcagtcggatgcctgcaacccagaaagcaaggaggccccttag

SEQ ID NO: 8777 - DNA, 219 bp, Artificial Sequence
  Description of Artificial Sequence: Synthetic coding sequence
atgcagcggctggtgctgctgctggccatcagcctgctgctgtaccaagacttgccggtccggtcagagttcgagcttgacagaatctgcggttatgggactgcacgttgcagaaaaaagtgccgctctcaagaatataggatcgggcgctgcccaaatacttatgcttgctgcttaaggaagtgggacgaatccttgctgaatcgtacaaagccgtag

SEQ ID NO: 8778 - DNA, 2247 bp, Artificial Sequence
  Description of Artificial Sequence: Synthetic coding sequence
atgggccgggccggcgccgccgccgtgatccccggcctggccctgctctgggctgttgggttgggcagcgcggctccacctccccgcctccggctctctttccaagaactgcaggcgtggcacggtctgcagaccttttccctggagcgcacctgttgctatcaggctctgttggtagacgaggaaagaggcaggctttttgtcggagctgaaaatcacgtggcatctctcaatttggacaatatttctaagcgcgcaaagaagctcgcttggcccgcccccgtggagtggcgcgaggagtgtaattgggccggaaaggatattggcaccgaatgcatgaacttcgttaaactactccatgcctataatcgaacccatttgctcgcctgtggcacaggagctttccacccaacctgtgccttcgtggaggttggtcaccgggccgaggagcccgtgctccgcctagatccaggtagaattgaggacggaaaaggcaagtccccctatgaccctcgccaccgcgcagcgagcgtcctggtcggggaggaactttactccggcgttgccgcagatctaatggggagggactttacaatcttccggtcgttgggacagagaccctctctccggaccgagccccacgactctcgctggctgaatgagcccaagtttgtaaaggtcttttggattccagaatccgagaatcctgatgatgataagatatacttcttctttcgggagacagctgtggaggcagcacctgccttgggccgactgagtgtcagccgcgttgggcaaatttgtcgcaatgatgtgggagggcagcgaagcctggtgaacaaatggacaaccttcctgaaagcaaggctggtctgcagcgtccccggggtggaaggcgatactcacttcgaccagcttcaggatgtgttcctgctttcctctcgagaccatcgcactcccctgctgtatgcggtgttctctacctctagttcaatttttcaaggatcggccgtctgtgtttactcaatgaatgacgtccgccgtgctttccttggcccatttgcacacaaagagggccctatgcaccagtgggtctcctatcagggccgtgtcccctaccctcggcccggcatgtgccccagtaagactttcggtacattcagttctaccaaggattttcctgacgacgtcattcagtttgctcggaatcacccactgatgtacaattcagtgcttcccaccggcggtcggcccctgttccttcaggtgggcgcgaattacacctttactcagatcgcagcagaccgggtcgccgccgcggatggccattatgatgtgctctttatcggaaccgacgtaggcactgtgctcaaagtaattagtgtgcctaaagggtccagacctagtgcagagggcctcctgcttgaggaactgcacgtattcgaggacagtgccgccgttacatcaatgcagatcagtagtaaacgccatcaactgtatgtcgctagtagatcggctgtagcccagattgctttgcaccggtgtgccgctcatgggcgggtctgtacagaatgttgtctggcccgagacccttactgtgcctgggacggtgtggcctgtactcggtttcagcctagtgctaaacgacgattcaggaggcaggatgttcggaatggagacccctccacgctgtgctcaggggatagctccagacccgccctgctggagcataaggtttttggggtcgagggaagctccgctttcctcgagtgcgagcccagatcgctgcaagccagggtagaatggactttccagcgggcaggggtcacagcccacacacaagtgctcgctgaggagcggacagagcgaacagccaggggcctccttctacgtcggctgcgcaggcgggatagcggtgtgtacctttgtgctgcggtggagcaaggtttcacccagccccttagaagactgtccctccacgtgctgagtgctacgcaggctgaaaggttggctcgcgcggaagaagccgctccagccgctcccccgggccccaaactctggtatcgagattttttacaactggtggagcccggagggggcgggtccgctaactcactccgcatgtgccgcccacagccagcattacaaagtctccctctggagtccaggaggaaaggccgcaatcggcggacccacgcccctgaacctagggctgagagggggccaaggagtgcaactcattggtag

SEQ ID NO: 8779 - DNA, 369 bp, Artificial Sequence
  Description of Artificial Sequence: Synthetic coding sequence
atggtgctgctgtgcctgttcctggccagcctggccgccaccccccgggctggcgtgaccggagcctggccgacatccggcctctctattctggcacagctgcagccatcttgcgaactaagatggactcaattaagccggagtagctggcgcgaccttgtcatgacaacttccctgtggagcttggcctatttccaacacttttcgcaggagactacaacccaagaacagctggacgagatggaagagattcctagggagagccagtgcggacggcaggatttccacgccctttcgtgccctaccgccagcccccgggaccgggtgcttctgtgttgccccggttggcgtgccatggtgccctcctag

SEQ ID NO: 8780 - DNA, 570 bp, Artificial Sequence
  Description of Artificial Sequence: Synthetic coding sequence
atgctgctgggccagctgagcaccctgctgtgcctgctgagcggcgcactgcctactgggagcgggcgaccagagcctcagagcccgcggcctcagtcgtgggctgctgctaatcagacatgggcccttggacctggcgctctgccaccactggtgcccgcttcagcgctagggtcttggaaggccttcttggggctccaaaaagcaaggcagctgggcatgggcaggctgcaacgaggacaagacgaagtggccgcagttaccttaccgttgaatccacaggaggtgatacagggcatgtgcaaggctgttccgttcgtgcaggtcttttctcgacccggctgttcggccatcagattacgtaatcatctttgtttcggccattgctcatctttgtatatacccgggtcagaccctacgcccttggttttgtgtaactcatgcatgccagcccgtaagcggtgggcccccgttgtgctgtggtgcctgacgggcagtagtgctagtaggagacgggttaaaatctcaacaatgctgattgaaggatgccattgctcccctaaagcgtag

SEQ ID NO: 8781 - DNA, 2505 bp, Artificial Sequence
  Description of Artificial Sequence: Synthetic coding sequence
atgaagcacaccctggccctgctggcccccctgctgggcctgggccttggcctggcactgtctcagttggctgcgggggcaacagactgcaagttcctagggcccgcggagcacttaacattcaccccagccgctagggctaggtggcttgcccctcgggtaagagcacccggtcttcttgactcattgtatggaacagtaagaaggtttctgagcgtcgttcagctgaatcctttcccttcagagcttgtgaaggctcttctgaatgagctggcatccgtaaaagtaaatgaggtggtccgatacgaggctggatacgtggtctgcgctgtgatcgccggcctctacctgctccttgttcctaccgccggcttgtgcttttgctgctgcaggtgtcacagaaggtgtggcggcagagtcaagacggaacacaaagccctggcatgcgagcgtgctgccttgatggtgttcctcctgctgaccaccctcctgcttttgatcggggttgtctgcgccttcgtgaccaaccagaggacccacgaacaaatggggccctcaattgaggccatgccagagaccctcctgagcctttgggggttggtttccgacgttcctcaggaattgcaggctgtcgcccagcagttctctctcccacaggagcaagtatcagaggaacttgatggagtgggagtcagtattgggagcgctatccacacccaactgagatctagcgtctatcccctgttggcagcagttggcagtctaggccaggtgctccaggtgagtgtgcatcacctgcagacactaaatgccactgttgtggagctccaggcagggcagcaggacctggaaccagcgattcgggagcaccgtgaccgccttttagaactgctgcaggaagcaagatgtcagggagactgtgctggtgccctgagctgggcccggacgctggaactcggagcagacttctctcaggtcccaagtgtggatcacgtgctacaccagctgaaaggcgttcctgaagcaaacttcagttctatggtacaagaggagaactctaccttcaacgctctgccagctctcgccgcaatgcagaccagcagtgtagtgcaggagctgaagaaggccgttgcacagcagcctgagggtgtacggacgcttgctgaaggctttcctggattggaggctgccagcagatgggcccaggcactgcaggaagtcgaagagtcctcccgaccatatttgcaggaagtgcagcgctacgaaacctatcggtggatcgtcggatgtgtcctgtgctccgtggtactatttgtggtactgtgtaatctgctggggctcaatctgggaatatggggcttgagcgcccgcgatgatcctagtcacccagaggccaaaggggaggccggggcgagatttcttatggctggagtcggtttatcattcctttttgcagcccccctgatcctgcttgtgtttgctactttcctcgtggggggtaacgtgcagacccttgtatgtcaatcctgggaaaacggtgaactttttgaatttgctgatactcctgggaacctgcctccctcaatgaacctgagtcagttgctgggactgcggaaaaacataagtattcatcaggcatatcagcagtgcaaagagggggcggctctgtggactgttctccaactgaatgacagctacgacttggaagaacaccttgatataaaccagtacacaaacaaactgaggcaggaactgcagtcactgaaagtcgatacccaatccctggaccttctttcctctgcagcacggagggacctggaggctctgcaaagcagtggtttgcaaaggatccactacccggatttcctggtccaaatccaaagacctgttgtgaagacgagcatggagcaactggctcaggagctgcaaggcctcgcacaggcccaggacaacagcgtgctgggacagaggttgcaagaagaggcacagggactgaggaatctgcatcaggagaaggtggtcccccagcagtctctggtggccaagctgaatttatccgtcagggctctagagtcatccgctcccaacttacaattggaaacctccgacgtgctggccaacgtaacctacctaaagggcgaactgcccgcctgggcggcacggatactgcgcaacgtttcagagtgctttctggcccgcgagatggggtacttcagccagtatgtggcatgggtccgagaggaagtgacccagcgtatagctacctgtcagcctctctctggcgccctagacaattctagagtgatcctgtgcgatatgatggctgacccatggaacgctttctggttttgtctggcttggtgtacgttcttcctgatccccagcataattttcgccgtgaaaacctccaaatatttcagaccaatcaggaagcgtttatcttctacctccagcgaggaaacccagctgttccatatcccccgcgtgacatcattgaagctatag

SEQ ID NO: 8782 - DNA, 2505 bp, Artificial Sequence
  Description of Artificial Sequence: Synthetic coding sequence
atgaagcacaccctggccctgctggcccccctgctgggcctgggcttgggcctagcgttatctcagctagcggcgggggctacagattgcaaatttttgggccccgccgagcacctgacattcacacccgccgccagggcgaggtggcttgccccccgcgtgagggcgcccgggctgctcgacagtctctatggtactgtgcggcgcttcctgtccgtcgtccagctaaacccatttccatctgaactcgttaaagctcttcttaacgaattggcctccgtgaaagtgaacgaagtggttcggtatgaggccgggtatgtcgtgtgtgcggttatagccggtctctatcttctgctcgtccctactgccggactgtgtttttgctgttgtagatgtcaccgaagatgtggcggtagagtaaagactgagcacaaagcactggcctgcgaacgggctgctttgatggtgttcttgctcttgaccaccctcctcctgctgattggagtggtgtgtgccttcgtgaccaaccagcgaacccacgagcaaatgggaccatccattgaggccatgcccgaaacccttctgtccctgtggggcttagtcagcgacgtgccccaggaactccaagccgtcgctcagcagttcagcttaccgcaggaacaggtctctgaagagctggacggtgttggagtgagcatcgggagtgccatccatacgcagctgcgcagttccgtgtaccctctgctcgccgcagtaggctctctgggccaggtcttgcaagtgtcagtgcaccacctgcagacattaaatgccacagtggtagagctgcaggcgggccagcaggatttagaacctgcaatccgcgaacaccgcgacagactgctggaactgcttcaggaggcacggtgccagggcgattgcgccggggcactgagctgggcacgaacgctggagctaggcgccgatttctcccaggtccctagcgtggatcacgtgttacatcagctcaagggagtgcccgaagcaaacttctcgtctatggtccaggaggagaacagcactttcaacgcactgcctgccttggcagccatgcagacatcctcggtggttcaggagttgaaaaaagctgtggctcagcagcctgaaggggttagaacgcttgccgaggggtttcccggtctagaggcagcatccagatgggcccaagcactgcaggaggtggaggaaagctcacgcccttacttgcaggaagtgcaacgatacgaaacttaccggtggattgtgggctgtgtcctctgctcggtggtacttttcgtggtgctctgtaacctgctgggcctcaacctcggaatttggggtctatccgcacgagatgatccctcccacccggaggccaaaggcgaggccggagctagattcctgatggctggcgttgggttgagcttcctatttgctgcccctcttattctcttggtctttgctacatttttggtaggtggaaacgtgcaaacgctggtgtgtcagagctgggagaatggcgagctgttcgagtttgcagacacacccggcaatctgcccccaagtatgaacttgtcgcagctcctgggcctgcggaagaacatctcaatccatcaggcttatcagcaatgtaaagaaggcgcagccttatggaccgtgcttcagctcaacgactcctatgatctggaagagcacctcgacatcaatcagtacacaaacaaactgagacaggaactgcagtccttaaaggtggacacacagtcccttgatctcctctcttctgccgcaaggcgggatctggaggcccttcagtcatccggattgcagcgaatacattatcctgatttcctggttcagatccaaaggccagtggtgaaaacctccatggagcagttggcgcaagagcttcagggcctcgcccaggcacaggacaattccgttctcgggcagaggctgcaggaggaggctcagggtttgcggaacttgcatcaggagaaagttgtgcctcagcagagcttagtggctaagctcaacttgagcgtcagggcactcgagtcatcagcacctaatctgcagctggagacatctgacgtgctcgctaatgtcacctacctgaaaggagagctgccagcttgggctgcacgcattctgcgcaacgtatcggagtgtttcttggctagagagatgggctacttctctcaatacgttgcatgggtgagggaggaggtgacgcagcgcatcgccacttgtcagcccctgagtggtgcgctggataactctagggtcatcctctgtgatatgatggccgatccatggaacgcattttggttctgcctggcatggtgtactttttttctgatcccgtccatcattttcgctgtgaagaccagcaagtatttccgacctatcagaaagagactgagcagcacgtcgtccgaagaaacccaactgttccacattccgcgtgtgactagcctgaagctttag

SEQ ID NO: 8783 - DNA, 216 bp, Artificial Sequence
  Description of Artificial Sequence: Synthetic coding sequence
atgacccagctgctgctgttcctggtggccctgctggtgctgggccacgttccttcaggccgttcagagttcaaacgctgttggaaaggccagggagcctgtcagacctattgtactcgccaggagacttacatgcacctgtgcccagacgcatcactgtgctgtctctcctatgctctcaagcctcccccggtgccgaagcacgagtacgagtag

SEQ ID NO: 8784 - DNA, 1377 bp, Artificial Sequence
  Description of Artificial Sequence: Synthetic coding sequence
atggaggccaccggcaccgacgaggtggacaagctgaagaccaagttcattagtgcttggaataatatgaagtactcatgggttcttaagaccaaaacatacttttctaggaatagcccggtcctgctactgggaaagtgttatcacttcaagtatgaagatgaggacaagacgctaccggctgagagtggctgtactatagaggatcacgtgattgctgggaatgtcgaggagtttaggaaagatttcatctcccgaatttggttgacttacagggaagagttccctcaaatagagggtagcgctttgacaaccgattgcggctggggttgtacacttagaactggtcaaatgctgctggctcagggcctgatccttcactttctcggcagggcctggacatggcccgacgccctcaacatcgaaaatagcgacagtgagagttggacctctcacacagtcaaaaagtttaccgcctcattcgaggcctcactgagcggagagagggagtttaaaacaccaacgatatctctgaaggagaccattggcaaatactcggacgaccacgaaatgaggaacgaagtctatcatcgaaaaattatctcgtggtttggcgatagccctctcgccctttttggtcttcatcaactcattgaatacgggaagaagagtgggaagaaagccggggactggtacgggcctgccgtcgtagcgcacattctgagaaaagccgtcgaggaagctagacatcctgacctacaaggaatcactatttacgtcgcccaagattgcaccgtctataatagcgacgtcattgacaagcagtctgcctcgatgacaagcgacaatgctgatgacaaagctgtaatcatcttagtgccggtgcggctcggcggcgagcgaacaaatactgattatctggagtttgttaaaggtattctctctctggaatactgcgtcggaataatcgggggcaagccaaagcaaagctactacttcgctggctttcaggacgacagccttatttacatggacccccattactgtcagagttttgtcgacgtgtctattaaagattttcctctcgagacgttccattgcccctctcccaaaaagatgtcattcaggaaaatggacccaagttgtactattggcttctactgtaggaacgttcaggattttaaaagggcatctgaagagattaccaagatgctgaagttctcatctaaggaaaaataccccctcttcaccttcgtcaacggacatagtagggattacgattttaccagcacaaccactaacgaggaagacttgttctcggaagacgagaagaagcagctgaagagattcagtactgaggaatttgtgcttttatag

SEQ ID NO: 8785 - DNA, 342 bp, Artificial Sequence
  Description of Artificial Sequence: Synthetic coding sequence
atgcggcagcggctgctgcccagcgtgaccagcctgctgctggtggccctgctgttccctggaagcagtcaggcacgacatgtgaaccacagcgcaaccgaggccttgggtgagctgagggagagagctcccggacagggcactaatggatttcagcttctgcgccacgccgtgaaaagggatttgctccccccgcgcactccaccttatcaggaacccgccagcgatctaaaagttgtggactgtaggaggtcagagggcttttgccaggaatattgtaactacatggagacacaagtggggtactgctccaaaaagaaggatgcttgttgtctacattag

SEQ ID NO: 8786 - DNA, 258 bp, Artificial Sequence
  Description of Artificial Sequence: Synthetic coding sequence
atgaagaaggtgctgctgctgatcaccgccatcctggccgtggccgtcggattcccagtgagccaagatcaagagcgagagaaaagatctatctccgatagtgatgaactcgcctctggcttcttcgtctttccctacccgtaccccttccggcccctcccccccatcccatttccgcgatttccctggtttcggagaaatttcccgatccctattccagaatccgcccccaccactcccctgccttccgaaaaatag

SEQ ID NO: 8787 - DNA, 264 bp, Artificial Sequence
  Description of Artificial Sequence: Synthetic coding sequence
atggccgtgagcgtgctgcggctgaccgtggtgctgggcctgctggttctgtttctgacttgctatgcagacgataagcctgataaacccgatgataagcccgacgattccggaaaagatcctaagccagattttcctaagttcctttccctgctagggaccgagattatagaaaacgcagttgagtttatcctccggagtatgtctaggtctacaggtttcatggaatttgatgacaacgagggaaagcactcatcgaagtag

SEQ ID NO: 8788 - DNA, 945 bp, Artificial Sequence
  Description of Artificial Sequence: Synthetic coding sequence
atgagcagcgaggccgagacccagcagccccccgccgccccccccgcagcacctgcgctgagtgctgcagacacaaaaccaggaactacaggtgctcaaggggcagtcgcccgcgcacatattggcggcgccggtggggacaaaaaggtgatcgccaccaaggttctggggaccgtgaaatggttcaacgttaggaatggatacggatttataaacagaaatgacaccaaggaggacgtgtttgtccaccagaccgccatcaagaaaaacaatcctaggaagtatctgagatccgttggcgacggagagaccgttgagtttgatgtggtcgaaggcgagaagggagccgaggcagccaatgtaaccggccctgggggcgtccccgtccaaggctctaagtacgccgcagacaggaaccactatcggcgttacccgagaaggcgaggaccacctcgcaattatcaacagaactaccaaaatagcgagtctggagagaagaatgaggggagtgaaagcgcgcccgagcgacccaataatgccggacctcaggctaaagtgccaacattactgcacgccgagtatggacgaaggccacagtatagcaatccccccgtgcagggagaggtgatggaaggagctgacaatcagggtgccggcgaacaaggcaggccagtccggcagtgcataggggacatcgatcacgactccgccggcgcactcttggctaggcagccaagagaagacggcaatgaagaggataaggagaaccagggggatgaaacccagggacagcagccccctcagagacgatacaggcggaactttaattacagaagacgaaggcccgagaatccaaagccacaggacggcaaggagacaaaggcggctgatccaccagccgaaaattctagcgcccctgaagcggaacaaggcggcgcagaatag

SEQ ID NO: 8789 - DNA, 636 bp, Artificial Sequence
  Description of Artificial Sequence: Synthetic coding sequence
atggtgttcctgaagttcttctgcatgagcttcttctgccacctgtgtcagggatatttcgatggaccgttgtatcccgagatgtccaatggtaccctgcatcactattttgtacctgacggcgactacgaggagaatgacgatcctgagaagtgccagctgctatttcgtgtcagtgatcaccgcaggtgttcccagggcgaggggtcgcaagttgggagcttactttccctcactctgcgagaagagtttacggtgctgggccgacaagttgaagacgcaggacgagtgcttgaaggaatttcgaagtcgatttcctacgatttagacggggaggagtcttacggtaagtatctccgacgggagagtcatcagataggagacgcctacagtaacagcgacaagtcactgactgagctggagtcaaaattcaaacagggccaggagcaggactcaagacaggaatccaggctgaatgaggattttcttgggatgcttgtgcatactagatctctccttaaagagactctggatatatcagtgggactgagagacaaatatgaactcctcgccctgacaattcggagccatggcaccaggctcgggagactcaagaacgactatctcaaggtttag

SEQ ID NO: 8790 - DNA, 1566 bp, Artificial Sequence
  Description of Artificial Sequence: Synthetic coding sequence
atgctgtgcgccctgctgctgctgcccagcctgctgggcgccacccgtgcaagcccaacttctggccctcaggaatgcgccaaaggctcaacagtttggtgccaggatcttcagaccgcagcccggtgcggggccgtaggctactgccaaggcgccgtgtggaataagccgaccgccaaatctctaccgtgtgacgtctgccaagacattgcagcagcagcaggtaacgggttgaaccctgatgctactgaatctgatatcctggcactggtaatgaagacctgcgaatggctaccgtcccaagaatcctcagctgggtgcaagtggatggtggatgcacattcatctgcaatcctctcaatgctgcggggcgctccggactccgcccctgctcaggtctgcactgcactgtccctctgtgaaccgctgcagcggcacctggcaaccctccgcccgctgtctaaggaggatactttcgaggccgtggctccctttatggcgaatgggccgctcacattccacccccgccaggcccccgaaggagctctctgtcaggactgcgtcaggcaggtgtctcgactccaagaggccgtgaggagcaaccttacgcttgccgacctgaacattcaggagcaatgcgagtcattaggaccaggcctcgctgtcctatgtaaaaactatctttttcagttcttcgtgcccgccgaccaggctttgcggctcctcccccctcaggagctatgtcgaaagggaggattctgtgaggagctcggggcccccgctagattaacccaggtggtcgcaatggacggcgttccctcattagagctgggccttccccggaagcagagcgaaatgcagatgaaagctggggtcacgtgcgaggtgtgtatgaacgtcgtccagaagctcgaccactggctgatgtccaattcctcagaactcatgatcacccatgccctagaacgggtgtgttcggttatgcccgctagtataactaaagagtgtataattctggtggatacttactccccgagcctcgttcagctggtagccaagataactcccgagaaggtgtgtaaatttatcagactttgcgggaatcgaaggagagccagagctgtccacgatgcttatgccatcgttccaagtcctgaatgggacgctgaaaatcaggggtcattttgcaacggctgtaagagacttctgactgtctcctctcacaatcttgaaagtaaatcaactaagagagacatactggtggcctttaagggcgggtgttctattctgcccctgccctacatgatccaatgcaaacacttcgttacacagtacgaacctgtgctgatcgagtctttaaaagatatgatggatccagtcgccgtttgcaaaaaggtgggggcctgtcatggtccccggactccacttctggggactgaccagtgcgccctgggccctagtttttggtgtcgttctcaagaagccgccaagttgtgcaatgctgtacagcactgtcagaagcatgtctggaaggagatgcatctgcacgcaggagagcatgcatag

SEQ ID NO: 8791 - DNA, 2127 bp, Artificial Sequence
  Description of Artificial Sequence: Synthetic coding sequence
atggccgccgccgccgtggccgccgccgccgccgccgccgccgccgcatccctgcaggttttggaaatggagtccatggagaccgcagcagctggaagcgcgggtctggctgctgaggtaaggggtagcggcacagttgatttcggaccgggtccaggaattagcgcaatggaggcttccggcggagatcctgggcccgaggctgaagactttgagtgctcaagtcactgttctgagctgagctggcgccaaaacgaacagagacgccaaggattgttctgtgacatcacactatgtttcgggggtgccgggggcagggagttcagggcccaccgcagtgttctcgccgccgcgactgaatattttacacctctgttgagcggacagttcagcgaaagccggagcggcagagttgagatgagaaagtggtctagtgaacctggaccagagcctgatacagtggaggcggtgatagaatatatgtatactgggaggattagggtgagtactggaagcgtccatgaggtgcttgagcttgccgaccgatttctccttatccggctgaaagagttctgtggggagttccttaaaaaaaagctgcacctgtcaaattgtgttgcaatccacagtctcgctcatatgtacaccttaagtcagctggccctcaaagccgctgacatgataaggcggaattttcacaaagtgattcaggatgaagaattctatacgctgccattccatctcatccgcgactggttgtccgaccttgagataacggtggacagcgaggaagttctgtttgagacagtcttaaagtgggtgcagcgtaatgccgaagagcgcgagcgatacttcgaagagctcttcaagttgctgaggctgagtcaaatgaaaccaacatatctcacacggcatgtaaaacctgagcgccttgtcgccaataacgaagtgtgcgttaaactggtcgcagacgccgtggagaggcacgccctgagggccgaaaacattcagagtggaacctgccagcatccaacttcacacgtgtccctcctcccccgttacggacaaaatatggatgtaataatggtcatcggaggagtctcagaaggaggggattacctgagcgaatgcgtcggttactttgtggatgaagaccgctgggttaatcttccccatatccataaccacttagacggccatgcagtcgcggtgaccgagtcatatgtctacgtggctgggtccatggaacccggcttcgccaagaccgttgaaaggtacaatcctaatttgaacacctgggaacatgtgtgctcattaatgaccagaaaacattcttttggactcacagaggtgaagggaaagctctactcaataggaggccacggaaatttctcccccgggttcaaagatgtcactgtctataaccccgagctcgataagtggcacaacctcgaatccgcacccaagattctgcgggatgtgaaggcccttgccatcgaggacaggttcgtctatattgccgccagaaccccagtggatagggatactgaagacggactgaaggcagtgatcacgtgttatgatacagagactaggcaatggcaggatgtcgaatctctgcccctcattgataattactgcttctttcaaatgagcgtggtgaattctaatttttatcaaaccgcgagctgctgtcccaaatcctactgtctcgaaaatgaggaggccgtgagaaaaattgcatcccaggtaagtgatgaaatcttggagtccctgcctccagaggttctgtccatagagggcgccgccatttgctattacaaggacgacgtgtttatcattgggggttggaaaaactccgatgacatcgacaaacaataccggaaagaagcttacaggtactgcgctgagcgcaaacgatggatgttgctccctcccatgccccagcccaggtgcagggctacagcctgtcacgttaggattccttacaggtacctgcacgggactcagcgctatccaatgccacagaatctgatgtggcagaaggaccgaatccgccagatgcaggagatccacagacatgccctgaatatgagacgcgtgccctccagtcaaattgagtgttag

SEQ ID NO: 8792 - DNA, 1578 bp, Artificial Sequence
  Description of Artificial Sequence: Synthetic coding sequence
atgagcggcaactgggtgcaccccggccagatcctgatctgggccatctgggtgctcgctgcacctacaaaggggccttccgcggaaggccctcagaggaatacaaggctggggtggatccagggaaagcaggttactgtgcttgggtcgcccgtgcctgtgaacgtcttcttaggggtgccgttcgcggctcctccactcggcagccttaggtttactaatccccagcctgcctctccttgggacaacttgagggaagcgacatcatatcctaacctgtgcttgcagaactcagaatggctgctgctggaccagcatatgctaaaagtgcattatcccaagtttggtgtttccgaggattgtctctatctgaatatatacgcccctgcccacgcggatacaggtagtaagttgccagtgctggtttggttcccagggggcgcattcaagacaggatctgcctccatttttgacgggagtgctctggccgcctacgaggatgttctggtcgtcgtcgtgcagtatcggctggggatctttggattctttaccacatgggatcagcatgcaccgggtaactgggcgtttaaggatcaggtggctgctctcagctgggtgcaaaagaatatagagttctttggtggcgacccctcttctgtgaccatctttggggagtcagcaggagccatttcagtatcttcactgatcctgagccctatggcaaagggactctttcataaggcaattatggaatccggcgttgcaatcataccctatttagaagcccacgactatgaaaagagtgaggatctgcaagttgttgctcatttctgtggcaacaacgcctccgactctgaggccctgctgaggtgcctgcggaccaagcctagtaaggagctgttaactctcagtcaaaagacgaagagctttacacgggtggtggatggcgcattttttcccaacgagccactagatttgctctcccaaaaggcttttaaagcaattccttccatcattggggtcaacaatcatgaatgcggctttctgctccctatgaaggaagccccagaaattctgtcaggttcaaacaagagtctggcgctgcatctcattcaaaatatcttgcacattcccccacaatacctgcacttagtagcaaatgagtactttcatgacaaacacagtctgacagagatccgcgattcactgctagatctcctgggagacgtattcttcgtggtgcccgccctgatcactgctcgataccatcgagagggtgctaccgaagaggagaagctcttaagtcgaaagatgatgaagtattgggcaacgttcgctaggactggaaaccccaatgggaatgatttgtccctgtggcccgcatacaatcttactgaacagtatctacagctggacctgaacatgagcctcggtcaacggctgaaagaaccgagggttgatttctggaccagtacgatacctttgattctgagtgcctcagacatgctgcattctcctctgtcaagtctgaccttcttgtccctgcttcagccatttttcttcttctgtgccccctag

SEQ ID NO: 8793 - DNA, 900 bp, Artificial Sequence
  Description of Artificial Sequence: Synthetic coding sequence
atggtgcggtgcctgggccccgccctgctgctgctgctgctgctgggctccgcttcaagcgtgggagggaatagatgtgtcgatgccgccgaagcctgtactgccgatgcacgatgtcagagactcaggtcggagtacgtggctcagtgtctagggcgcgctgctcaaggcggatgcccaagggctcgctgcaggagggctcttcgtcgcttctttgccaggggacctcctgctttgacccacgccttactgttctgtccatgcgccggccctgcttgcgctgagcgtcgtaggcagaccttcgtccccagttgcgcattttcgggtcccggacctgcgccaccatcctgcttagagcccctgaacttctgcgagcggtccagagtctgtcgatgtgcgcgcgcagccgccggtccctggagaggatggggccgaggtctgtcccctgcgcataggccaccagccgcacaggcatccccaccagggctttctggcctagtccacccatccgcacaacgacctagaagattgcccgccggacccggccgccccctccctgcaagactacggggaccccgaggagttcccgccggcactgcggtcacgcctaactacgtggataacgtctccgcccgggtggccccttggtgcgactgcggtgcttccggcaataggagggaggattgcgaagcattcaggggacttttcacaagaaacaggtgtctggatggggccatccaggcttttgcttcaggatggccccccgttttgctggatcagctgaacccgcaaggtgacccggagcacagcctgttacaggtgtccagcaccggccgtgcccttgagaggcgttcgttactgagcattctgccagtgctcgcgctccctgccttgctgtag

SEQ ID NO: 8794 - DNA, 270 bp, Artificial Sequence
  Description of Artificial Sequence: Synthetic coding sequence
atgcaggcctgcatggtgcccggcctggccctgtgcctgctgctggggcccctggctggggccaagcctgtccaagaagaaggggatccttacgcagaactgcccgcaatgccttattggccattctcaacatccgacttttggaattatgtacagcacttccaggctctgggagcttatcctcaaatagaagacatggcaaggaccttctttgcccatttccctttgggcagcacacttggcttccatgtgccttaccaggaggattag

SEQ ID NO: 8795 - DNA, 663 bp, Artificial Sequence
  Description of Artificial Sequence: Synthetic coding sequence
atggccagcgagcggctgcccaaccggcccgcctgcctgctggtggcatccggagcagctgaaggggtgagcgcccagtcctttctgcattgcttcaccatggccagcactgccttcaacctgcaggtggccactcccggtggcaaagcaatggaattcgtggatgtgaccgagagcaatgcccggtgggtgcaggatttccgcctgaaagcttacgcctctccagcgaagctcgagtccatcgacggcgcccggtaccacgctctccttattccgagctgtccaggcgcgttgactgatctagcctcttctggatcactggcccgcatcctgcagcattttcactctgagtccaaaccgatctgcgcagtgggccacggcgtcgccgctctttgctgtgccaccaacgaagaccgcagttgggtgttcgattcttactccctgaccgggccatctgtttgtgagttagtcagggcaccaggctttgcacgcctacctcttgtggtggaagatttcgttaaagatagtggggcctgtttcagcgcatcggagcccgacgccgtgcatgttgtgttagatagacacctcgtcaccggtcagaacgcttccagcaccgttccagccgtacagaatttgctgtttctgtgcggatcacgtaagtag

SEQ ID NO: 8796 - DNA, 1158 bp, Artificial Sequence
  Description of Artificial Sequence: Synthetic coding sequence
atgtggggcttccggctgctgcggagcccccccctgctgctgctgctcccccagctgggcattggcaacgcatcatcgtgcagccaggcacgtacaatgaaccctgggggaagcgggggcgcccggtgcagcttaagcgcagaggtgcgcaggcgacaatgtttacagttgtccactgtaccgggtgcagacccacagaggtctaacgaattgctattactagccgcagccggagaaggcctggaaaggcaggatctccccggtgaccccgctaaagaggaaccacagcctcccccccagcaccatgtgctgtactttccaggcgacgtgcagaattaccacgagataatgacaagacatcctgagaattatcagtgggagaattggagcctggaaaatgtggctacaatcctggcgcaccggttccctaattcctatatctgggtcattaaatgtagtcgcatgcacctgcataaattttcttgctacgataattttgtcaaatctaacatgtttggcgccccagaacataatactgactttggggcctttaaacacttgtatatgctgcttgtgaacgccttcaacctatcccagaacagtctgagcaaaaagagcctgaatgtgtggaataaggattcaatcgcaagcaactgccgctcttctccctcccatactaccaacggctgccaaggcgagaaggtaaggacatgcgagaagagcgacgagagcgcgatgtccttctaccctccaagcctgaatgacgcaagttttacccttataggattttctaagggctgtgtggtccttaaccagcttttgtttgagctgaaggaggccaaaaaagacaagaatattgacgctttcatcaagtctattaggaccatgtattggttggacggcggccactcaggaggttccaacacctgggtgacttacccagaagtgctgaaggagtttgcccagacgggaataattgtgcacactcatgtcaccccgtatcaggtgcgggatccaatgcggtcatggattggtaaagagcacaagaagttcgtccagattctgggagaccttgggatgcaggtcaccagccaaattcattttactaaggaagcgccaagtatcgagaaccactttagggtgcacgaagttttttag

SEQ ID NO: 8797 - DNA, 936 bp, Artificial Sequence
  Description of Artificial Sequence: Synthetic coding sequence
atgcggggcgccgcccgggccgcctggggccgggccggccagccctggccccggccaccagcacctggacccccaccaccaccgttacctctgctcttgttgctactcgccggtctgcttggcggcgcgggagcccagtactcatcggatcggtgctcttggaaaggatccggattgacccacgaggcccatcgcaaagaagtggagcaggtctacctgcgttgtgcggccggggccgtggaatggatgtaccctactggcgctttgatagttaacctgagacccaacaccttcagtcctgcccgtcacctcaccgtgtgcattcggagttttacagattcatctggagccaatatttatttagaaaagaccggcgaactgaggctacttgtccccgacggcgatgggcggccaggccgagtccagtgtttcgggctggagcagggcgggttgtttgtcgaagccactccccaacaggatatcggcagacggacaacgggatttcagtacgaactagtgaggcggcaccgggccagcgacctccacgaactcagtgccccctgtagaccctgtagcgacactgaggtgctgctggcagtgtgcaccagtgacttcgccgtaaggggctcaattcagcaggtgacccacgaacctgagagacaggattctgctattcaccttcgcgtctctcgcctctatcgccaaaaaagcagagtgttcgagccagttcccgaaggtgacggccactggcagggaagggtgaggacccttttagaatgtggagtgcggcctggccatggggacttcctgttcacgggccacatgcacttcggagaagcacgcctgggctgtgcacctagatttaaggattttcaacgcatgtacagggacgcccaggagcgtggccttaacccctgtgaggtggggaccgactag

SEQ ID NO: 8798 - DNA, 1221 bp, Artificial Sequence
  Description of Artificial Sequence: Synthetic coding sequence
atgggccccagcacccccctgctgatcctgttcctgctgagctggagtggtcctctgcaggggcagcaacaccatttggtcgaatacatggagcggagacttgctgccctggaggagcggctcgcacaatgtcaggaccagtctagtcgccatgctgctgagttaagagacttcaaaaataagatgctgcccctattagaagtagcagaaaaggaaagagaggcgctgcggactgaggccgacaccatatctggccgcgttgatagactggagagggaagtggattacttggagacacagaatccagctctgccttgcgtggagtttgacgagaaggttacaggcggtcccgggaccaaaggtaaaggccgtcgcaatgagaagtacgacatggtgactgattgcggctatacaatctcccaggtgcggagcatgaaaatactgaaaaggttcggaggtcctgccggcctatggacaaaggatccactggggcaaacggaaaagatttacgtcctggatggcactcagaacgacacagctttcgtcttccctcggctgagagattttacactggccatggccgcaaggaaagcatcccgcgtgagggtccccttcccctgggtgggcacgggacaacttgtttatgggggatttttatacttcgcccgtcggccaccggggcgccctggggggggaggggaaatggaaaatacacttcagctcattaagtttcacctggccaaccgcaccgttgtcgacagttctgtgtttcccgctgagggcctgatcccaccctatgggctgactgccgatacatacatcgacctcgccgccgatgaggagggcctgtgggcagtgtacgccacacgcgaggacgaccgacacctgtgcttagcaaagctagatccgcaaactcttgataccgagcagcagtgggatacaccctgcccccgcgagaatgcggaagccgcttttgtgatatgtggtactctgtacgtagtatataatactcgacctgcttcccgcgcacgaattcagtgttctttcgacgcttctggtacactaacacccgagcgcgccgcactgccctactttccacgaaggtacggcgcccacgcttccctcaggtacaacccccgtgaaaggcagttgtacgcatgggatgacggataccaaattgtctacaaacttgagatgcggaaaaaggaggaggaggtgtag

SEQ ID NO: 8799 - DNA, 900 bp, Artificial Sequence
  Description of Artificial Sequence: Synthetic coding sequence
atgggcggcccccgggccctgctggccgccctgtgggccctggaggcggctgggacagctgcactgaggataggggccttcaacatccagagtttcggggattcaaaggtcagcgatcctgcctgcgggtccatcatcgcgaaaatccttgccggctatgacctcgcactcgtgcaggaggtccgcgatccagatctttctgctgtatctgcccttatggagcagatcaattctgtgtctgaacacgagtactcattcgttagtagccagcctttgggacgggaccagtataaggagatgtacctgttcgtctaccggaaggatgcggtgtcagtggtcgacacatatctctatccagacccggaagacgtgttctcccgggaaccatttgttgtgaaattttcggctcccggaaccggggagcgcgcccccccacttccctcccgacgggctctcactccacctcccctccctgcagctgcccagaacctcgtgcttattccactgcacgcagcaccacatcaggcggtcgcggaaattgacgcactgtacgacgtgtatctggacgttatcgataagtgggggaccgacgatatgctgtttttgggcgatttcaacgctgattgctcctatgtgcgcgcacaggactgggctgccatccggctgcgatcctcagaggtgtttaagtggcttatccctgatagcgctgatacgactgttggaaacagcgactgtgcctacgaccgtatcgtggcatgcggagcccgtcttagacgcagcctcaaaccccagtctgcgaccgttcacgattttcaggaggagtttggactggaccagacacaggcattggcaatctcagaccacttcccagtcgaggttactctgaaatttcaccgctag

SEQ ID NO: 8800 - DNA, 1617 bp, Artificial Sequence
  Description of Artificial Sequence: Synthetic coding sequence
atgggctgcctgtggggcctggccctgcccctgttcttcttctgctgggaagttggcgtgtcaggttctagcgccggacccagcaccaggcgggccgacaccgccatgaccacggacgacactgaagtcccggctatgacgctggcacctggccacgccgcccttgagacccagactctgagtgccgagacatcatcacgggccagcacacccgccggccccattcctgaggcagaaaccaggggggcaaaacgcatttcacctgctagggaaactagaagttttacaaaaacttcgcctaactttatggtccttattgcaacatccgtggaaacctccgccgcctcaggttccccagagggcgcagggatgacgactgttcaaacgatcactgggtctgatccccgtgaggccatctttgacactctgtgtacagacgattctagcgaagaggccaaaactctgaccatggacatcctgacactagcgcacaccagtacagaggcgaaggggctgagcagcgaatcttcagctagttcagattccccgcacccggtcatcacacccagccgtgcctcagagagcagtgcttcttcagacggccctcatcctgtgatcacgccgagcagagcctctgaatcttcggcctcgagcgacggcccgcaccctgtgataacaccttcctggtcaccgggtagcgatgtcacacttttagccgaggcactagtgacagtaactaacattgaagtgatcaactgttccattacagaaatcgaaaccacaacgagttccattccaggtgccagcgacacagacctgattcccacagaaggcgtcaaagcgtcctccacgtcggaccccccggccctgccagattcgacggaagcaaagccacatattactgaggtgaccgccagcgcggagactctttccacggcgggaacaaccgagagtgccgctcccgacgccacggttggtacgcctctgcccaccaattccgcaacggaacgcgaagttaccgctcctggtgccacaacattatcaggcgctcttgtgaccgttagtcgcaaccccttagaagagaccagtgctctttcagtggagactcccagttatgtgaaggtatctggcgcagctcctgtgtccatcgaggctggatccgcagttggcaagacaaccagcttcgcgggtagtagcgcctcgtcctactctccaagcgaagccgccctgaagaatttcacacctagcgagactccaactatggatattgcaacaaaaggcccattccctacttcacgggatccgctgcctagcgtccctccgaccacaactaacagcagccgtggaactaatagtacccttgccaagatcacgactagcgccaaaaccaccatgaagccccctaccgccacccccactaccgcccggaccagaccaaccacagacgtgagtgcaggtgaaaatgggggcttcctattgttgagactgtcagtcgccagccccgaggatctgacagacccgagagtagcagagaggctcatgcaacagctccatcgcgaattgcatgcacatgccccacattttcaggtgagtcttctccgggtaaggcgtggatag

SEQ ID NO: 8801 - DNA, 975 bp, Artificial Sequence
  Description of Artificial Sequence: Synthetic coding sequence
atgagcagcgaggccgagacccagcagccccccgccgccccccccgctgctccagccctgagcgccgctgacactaaacctggaacaactggtagcggagctgggtctggaggaccaggaggcttaacgagcgccgcaccagctgggggggataagaaggttattgcaaccaaggtgctgggcactgtgaaatggttcaatgttaggaatggttacggcttcatcaataggaacgacactaaagaggatgtgttcgtccatcagacagccattaagaaaaataaccctcggaaatacctacggtcggttggcgatggtgaaactgtggagtttgacgtggtggaaggcgaaaaaggggctgaggccgccaatgtaaccggacctggaggcgtccccgtgcaggggtcaaaatatgccgcagatcggaaccactatagaagatatccccggagacgcggccctcctcgtaattaccaacagaactaccagaattccgaatctggcgagaagaacgaagggtctgaaagcgcacctgaaggtcaggcacaacagagacgcccttaccgccggcggcgcttccccccttattacatgagaaggccgtacggccgcaggccacagtattccaaccctcctgtgcagggcgaggtcatggagggcgccgacaaccagggcgccggcgagcagggaagaccagtccgacaaaatatgtacaggggataccgcccgagattccgccggggacctccccggcagcgacaaccacgcgaggacgggaacgaagaagacaaggaaaaccagggggatgagacacagggccaacagcccccacagcgcaggtacaggagaaatttcaattacagacggaggcgccctgaaaatccgaaaccacaggacggcaaggaaactaaggcagcagatcccccagcagaaaatagctcagcccccgaggccgagcagggaggcgcagagtag

SEQ ID NO: 8802 - DNA, 210 bp, Artificial Sequence
  Description of Artificial Sequence: Synthetic coding sequence
atgcggatcttctactacctgcacttcctgtgctacgtgaccttcatactaccagcaacttgtacactggtaaatgcggatcggtgtacaaagcgctacggacgctgcaaacgcgactgtctcgaaagcgagaaacagatcgatatttgttctttgccccggaagatttgctgcacagagaagctgtatgaggaggatgacatgttctag

SEQ ID NO: 8803 - DNA, 342 bp, Artificial Sequence
  Description of Artificial Sequence: Synthetic coding sequence
atgaagctgctgaccaccatctgccggctgaagctggagaagatgtattctaagaccaatacatcctccactatatttgagaaagcgagacacggaacagaaaagatcagcactgcccggagtgaagggcatcacattacctttagtcgatggaaatcctgcaccgcaatcggtggcaggtgtaagaatcagtgcgacgactcagaatttcgcattagctactgtgcacgcccaacaactcattgctgcgttaccgaatgtgatccaaccgatcctaacaattggattcccaaggattccgtaggaacccaggagtggtatccaaaggactcgaggcactag

SEQ ID NO: 8804 - DNA, 3030 bp, Artificial Sequence
  Description of Artificial Sequence: Synthetic coding sequence
atggacctgatccggggcgtgctgctgcggctgctgctgctggccagtagcttagggcctggggctgtaagcctcagggccgctattaggaaaccaggcaaagtgggcccgccgctggatataaagctcggcgccctgaattgcaccgcgttctctatccaatggaaaatgcctaggcacccaggcagccccatcttgggatatacagtgttttactccgaagtgggagctgacaagtctctgcaggaacagctccattccgttcctctttcccgtgatatcccaaccaccgaagaggtgatcggcgacctgaagcccggcactgagtaccgagtctcaatagccgcctactctcaagctggcaagggaaggctgagttcccctaggcacgtcaccacgttatcccaggatagctgcctccccccagccgcacctcagcagcctcacgttatcgtagtgagtgattcggaagtcgcactttcctggaagccaggggcgtctgaggggagcgcacccatccagtactactcggtcgaattcatccgtcctgattttgataagaaatggacgtcaatccatgagcgcatccagatggacagcatggtgataaagggacttgaccccgacaccaattaccagttcgctgtcagggccatgaatagccacgggccatcgccccgttcctggccatccgatatcatcagaactctctgcccagaggaggctggctccggaaggtacggacctcgttatattaccgatatgggtgccggcgaggatgatgagggcttcgaggatgacctcgatttagatatttctttcgaggaagtgaaaccccttccagccaccaaaggtggtaacaagaagttcctcgtggaatcaaaaaaaatgagtatctctaacccaaaaaccataagtcgtctgatcccccccacaagcgccagccttcccgtgactaccgttgccccccagcccattcctatacagaggaaaggaaagaacggagtggcaattatgtctcggcttttcgacatgccttgcgacgagaccctttgtagcgctgatagcttctgcgtcaatgattacacatggggaggatcccggtgccaatgcacgttgggaaaagggggagaatcctgttctgaggatatcgtaattcagtacccgcagttctttgggcattcttatgtgacctttgaacctttaaaaaatagttatcaggcattccagatcactttggagttccgagctgaagcagaggacggtttactcttatactgtggagagaatgagcacggaaggggcgactttatgagcttggctataattaggagaagcctccagtttcggtttaattgcgggaccggggtggctattattgtttcagaaacaaagattaaattgggcgggtggcacaccgtgatgctgtacagagatggtctgaatgggctgcttcagttgaataacggaaccccggttactggccagtcccagggccagtactctaagattacattcagaacaccgctgtaccttggcggcgccccctccgcatactggctggtgcgtgctaccggcaccaatcggggatttcaagggtgcgtacagtcccttgccgtgaatggccgaagaatagatatgcgtccatggcctttgggaaaagccttatctggggctgatgtgggggagtgctctagcggaatttgtgacgaagcgtcatgcattcacggcggcacttgtaccgccattaaggcagatagctacatatgcctgtgcccccttggattcaaaggacggcactgcgaggatgcctttactctgactataccccagtttcgtgagagcttgagaagttacgctgccactccgtggcccctcgagccacagcattatctaagcttcatggagtttgaaatcacctttaggccagacagcggggatggggtattattatatagctatgacaccggctctaaggactttctatccattaatttagctggcggtcacgtagagtttcgcttcgattgcggtagtgggaccggggtgcttcgctccgaggatcccctgaccctcggaaattggcatgagctgcgggtgtctagaacagctaagaatggtatactacaagttgacaagcagaagattgtcgagggcatggccgaagggggattcacccagatcaagtgtaacacagatatatttattggcggagtgcctaactacgacgacgtaaaaaaaaattctggcgtcctcaaacctttttctgggagcattcagaaaatcattcttaacgataggacgattcatgtcaagcacgatttcactagcggggttaatgtggaaaatgctgcacatccatgcgttcgggctccctgcgcgcatgggggctcgtgcaggcctaggaaggaaggctatgactgcgactgcccactcggcttcgaaggcctccactgccagaaggccatcattgaggccatcgagatcccacagtttattggacgaagttatctgacatatgacaacccggatatactgaaacgtgtgagcgggagtagatctaacgtgttcatgagattcaagaccactgctaaggacgggctgttgctctggcgcggcgactcccctatgaggccaaactctgacttcatctcccttggtctgcgggacggtgctctggtgttcagctacaacctaggctcaggcgtggccagcataatggtaaacggaagcttcaacgatggtagatggcaccgggtgaaagctgttcgagacggccagtcagggaaaatcacagtggacgactatggggctcgaactggaaagtcccctggcatgatgaggcagctgaatatcaacggggcactctatgtcggaggcatgaaggagatcgcgctccacacgaataggcagtatatgcggggcctggtgggctgcatcagtcactttacactcagtaccgactaccatatatccctggtggaggacgctgtggatgggaagaatattaacacctgcggagcaaagtag

SEQ ID NO: 8805 - DNA, 1272 bp, Artificial Sequence
  Description of Artificial Sequence: Synthetic coding sequence
atgagcgtgcggggcatcctgcggctgggcacccaggagtaccccagcccgcttgatcccgaggtaggcccgtactgtgacaccccaaccatgaggacactgtttaacctgctgtggctggccctagcgtgctcccccgttcacaccaccctctccaagagcgacgccaagaaagctgcgagcaagactttgctggagaaaagccagttctcggataagccggtacaggaccgtgggctggttgtgacagacctgaaggctgaatcagtggtgctcgagcacaggtcttactgctcagcaaaggctcgtgaccggcactttgccggggacgtgctcgggtacgtgaccccatggaactcgcatggctatgacgtaacaaaggtgttcggctcaaaatttactcagatttcccctgtgtggttgcagctaaagcgcaggggacgtgagatgttcgaagtgaccgggctccacgatgttgaccagggttggatgagagccgtgaggaagcatgcaaaggggttgcatattgtcccgcggttgctctttgaagactggacctatgatgacttccgtaacgtgctggattcagaggacgagatcgaggagctctcgaagactgtagtgcaggtcgctaaaaaccagcatttcgatggtttcgtggtggaagtgtggaaccagttgctctcacagaaaagagtgggcctgatacacatgctcacacatctggctgaagcgctgcaccaggcacgtttgctcgcacttctggtgattccgccagcaataactccgggtaccgaccagctgggcatgttcacgcacaaagagttcgagcagctggcccctgtactggacggtttctcactgatgacgtacgattacagcactgcccatcagccagggcctaatgctccactgagttgggtccgcgcatgtgttcaagtcctggaccccaaaagcaagtggcggagtaaaattctccttgggctgaacttttacggcatggactatgcgacatccaaggacgcccgtgagccggtcgttggtgcaaggtacatccaaacgctgaaagaccaccgccctagaatggtatgggacagtcaggcgtccgagcatttcttcgaatacaaaaaaagccggagcgggcggcatgtggtcttttatccaactcttaagagcctgcaggtgcgcctggagctggcccgcgaactgggcgtgggggtctctatctgggagctgggccagggactggattacttttatgaccttctctag

SEQ ID NO: 8806 - DNA, 1182 bp, Artificial Sequence
  Description of Artificial Sequence: Synthetic coding sequence
atgcggaccctgttcaacctgctgtggctggccctggcctgcagcccggtacacaccacccttagtaaaagcgacgctaaaaaggctgcatccaagactctcctcgagaaatctcagtttagcgacaagccagttcaggatagagggcttgttgtgacagacttgaaggccgagtctgtcgtactggagcatcgatcatattgcagcgccaaggcccgcgacaggcatttcgctggagacgtgctaggatatgtcaccccatggaacagccacggatacgacgtgactaaagttttcgggagtaagtttacacaaatatcgcctgtttggttacagctgaagcggcgtgggagagaaatgtttgaagtgactgggctgcacgacgttgatcagggttggatgagagccgtccggaagcacgctaaggggctccacatagtgccacggctcctgtttgaagattggacgtacgacgactttaggaacgttctcgattcggaggacgaaatcgaagaactatccaaaactgttgtgcaggtggctaagaatcagcattttgacggcttcgtggtggaagtgtggaaccagctgctgagccagaagcgagtggggctgattcacatgctgacacacttggcagaggctctccaccaagctaggctgctggcactgctggtaataccgcccgccatcactcccggcactgatcaactaggaatgttcacacacaaagagtttgaacaacttgccccagtgttagacggtttttctctgatgacatacgactacagcaccgcacatcaacctggaccgaacgctccgctgagctgggtgagggcctgcgttcaggtcctggaccctaaatctaagtggcgctccaaaatactgcttggcctgaatttctacggcatggattacgcgacctccaaagacgcacgggaaccggttgtgggcgctcgatatatccagacattgaaagaccaccgaccaagaatggtgtgggatagccaggcttcagagcacttcttcgagtataagaagtccagaagtggccggcacgtggtcttctaccctacgctgaaatccctccaggtgcgcctcgaactcgctcgagagctgggcgtcggtgtctccatttgggagttggggcaggggctggactacttttatgatttgctgtag

SEQ ID NO: 8807 - DNA, 1959 bp, Artificial Sequence
  Description of Artificial Sequence: Synthetic coding sequence
atggccagcgtggcctgggccgtgctgaaggtgctgctgctgctgcccactcaaacatggtctccagtcggtgcaggtaatccacctgactgtgacgctccacttgcttccgcgcttcctcgatcctccttttcaagcagctcagagctcagttcttcccatggccccggattctctaggctgaacagacgggacggggccggcgggtggacccctctcgtgagcaacaagtaccagtggctgcagattgatttgggcgaacgtatggaagttactgcggtggcaactcagggcggatacggctcttcagactgggtcaccagttatctgcttatgtttagtgacggtggccgaaactggaaacagtaccgtagagaagagtctatctggggattccccgggaacacgaatgccgattcggtggtccactatcggttacagccaccgttcgaggcacgattcctgcggtttctgcctctggcttggaaccccaggggaagaattggaatgagaatcgaggtttacggttgcgcgtataagtccgaggttgtgtatttcgacggacagtctgccctcctgtatcgtcttgataagaagcctttaaagccaataagagacgtgataagcctcaaatttaaggcaatgcagtccaatggaatcctgctgcacagagaggggcagcacggcaatcatatcacactggagcttattaagggaaagttggtttttttcctgaacagcggcaatgctaagctccctagcactatagccccagtgactctgactctgggttcattgttggacgaccagcattggcactccgtgctgattgaattattagatactcaagttaatttcacggttgataagcatacccaccatttccaggcaaagggagactccagttacctagatttgaatttcgaaattagctttggcgggattccgactccaggaaggtcccgggcttttcgaaggaaatcattccacggctgtctagaaaacttgtattataacggtgtggatgtaaccgagcttgcgaaaaaacacaagcctcagatcttgatgatgggcaacgtcagcttttcttgcccacagccacagaccgtgccggtcactttcctgtcatcccggtcttatctggccttgcccgggaattccggagaagacaaggttagcgtgaccttccagttccggacgtggaatagggcaggacatctactgtttggcgagctgaggcgaggctccggcagctttgtactgtttctcaaagacggcaaactgaagctctctctgtttcaacctgggcagtcccctaggaacgtcacagctggggctggattgaatgatggccagtggcattccgtcagctttagcgcgaaatggagtcacatgaatgtggtcgtcgacgatgatactgctgtgcagcccctggttgctgttctgattgattcgggcgacacatactacttcggcgcactgtacgagcagagctgcgaagcgcacaagcacagaggaaacccttccggcctctactacattgatgccgatggctccggtcccttggggcctttccttgtctactgtaatatgaccgacgccgcctggactgtggtgcagcatggtggtcctgatgctgtgacactccggggagctccaagtgggcaccccaggtccgctgtctcttttgcttacgccgccggggctggccagttgcgctcagcagtgaatttagcagagagatgtgagcagagactggcactgcggtgtgggaccgctcgacggccagattcccgcgacggaaccccgttatcatggtgggtgggtagaaccaacgaaacgcacacgtcttggggcggttccttgcctgatgctcagaaatgtacatgcggccttgagggcaattgcattgacagtcagtattattgcaattgcgacgctggacggaatgagtggtag

SEQ ID NO: 8808 - DNA, 1455 bp, Artificial Sequence
  Description of Artificial Sequence: Synthetic coding sequence
atgtggtacgtgagcacccggggcgtggccccccgggtgaacttcgaaggggctctgttcagtggatacgctcccgatgggggcctcttcatgcctgaagaacttccccagctggatcggggaaccctgtgtcaatggtccaccctgtcgtacccaggactggtaaaggagctgtgcgctctgtttatcggctctgaactgctaccgaaggatgagctgaatgacctgatcgacagagcctttagcagattccgacatcgggaggtggtgcatctgagtcgtctgaggaatggtctcaacgtgttggaactttggcacggagttacttacgctttcaaagatcttagtctgtcctgcacaactcaatttctacaatactttttggagaagcgggagaagcatgtaactgtcgtggtcggtacttcgggcgacacaggaagcgcggcaattgaaagcgtccaaggcgcaaagaatatggacatcatcgtgctcctgcccaagggccattgtacaaaaattcaggagctgcagatgaccacagtactcaagcagaatgtccacgtcttcggcgtggaagggaactctgacgaactggatgaaccgattaaaacggtcttcgcagatgtggcctttgtcaagaaacataatctgatgagtttgaatagcattaattggagcagagtgttggttcagatggcacaccatttctttgcatactttcagtgcacaccctcacttgatacacatccactgcctttggttgaagtggtggtaccaaccggggctgcgggcaatctcgccgcaggctacatcgcacaaaagatcggcctccctatcagattggtggtcgcagtgaaccggaacgatattatccataggactgtgcagcagggagactttagcttaagcgaagctgtcaaatccacacttgcttcagctatggacatacaggtgccttataacatggagagggttttttggctgcttagcggtagtgacagccaggtaactcgagctttaatggagcagtttgagcgaactcagtcagtgaatctcccaaaggaactgcattctaaactcagcgaggccgtgacttctgtgtcagtgtcggacgaggctattactcagaccatggggaggtgctgggatgagaatcaatatctcctgtgtccgcactccgccgtagctgtgaattaccactatcagcaaatagatcgtcagcaaccctcaaccccaaggtgttgtctggcacccgcgagcgccgcgaaattccctgaagccgttctggctgctggtctaacaccagaaaccccagcggaaatcgttgcattggagcataaagaaactaggtgcacactcatgaggcggggagacaactggatgctgatgctcagagataccatcgaagacctgtctaggcaatggcgtagccacgccctgaacacgtcgcagtag

SEQ ID NO: 8809 - DNA, 264 bp, Artificial Sequence
  Description of Artificial Sequence: Synthetic coding sequence
atggtgagcctgatgaagctgtggatccccatgctgatgaccttcttctgcacggtgctgttgagcgtgctcggagaaatgaggaagaaacgttacgatcgaaaagagcttctcttggaggagtgctggggaaagcccaatgtgaaggagtgtacaaacaagtgttctaaggcattcagatgcaaggacaagaattacacttgctgctggacttattgcgggaatatttgctggatcaatgtggagaccagtggggactactag

SEQ ID NO: 8810 - DNA, 453 bp, Artificial Sequence
  Description of Artificial Sequence: Synthetic coding sequence
atgcggttcatggccggccccgccggcagccagagcctgggccccctctgtttccacagttcccctcaggccctgtatacagtgctcctaatagtgctggtgatgatgtccttagtgttcggaaagtttgtcccagtaaattgggaaccgccacagccgttgccttttcccaagtaccttagatgctaccgatgcctgctggaaacaaaagaactgggctgccttctcggcagcgacatatgcttgacaccggcgggatctagctgcatcactctgcacaaaaagaactcaagcgggtctgatgtaatggtatctgactgccgaagcaaggagcagatgtcggattgttctaacacaaggacctcccctgtgtctggattctggatcttttctcagtattgcttcttagacttttgtaatgatccacaaaacagagggttgtacacaccctag

SEQ ID NO: 8811 - DNA, 873 bp, Artificial Sequence
  Description of Artificial Sequence: Synthetic coding sequence
atgagcgtgcggcggggccggcggcccgcccggcccggcacccggctgtcctggctgctctgttgttcggccctcctctcacccgccgcagggtatgtgattgtgtctagcgtctcatgggctgttacaaatgaggtggacgaagaactcgatagcgcttcaactgaagaagccatgcccgctctccttgaagacagcggtagcatctggcaacagagctttcctgccagcgctcataaggaggatgctcaccttaggcccagggccggagcggcgagggcacgaccgcctcctgcccccccaggcatgtttagttaccgccgggagggaggccagaccgcatctgcaccacctggaccacgcctcagagcagccacagcacgcagcctcgcccatgcctccgtctggggctgtctagctaccgtgtccacgcacaagaagattcaaggcttgcctttcggcaactgccttccagttagcgacggtccctttaataactccacgggtataccattcttttacatgacagcaaaagatcctgtcgtggccgatcttatgaagaaccccatggccagcctgatgcttcctgaatcagagggcgaattctgcaggaaaaatattgttgaccctgaagaccctcgctgtgtccaattgactttgacaggtcagatgattgccgtttctcctgaagaagtagagtttgccaagcaagctatgtttagtaggcatcccggaatgcgcaagtggccaaggcagtatgagtggtttttcatgaagatgcggatcgaacatatttggctgcagaagtggtacgggggcgcatccagcatctcccgggaagaatactttaaggctgtgccacgtaaagcttag

SEQ ID NO: 8812 - DNA, 2742 bp, Artificial Sequence
  Description of Artificial Sequence: Synthetic coding sequence
atgggccccgaggccctgagcagcctgctgctgctgctgctggtggcatctggagacgccgatatgaagggtcactttgatccagccaaatgccggtacgcgctcggcatgcaagataggactatcccggattccgatatcagcgccagcagcagctggagcgatagtacagccgcccggcacagtcgtttggagtccagcgatggagatggagcctggtgccctgcagggagcgtatttcctaaggaagaggagtatctgcaggttgatctgcagcggctccaccttgtagcactggtgggaacccagggtcgacatgccgggggattagggaaagagttcagtagaagttacagattaagatacagtagggatggaaggagatggatgggctggaaggaccgttgggggcaggaggttatttctggtaatgaagatcctgagggagttgtccttaaggatcttggaccacccatggtcgccagactggtgcgtttttaccctagagctgaccgggtcatgagcgtgtgcctgcgcgttgagctatacggctgtctgtggagggatgggctgctgtcatacaccgctcccgtgggacaaactatgtacctctccgaggcagtttatcttaatgacagcacatatgacggacatacagttggaggcttgcaatacggtgggctggggcagctggctgatggagtggtgggattggacgatttcagaaagtctcaagaactgagggtgtggcctggttacgactacgtcggctggtctaaccattcttttagcagcggttatgtggagatggaattcgagtttgacagactcagagctttccaggcaatgcaagtgcattgcaataatatgcatacactaggggcccggctcccaggcggagtcgagtgccgatttagaagaggcccggccatggcctgggaaggtgaaccgatgcgtcacaacctcggcggcaatttaggagacccccgagcccgtgccgttagcgtgcctctcggcgggcgcgtggctcgcttcctacagtgccgattcctattcgccggaccatggctcctgttctcagagatctcttttattagcgatgtggtcaacaacagttctcccgccttgggggggaccttcccaccagcaccgtggtggcctccgggtccaccacccaccaacttttcctctctcgagctcgagccacggggccagcagcctgtcgcaaaggccgagggttcccctaccgccatcctcattggatgcctagtggcaattatactcctgctgctcctgattatagccctcatgttatggaggctccattggaggagactgctgagtaaagctgagcgccgcgtacttgaggaagaattgacagttcatctgtcggtgcctggagacaccatcctgatcaacaacaggccggggcctcgcgagccccccccttatcaggaacccaggcctcgcggaaatcccccacattctgccccctgcgttccgaatgggtccgccctcctgctctcaaacccagcctaccgcctgcttcttgccacctacgcccgacctcccagaggaccagggccccctactcctgcttgggccaagccaaccaatactcaagcttacagcggcgactacatggagcctgagaagccaggtgcgcctcttttgccccctccccctcaaaactccgtgccccattacgccgaggctgacattgtcacactgcagggcgttaccggtgggaatacctatgcagttccggcccttccacccggagctgttggcgatggaccaccacgggtagactttcccagatctagactgagattcaaggaaaaacttggcgaaggccagttcggtgaagtccacctgtgcgaagtggactcaccacaggacttggtgagtctggatttccccctgaatgtcagaaaagggcaccccctccttgtggcagttaagattctaagacccgacgctaccaaaaatgccaggaatgattttctgaaagaagtcaagatcatgagcaggttaaaggaccccaatatcatacggctactgggggtgtgcgttcaagatgatcctctgtgcatgataacggattatatggagaacggtgatctgaatcagttcctgagtgcccaccagttggaggacaaggcagctgagggggcaccaggagatggtcaggccgctcaggggcccactattagctaccctatgctcctacatgtcgcagcacagattgcttctggcatgcgctacttggcaaccttaaattttgtacacagagatctggccacaagaaattgcttggtaggcgaaaattttactattaagattgcggattttggtatgagcaggaacctgtacgctggtgactattatagagttcaaggacgggctgtcctcccgatacgctggatggcctgggaatgcattctcatggggaagtttacgactgctagtgacgtttgggcctttggcgtgactctgtgggaggtgctcatgttgtgccgcgcacaacctttcgggcagttgactgacgagcaggttattgaaaacgccggcgaattcttcagagatcagggtagacaggtgtatttgtcccgtcccccggcatgcccacagggtctatacgaactgatgctgcgctgctggtcaagggaatcagagcagaggccaccttttagccagctgcaccgcttcttagcagaggatgcccttaacaccgtgtag

SEQ ID NO: 8813 - DNA, 243 bp, Artificial Sequence
  Description of Artificial Sequence: Synthetic coding sequence
atgaagctgagcggcatgttcctgctgctgagcctggccctgttctgctttctaactggagtattctctcaaggtggtcaggttgattgcggggagtttcaggaccctaaggtctactgtacgagagaatcaaacccccattgtggcagtgacggacagacttatggcaataaatgcgcgttttgcaaggctattgtgaagtccggtggaaaaattagcctcaaacatcccggtaaatgctag

SEQ ID NO: 8814 - DNA, 270 bp, Artificial Sequence
  Description of Artificial Sequence: Synthetic coding sequence
atgaagccctggatcctgctgctggtgatgttcatcagcggcgtggtgatgttactgccggtgctggggagcttttggaataaagatccatttttggacatgatcagggagacagagcagtgctgggttcagccaccatataagtattgcgagaagaggtgtaccaaaataatgacatgcgtacggcccaaccatacttgctgctggacttattgtgggaacatctgcttagataacgaagaaccccttaagagcatgctgaatccttag

SEQ ID NO: 8815 - DNA, 264 bp, Artificial Sequence
  Description of Artificial Sequence: Synthetic coding sequence
atgctgccctgcctggccctgctgctgctgatggagctgagcgtgtgcacagttgccggcgacggcggagaggagcagacactgagtaccgaggcagagacttgggagggagccggacctagcatacagcttcaactgcaagaagtcaagacaggcaaggcttcacagttctttgggctcatgggtaagcgagtcggaggccgcccacttatacaaccccggaggaagaaaggcagagaagacgaggcccaggggagtgaatag

SEQ ID NO: 8816 - DNA, 285 bp, Artificial Sequence
  Description of Artificial Sequence: Synthetic coding sequence
atgcagcacagcctggtgttcttcttcgccgtgatcctgcacctgagtcaccttctacacctcgacgccagcatccatccctttagattgcccttctcctcaaagccttttctgctcatccctatgtcaaatacaactttgccgcacacagcatggccgctgtcctttctgcaccagacagtgtccactctgaaagcagtagccgtgactcattcgctatggcacttgcaaattcctgtggactgtcaggcttgtaatagaaagtccaagaaaatttattgctag

SEQ ID NO: 8817 - DNA, 327 bp, Artificial Sequence
  Description of Artificial Sequence: Synthetic coding sequence
atgcggcagcggctgctgcccagcgtgaccagcctgctgctggtggctctgttgttccccggcagcagtcaggcccgccatgtcaaccattctgctaccgaagcgctgggggaactgagagagcgcgccccgggtcaaggcaccaacggtttccagctgctacgacacgccgtgaaacgtgacttgttacctccaagaactccaccctatcaaggcgacgtgcccctggggattcgcaacacgatctgcagaatgcagcagggaatctgcagactctttttctgccattcaggaacggggcaacagcaccgccagcgatgtgggtag

SEQ ID NO: 8818 - DNA, 807 bp, Artificial Sequence
  Description of Artificial Sequence: Synthetic coding sequence
atgctgctgctggccgccgccttcctggtggccttcgtgctgctgctgtatatggtgtcccccttgatttcacccaagcccttagccttgcccggagcacacgtagtggtgaccgggggatccagcggaatcggtaagtgtattgcgatcgagtgctacaaacaaggggcgtttatcaccctcgtagcgcgcaacgaggataagctactccaggctaagaaagagatcgaaatgcatagcatcaacgacaaacaggttgtactgtgtatctcagtggatgtgtcacaagattataatcaagtcgaaaatgtgataaaacaggcccaagagaagctaggtccagtcgatatgttggtgaattgcgcagggatggctgtgtctggcaagttcgaggaccttgaggtgagcacttttgaagtaaagccttacaacgtgtatatcaccgtggcttaccctcctgatacagatacacccggcttcgcagaagagaacaggactaagcctctcgaaacccgtcttatttccgagaccacgagcgtctgcaagcccgagcaggtcgctaagcagatcgtgaaagatgccatccaagggaactttaactcatcattaggtagcgacggttacatgctctccgccctcacgtgtgggatggcccctgtgactagtattacagagggcttacagcaggtggtgacaatggggttgttccggacaattgctttgttctacctgggttccttcgattctattgtccgccgctgcatgatgcagcgcgaaaagtctgaaaatgctgataagaccgcgtag

SEQ ID NO: 8819 - DNA, 1686 bp, Artificial Sequence
  Description of Artificial Sequence: Synthetic coding sequence
atgcggtggatcctgtgctggagcctgaccctgtgcctgatggcccagacagctctgggtgcactccacacaaaacggccccaggtggtgaccaagtatggcaccctgcagggcaagcagatgcacgtcggaaagacacctattcaggtgtttttaggggtgccctttagtcgtcctcctctgggcattctccgattcgctccccctgagccacccgagccatggaaaggaattcgagatgccacgacctatccaccaggatgtctgcaggagtcttggggacagctcgcaagcatgtacgtatccacacgggaaagatacaaatggttgaggttcagcgaggactgcctctatctaaatgtgtacgccccagccagagcccctggagatccccagctgcccgttatggtctggttcccgggcggagccttcatcgtgggagccgcatcatcttacgaaggaagcgatctggccgcacgggaaaaggttgtgctggtgtttctccagcatagactgggtatattcggctttctgagtaccgacgattcccatgccaggggcaattgggggctgctcgaccagatggctgcacttaggtgggtccaggagaatattgcagcctttggtggggatcccggaaacgtcaccctttttggtcagtccgccggggctatgagtatttccgggctgatgatgtcaccactggccagcggcctcttccacagagccatctcccagtccggcacagccctcttccggctgtttatcacttccaacccgctgaaagtggcaaagaaagtcgcccatctggccggctgcaaccataattccactcagatcctggtaaactgtctccgagctctgtcaggcactaaggtgatgcgcgtttctaacaagatgagatttctccagttgaattttcagcgggatcccgaggagattatttggtccatgtcccccgtggtcgacggcgttgtcatcccagatgatcctctagtgctgctgactcagggtaaggtgtcttctgtcccctacctgctgggtgtgaataacttggaatttaactggctgctcccttacattatgaaatttccactaaacagacaagcgatgagaaaagagacaattacgaagatgctctggtctacaaggacgctgcttaatattacgaaagagcaggtgccactcgtggtggaagaatacctcgataacgtgaatgaacacgattggaaaatgttaaggaaccgaatgatggacatcgtccaggatgccacctttgtgtacgccactctgcagactgctcactatcaccgcgatgcagggctacctgtgtatctgtatgagtttgaacaccatgctagagggatcatagttaagccacggactgatggcgcagatcacggcgatgaaatgtacttcctttttggaggaccatttgctaccgggctctctatgggcaaggaaaaggccctgtcgttacagatgatgaaatattgggccaacttcgcccggacaggtaaccccaacgatggcaacctcccctgttggccacgctacaacaaagatgagaagtacctgcagctcgacttcaccactagagtcggcatgaaactgaaggaaaaaaagatggccttctggatgtctctgtaccagagccagaggccggagaagcagaggcagttttag

SEQ ID NO: 8820 - DNA, 444 bp, Artificial Sequence
  Description of Artificial Sequence: Synthetic coding sequence
atggccagcagcctgaagatctggggcaccctgctggccctgctgtgcattctttgtaccctcctcgtccaatccaaagaggtttcctggagagagttcatgaaacagcactaccttagtccctcacgggagtttcgagagtacaagtgcgatgtgctcatgcgggaaaacgaagcactcaaggacaaatcttcccatatgttcatctacatttcatggtacaagatagagcatatctgcacatccgacaattggatggatagatttcgaaatgcctacgtgtgggtgcagaaccctctgaaagtgttaaagtgtcatcaggagaatagcaaaaattcatacaccgagtctagatcgtttaattacatcgaattccattgtagcatggacgggtacgtggactcaattgaggacttgaaaatggtggagcccatcggcaactag

SEQ ID NO: 8821 - DNA, 444 bp, Artificial Sequence
  Description of Artificial Sequence: Synthetic coding sequence
atgaccagcagcctgaagatctggggcatcctgctggccctgctgtgcatcctatgtaggctttgtgtgtactctaataacatctattggcgcgagtttatcaagcttcactacctgtctcctagtcgcgagttcaaggaatacaagtgcgacgtgctgatgcgagaaaaggaggcccttaaggggaagtctttccacatgtttatctatagtttatggtttaaaattcagcgcgcatgtatcaatgaaaaaggctccgatcgctacagaaatgcttatgtatgggctcccggggcattgaaagtcctggaatgtcactgggagaagtacaataatagatacacagagtctcgatcgttttcttatatagagttccactgtggagtggacggctatgtcgataatatcgaagatctgcggatcattgaaccgatctccaattag

SEQ ID NO: 8822 - DNA, 1248 bp, Artificial Sequence
  Description of Artificial Sequence: Synthetic coding sequence
atgagccccttcctgtacctggtgctgctggtgctgggcctgcacgccactatccactgcgccagccccgagggtaaagtcaccgcttgccatagcagccagccgaacgcgactttgtataagatgtcatccattaacgcagattttgccttcaacctgtatcgacgcttcacagtcgagactccagataagaatatcttctttagccctgtgagcatcagtgcggcattggtgatgttgtccttcggggcttgttgctccactcaaactgagatagtcgaaaccctcgggtttaacctgacggatacccccatggtggagatccagcacgggttccagcatctgatctgctcactgaacttccccaagaaggagttggagctgcaaataggaaacgctctctttatcgggaaacatctcaaacctctggccaagttcctgaacgacgtgaagactttatacgagaccgaagtctttagcacagacttcagcaatattagtgccgccaagcaggagatcaattcacacgtcgagatgcagaccaagggcaaggtggtgggactcatccaagaccttaagcccaacaccatcatggtgctggtgaattatatccacttcaaagcgcagtgggcaaatccattcgacccttcgaagaccgaagattcctctagtttcctaatcgacaaaacaacaaccgtgcaggtgcccatgatgcaccagatggaacaatactaccacttggtggacatggagctcaactgcacggtccttcagatggattactcaaaaaatgccctggccctgtttgtgctcccgaaagagggacagatggagagcgtggaggcagcaatgtccagcaaaaccttgaaaaagtggaacagattactgcagaaagggtgggtggacctttttgtgccaaaatttagcatcagcgccacatatgatctaggggccaccctgctcaagatgggtatacagcatgcctactccgaaaatgcagacttctccggcttgactgaggataatggattgaagctgtcaaatgctgcccacaaagccgtgctccacatcggcgaaaagggcaccgaggctgcggctgtgccagaagtggaactctcggaccaaccagagaacacgttcctccaccctataatccagatagatagatcctttatgttgctcattctagaacgatcgacaaggagcattctcttcctgggaaaagtcgtgaatcctaccgaggcatag

SEQ ID NO: 8823 - DNA, 285 bp, Artificial Sequence
  Description of Artificial Sequence: Synthetic coding sequence
atgcggaccctggccatcctggccgccatcctgctggtggccctgcaagcacaggccgagcccctgcaggctagggccgatgaggtagccgccgctcctgaacaaatcgcagcagacataccggaggtggtggtatccttggcttgggatgagagtctggctcctaaacatcctggctcaagaaaaaacatggactgctattgtagaatccccgcatgtatcgccggggagcggaggtacggcacatgtatctaccaggggcgactgtgggcattctgttgttag

SEQ ID NO: 8824 - DNA, 1062 bp, Artificial Sequence
  Description of Artificial Sequence: Synthetic coding sequence
atgcggctgccccggcgggccgccctgggcctgctgcccctgctgcttctgttgccccccgcacccgaggcagccaagaagcctaccccctgccacagatgccggggcctggttgataagtttaaccagggtatggtcgatactgcaaaaaaaaactttggcggtggcaacacagcttgggaggagaagaccttatcaaagtatgaaagttccgaaattcgcttgctagaaatcctcgagggcctgtgtgaatctagtgatttcgagtgcaatcagatgttggaggctcaagaggaacatctggaggcctggtggctgcagctgaagtccgagtaccctgacctgttcgagtggttttgtgtgaagaccttgaaagtgtgttgctctccggggacatatgggcccgattgtctcgcatgccagggaggcagccagaggccatgctccggcaacggccattgttcaggcgatggctccaggcagggagacgggagttgccggtgtcatatggggtatcaaggaccactttgcacagattgtatggatgggtacttcagcagcctgcgcaacgaaacacacagcatttgtaccgcatgtgacgaatcatgcaagacctgctccggcctcacgaaccgggactgtggtgagtgtgaggtggggtgggtgctggacgaaggagcctgtgtcgacgtggacgaatgtgccgctgaaccacccccttgcagcgcggctcaattctgcaaaaacgcaaatggtagttacacttgcgaggaatgcgattcgtcctgtgtgggctgcacaggagaagggccagggaactgcaaggaatgtatatcaggatacgcccgagaacacggccagtgtgctgatgtggatgaatgctccctcgctgagaaaacctgtgtgaggaaaaacgaaaattgttacaacacacctggcagctacgtgtgtgtgtgtccagatggattcgaggaaacagaggatgcctgtgttcccccagccgaggcagaggcaaccgaaggtgaaagccccactcaactgccgagcagggaagatctgtag

SEQ ID NO: 8825 - DNA, 651 bp, Artificial Sequence
  Description of Artificial Sequence: Synthetic coding sequence
atgaagctgaacctggtgcagatcttcttcatgctgctgatgctgctgctgggacttggcatggggctggggctcggtttacatatggctaccgccgtgttggaagagtccgaccaaccacttaatgagttctggtcttctgactcacaggataaggctgaggcaacggaagaaggggatgggacacagacaactgagaccctagtgctgagcaataaggaggtggtccagcccggatggcctgaggatccgatcctgggtgaggatgaagtgggaggcaacaagatgctacgtgcatccgcattgtttcagtctaacaaagactacctcagattggatcagacagatcgcgagtgcaatgatatgatggcccacaagatgaaagaaccctcccagagttgcattgctcagtacgcattcatccacgaagaccttaatacagtcaaggccgtgtgtaattctccagtaattgcctgtgagcttaaaggaggtaagtgtcataagtcaagccggccatttgatttaaccttgtgcgagcttagtcagcccgaccaggtgaccccgaactgcaactaccttacaagtgtgattaaaaaacacataattatcacttgtaacgacatgaagcgtcagctgcccactggccagtag

SEQ ID NO: 8826 - DNA, 222 bp, Artificial Sequence
  Description of Artificial Sequence: Synthetic coding sequence
atgcggatcgccgtgctgctgttcgccatcttcttcttcatgagccaggtactgcctgccagaggaaagtttaaagagatctgcgagcggcccaatggctcttgcagagacttctgccttgagactgagatccacgtcgggcgatgcttaaatagtcagccttgctgtctaccactgggccaccaaccacggattgagagcactacacctaaaaaagactag

SEQ ID NO: 8827 - DNA, 609 bp, Artificial Sequence
  Description of Artificial Sequence: Synthetic coding sequence
atggagcggggcgccggcgccaagctgctgcccctgctgctgctgttaagggccacgggctttacctgcgctcaaaccgatgggaggaacggatataccgcggtcattgaagtaaccagtggtgggccctggggggactgggcctggccagagatgtgcccagacggcttttttgcctccggtttttctctgaaagtagagcccccccaaggcatccctggtgacgacacagcactgaacggtatacgcctgcattgtgctaggggcaatgtattaggcaacactcatgtcgttgagagccaaagtggaagctggggggagtggtctgaacccctgtggtgtcggggcggtgcatacctggtggctttctcacttagggtggaggccccaaccacgctgggggacaacactgccgctaataatgtaagatttcggtgctcagatggagaggagctccaaggtcccgggttgtcttggggggactttggagattggagtgatcattgtcccaaaggagcctgcggcctgcagactaaaattcagggtccacgcggacttggggacgacaccgcgcttaatgacgctcggttgttctgttgccgcagctag

SEQ ID NO: 8828 - DNA, 759 bp, Artificial Sequence
  Description of Artificial Sequence: Synthetic coding sequence
atgcagctgacccggtgctgcttcgtgttcctggtgcagggcagcttatatctagttatctgtggacaggatgacgggcctcccggtagcgaggatccagaaagggacgaccacgaggggcagcccaggccacgtgttccccgaaaacgtggccacataagcccgaaatcacgccccatggctaactccaccctactaggtctcctcgcgccacctggtgaggcttggggtatcctgggccagcctccgaacagacctaaccacagcccacccccgagcgcgaaagtgaaaaagatctttggctggggtgacttctacagcaacattaagactgtggccttgaacttactggtgacaggcaagatcgttgatcatgggaacggcacctttagcgtgcactttcaacacaatgcaacggggcaggggaacatttctatctctcttgtccctccaagcaaggcagttgagttccaccaagaacagcagatttttatagaagcaaaggccagcaagatctttaactgtcggatggaatgggaaaaggtggaaagagggcgccgaacctcgctgtgtacacacgacccagccaagatctgcagcagggatcacgctcagtcatcggcaacttggtcctgctcacagccctttaaggtcgtgtgcgtgtacattgctttttacagcacagactacaggctcgtgcagaaggtgtgtcccgactataactaccatagcgacacaccctattatccaagcggatag

SEQ ID NO: 8829 - DNA, 555 bp, Artificial Sequence
  Description of Artificial Sequence: Synthetic coding sequence
atgaagatcctggtggccttcctggtggtgctgaccatcttcggcatccagagccatggatacgaggtttttaatattatctcgccaagtaataacggcggcaacgtgcaggagactgtaaccatcgataatgagaagaacacagcaatcattaacattcacgcaggtagctgcagctccaccacgatctttgattacaaacacggttacattgcatcaagagttctgtcccgtagggcctgtttcattttgaagatggatcatcagaatatacctcctctgaacaaccttcagtggtacatttacgaaaagcaggccttggataatatgttctctagcaagtacacatgggttaaatacaaccccctggagagtctcatcaaagatgtggactggttccttctggggtcccctatcgagaagctttgcaaacacataccactgtacaagggggaggtcgtggaaaatacacacaatgtcggggcaggcgggtgtgcgaaagctggcctgttgggaatcttggggatcagtatttgtgcagatattcacgtgtag

SEQ ID NO: 8830 - DNA, 651 bp, Artificial Sequence
  Description of Artificial Sequence: Synthetic coding sequence
atgggcgccgtgatgggcaccttcagcagcctgcagaccaagcagagacggccatcgaaggacaaaattgaagacgagctggagatgacgatggtttgtcataggcccgagggccttgagcagctggaagcccagaccaatttcaccaagagggaacttcaggtgctctatcgcggctttaagaacgaatgcccatcaggggtggtgaacgaggacacgttcaagcagatctatgcgcaattctttccacacggggacgcctccacctatgcccactatttatttaatgcctttgacaccacccaaacaggttccgtgaagtttgaggacttcgttaccgcacttagcatactgctgcgcggtaccgtgcacgaaaagctgaggtggacattcaacttgtatgatatcaacaaagatgggtacatcaataaagaggagatgatggacatcgtcaaggctatctatgatatgatgggaaagtatacataccctgtactgaaagaggatactccccgacagcatgtggatgtgttctttcagaagatggacaagaacaaagacggcatcgtgaccctggacgagttcctggaatcttgtcaggaagacgataacatcatgaggagccttcagctgtttcaaaacgtcatgtag

SEQ ID NO: 8831 - DNA, 2736 bp, Artificial Sequence
  Description of Artificial Sequence: Synthetic coding sequence
atggcccagctgttcctgcccctgctggccgccctggtgctggcccaagccccagctgctctggcagacgtcctggaaggcgactcaagtgaagatcgcgcattccgggtgcgcattgcgggcgacgccccactgcagggagtgctcgggggagctttgacaatcccctgccacgtgcattatctgcgcccaccaccctcccgccgtgccgtccttggtagccctcgagtcaagtggactttcctctctagaggacgcgaggcagaggtcctggttgctcgcggggttagggtgaaggtgaatgaggcgtatcgcttcagagtcgcccttccagcttatcctgctagtttgactgatgtctcattggctctgtccgaattgcggcccaatgattctgggatctataggtgcgaagtgcagcatggcatagacgacagttcagatgcagttgaggtcaaagttaaaggggttgtgttcctttaccgggaggggtccgctagatacgccttctcattctcaggggctcaggaagcctgcgcaaggatcggggcacatatagcaacccctgagcaactctacgctgcctaccttggaggttatgagcaatgtgacgccggctggctgtctgatcagactgtgcgttatcctattcagacaccacgggaagcttgctacggagacatggacggatttccaggcgtaaggaattacggagtcgtggatcctgatgacttgtacgatgtgtattgttacgccgaggacctcaacggcgaattgtttcttggagatccccccgaaaagctgacgctggaagaagccagagcttactgccaggaaaggggggccgaaattgcaacaactggtcagctgtacgcggcgtgggatggaggcctggaccattgttcaccgggctggctcgcagacggaagcgttcgttaccccattgtcacccctagccagcgctgtggaggcggtttgcctggagtcaaaaccctgttccttttcccaaatcagacaggattcccgaacaaacattctagattcaacgtctactgctttcgcgacagtgcccaacctagcgctatcccagaggccagcaatcccgcctctaaccctgcatctgacggactggaagctattgttactgtcactgagacgctggaagaactccagttgccccaggaggctacagaatcagaatcccgaggagccatatactccattcccattatggaggatgggggaggcggtagctccacccccgaagatcctgcggaagctcccaggacactgctagagtttgagacacagtccatggttccacctacaggctttagtgaagaggaggggaaggccctggaagaagaggagaaatacgaagacgaggaggagaaagaagaagaagaagaggaagaagaggtcgaagacgaagcactatgggcatggccaagtgagctctcaagccctggccctgaggcctcacttcccacagagcccgccgcccaggaagagagcctgagtcaagcccccgcaagggccgtgttgcaacccggggcgtcccctctccccgatggagaaagtgaggccagtagacctccccgcgtgcacggaccccccactgagaccctgcccacaccacgcgaacgcaatttggccagccccagccccagcacactcgtcgaagcaagggaagttggggaggcgacaggcggcccggaactgtccggggtcccccgcggggaatcagaagagaccgggtcatcagagggcgctccctcactgctgccggccactcgcgcaccggaaggcactcgtgagctggaagccccctcggaagacaactccggtaggacagcgccagccgggacctctgtccaggcccagcctgtattgcccactgactctgcaagcagaggcggggttgcagtcgtgcctgcatctggtgactgtgtgcctagcccctgccataacggcggcacatgcctcgaggaggaggaaggcgtccggtgcctgtgcctcccaggatacggaggagatctctgcgatgtggggttgaggttctgcaaccctgggtgggatgcttttcagggagcttgctacaagcacttcagtacacgccgatcatgggaagaggccgaaacccagtgcagaatgtacggcgcacacttggcatcgatcagtacgcccgaggagcaggacttcataaacaaccgctaccgcgaataccagtggataggacttaacgaccggaccatagagggtgatttcttgtggagtgatggggtgcccctgttgtatgagaactggaacccgggccaacccgattcatattttttgagtggcgagaactgcgtggtgatggtgtggcatgaccagggacagtggagcgatgttccgtgcaattaccatctttcctatacctgcaaaatgggtctggtgtcttgtggacctcctccagagcttcctttagctcaggtgttcggtagaccaagactgcggtatgaagtcgataccgttctgcggtacaggtgtagagaggggctcgctcaacgaaatctgcctctgatccggtgtcaggagaacggaagatgggaggcccctcaaataagctgcgtacctagaagacctgctcgagcactgcatccggaagaggatccagaaggtagacagggcaggctgctgggacgatggaaagccctgctgattcctcccagtagtcccatgcccggcccctag

SEQ ID NO: 8832 - DNA, 852 bp, Artificial Sequence
  Description of Artificial Sequence: Synthetic coding sequence
atgggcctgggcctgcggggctggggccggcccctgctgaccgtggcgacggcactgatgttgccggtaaagccacccgctgggtcctggggtgcccagatcataggcggacacgaggtcaccccccacagccgcccttacatggcttccgtgaggttcggcggacagcatcactgtggcggcttcctgctccgtgcccggtgggtggtaagcgctgcccactgtttcagccatagggacttgaggaccggcttggtcgtccttggggcccatgtactaagcaccgcagaaccaacacaacaggtgtttggcatcgacgccctgaccacccatcccgattaccatccaatgacacacgccaacgacatctgtctgttacgtctgaacggtagcgccgtattggggcccgctgtcggactgctgcggcccccgggtagaagagcaagacctcccaccgccggcaccagatgccgggtggctgggtggggcttcgtgagcgattttgaggaacttccaccgggactgatggaggccaaagtgcgggttctggatccagatgtttgtaatagttcctggaaaggacatctgactctgaccatgctgtgtacacggagcggggatagccacaggaggggcttctgcagtgccgactctggaggcccgctggtctgtcgcaatcgagcacatggccttgtgtcattttccggcctgtggtgtggcgatcctaaaaccccagacgtgtatacccaggttagcgcgttcgtggcttggatctgggatgtggtgaggcgcagctccccccagcccggacccctacccggcacaacccgaccccccggcgaggcggcctag

SEQ ID NO: 8833 - DNA, 1209 bp, Artificial Sequence
  Description of Artificial Sequence: Synthetic coding sequence
atgatggtggccctgcggggcgccagcgccctgctggtgctgttcctcgctgccttcctccctccgcctcagtgcactcaggatcctgccatggtgcattacatttatcaaaggttccgtgtgttggagcagggactggagaaatgcacccaggccacgagggcatatatacaggagtttcaggaattctccaagaatatctcagtgatgctcggcagatgtcagacttacacttctgaatacaaaagcgctgtgggaaacctcgcacttcgtgttgagagggctcagcgggagattgactacattcaatatctgagggaagctgacgaatgcatcgagtctgaggataaaaccctagcagagatgctgctgcaggaagctgaggaagaaaagaaaataagaactctgctaaacgcctcctgcgacaacatgctcatgggaatcaagtcactgaagattgtgaagaagatgatggatactcacgggagttggatgaaggacgccgtctataactcccctaaggtttatctcctgatcgggtcgcgaaacaataccgtgtgggagttcgcaaatatccgggcattcatggaggataataccaagcccgcccctaggaagcagatcctgaccctgagctggcaaggcactgggcaggtcatctacaaaggcttcctattctttcacaatcaagcgacctctaacgagattattaaatacaatctccaaaagagaacagtggaagatcgcatgctcctaccgggtggcgtgggccgcgctctggtctaccaacacagtccatcgacctacattgacctggcagtggatgagcatggactttgggctatccacagtggccctggaactcattcccacctcgtgttgactaagattgaaccagggacgcttggagtggagcactcttgggatactccttgtaggagtcaggatgcagaagcgtcctttctgttatgtggcgtcctttatgtcgtctattctactggcgggcagggaccgcatcgaattacctgcatatacgacccccttggcacaatttctgaagaggacctgccgaatcttttcttccccaaaaggccaagaagtcattcgatgattcactacaatccacgtgataaacagttgtatgcctggaacgagggcaaccaaattatctacaaacttcaaacaaaacggaagttgccacttaagtag

SEQ ID NO: 8834 - DNA, 1221 bp, Artificial Sequence
  Description of Artificial Sequence: Synthetic coding sequence
atgcagctgttcctgctgctgtgcctggtgctgctgagcccccagggggcttctctgcatcgccaccacccccgtgagatgaagaagcgcgttgaggatttacatgttggcgctacagtggctccatcctcgaggcgggattttacattcgacctttatcgggctctggcgagcgcagccccttctcagagcatatttttttctcccgtgtctatctctatgagcctggcaatgctgtctttgggcgccggtagctccacaaaaatgcagatccttgagggacttggactcaacctgcagaagagctctgagaaggaactccatcggggattccagcagctgctgcaggagttaaatcagccccgtgatggcttccagttgtcgctaggtaatgcactgttcacagatctggtggtggacctccaagacacatttgtgtcagccatgaaaactctgtacctcgccgacacattccccactaacttcagggacagtgcaggtgcgatgaagcagattaatgattatgtggcaaagcagactaagggcaaaatcgtcgacctcctgaagaacttggacagcaatgccgtcgtaattatggtcaattatatattctttaaggccaagtgggagacatcgtttaatcacaaagggactcaggaacaggatttttacgtgacgagtgaaaccgtggtccgagtgccaatgatgtcgcgagaagatcagtaccactacctgctcgacaggaacctctcttgtagagtggtgggcgtgccatatcagggaaacgcgaccgctctctttatcttgcctagcgagggaaaaatgcagcaggtggaaaatggcctgtccgaaaagacgctgcgcaagtggttgaaaatgtttaaaaagagacagcttgagctgtatctgcctaaattcagcatcgaggggtcttaccagctggaaaaggtgctaccgtcacttgggattagtaatgtgtttaccagtcatgccgacctttcaggaattagcaatcacagcaacatacaggtgtctgagatggttcataaagccgtggttgaggttgatgaatctggcaccagagccgcagccgcgacgggcacaatttttaccttcagaagtgctaggctgaatagtcaacgtttagtgttcaacagaccctttctgatgttcatcgtggataacaacatcctgttccttggcaaagtaaatcgtccctag

SEQ ID NO: 8835 - DNA, 1626 bp, Artificial Sequence
  Description of Artificial Sequence: Synthetic coding sequence
atgcggctgagccccttccacctgcagctggagttccacatgaaggagaaacgcgaggatcttcagatctcctggagtttcatttctgttcccgagatggctgtgaacattcagccaaaagcactgggcgaggatcaagtggctgaaacctctgcaatgtctgacgtgcttaaggatatactcaagcatctggccggctccgctagtccaagcgtggtcttgattactaaacctactactgtgaaggaagctcagaaccttcaatgcgctgcctctactgcacaagagtcctgccctcccaagccaccaagagcacacgagctcaagctcttggtgcggaacatacacgtgttattactcagcgaaccgggagccagtggtcacataaacgcagtctgcgttgtgcagctcaacgaccccgtacaacgcttttccagcactctgaccaaaaacacgcctgatttaatgtgggaggaagaattcacatttgaacttaacgccaaaagcaaggagctgcatctacagatttctgaggccgggagatcatcagaaggactgttggcaaccgcaaccgtgccacttgacctcttcaaaaagcagccaagcgggcctcaaagcttcacactaactagcggctctgcctgcggctcaagcgtcttgggcagcgttaccgctgagttttcatacatggagcctggggagttgaaaagctggccaatccctcctcctgtccctgccgccaagatcgaaaaagatcggacagtgatgccttgcggaactgtcgtgaccaccgtaaccgcagtgaagacaaaacctagagtggacgttggccgcgcttcgcccctttccagcgactctccagtaaaaactccgattaaagtgaaggttatcgagaaagacataagcgttcaagccatcgcttgtcgttccgcacctgtgtcaaagacactgtcttcctctgacaccgaattactggtcctgaacggcagcgatccagtcgcggaggtagccattaggcagctgtctgaatcgtctaagctgaagctgaagagcccacgcaagaagagtaccatcattatctctggaatctccaagacatcactgagccaggaccacgatgcagccctgatgcagggctacaccgcatccgtggacagcactcaccaagaggatgcgccgtctcatccagaacgcgcagccgcttccgcgcctcctgaggaagccgaaagtgcgcaggcaagccttgctccaaagccacaagaggacgaactggatagttgggatctagagaaggagccacaggccgccgcatggtcctcccaagtcctgctcgacccagacggggacgagctgtcagagtcttccatgtctgtcctggaaccaggcacggccaagaagcacaagggaggaattctcagaaaaggtgccaaactgtttttccggagacggcatcagcagaaggaccccggcatgtcccaatcgcataatgacttggtgttcttggaacagccagaggggtcacggaggaaaggcattaccctaaccagaatccttaacaaaaaacttctgagtcgccatcgcaataaaaatacaatgaacggagctccagtggagccttgcacttag

SEQ ID NO: 8836 - DNA, 993 bp, Artificial Sequence
  Description of Artificial Sequence: Synthetic coding sequence
atggccttcctgcccagctgggtgtgcgtgctggtgggcagcttctctgcgagtctggccgggacctcaaacctgtccgagactgagcctcccctctggaaagaaagcccgggccaactgtctgattaccgcgttgagaattcaatgtatattataaatccatgggtctatctcgagaggatgggcatgtacaaaattatccttaatcaaacggctcgttactttgcaaagttcgcccctgataacgaacagaacatcctttggggcctgccattacagtatggctggcagtaccgcactggtcggcttgccgacccaactcggcgtacgaattgcggctatgagtccggcgaccacatgtgtatttccgtggactcttggtgggcggatttgaactattttctctcttcacttccatttctggctgcggttgactccggcgtcatgggtatttccagcgatcaggtccggttgctgcccccccccaaaaacgaacggaagttttgctacgatgtcagttcctgccgttcgtcgtttcctgagaccatgaacaaatggaataccttctatcagtatctgcaatccccgttctccaagtttgatgacctccttaagtatctgtgggccgcacacaccagcactttagcagataatattaagtccttcgaggatcgatatgactactactctaaggccgaggcacactttgagcggtcttgggttttagccgttgatcatttggccgccgtgctctttccaacgaccttgatccgttcttataagtttcagaagggaatgcctccaaggatcttgcttaatactgatgttgcgccctttatttccgacttcacggcgttccaaaacgttgtattggtcctgcttaacatgcttgacaacgtggataaaagcattggttacctttgcactgaaaagtctaatgtataccgtgaccactctgagagcagcagcaggtcatacggcaataattcctag

SEQ ID NO: 8837 - DNA, 813 bp, Artificial Sequence
  Description of Artificial Sequence: Synthetic coding sequence
atggacagcctggagtggaactgggccctggtgtacgagctgagcggagaacatcacgacgaggagtggtccgttaagacctatcaggaggtcgcacaaaaatttgtcgaaacccaccccgagtttattggcatcaagatcatttactcggatcacagatccaaggatgtggccgtgatagcggagagtattcgtatggccatgggactacggattaagtttcccacagttgtggcaggtttcgatctggtcgggcacgaggacactggccatagtctgcatgactacaaggaggcccttatgataccagctaaagacggggtgaaacttccctatttctttcacgccggcgagacagactggcaggggacctctattgaccggaacatactcgacgctctcatgctgaacaccacacggatagggcacgggtttgcattgtccaagcatccggccgtccgcacttattcctggaagaaagacatcccaatcgaggtatgccctatctccaatcaggtcctcaaattggtctccgatctgaggaaccaccccgtcgcaaccctcatggccacgggacaccccatggttatcagctccgacgatccagctatgtttggcgctaaagggctgtcttacgacttctatgaggtcttcatggggataggcgggatgaaggcagatctccgcacattaaaacaactcgcgatgaattcgataaaatatagcacattactagagtctgagaaaaacacttttatggagatatggaaaaagcgctgggacaagttcattgcagacgtcgcgacaaaatag

SEQ ID NO: 8838 - DNA, 939 bp, Artificial Sequence
  Description of Artificial Sequence: Synthetic coding sequence
atgggcgtgatggccatgctgatgctgcccctgctgctgctgggcatatccggtctcctgttcatatatcaggaggtgtctcgtctttggagtaagagcgccgtgcagaacaaggtggtggtcattacagacgcgattagcgggttaggcaaagagtgtgccagagtgttccacaccgggggcgccagactggtgctttgcggcaaaaactgggagaggctggagaacctttatgacgcgctgatttctgtagctgatcccagcaagcaaactttcacacctaaactcgtgctgttggacctgtcagatatcagttgcgtgcccgacgtggcgaaggaagtccttgattgttatggctgcgtggacatcctgattaacaatgcctctgttaaagtaaaaggaccagcgcataagatttctcttgaactggataaaaaaataatggacgctaattacttcggacccattactctgacaaaagcgctgcttcctaacatgatttccagaagaacagggcaaattgtcctagttaacaatatacagggtaaattcggaataccgttccgcacgacctacgccgcgagcaaacacgcggctctcggtttcttcgattgtcttcgagcggaggtggaggaatatgatgtggtgatctccacagtgtcgcctaccttcatccgctcttatcacgtttatccagaacaggggaattgggaggcctctatatggaaattcttctttcggaaactgacttacggtgtacatcccgtagaggttgcagaagaggtcatgcgaaccgtaagaagaaagaagcaagaagtgtttatggctaatccaataccgaaggccgccgtgtatgtgcgcacatttttccctgaattctttttcgccgtggttgcctgcggtgtgaaggaaaagcttaatgtgcccgaagaaggttag

SEQ ID NO: 8839 - DNA, 738 bp, Artificial Sequence
  Description of Artificial Sequence: Synthetic coding sequence
atggccagcaccgccctgctggccctgtgcagcaccggcgccttcagtggactcgccgtcgaggccggggccggcgtgtgtcatgctacacccatctatgctggccatagctggcatcaagctaccttcagactcaatgtggccggctccaccctcagccggtatctgagggacctgttggtggctgctaatccggacctcctgcagcaggcactcccaagaaaggcaataactcaccttaaaaaacgctcctgctacgtgagtctggatttcgagggagacctccgagatccagctcgtcatcatccagcttccttcagtgtcgggaatggatgctgcgtgtgtcttagctctgagaggtttcgctgccccgaaccgatcttccagccaggtcttctagggcaggctgagcagggtctccctgccctggcttttcgggctctacagaagatgcctaagactctgaggacccgcctggctgatacggtcgtactggccgggggatctaccctgttcccgggattcgccgagaggctcgacaaggagctggaagcccagtgcaggagacatggctatgctgctctgagaccccacctggtcgctaaacatggtcgcgggatggcggtctggacaggggggtccatggtggcaagcctccattccttccagcggcgatggataacccgcgctatgtatcaggagtgtggaagtcggctcctgtacgatgtgtttaattag

SEQ ID NO: 8840 - DNA, 909 bp, Artificial Sequence
  Description of Artificial Sequence: Synthetic coding sequence
atgcggcggtgggcctgggccgccgtggtggtgctgctgggcccccagttggtgctgctgggaggagtgggtgccagaagggaagcgcagcggactcaacagccaggacagcgcgcggaccctcccaacgcgaccgcatcagcctcatcgagagagggcttaccagaagctccgaaaccctctcaagcatcagggcctgaattctccgatgcccacatgacgtggctcaattttgtccgtaggcctgatgatggggctctgagaaagaggtgcggttcaagggacaagaaacctagagatctatttggtccacctggtcctccgggcgctgaggtaacggccgaaaccctgttgcatgaatttcaggaattgctgaaggaagccaccgaacggcgtttcagcggcctcctggaccccctgctcccacagggcgccggtcttagactggtcggcgaggcatttcattgccggctccaggggcctagaagggtagataagcggacactagttgagctgcatgggttccaggcacccgccgctcagggcgcttttttaaggggcagtggacttagccttgccagcgggcgctttaccgcgcctgtgtcaggaattttccaatttagcgcctccctccacgttgaccattctgaacttcagggaaaagcgaggttaagggcacgtgatgtcgtctgtgtgctgatctgtattgaatctctctgccagcgccacacttgtctggaagctgtcagcggcctggagtcaaactctagagtgttcactctccaggtgcagggcttgctccagctgcaagctggccagtacgcgtctgtattcgtggacaatggatctggggccgtgttgactatacaggccgggtcctcattttcgggcctcttgcttggcacatag

SEQ ID NO: 8841 - DNA, 1416 bp, Artificial Sequence
  Description of Artificial Sequence: Synthetic coding sequence
atggacagcgcccccctgttcccccggccccacctgttccagaacctcctgctcttcctgtgggcactgctcaattgtggcctgggagtctccgctcagggaccaggcgagtggacaccatgggtgtcttggactaggtgtagttcctcctgcggccgaggtgtgagcgttcggtcacggcgctgcctgcgtctgcccggcgaagagccctgttggggtgactctcacgagtatagactttgccaacttcctgattgcccacccggcgctgtgccctttagggatcttcagtgtgccctctataatggaagacctgtactagggacacagaagacctaccagtgggtccctttccacggcgcaccaaaccagtgcgatctgaactgcctggccgaagggcacgccttctaccacagcttcggacgggtactggacggcacagcctgttcaccgggggcccagggagtgtgtgtggcaggccgctgcctgtcagcagggtgcgacgggttgctaggctcaggggcacttgaggaccgctgcggccgctgcggtggcgcaaatgacagttgcctgtttgttcagagagtgttccgcgacgccggagcctttgctggttactggaatgttacccttatccccgagggtgctcgtcacatccgcgttgaacatagaagccggaatcatctggcactcatgggaggcgatgggcgctatgtcctgaacggacactgggtagttagtccacccggaacatacgaggctgccggtacccatgtggtgtatacccgggatacagggccacaagaaactttgcaggctgctggccctacatcccacgatcttttgcttcaagtgttgctccaggagcccaaccctggtatcgaattcgaattctggctgccacgggagcggtacagcccatttcaggcgagggtgcaggctctgggctggccgttgaggcagcctcagccgcggggagtggagccccagccccccgctgctccagcggtgaccccagcacagacacctacactggccccagacccctgccctccttgccccgacaccagaggccgggcccaccgattacttcactattgtgggagtgacttcgtcttccaggcccgcgtgctgggccatcaccatcaagctcaagagactcggtacgaagtgcgaatccaactggtgtacaaaaatcgctcacccctgcgtgcccgggaatatgtctgggcccccgggcattgcccctgtccgatgttggctccccatcgagactatcttatggccgtgcagcggctagtcagccccgatgggacgcaagatcagctgcttctacctcacgctgggtacgccaggccatggtcccccgctgaggacagcagaataagactcacagcccgccgctgcccaggttag

SEQ ID NO: 8842 - DNA, 222 bp, Artificial Sequence
  Description of Artificial Sequence: Synthetic coding sequence
atggccccccagaccctgctgctggtgctggtgctgtgcgtgctgcttcttcaagctcaaggaggataccgggacaagatgaggatgcaaaggattaaagtctgtgaaaaaaggccatcaattgatctttgtatccatcactgctcttactttcaaaagtgcgaaacaaacaagatctgctgctctgctttctgtggtaatatatgcatgagcatcctttag

SEQ ID NO: 8843 - DNA, 2349 bp, Artificial Sequence
  Description of Artificial Sequence: Synthetic coding sequence
atggcccgggcccgggccggcgccctgctggccctgtgggtgctgggcgcagcagcccaccctcagtgtttggactttagacctccatttcgcccaacccagccactgcgcctgtgcgcccagtattctgacttcggctgttgtgatgaaggccgcgatgccgaattaactcgaaggttctgggcactcgccagccgcgtggacgccgccgagtgggccgcgtgtgcaggctacgctcgggacctgttatgtcaggaatgctccccctacgctgcccatctttacgacgcagaggatccattcacacctcttagaacggtccctggactatgtcaggactactgccttgacatgtggcacaaatgtcgcggtctatttcggcacctaagcaccgaccaggagctctgggcactagagggtaaccttgccagattttgtcgatatctttcgctggacgacactgattactgtttcccttatcttctcgtaaataagaatctgaattccaacctggggcatgtcgttgccgatgccaagggctgtttgcaactctgcctggaggaggtggctaatggtctcagaaaccccgtcgccatggtacacgccagggacggcacccatagattttttgtcgctgagcaggtaggactggtctgggcttacctccccgatcgtagcagattgggaaagccattcctgaacatatctagagtggtactcacctcgccctgggaaggggacgagcgcggattcctcggcatcgctttccatccctcttttcagcataaccgaaggctgtatgtttactattctgtcggaattagaagctccgagtggattcgaatcagcgagtttcgggtctcagaagacgacgagaatgccgtagaccacagctcagagcggattatcctagaagtgaaggagcctgctagcaatcataacggggggcagctgctatttggagacgatgggtacctgtatatcttcaccggcgatggggggatggccggggacccgtttggtactttcggcaacgctcagaataagtcagccctcctcggaaaagtgctgcgtatcgacgtagaccgcaaagaacggggtctgccttatgggattccaccagacaaccccttcgttggggacccagccgcccaacctgaggtttacgcactgggcgtccgcaatatgtggagatgtagcttcgatcgcggcgatccgtcaagcggaaccggcaggggacgcctcttttgcggcgatgtcgggcagaataagttcgaggaggtcgacgtggtggagaggggtggcaactacggctggagggcaagggagggctttgagtgttacgaccgaagcctgtgcgcgaatacttcattgaatgacttgctacctatatttgcttacccccatactgtgggaaaaagcgtaactggaggatatgtgtaccgggggtgtgaataccccaacctcaacggcctttacattttcggagatttcatgtcagggagactgatgtctctgcaggaaaatcccggtaccggtcagtggcagtattccgaaatctgtatgggacatggccagacatgtgagttccccggactcattaacaactattacccttatattatcagcttcggcgaagatgaggcgggagagctgtattttatgtcaacgggcgagccatccgccacggccccccgtggtgtggtttacaaaattatagacgcgtcccgcagggcaccccctggtaaatgtcagatccagcccgcccaggtgaagatccggtctcggctcattccctttgtgcccaaggagaagtttatacccaaaaccaggtccaccccgcggcccacagcgagggcccctacccgcgctcccagacgtggccggcccacagccgcgcccccagcgcccacaccaaggcctgctcggccgacccaacaacctggatcgcgtcgcgggggcggaaggcgccggggcaggctcaatagtgcatctagagctttcagggatggcgaagtgcggctcgtgcgacccgctggactgagttctggcagtggacgggtcgaggtctttgtcggaggaaggtggggaacagtgtgcgatgactcctggaatatatccggggccgctgtagtgtgccgccaactgggatttgcttatgccgtgcgggcagtgaagagagcggaatttggacagggcggcagccttcctatactgctggatgacgtgcggtgtgcagggtgggaaaggaatttgttagagtgtcagcacaatggggtggggacacacaactgtgaacatgacgaagatgccggggtggtgtgctctcaccagaaccctgatctgtag

SEQ ID NO: 8844 - DNA, 1317 bp, Artificial Sequence
  Description of Artificial Sequence: Synthetic coding sequence
atgcaccccctgcccggctactggagctgctactgcctgctgctgctgttttcacttggcgtccaggggagtctaggcgcgccctctgcagcaccggagcaggtgcatctctcgtatcccggtgaacccgggagcatgaccgtgacgtggacaacttgggtgcccacgagaagtgaagtccagttcggcctgcagccctctggcccattgccgctccgtgctcagggcacttttgtgccctttgtggatggtggaattcttaggagaaaactgtacatccacagagtgacactgaggaagctccttcccggcgtgcagtatgtgtaccggtgcggatccgcacaaggctggagtcggcggttccgattcagggccctgaaaaatggcgcccactggtccccacggctggcagtcttcggtgacttgggagctgacaaccccaaggcggtgcctaggctcaggagggacacccaacaggggatgtacgatgccgttctgcacgtgggggacttcgcctacaacctcgatcaagacaatgcaagagtcggtgatcggtttatgaggctgattgaacccgtggcagcatctttaccctacatgacctgtcccgggaatcatgaagagcgctataactttagcaactataaggccagatttagcatgcctggtgataatgaaggactatggtactcttgggacttaggtccggcgcacataatcagcttttcaacagaggtctatttcttcctccactatgggaggcacctggtgcagaggcaatttcggtggctcgagtccgacctgcagaaggccaacaagaatagagccgcccgaccgtggatcattaccatggggcaccgtcccatgtactgttccaatgccgacctggacgactgtacgaggcatgagagtaaggtccgaaagggcctgcagggaaaactgtacggactggaagacctgttctataagtatggcgtggacctgcagctatgggcacacgagcacagttatgagcgcctctggccaatctacaactatcaagtcttcaatggctctcgcgaaatgccatatacaaacccacgagggccggtgcatattatcacgggctctgctggctgtgaagaaaggctaacaccgtttgccgtattcccaagaccttggagcgctgtccgggtgaaagagtatgggtacacaaggctgcatatcctgaatgggacacacatccacatccagcaggtctctgacgaccaagacggcaagatcgtggatgacgtgtgggtggtcaggcctcttttcggtcgccggatgtatctctag

SEQ ID NO: 8845 - DNA, 411 bp, Artificial Sequence
  Description of Artificial Sequence: Synthetic coding sequence
atggcccggaccaagcagaccgcccggaagagcaccggcggcaaggcaccacgtaagcagcttgccaccaaagccgcgaggaagagcgccccagcaactggaggagtgaagaagccacaccgctatcgaccaggcaccgttgctttacgcgaaatcaggagatatcagaaatccacagaactcctgataagaaagctgccttttcagcgccttgtgagggagatcgcccaggacttcaagaccgaccttcggttccagagctctgccgtgatggccctccaggaggcctctgaggcatacttggttggactctttgaagacacaaacttatgtgccatacatgcaaaaagggtaactattatgcctaaagacatccagctcgcaaggaggataaggggcgagagagcctag

SEQ ID NO: 8846 - DNA, 1209 bp, Artificial Sequence
  Description of Artificial Sequence: Synthetic coding sequence
atggccgcccggcccggccccctgtggctgctgggcctgaccctgtgtgctcttggcgggggaggccctggtctcaggcccccacccggctgtcctcagcgtcggctcggcgccagagagaggcgcgatgtccaacgagagatcctggccgtgctcggtctaccagggcggccgcgaccacgtgcaccgccagcagcttcccggttgccagcgagcgccccgttatttatgctggacctatatcacgcaatggcaggcgacgacgatgaggacggcgctcccgccgagcaaaggttgggccgagccgacctggtgatgtccttcgtgaacatggtcgagcgggaccgggccctggggcatcaagagccccattggaaggagttcagattcgacctgacccaaatccccgccggtgaagccgtgacagctgcagagtttaggatttataaggtccccagcattcacctactgaaccggaccctgcacgtgtccatgttccaggtggtgcaggagcagtcaaaccgggagagcgatcttttttttttggacctgcagacactccgtgccggagacgaagggtggctggtgttggacgtaaccgccgcatcagactgctggctgttgaaaagacacaaggatctgggcctgcggctctacgttgaaaccgaagacggccatagcgtcgaccctggtcttgcaggcctcctcggacaacgggctccacgatcgcagcaacctttcgtagtcacattcttccgagctagcccatctcctatcagaacccctcgggccgtgcggcctcttcggcgaagacagcccaagaagtctaatgagttgccacaagccaatcgcctgcccggcatttttgatgacgtgagagggagccatggcaggcaagtgtgtcgcagacacgagctctacgtgagcttccaggatctgggatggttagattgggtgatcgcgccacagggctacagcgcctattattgtgagggagagtgttcttttccgctggacagctgtatgaacgctactaatcacgcaatattgcaaagtcttgtacatttgatgaaaccaaacgccgttcccaaggcatgttgcgcaccaacgaagctgtctgcgacaagcgtgctgtactatgatagcagcaataatgtgatcctacggaagcaccgaaacatggtggtgaaggcgtgtggatgtcactag

SEQ ID NO: 8847 - DNA, 957 bp, Artificial Sequence
  Description of Artificial Sequence: Synthetic coding sequence
atggccgccgccgccctgcccccccggcccctgctgctgctgcccctcgttctacttctgagcgggaggccaacgcgcgcagacagcaaagtgtttggtgatcttgaccaggtgcgaatgacatctgaaggatcagactgtcgctgtaagtgtattatgcgccccctgtccaaggatgcctgttctcgcgtgagatctggtcgagcccgtgttgaagatttttataccgttgagaccgtctccagtggaaccgattgccgctgctcatgtacagccccaccctcctcacttaatccctgcgaaaacgagtggaaaatggaaaagctgaagaaacaggctcccgaactcctaaagagcatcaaagctaatctgtcccgcgaaaacgaggtcgtcaaagactctgtgagacatctatcggaacaattgaggcactatgaaaatcactccgctatcatgctaggtattaaaaaggagcttagtagactgggtttgcagctcctgcagaaggatgcagcagctgcacccgccactcccgccaccggaacaggaagcaaggcacaggataccgctaggggcaaaggaaaggatatcagcaagtatggctctgtgcagaagtccttcgccgaccgtggtttgccaaagcctccgaaggagaagctactgcaggtggaaaagcttcgcaaggaaagcgggaaggggtctttcctgcaacctaccgctaagccaagagctttggctcaacagcaagccgtcattagggggttcacttattacaaggccggcaaacaagaggtcaccgaggccgtggctgacaacaccctccagggtacctcatggttagagcagttgccgccgaaggtggaaggccgttcgaacagcgcggagcccaatagcgccgagcaggacgaggctgagccgcggtcttcggagagagtggaccttgcgtcagggacctag

SEQ ID NO: 8848 - DNA, 402 bp, Artificial Sequence
  Description of Artificial Sequence: Synthetic coding sequence
atggccctgggcgtgcccatcagcgtgtacctgctgttcaacgccatgaccgctctgacagaagaagctgctgtaaccgtcacccccccgattaccgcacagcaggcagacaacatcgaaggtcctatagccctcaagttcagccatttgtgcctagaagaccacaactcctactgtatcaatggcgcttgtgcttttcatcacgaactcgaaaaggctatctgtcgctgtttcacaggttatacaggggaacggtgcgagcatcttacactgacctcatatgccgtggactcgtatgagaaatacatagcgatcggcatcggagtcggcctgctgttatcagggtttttggtgatcttttactgctacatccgtaagaggtatgagaaagataagatctag

SEQ ID NO: 8849 - DNA, 651 bp, Artificial Sequence
  Description of Artificial Sequence: Synthetic coding sequence
atgagcagcgaggccgagacccagcagccccccgccgccccccccgcagcccctgcactgagtgcggccgatacaaaacccggcacaacaggctcaggcgcgggatccggaggccctggcggcctgacttccgcagctccagcaggcggcgacaagaaggtgattgctacaaaggtcctgggaacagtgaagtggtttaatgtgcgaaacggttacggtttcataaatagaaatgacacgaaggaggacgtgtttgtacaccaaggagccgaggccgcgaatgtaaccgggccaggcggcgttccagtccagggctcaaagtacgcggccgaccgaaatcactaccgtagataccccaggcgtcggggtcctccacgaaactaccaacaaaactaccagaattcggagtccggagagaagaacgagggcagcgagtcggccccggagggccaggctcaacagcggagaccctacagaaggcgccgattcccaccttattatatgagaaggccttacggccgccgtcctcagtacagtaaccctcccgtccagggggaggtgatggagggcgccgataatcagggcgctggagagcagggaagaccggtgagacagaatatgtacagaggttacagaccccgcttcaggtag

SEQ ID NO: 8850 - DNA, 756 bp, Artificial Sequence
  Description of Artificial Sequence: Synthetic coding sequence
aacgactggagcgccgaccagctgtacctggagaccaccggcaagtctaggaccctgcagtctggactggcgttactttatggatttctgccggattttgactggaagaagatatactttagacaccaacccagcgctctgttctgcagcggatcttgctattgtcccgtccggaatcagtatctcgaaaaagagcagaggcggcagtacctccttcgcctcaaaaatagccaattggagaagacctacggggagatggctaagatcgtcgacgtgcccaccaaacagctcagggcagccaatcctatcgatagtatgctctgtcacttttgccacaacgtgtccttcccttgcactcgcaacggctgcgtcgacatggagcactttaaagtgatcaaaacgcatcagatcgaggatgagcgagagaggcgagaaaaaaagctgtatttcggatacagcctgcttggagcccacccgattctgaaccagactattgggcgcatgcaaagagccaccgaaggtcggaaggaggaactctttgctctttactccgcccatgacgtcacactgtccccagtgctctctgctctcggcttgagtgaagcccgcttccctagattcgcagcgcgggtcaatattccatctggtttttttactatggcaagtatgagccactccacacctctcagcgccaaaacaaccacctcagtcctccccagcccgtgcgcccgcttaaaaacctggagcgccctgtag

SEQ ID NO: 8851 - DNA, 576 bp, Artificial Sequence
  Description of Artificial Sequence: Synthetic coding sequence
atggccgccccccggggccgggccgccccctggaccaccgccctgttgctgctgctcgcatcacaagtcctctcccctggttcctgtgccgacgaggaggaggttcctgaagaatgggtcctgctccacgtggtacagggtcagatcggtgccggcaactattcatacctacgactgaaccatgaaggaaagatcgtcctgcgaatgaggagtctgaagggcgacgccgacttatacgtgagcgcctcttcactgcacccttctttcgatgactatgagctgcaatcggccacatgcggacccgatgctgtttctattcccgctcacttcagaagaccggtgggcatcggcgtatacggacatcctagccacctcgagtccgaatttgaaatgaaagtatattatgatggaactgtggagcaacaccccttcggagaagccgcctatcctgccgacggtgcagacgccggtcagaaacacgcaggagctccagaggatgcttctcaagaagaggaaagtgtgctgtggactatcctgatttccattttgaaactggtcttggaaattctattctag

SEQ ID NO: 8852 - DNA, 2301 bp, Artificial Sequence
  Description of Artificial Sequence: Synthetic coding sequence
atgggccggcggcggctgctggtgtggctgtgcgccgtggccgccctgctgagcggcgctcaagcacgcgggactcccctgctcgcacgccccgccccacctggtgccagccgttactccctttacactaccgggtggaggccacgactgagaccaggaccccataaggccctgtgtgcttatgtggtacatagaaacgtgacctgtatactacaggagggcgcagagagttacgttaaggccgagtatcgtcagtgtcgttggggacctaagtgtcctggaactgtgacataccgcacggttctgagacctaagtataaggtcggatacaagactgtgactgatctggcttggcgatgctgccctggattcaccggcaaaaggtgccctgaacacctgactgatcacggtgctgctagcccacaactcgagcctgaaccacagatcccgagcggtcagcttgatcccgggccacgcccaccaagctatagcagggctgccccgagcccacatggaagaaagggcccaggcctgttcggggaacgactcgagcgactggagggagatgttcagcggttggcgcagacctacggcacactctccggccttgtagcttcccacgaggaccctaaccggatgaccgggggacctagggctcccgcggtccccgtgggattcggtgtgattcctgagggccttgtggggccaggagaccgagcacggggcccactcactccacctcttgacgaaatcctttccaaggtgacagaggtctccaataccctgcagaccaaggtgcagctgctggacaaggtccatggactcgcccttggccacgaagcccatcttcagaggctccgggaagctccgccctccccccttacctccctcgcactattggaagagtatgttgatcggagactccatcgcctgtgggggagcctcctggatggattcgagcagaagcttcagggcgtgcagtcggagtgcgatctgcgcgttcaagaagttaggcgccagtgcgaggagggacaggccgcctcaaggaggcttcatcagagtttggatggccgggaattagccctgcgccaggagctgtcccagctgggaagccagttacaaggcctgagtgtgtcaggtaggggatcttgttgcgggcagctagcactaattaatgcgcggatggacggattagaacgcgccttacaggccgtcaccgaaacacaaaggggacctggcgctcccgccggagatgaacttactcgcctatccgcggccatgttggaggggggggtggacggcctgctggaaggtctcgaaacattaaacgggaccgagggaggcgctcgcggctgctgtctgagactcgatatgggtgggtggggcgtgggcggtttcggcacaatgctggaagaaagagtgcagagcctggaagaaaggttggctacacttgccggcgaactcagtcatgactctgcatccccaggccgcagcgctcggccactcgtccagaccgaactggccgtgttggaacagcgcctggtgtctctcgagacctcctgtaccccttccaccacctctgcaatcttggacagtctcgtcgcggaggtgaaagcctggcagtccagatccgaagccctgttgcgacaggttgcatcccacgccgcactactccagcagctcaatggcactgtcgcggaggtgcaaggacagctcgctgagggtaccgggtccagtctgcagggggagataaccctgctgaaagtaaacctgaattccgtcagcaaatcactaacgggactgagcgattccgtgagtcagtactccgatgcttttttggctgcgaatacttccctggatgaaagggagaggaaggtggaagccgaagttcaagctattcaggagcaggtttctagtcagggcagccggttacaggctggccacaggcaggttttaaatcttcgcggcgagttagagcagctgaaagctggggtagccaaagtcgcctctggtctcagccgttgccaggacacagctcagaagctccagcatacagtcgggcattttgaccaacgagttgcacaggtcgaaggggcctgtagaagactcggtctcttagccgcaggactcgatagtttgcccacagagcctctcagaccaagagagggtctgtggtctcacgttgatcagctcaaccgcactttggcccagcatacccaagacatcgcccgattgcgggacgatctcctggattgccaggctcagctggccgagcaggtaagacccggccaggctaactag

SEQ ID NO: 8853 - DNA, 1251 bp, Artificial Sequence
  Description of Artificial Sequence: Synthetic coding sequence
atgtaccggcacggcatcagcagccagcggagctggcccctgtggactaccatctttatttttctgggggttgccgccatccttggcgttaccatcggcctgctggtccacttcctcgccgtggaaaagacttattactatcagggcgacttccacatttcaggagtaacatacaacgataactgtgagaatgctgcctcccaggcctctactaatctgagcaaggacattgagacaaaaatgctcaatgccttccaaaatagctctatctacaaggaatacgttaaatctgaggttattaagctgctgcccaacgcaaatggatccaacgtgcagctgcaactgaaattcaagtttccccctgctgaaggcgtctccatgcgcacaaaaatcaaggccaaactacaccagatgttgaagaataacatggcgtcatggaatgctgtgccagcttccatcaaattgatggagattagtaaagcagcatccgaaatgctcacaaataactgctgcggtcggcaagtggctaactccattatcaccggaaacaaaatcgtgaacggaaaatcttcgctagaaggcgcttggccatggcaggcatctatgcaatggaaagggcggcactattgcggagctagtctgattagctctcgctggcttctgagtgcagctcattgttttgctaaaaagaacaatagtaaggactggacagtgaatttcggcattgtcgtaaacaagccttacatgacccgtaaggttcaaaatattatctttcacgaaaactattcaagcccaggccttcacgacgatattgccctggtccagctggcagaggaagtctcctttaccgagtacatccggaaaatctgccttcccgaggcaaaaatgaagttgtccgaaaacgacaacgtggtggtcactgggtggggaactttgtatatgaatggctcgttcccagtgattctgcaggaagattttttaaaaataatcgataataagatatgcaatgcatcctacgcttactcaggattcgtcacagataccatgctctgtgctggcttcatgtctggggaggctgatgcatgtcagaacgactccggggggccactagcctatcccgattcacgtaatatttggcatcttgtgggcattgtcagctggggagatggatgcggcaagaaaaacaagcccggcgtttacacccgtgtcacatcctaccgcaattggattaccagtaagaccgggttgtag

SEQ ID NO: 8854 - DNA, 639 bp, Artificial Sequence
  Description of Artificial Sequence: Synthetic coding sequence
atgctgagcagcgtggtgttctggggcctgatcgccctgatcggcactagcaggggatcttatccattctcccattccatgaagcctcatttacatccgcgactctaccatggctgttacggcgacatcatgaccatgaaaacgtcaggcgccacatgtgatgccaattcagtgatgaactgtgggatcagggggagtgaaatgtttgctgaaatggaccttagggcaattaagccttaccagacactgatcaaagaagtgggacagcgtcattgcgtggaccccgctgtaatcgccgcaatcatcagtagagaaagtcacggcgggtctgtgttgcaagatggctgggatcatcgcgggttgaagttcggacttatgcagttggacaaacagacataccaccctgtgggcgcctgggacagcaaggaacatctgtctcaggcaaccgggatcctcaccgaaaggatcaaagctattcaaaagaagttccctacctggtccgtggcccagcatcttaaaggaggccttagcgctttcaagtcagggatcgaggcaattgccacccccagcgatatcgataacgacttcgtgaatgacatcatcgctagggccaaattctacaagcgtcagagtttttag

SEQ ID NO: 8855 - DNA, 378 bp, Artificial Sequence
  Description of Artificial Sequence: Synthetic coding sequence
atggcccggagcgccaccctggccgccgccgccctggccctgtgccttttgcttgccccacccggactggcatggtataagcccgcagctggacacagcagctactcagtgggccgcgcagcaggcctgctatcaggattgcggcggtccccctatgcacggaggtctcagccatacagaggagctgagccccccggcggcgcaggggcctcccctgaattgcagctccatcccagactcaggagtttagcagtgtgcgtccaggatgtggcccctaatcttcagaggtgtgaaaggttgccggacggcaggggaacatatcagtgcaaagctaatgtgttcctgtcactgcgggccgccgattgcctagcagcctag

SEQ ID NO: 8856 - DNA, 867 bp, Artificial Sequence
  Description of Artificial Sequence: Synthetic coding sequence
atgaacaacctgagcttcagcgagctgtgctgcctgttctgctgcccgccttgtccgggtaagattgcttcaaaattggccttcctgcctcccgatcctacctataccttaatgtgcgatgagagcggatcacgctggaccttgcacctctccgagcgcgctgattggcagtacagcagtcgtgagaaggacgcaattgaatgttttatgacaaggacttcaaaggggaacaggatagcttgcatgttcgtgcggtgttctcctaacgccaaatatacattgttgttttctcacgggaacgctgtagatttaggccagatgagtagcttttacatcggcctgggcagcagaatcaactgtaacattttttcctatgattactctggatacggggcaagtagcggtaagcctacagagaagaacctctatgccgatatcgaagcagcctggcttgcactgcgaacccgttatgggatcagacccgagaacgttattatctacggtcaaagcattgggaccgtgccatctgtggacctggctgctcggtacgagtccgctgcggtgatcctgcacagccccctaaccagtggaatgcgggtcgccttccccgacacgaagaagacctattgcttcgacgcattccccaacatcgataaaataagtaaaattacctccccagtgctcatcatccacggtaccgaagatgaggtgattgacttctcccacggactagccctgttcgaacgatgccagcgtcccgtggaaccattatgggtcgagggggcaggacacaatgacgtggagctgtatgggcagtatctggaaagactgaagcagtttgtgtctcaggaactcgtcaatctctag

SEQ ID NO: 8857 - DNA, 417 bp, Artificial Sequence
  Description of Artificial Sequence: Synthetic coding sequence
atggtggcccccgccgcccgggtgttcctgcgggccgtgcgggccgccttaacaagcacagtccctgatcttctgtgcttgctagcccgcgggtcaccaagaggtctggccagtggacgtctgccacttgcagttcatagcgctcagcatggccctggctcgggcgctccatggttacggatagctcggcgagctctgaggtttgttctgtctaaacactggggcgacgattgctatctcacgaataggctttggcaggatttaaagcccccatctcacgttgagaacggtcaggagctcagactcgccccccccgtgcagtgggcactgcaagtccagggaaaccagctgcaaaccgccgtactgtgtctacgtatggcgcccccggaaccagcgggaagtaggcagcgcatttag

SEQ ID NO: 8858 - DNA, 1332 bp, Artificial Sequence
  Description of Artificial Sequence: Synthetic coding sequence
atgggcggcccccgggcctgggccctgctgtgcctgggcctgctgttacccggcgggggtgctgcttggtccattggcgccgcccctttcagcgggagacgaaattggtgctcttatgtcgttacccgcacaatctcatgccacgtacagaacggaacttatctgcaacgggtgcttcaaaactgcccttggcctatgtcttgtccgggcagcagctatcgtactgtggtgagaccaacatacaaggtgatgtacaagatcgtgaccgcccgggagtggcgttgctgtcctgggcacagtggagtgtcgtgcgaagaggttgccgcatcttcagcatcactggagcccatgtggtcggggagtaccatgcgtcgcatggcgttgagaccaactgccttctctgggtgccttaactgcagcaaagtctcggagctgacagaacggttgaaggttcttgaggcaaaaatgactatgttgacagtcatcgaacagccagtccctcccacaccagccacgccagaagaccccgctccactgtggggacccccacccgcccaggggagccctggcgatggcgggctgcaggaccaggtcggggcatggggcctgccaggacccaccggccccaagggggacgccggtagtagggggcctatgggcatgcggggacccccaggtccacagggccccccaggctcccccggcagggccggcgctgtgggtacacccggagaaagagggcctcccggtccacctggcccacctggtccaccaggccctcccgcaccggtagggcccccacatgcccgtatctcccagcatggcgatccacttctctctaatacattcaccgaaacaaataaccactggccacagggtcctaccggacccccaggccctcccggccccatggggcctcccgggccccccggaccaaccggagtgccgggcagcccggggcacattggcccccccggcccaactggccctaaaggcatctccggccacccgggagaaaagggtgagcgtggcctgaggggcgaacctggacctcaaggcagcgccggacaacgtggtgagccaggccctaagggcgaccccggcgaaaaatcacactggggcgagggacttcatcaactgcgcgaagcgttgaagatcctcgccgagcgagtgttaattcttgaaacaatgatcggcctgtacgaacccgagctcggtagtggtgcaggcccagccggtacgggcactccctccctcctgcgcggaaagagaggcggccatgcaaccaattatcgcatcgtggcacctcgatcaagagacgagcggggttag

SEQ ID NO: 8859 - DNA, 717 bp, Artificial Sequence
  Description of Artificial Sequence: Synthetic coding sequence
atggtgctgctgctgctggtggccatccccctgctggtgcacagctcacgtggcccagcgcactatgagatgctcggtcgttgtcggatggtctgcgacccacacggccctcgcggacccgggccggatggagcaccagcctctgtgcctccattccctccaggcgccaagggcgaagtcggccgacgcggaaaggcgggtctgcggggcccccctggtcccccaggtccacggggcccgcctggcgaaccaggtaggccaggtccccccgggccacccggacctgggccgggaggagtggcgcccgctgccggctatgtgccgcgcattgctttttatgctggactgagaagaccgcacgagggatacgaagtcttgagatttgacgacgtagttaccaatgtgggaaacgcctatgaagccgcatctgggaagtttacttgtcctatgcctggggtttacttttttgcctatcacgttctgatgcggggcggggatggcaccagcatgtgggccgatctgatgaaaaacggacaggtgcgggccagtgcaattgcccaggatgctgatcaaaactatgactacgcctccaattctgtgatactccatcttgacgtgggggatgaggtctttatcaagcttgatggcggtaaggttcacggcggcaatacgaataaatactcgacgttttctgggttcatcatttacccagactag

SEQ ID NO: 8860 - DNA, 282 bp, Artificial Sequence
  Description of Artificial Sequence: Synthetic coding sequence
atgaagctgttcctggtgctgatcatcctgctgttcgaggtgctgacagacggggcaagactgaagaagtgttttaataaggtgacaggctactgcagaaaaaagtgcaaggttggcgagcgctacgagattgggtgtctaagcggtaaactgtgttgcgccaacgacgaggaggagaaaaaacatgtgtccttcaagaaaccccatcagcactcaggggagaaattgtctgtcttgcaggactatataatactgccaacaatcaccatttttaccgtctag

SEQ ID NO: 8861 - DNA, 609 bp, Artificial Sequence
  Description of Artificial Sequence: Synthetic coding sequence
atggtgcggatctggaccaccatcatgatcgtgctgatcctgctgctgaggattggacctaacaaaccctctctgtctggcagacaagcccctgcccaagcacaaacctccgatctggtgcccagtttgttcccattgggcctttgggccccggggttctgtacgtggagctctcctgacgaagataaagtgtggcgcccagcctgggagcaaggcccaaaaggcgagccggacccaagagggctcaggcctcgcaaaccagtgccagggactggaaacagagactctgggactcggcggagactgcaggatgcgaccgagcaggatccacgtcctggcaatgatgtagcctccgcagaaaccgccgggcctccatcacctagcggaattcgcgctcaggatcgggcccctcgacatcggagagccccccccgcaagaatgccagttgctccagctccaagtgcggacggggaacctctgcaagagcagggtggtgggctgttccatcgaactagatctgtgtataacggactggagctgaacacctggatgaaagtagaaagactgtttgtcgagaagttccatcagtccttcagcctggacaattag

SEQ ID NO: 8862 - DNA, 342 bp, Artificial Sequence
  Description of Artificial Sequence: Synthetic coding sequence
atgctgccctgcctggccctgctgctgctgatggagctgagcgtgtgtacagttgctggtgacggcggagaggaacagaccctaagtacagaggccgaaacgtgggtcatcgtagctctcgaggagggcgcagggccttctattcagttacaactccaggaagtcaagactggcaaggccagccaattctttggactgatgggaaaaagggtgggcggccgcccacttatccaacctaggcgaaagaaagcctatcaacttgagcacaccttccagggcctgctaggaaaacgaagcctctttaccgaggggcgcgaggacgaggcacagggttctgagtag

SEQ ID NO: 8863 - DNA, 1269 bp, Artificial Sequence
  Description of Artificial Sequence: Synthetic coding sequence
atgggccccgcctggctgtggctgctgggcaccggcatcctggcctccgtgcactgtcagccacttttagcccatggagataagtcacttcagggcccacagccaccccggcatcaattatcggaacctgcccctgcttaccacagaatcaccccaactatcactaacttcgctctgagactgtataaggagctcgctgccgacgcccctggaaacattttcttttctccagtgtccatttcgactaccttagcgctgctttctcttggggcacaggctaacacttcagctctgattctggagggccttggtttcaatttgaccgaaacacctgaagcagatatccatcagggcttccggagccttctacacaccttggctctgccgagtcctaaacttgaactaaaggtcggcaactcactgttccttgataagcgtctcaagccgcgacaacactacctagactcaatcaaggaactctacggagcttttgccttcagcgccaatttcacagattctgtgaccaccggccgacaaataaacgattatcttagacgccagacctatggacaggtggttgattgtctccccgagtttagccaagacacattcatggttctagcaaattatattttttttaaggcaaagtggaaacaccccttttcacggtaccagacacagaaacaggaatctttcttcgtggatgaacgcacaagcctgcaggtgcctatgatgcaccagaaagaaatgcaccgatttttgtacgaccaggacctcgcatgcaccgtactccagatagaatatagggggaatgcacttgccctcttagtactccccgatccagggaagatgaagcaggttgaagccgcactgcagccacagacactgcgaaaatggggccaattactactgcctagtttgctcgacctgcatttgcccaggttctcaatctccggtacctataacctggaggatatcctgccacagattgggctgactaacatcttgaatctggaggcggatttctcgggtgtgaccggccagctgaataagacaatcagcaaagttagccacaaggctatggtggatatgagcgagaaggggaccgaggccggagcagcttccggattgctgagccaacccccatcccttaacaccatgtccgaccctcacgcccattttaatcgacccttcctgcttctgctgtgggaggtaacaacgcagagtttactgttcctcggaaaagttgtgaatccagtggcgggttag

SEQ ID NO: 8864 - DNA, 237 bp, Artificial Sequence
  Description of Artificial Sequence: Synthetic coding sequence
atggccctgatccggaagaccttctacttcctgttcgccatgttcttcatcctggtgcagcttccctccggatgtcaagctggcttggacttttcacagccttttccctctggagaattcgcggtgtgcgagtcttgtaagctgggccggggtaagtgccgcaaggagtgcttggagaatgagaagccagacgggaactgtagactcaacttcctctgctgccgacagagaatatag

SEQ ID NO: 8865 - DNA, 2139 bp, Artificial Sequence
  Description of Artificial Sequence: Synthetic coding sequence
atggccgccgccggcctggtggccgtggccgccgccgccgagtactcaggaaccgttgcatcgggaggtaatctgcccggggtgcactgcggaccctccagtggtgccggccccggatttgggccagggtcctggtcaaggagcctcgacagggccttggaggaggccgccgtcacgggcgtactgagtctgtccggccgcaagctgagggaatttccaagaggtgcggctaatcacgatttgactgacacgacccgggctgacctgtcaagaaacagactgagcgagatcccaattgaggcatgccactttgtttctctggagaacctcaacctgtaccagaattgcattcgctacatccccgaggcaatcttgaatctccaggccttgactttcctgaacataagtagaaaccagcttagcactctcccggtgcacctctgtaacctgccactgaaagttctgatcgcaagcaacaacaaattagtttctctgccagaggagatcgggcatctccggcatctgatggaactggatgtgtcctgtaatgaaatacagacaataccttctcagataggcaacctagaggccctcagggacctcaacgtacgaaggaaccatctggtacaccttccagaggagctggctgagctcccgttgatccgactggactttagctgtaacaaaatcacgaccatcccggtatgctatcggaacttgcggcatctacagactatcactctggacaataatccgctccagtcgccccccgcacaaatttgcatcaagggcaaggtacatatatttaagtacctgaacattcaggcctgcaaaattgccccagacctacccgattatgatcggcggcctctggggtttggttcttgccacgaagaactttactcaagtaggccatacggggcgttggattctggctttaacagcgttgattcaggcgataaaagatggagcgggaatgagcccactgacgaatttagcgacctgcccctgcgcgtcgccgagattaccaaagagcagagactgcgacgggaaagtcaataccaagaaaatagagggtcactcgtggttactaatggtggcgtcgaacacgatctggaccaaatagattatatcgatagctgcacagcagaggaagaagaggccgaagtccgtcagcccaaaggacccgaccccgatagcctttcttcccaatttatggcttacatagaacagagacggatttcccatgaaggctcccctgttaagcccgtggctatcagagagttccagaagaccgaggatatgcgacggtacctgcaccagaatcgagttcccgcggagcctagttctcttctttctctgtcagcatcacacaaccagctttctcacacggatttagagctccaccagcggcgagaacagttggtcgagcgcacaaggagggaggctcaactggccgccttgcagtatgaggaagagaaaattagaacaaagcagatccagagggatgctgtgctggattttgtgaaacagaaagcctcacagtcacctcaaaagcagcacccactcttggacggagtcgacggagaatgtcctttccccagccgacggtcccaacatacggacgatagcgctctgtgcatgagccttagtggcctcaatcaggtcggatgcgccgcaacattgccccattcaagtgccttcacgcctctaaagtcagatgaccgcccaaacgcactcctttcttcccccgcaacagaaaccgtgcaccacagccctgcctattcattccccgctgccatccaacgcaaccaaccacaaaggcccgaaagctttctgttccgcgcaggtgtgcgggctgagaccaataagggacacgcttcacctctgcccccatcagctgcccctaccaccgacagtaccgatagtattacgggacagaattcaagacagcgcgaggaagaattggaactgatcgaccagctgcggaaacacatagaatatagactgaaggtttcactcccctgcgacctgggcgctgcgctcactgacggtgttgtgctttgccacctggccaatcacgtcagaccaagatcagtgccttcgattcacgtaccctcacctgccgtggttagttag

SEQ ID NO: 8866 - DNA, 213 bp, Artificial Sequence
  Description of Artificial Sequence: Synthetic coding sequence
atgcgggtgctgttcttcgtgttcggcgtgctgagcctgatgttcaccgttccaccagccagaagcttcatctctaatgacgaatgtccgagtgagtactaccactgtaggctgaagtgcaacgcagacgagcacgccattagatattgtgccgacttttcaatctgctgcaaactgaagattatcgaaatagatggtcagaagaaatggtag

SEQ ID NO: 8867 - DNA, 789 bp, Artificial Sequence
  Description of Artificial Sequence: Synthetic coding sequence
atggccgccgccagcgccggcgccacccggctgctgctgctgctgctgatggccgtggcagcaccatcacgggctcgagggtctggttgcagggccgggaccggagcccgcggtgctggagctgaagggagagagggtgaggcttgtggaactgtggggctcttattagaacactcttttgagattgacgatagtgccaacttccgcaagcgggggtctttgttgtggaaccagcaggatggcacactcagtctatctcagagacaactctccgaggaggaacgcggaagactgagggacgtcgccgccttgaacggcctgtatcgggttcggattccgcgacggcccggggccttagatggcttggaggcaggtgggtacgtgagtagctttgttcctgcatgttctttagtggaaagccaccttagtgatcagctgaccttgcacgtggatgtggctggcaacgtcgtgggtgtcagcgtagtgacacaccccggtggctgccgcgggcacgaggtcgaggatgtggacctcgagcttttcaatacaagtgttcagctccagcctcccacaaccgctcccggacctgagactgccgcatttattgagaggctggaaatggaacaggcccagaaagccaaaaatcctcaggaacaaaaaagctttttcgcgaaatactggatgtatattataccagtggtgctttttctcatgatgagcggggcccctgatactggtggacagggggggggaggggggggcggaggaggaggcggatccgggagatag

SEQ ID NO: 8868 - DNA, 150 bp, Artificial Sequence
  Description of Artificial Sequence: Synthetic coding sequence
atggacagcagccgggagcccaccctgggccggctggacgccgccgggttctggcaggtttggcagaggtttgatgccgatggccatggccacgagtccaagtttgcgcagggcgaaaccgccgtttatgattatccacgatgtttatag

SEQ ID NO: 8869 - DNA, 213 bp, Artificial Sequence
  Description of Artificial Sequence: Synthetic coding sequence
atgcccggcgccatgaagatcttcgtgttcatcctggccgccctgatattgctggctcagatcttccaggctagaacagccattcatcgagctctgatttccaagagaatggaaggccactgtgaggccgagtgtctgacatttgaagtgaagattggggggtgtagggcagaactcgccccgttctgttgcaagaaccgcaagaaacactag

SEQ ID NO: 8870 - DNA, 711 bp, Artificial Sequence
  Description of Artificial Sequence: Synthetic coding sequence
atgatgcccgccgagcggcggctgcccctgagcttcgtgctggacgttctggagggtcgagctcagcaccctggtgtcttgtacgtccagaagcaatgctccaacttacctagtgagctccctcaactcctgccagacctggagtctcatgtgccctgggcatctgaggcattgggcaagatgccggatgccgtgaacttttggcttggcgaggccgcggcagtcacctcccttcataaggatcactacgagaatctttattgcgttgtctcaggggaaaagcacttcctctttcatcctccctcagacaggccattcatcccgtatgggctgcgcgtcccaggctgtctccagtttcctcataccttgttaccgtgggcccccgagttgtatacgcccgcaacatatcaactcacagaggaaggtacttttaaggtggtggacgaggaggccatggagaaagttccttggattccactagaccccctggcccccgacctggctcgctatccgtcctacagccaggctcaggcactgaggtgtaccgtccgagctggggagatgttatatctcccagcactgtggttccatcatgtccaacagagtcaggggtgcatcgccgtgaacttttggtacgatatggagtacgatttgaaatactcttactttcagctgctggatagcctgacgaaggcctccggcctcgactag

SEQ ID NO: 8871 - DNA, 1098 bp, Artificial Sequence
  Description of Artificial Sequence: Synthetic coding sequence
atggcccccaagctgatcaccgtgctgtgcctgggcttctgcctgaaccaaaagatttgtccacatgcaggtgctcaggataaattttcactatcagcctggccctcccccgtggtgccactggggggccgggtgaccctttcatgtcatagccacctgcgttttgttatatggaccattttccaaacaaccggcacccgctcccatgagctccacaccggactttcaaacaacattactatttcccccgtgacccctgaacacgccggcacatatcgctgcgtcggcatctataagcatgcttccaagtggtctgcagagagcaatagccttaagatcatagtcactggactcttcactaaaccaagcatttctgcccacccttcctctttggtacatgcgggcgccagggtgtctttgcgttgtcactccgaactggctttcgatgagttcattctttataaagagggccatattcagcactcacagcagctggaccaaggaatggaagccgggatccactacgtcgaggccgtgttctctatgggcccagtgactccagctcatgccggggcataccgctgttgtggctgtttcagccatagtaggtacgagtggtcagcaccctccgacccgcttgacatagtcatcaccggcaagtacaaaaagcccagtctaagcacacaagttgaccctatgatgcggctgggggaaaaattgaccttgttctgctccagcgagatcagcttcgatcagtatcacttgtttcgacacggcgtagctcatggtcagtggttgagcggagggcagagacatagggaggcgttccaggccaatttctctgttggacgggctacaccagttcccggcggcacttaccgatgttatgggagcttcaacgatagcccatacaaacctcccgttacgcggtgcaactttacccctcaggaaacattacgagtgttgctgtgtcactcacagaatcctcctctgaatctaacacctccctggcagacccaaagcccgcgaaaggccaatggcaggatgaagcggtcactacagcagaaaaggcaccgccggtcatatatgccctcatag

SEQ ID NO: 8872 - DNA, 198 bp, Artificial Sequence
  Description of Artificial Sequence: Synthetic coding sequence
atgcggaccttcctgttcctgttcgccgtgctgttcttcctgacccccgccaagaatgccttctttgatgagaagtgtaacaaactgaaaggtacctgtaagaacaattgtggcaagaacgaagaactgatagcactttgccagaaatctctgaaatgctgcagaacgattcagccttgcggcagcattatcgactag

SEQ ID NO: 8873 - DNA, 198 bp, Artificial Sequence
  Description of Artificial Sequence: Synthetic coding sequence
atgcggaccttcctgttcctgttcgccgtgctgttcttcctgaccccagctaagaacgctttcttcgacgagaaatgtaacaagctgaagggaacttgcaaaaacaactgcggcaagaatgaagagcttatcgcgttgtgccaaaaatctctgaaatgttgccgaacaatccaaccttgtggatctatcattgactag

SEQ ID NO: 8874 - DNA, 237 bp, Artificial Sequence
  Description of Artificial Sequence: Synthetic coding sequence
atggccctgatccggaagaccttctacttcctgttcgccatgttcttcatcctggtgcagcttccgtccgggtgccaggctgggcttgacttttcacaaccctttccatctggtgaattcgcggtctgcgagtcgtgtaagttgggtcgaggcaagtgtagaaaggaatgtcttgaaaatgaaaagccagacggcaactgccgcttaaatttcctgtgctgccgtcagagaatttag

SEQ ID NO: 8875 - DNA, 2868 bp, Artificial Sequence
  Description of Artificial Sequence: Synthetic coding sequence
atgtgggccggcctgctgctgcgggccgcctgcgtggccctgctgttgccaggtgcaccagcacgcggttatacgggtcggaaaccgcctggccactttgccgctgagagacggcgtttggggccccatgtctgcctgtccggtttcggaagtggctgctgtcccggctgggcaccaagcatgggaggaggccattgtacccttcctctttgttctttcgggtgtggctccggcatctgtattgctcccaacgtttgctcgtgccaagacggtgaacagggagctacatgtccggagacccatggaccatgtggggagtatggctgtgatcttacctgtaaccatggaggctgtcaggaggttgcccgggtctgcccagttggctttagtatgacagagactgctgtcgggatccgttgcactgacatcgatgaatgtgttacgtcatcttgtgaggggcactgcgtaaatacagagggtggtttcgtgtgtgaatgcgggccagggatgcagctgtcggcagacagacactcctgtcaagatacagacgagtgtctcggaactccatgtcaacagcggtgcaaaaacagtattggtagttacaagtgcagctgccggacagggtttcatctgcacgggaataggcatagctgcgtcgacgttaacgagtgcagacggcctcttgagcggcgagtatgtcaccactcatgccacaatactgtcggctcattcttgtgcacctgcagaccaggattccggctccgggctgaccgcgtgagctgcgaggctttccccaaagcagtgctggcgccttccgcaatactgcagccccggcagcatccaagtaaaatgcttttgcttcttccagaagcgggccgaccagcactaagcccaggccactcaccaccctccggcgcccctggacctccagccggggtacgcacaaccagactgccatctcctactcccagactccctactagctctccatccgcacccgtgtggctgttgtctactctgttggccactcctgtgccgactgcgagcctcctcggtaatctccggccacctagcctgctgcagggtgaggtgatgggcacgcccagctcaccacgggggccagagtcgccaagactcgcggccgggccctcgccatgctggcatctcggtgctatgcatgagagcaggtcaagatggaccgaacccggctgttcccagtgttggtgtgaggacggtaaagtgacttgcgaaaaagtccgatgtgaagccgcctgttctcatcctataccctccagggacggagggtgctgtccttcttgcactggctgcttccactctggcgtagtccgagctgaaggggatgtcttctctcctcctaacgaaaactgcaccgtgtgtgtctgcctggccggtaacgtgtcttgcatctcccccgaatgcccatccggaccatgccaaacccctcctcagacggactgttgtacctgtgtacccgtgcgctgctattttcatggtcgttggtacgcagatggagcggtgttttctggtggaggagacgaatgtacaacatgcgtgtgtcagaatggagaggttgaatgttccttcatgccatgtccagagcttgcatgcccacgggaagaatggcgcttgggccccggacaatgctgttttacctgccaggagccaactcctagcaccggctgtagtcttgatgacaacggggttgagttcccaatcggccagatatggagtccaggggacccctgcgagctttgtatctgccaagctgacggctccgtgtcatgtaaacgtactgattgtgtggacagctgtcctcatcctatacggattccggggcaatgctgccccgattgctccgccggatgtacttacactggccgcattttctacaacaatgaaacctttccctcagtcctggacccgtgcttgagctgcatttgcctcctgggttctgttgcttgttctcccgtggactgcccgattacgtgtacctacccctttcaccccgacggcgaatgctgccccgtgtgccgcgactgcaattatgagggtaggaaagtggctaacggccaggtattcaccctcgacgatgagccatgtacccgctgcacttgccagctgggggaagtgtcatgcgaaaaggtgccctgccagagagcctgcgccgacccagcgctcctgcctggtgattgctgtagtagttgtccggatagtctctctcccctggaagagaagcagggcttgagtccacacggaaatgttgccttctctaaggctggccgaagcttacacggcgacaccgaagctccagttaactgctcctcttgccccggaccacccacagcttctccaagccgccctgttctgcacctcttacagctcctactgcggaccaatctcatgaagacgcaaactctgcctacttctccagcaggggcccatggaccccatagccttgctctcggcttgaccgctacttttcctggcgaacccggcgcctcaccccgtttgagcccgggcccctccaccccgcctggcgcaccgactctgccattagctagtcccggggcaccccagccgccgccagtgacacccgagaggtcattttctgcatccggagctcagatcgtttctcgatggccaccactgcccgggacactcttgacagaagcttccgccttgtcaatgatggacccctccccgagcaaaacgcctattacactgttaggacctcgggtgctttctcccactacttctcgcttaagtaccgccctagctgctaccacacaccccggcccccagcagcctcctgtgggggcgtcgcgcggagaggagtctacaatgtag

SEQ ID NO: 8876 - DNA, 270 bp, Artificial Sequence
  Description of Artificial Sequence: Synthetic coding sequence
atggtgagctgcgagcggcgggccagcaagagcgtgggccagatcctgctgtgggattttggttacacatgccggttgtctcacagaagacgcaatagtacagaaattctctccaggaatctgccagccctgtatactggcatcaaggtttgtgagaagcggccaagtatcgacctgtgcattcatcattgctcctactttcagaaatgtgaaacaaataaaatctgctgcagcgccttctgcggcaacatatgtatgagcatcctgtag

SEQ ID NO: 8877 - DNA, 600 bp, Artificial Sequence
  Description of Artificial Sequence: Synthetic coding sequence
atggagaccttccccctgctgctgctgagcctgggcctggtgctggctgaagcttctgagagcaccatgaagattattaaggaagaatttacagatgaagagatgcagtatgacatggcgaagtcaggacaggagaagcagacgatcgagattctgatgaaccctatcctcttggtgaaaaacacttccctttccatgtccaaagacgatatgtcatccacgctcctcacgttcagaagtctccattacaacgaccccaaggggaattcatctggcaatgacaaggagtgttgcaacgatatgacggtttggaggaaagtgtcggaggcaaatggctcctgcaaatggtcaaacaacttcatcaggtcaagcaccgaggttatgcggcgcgtccatagagctccctcttgtaaattcgtgcaaaaccccggtattagttgctgtgagagtctggagctcgagaacactgtgtgccagtttacaactggaaaacagtttcccagatgccagtaccacagtgttacctcccttgaaaagattctgacagtcctgacaggccactctcttatgtcctggcttgtgtgcgggagcaaactttag

SEQ ID NO: 8878 - DNA, 729 bp, Artificial Sequence
  Description of Artificial Sequence: Synthetic coding sequence
atggccgccgccacccggggctgccggccctggggcagcctgctgggactgctaggcctggtatccgccgccgcagccgcatgggatcttgcatccctgcggtgtacacttggggccttctgcgagtgcgactttcgccctgatctcccaggtctggaatgcgatcttgcacagcatctggccggacaacacttggctaaggctttagttgtgaaagccttgaaggcattcgtgcgggatcctgctcccacaaaacctttagtgttaagtcttcacggttggacaggaacaggaaagtcttacgtgagctcccttttggctcactacctgttccagggtgggctgcgatcacctagggttcaccatttcagtcctgtgttgcacttccctcatcccagccatatagagcgctacaagaaagatctcaaatcttgggtgcaggggaacttgaccgcttgtgggcgctccctctttttgttcgacgagatggacaagatgcctcccggcttgatggaggtgctcagaccgttcctgggatctagctgggtagtgtacgggactaactatagaaaggccattttcattttcattcgctggctccttaaacttggccaccatggccgtgctcctcccaggcgctcaggcgccctgccgccagctcctgccgcacctcggcctgcgttacgcgcccagagggccggccctgcggggcccggggctaaggggtag

SEQ ID NO: 8879 - DNA, 627 bp, Artificial Sequence
  Description of Artificial Sequence: Synthetic coding sequence
atgctgggcctgctggtggccctgctggccctgggcctggccgtgttcgccctcctggatgtgtggtacctggttcggcttccgtgcgctgtgctgcgtgcacggctcctgcagcccagggttagagacttgctggccgaacagcggttcccaggacgcgtccttcctagcgatttggatctactgcttcacatgaacaacgcacggtatcttagagaggcggatttcgctcgagtggctcacttgacaagatgcggggttcttggggccttacgggagctccgcgcccacactgtgctcgctgcgagctgtgccaggcaccgtaggtcccttcgactcctcgaacctttcgaggtaaggactcgcctgctggggtgggatgacagagccttctatttggaagctcgcttcgtcagcctgcgcgatggattcgtctgcgccctgctgcggttcaggcagcatttgcttgggacaagccccgagcgcgtcgtgcaacatctgtgtcagagaagagtcgagccccccgagctgcctgcagacctccaacattggatttcctacaatgaggcgtcgagtcagctgcttcggatggagagcgggctgtccgacgtgaccaaagatcagtag

SEQ ID NO: 8880 - DNA, 423 bp, Artificial Sequence
  Description of Artificial Sequence: Synthetic coding sequence
atgctggtgaagctgaacagccaggcccggctgagcagcatggtgaaaaaggtgagactgccatcccgctgtgagccccctggaaccacatgcaccgtgtcagggtggggtaccaccacttccccagacgttaccttccctagcgatctgatgtgtgttgatgtgaaactgatcagcccacaggactgtaccaaggtgtacaaggatctcctcgaaaacagcatgctttgtgctggcatcccagacagtaaaaagaacgcatgcaatggcgacagtgggggtcctctggtttgccgcgggacattgcagggtttggtctcctggggaacctttccatgcggccaacctaacgatcccggggtgtatactcaggtgtgcaaattcaccaaatggatcaacgatactatgaaaaaacaccggtag

SEQ ID NO: 8881 - DNA, 354 bp, Artificial Sequence
  Description of Artificial Sequence: Synthetic coding sequence
atgctgagcaaggcccacggctgcaagaccgccctgagcctgggccggtgtcccaaaattcgtgaagaatgcgaatttcaggagagagacgtctgcaccaaagataggcagtgtcaggacaacaagaagtgctgcgtattcagctgcggaaagaagtgccttgatctgaaacaggatgtttgtgaaatgccgaaggaaacggggccttgcctggcttacttcctccactggtggtatgataagaaagataatacttgctcaatgttcgtgtatggcggatgtcaagggaataacaataactttcaatccaaggcgaattgcctgaatacatgtaagaacaagcgcttcccatag

SEQ ID NO: 8882 - DNA, 2328 bp, Artificial Sequence
  Description of Artificial Sequence: Synthetic coding sequence
atgcaccccggccccgaggaggccggcagcggccggtacggccccaggtacattaccgacatgggggcaggtgaagatgacgagggtttcgaggacgatttagaccttgatatcagttttgaggaagtcaaacccctacccgcaaccaagggcggtaacaagaaattcctggtggagtctaagaaaatgagtatctctaaccctaaaacaatttccaggttgattcctcctacaagcgcttcattaccagtgacaactgtcgctccccagccaatacctatccaaaggaagggcaagaatggtgtggcaatcatgtctcggctttttgatatgccttgcgatgagaccctttgttcagcagattcattttgcgttaatgactacacatggggcggaagcagatgccagtgcaccctgggtaagggcggagaaagttgttccgaagatatcgtcatccaatacccgcagttctttggacactcgtacgtgacttttgagcctctcaagaacagctatcaagcattccagatcaccttggagttccgcgcagaagctgaggacggtttgcttctctattgcggtgagaatgagcacggacgcggggacttcatgagcctggccattattagaaggtcactccaattccggttcaattgcgggacaggagtggccattattgtttccgagaccaagatcaaactgggcggttggcatacagtgatgttatatagagacggtctgaatggactgcttcaactgaacaacggaactccggtaactggacaatctcaggggcaatatagcaaaatcaccttccgaactccgctgtatctggggggtgcccccagcgcctactggctggtacgcgctactggtactaatcgtggattccaaggctgtgtccagtctctggccgtgaacggaaggaggatagacatgcgaccttggcccctgggaaaagcactcagcggggcagatgtgggtgagtgcagcagcgggatttgcgatgaagcatcctgcattcacggcgggacatgcaccgccattaaggctgattcttatatttgtctctgtccgctgggtttcaagggtagacactgtgaagacgcttttaccttaaccattccgcagtttagggaatctctcagaagctatgctgccacaccgtggccactggagcctcagcattatttaagttttatggagttcgagattactttccggcccgactccggggatggtgttctcctgtactcgtacgatacaggatcaaaagattttctgtccattaatctggctggtgggcatgtcgaattcagattcgactgtggatctgggaccggggtgctgcgatctgaagatccgctcacgttaggcaactggcacgaactacgcgtgagtcgcactgcaaagaatggaatcctacaggtggacaagcagaagattgtggaaggcatggccgaaggcgggttcacgcagatcaaatgcaacacagatatctttattgggggcgtgcctaattacgacgatgtgaaaaaaaatagtggcgtgctgaagcccttttctggttctatccaaaagattatcctcaatgatcggacgatacatgtgaagcatgacttcactagtggggttaatgtagaaaatgccgcccacccctgtgtgagagccccttgtgctcacggagggtcctgccggccaaggaaggagggctacgattgcgattgccccctgggttttgagggcctccattgccagaaggctattatcgaagcaatcgaaattccacaattcattggccggagctatctgacttacgataatccagacattctgaagagagtttccggaagcagatctaacgtgttcatgagatttaaaacaaccgcgaaagacggtctgctcctgtggaggggggactccccgatgcgtcctaatagcgatttcatatctctgggccttcgggacggagcactggtcttcagttacaacttggggtctggtgtggcctccatcatggttaatggctccttcaatgacggtaggtggcatcgggtgaaagccgtgagagacggacaatccggaaagatcaccgtggatgactatggcgcacggaccgggaagtccccaggcatgatgagacagcttaatattaacggtgcactttacgtgggaggaatgaaggaaatcgctcttcacacaaatcggcagtacatgcgcggcttggtgggatgcatcagccactttaccctaagcactgactaccacataagcctagtcgaagacgctgtggacggcaagaacattaatacttgtggtgcaaagtag

SEQ ID NO: 8883 - DNA, 1257 bp, Artificial Sequence
  Description of Artificial Sequence: Synthetic coding sequence
atgcggaccctgttcaacctgctgtggctggccctggcctgcagcccagtccatacgacattgagcaaatccgacgcaaagaaagccgcctccaagaccttgctggagaaggtgaagttttgcagctgctgcccaggttggtctgctatggccaggtcctggctaacagcaacctccgcaacgcaaagtcagttcagtgataaaccggtccaggaccgcggtctggtggtcactgaccttaaagctgagtccgttgtccttgagcatagaagttactgctcggccaaggcccgcgaccgtcacttcgccggcgatgtgcttgggtatgtcactccctggaacagccatggctatgatgtcacaaaagtgttcgggagcaaattcactcagatcagcccagtctggctccagctgaaaaggcgcggacgtgagatgtttgaagtcacaggcctacacgatgtagaccaggggtggatgcgcgctgtgcggaagcacgccaaggggctgcatatagtgccccggctgttgtttgaagactggacatacgatgatttccggaacgtcctggactcagaagatgagatcgaggaattgagcaagaccgtcgtgcaggtggccaagaaccagcactttgacggttttgtcgtggaagtctggaaccagctgctcagccagaaaagggttgggctgattcacatgctcacccacctcgccgaggcgctccaccaagcaagactcttggccctattagttatccccccagctatcacacccggaacagatcagttgggaatgtttacccacaaggagtttgaacagctggctcctgtgcttgacggttttagtctgatgacctatgattattccactgctcatcaacccggacctaacgctcctctttcttgggttcgagcctgcgtgcaggtcctggacccaaagtcgaaatggcggtcaaagatcctgctaggcctgaatttttatggtatggattatgccacttcaaaggatgccagagaaccagtggtgggcgctcgatacattcagacgctcaaggatcatagaccccggatggtttgggatagccaagcaagcgagcacttctttgaatacaagaagtccaggtccgggcgacacgttgttttttatccaaccctaaaaagcctgcaggtccgcttagagcttgccagggagctcggcgtaggcgtatcgatctgggagctgggccagggccttgactacttctacgacttactctag

SEQ ID NO: 8884 - DNA, 813 bp, Artificial Sequence
  Description of Artificial Sequence: Synthetic coding sequence
atgatgctgcggctgctgagcagcctgctgctggtggccgtggcctctggatacggacctccgtctagccgcccttcaagtcgcgtggtcaatggagaggacgcggtgccgtactcatggccttggcaagtgagcctccagtacgagaagagtggatctttttaccacacatgcggggggtccttgatagccccagactgggttgtaactgctggccactgcattagcagttcccgcacatatcaagtggtgctgggagagtatgacagggcagtgaaggagggtccagaacaggtgattccaataaacagcggggaccttttcgttcaccccctatggaaccggtcatgtgtcgcgtgcggaaacgacatcgctcttataaaactcagtcgctccgcacagttaggggacgcagtgcagctggcatctctgccgcctgctggcgatattctccctaatgagaccccctgctatatcactgggtggggaagactgtataccaatggccccctccccgacaaacttcaggaagccctgctgccagtcgtggactacgaacattgttcccgttggaattggtggggaagcagtgtcaaaaagacgatggtttgcgcaggtggcgatataaggtccggatgcaacggagactccgggggaccactgaattgcccgacagaggatggaggctggcaggtgcatggagtcacttcttttgtttccgcttttgggtgcaacacacgccgtaaacctacggtcttcacgagggtgagcgctttcatcgactggattgaagagacaatagcatcacactag

SEQ ID NO: 8885 - DNA, 585 bp, Artificial Sequence
  Description of Artificial Sequence: Synthetic coding sequence
atgaccatgcggcacaactggacccccgacctgagccccctgtgggttctgctgctgtgcgcacacgtggtgaccttgctggtaagagctacacccgtgtctcagaccacaacggcagctactgctagtgttcgcagcacaaaagacccatgccctagtcaacccccggtttttcccgccgctaagcagtgtcccgcattagaagttacttggccagaggtggaagttccgctcaatggcacactcagtctgtcctgcgtggcctgctctagattcccaaactttagtatactctattggctggggaatggctccttcatcgagcaccttcccgggagactgtgggaaggctcaacttcgcgagagcgcggctctacaggcacccagctctgtaaggcactcgtactggaacagctgactcctgctttacatagtaccaatttcagctgtgtgcttgtagatcctgagcaagtggtccagagacacgtggtgctggcacagctttgggccggcctgcgcgctaccctcccacctactcaggaagccttaccgagctcccacagcagcccccagcagcaagggtag

SEQ ID NO: 8886 - DNA, 1308 bp, Artificial Sequence
  Description of Artificial Sequence: Synthetic coding sequence
atgcagggccagggccggcggcggggcacctgcaaggacatcttctgttccaaaatggccagctatctgtatggagtcctctttgcggtaggactgtgtgctccaatctactgcgtcagtcccgccaacgcaccctcagcatatcctcgaccctccagtacaaaatctaccccggcatcacaggtgtattccctgaatacggatttcgcgtttcgcctctatagacggctggtgctggaaaccccctcccagaacatatttttttcccccgtcagtgtgtctaccagtttagccatgctgagcttgggagctcatagcgttaccaaaacacagattctgcaaggcttaggatttaatcttacacatacaccagaaagtgctattcaccagggattccagcatttagtgcatagtttgacagttccttctaaggatttgacgctgaaaatgggcagtgccctgttcgttaagaaagagttacaactgcaggctaatttcctgggcaacgtgaagcgtttgtacgaggccgaggttttctccactgacttcagcaatccatccatcgcccaagcccgcatcaattctcacgttaagaagaaaacccaaggaaaagtcgtggacatcattcagggcctggacctcctcacagccatggtattggtgaatcatattttctttaaagctaaatgggagaagccttttcacccagaatataccaggaaaaacttcccttttctcgttggtgagcaggtaaccgtccacgtgcccatgatgcatcaaaaggaacagttcgccttcggagtcgatacagagctgaactgtttcgtcttgcagatggattacaagggagacgcggtggctttctttgtcctgcctagcaagggaaaaatgcgtcaattggaacaggctctgtcagcccgcaccctccggaaatggtcacacagtctgcagaagcgctggattgaagtgtttatccccaggttctctatctccgcatcctataatttggagacaattctgcctaagatgggcattcagaatgtctttgataagaacgcggatttttcaggcatcgccaaaagggattctctgcaagtctccaaagccacccataaggctgtactggatgtgagtgaagaaggcaccgaggccaccgctgctactaccacaaaatttattgtgagatccaaagatggacccagctacttcaccgtgtcgtttaacaggaccttcctaatgatgattactaacaaggcaactgacgggatcttgtttctcggcaaagtagagaatccaacaaaatcatag

SEQ ID NO: 8887 - DNA, 393 bp, Artificial Sequence
  Description of Artificial Sequence: Synthetic coding sequence
atggccagcgacctgatccggaccatcctggccgtggccctgatctctaagttgggcaccgcagtggatgcagagctcatgccaagcggggccatacttcagaacaagagggagaatctaccccgagtctgccatgccctggctttcctcggcatggcacggtgccaagacctgttcctcgtgaggctgcaagggtggaagctcggcaccagatttcaggacgggcctcggagtaccccgcaagaagaaggcggatcacctcagcggaagagaggaatgccagttcagattcactttcttcttaaatcatttctctctagccctattaccttcgccttcatctccctggcccggacagtctccttagcaacagcaatttgcaagatcgtctag

SEQ ID NO: 8888 - DNA, 837 bp, Artificial Sequence
  Description of Artificial Sequence: Synthetic coding sequence
atgcagtggctgcgggtgcgggagagccccggcgaggccaccggccatcgggtgaccatgggcaccgccgcccttgggccagtttgggcagctctgctgctgtttctgctgatgtgtgagatacctatggttgagctcacgttcgatcgggccgttgcaagtggttgccagaggtgttgcgattctgaggatcctttagacccagcccacgtcagttcggctagctcctctgggagaccacacgctttgcctgaaatccgcccgtacatcaatattacaatcctaaaaggcgacaagggagatcccgggcccatgggcctgcccggttacatgggtcgggaagggccacaaggcgagcctgggccccaaggaagcaagggcgacaagggcgaaatggggtcaccgggtgccccttgtcagaaacggtttttcgccttctctgttggtcggaaaaccgctctacacagcggcgaagacttccagactctccttttcgagcgcgtgtttgtaaatcttgatgggtgtttcgacatggcaaccggtcagtttgccgcccctcttcgcgggatttacttcttcagcctcaatgtccacagctggaattacaaagaaacgtacgtacatatcatgcacaaccagaaggaggccgtgatcttgtacgctcaaccttctgagcggtccatcatgcaatcgcagtccgtgatgctggacctggcttatggagatagagtgtgggtgaggcttttcaagcgccagagggagaatgcaatttattcaaacgatttcgacacatacatcacgttttcaggccatcttattaaggcagaagacgattag

SEQ ID NO: 8889 - DNA, 1635 bp, Artificial Sequence
  Description of Artificial Sequence: Synthetic coding sequence
atgtgcaccgtggtggacccccggatcgtgcggcggtacctgctgcggagacagctgggccagggcgcctatggaattgtatggaaggccgtcgatcgcagaacgggagaagtagtggcgatcaaaaaaatttttgatgcgttcagggacaagacagatgctcagcggacttttagggagattacgttactgcaggaattcggggaccaccctaacataatttccctgcttgatgtgatcagggcagagaacgacagggatatataccttgtgttcgagttcatggacactgacctcaatgcagtgatcagaaaggggggcctgcttcaggatgtgcacgtgcgcagtatcttttaccagttgctgagagccacaagattcttgcactccgggcatgtggtgcaccgtgatcagaaaccttcaaacgtccttctggacgcaaactgcacagtcaaactctgtgactttgggctcgccaggagtctgggggatcttccagaaggcccagaggaccaggctgttacagagtacgttgcaactcgctggtatcgcgccccagaagtgctgctttcaagccatcggtatacactcggggttgacatgtggagtttgggctgcatactaggcgagatgctccgcggcagaccactattcccaggtacttccaccttacatcagctggagctcattctggagacaatcccacctccgtctgaggaggacctgcttgccctggggtctggctgccgcgcctctgtactgcaccagctcggctctagacctcgtcagacacttgacgcgctgttgccaccggacacctctcccgaggccctagaccttctgcgccggctactggtttttgctcccgacaaaaggcttagtgctacacaggccctacagcatccctacgtccaacgcttccattgtccctctgatgagtgggcaagagaggcagatgttcgaccgagggcgcacgaaggagtccaattatctgtgcctgagtaccgaagccgggtttatcagatgattctggaatgcgggggctccagcgggacaagtcgtgaaaagggccccgaaggcgttagtccatcccaggcccacttgcataagccccgggccgaccctcagctgccatcccgaactcccgtgcaaggcccgaggcctaggccacagagcagtcccggtcacgatcctgccgagcacgagtccccaagagctgccaagaacgttcctaggcaaaacagtgcaccccttttacagacagctctcctgggaaacggcgagagacctccgggcgcgaaggaggcccccccactgaccctgtctctggttaaaccatcagggagaggagccgccccctctctgacttcgcaggcagctgcccaggtggccaatcaagctctgatccgcggagactggaaccgcggcggcggagtgagggtggcaagtgtccagcaggtgccgcccaggctgccccccgaggcgaggcccggacggcgaatgttcagtactagcgccttgcaaggtgcccaaggaggagctcgtgccctgcttggtggctattcccaagcttatggcactgtctgtcatagcgcactggggcacctgcccctgttagagggacaccacgtgtag

SEQ ID NO: 8890 - DNA, 399 bp, Artificial Sequence
  Description of Artificial Sequence: Synthetic coding sequence
atgaagagcagcggcctgttccccttcctggtgctgctggccctgggcacgctcgcaccttgggcagtagaaggatctggcaagtcattcaaagctggtgtgtgcccccctaaaaaaagtgcgcagtgtctcagatataagaaacctgaatgccaatcagactggcagtgccctgggaagaaacgctgctgtcctgatacttgcggtattaaatgtctggatcccgttgacacaccaaatccaacccgacgcaaaccaggaaagtgtcctgtgacttacggtcagtgtctgatgcttaacccacctaacttctgcgaaatggatggccaatgcaagcgcgatctgaagtgttgtatggggatgtgcggcaaaagctgtgtgagtcccgttaaggcatag

SEQ ID NO: 8891 - DNA, 1401 bp, Artificial Sequence
  Description of Artificial Sequence: Synthetic coding sequence
atgaagccccccctgctggtgttcatcgtgtgcctgctgtggctgaaagacagccactgcgctcccacatggaaggacaagaccgcaataagcgaaaacctaaagagcttttcagaggtcggcgagatcgatgccgacgaagaggttaaaaaagccctgaccggcataaaacaaatgaaaatcatgatggaaagaaaggagaaggaacataccaacctgatgagcaccttaaagaagtgtcgtgaagagaagcaagaagcccttaagctgcttaacgaggtgcaggagcatctcgaagaagaagagaggctctgtcgagaaagcctggcagattcctggggggagtgtcgctcttgtttagagaacaattgcatgagaatctacactacatgccagcctagctggagctccgtgaagaacaagattgagaggttttttagaaaaatctaccagtttttattcccatttcacgaagataacgagaaggatctccctatcagcgaaaaattaatcgaggaagacgctcaactgacacaaatggaagatgtcttcagccaactcaccgtggacgtaaactctttattcaaccggagttttaacgtcttccgtcaaatgcagcaagaattcgatcagacgtttcagagtcacttcatcagtgacaccgatctgacagagccctattttttcccagccttttctaaggagcctatgacaaaggccgatttggaacagtgctgggacatccccaactttttccaattattctgcaactttagtgtgtctatctatgagtcagtgtccgagaccatcacgaagatgctgaaggccatagaggacctgccaaagcaagataaagccccagatcacggagggctcatctccaaaatgctcccaggacaggaccgaggactgtgcggcgagttggatcagaacctctcccggtgttttaaattccacgagaagtgccagaaatgtcaggcccatctgagcgaggattgtccggatgtccccgccttgcatacagagctcgatgaggccatccggctggtgaacgtttccaaccaacagtacggtcagatactccagatgacacggaagcaccttgaagacacagcatatctcgtcgagaaaatgagaggacaattcggctgggtgagtgaactggccaaccaggcacctgaaaccgaaattattttcaacagtattcaagtggtgcctaggatccatgaagggaacatcagcaagcaggatgagactatgatgacagacctaagtatccttccctcatccaatttcactctcaaaatccccctggaagagagcgctgagagttcgaactttattggctacgtggtggccaaggcactccagcactttaaggaacactttaagacctggtag

SEQ ID NO: 8892 - DNA, 522 bp, Artificial Sequence
  Description of Artificial Sequence: Synthetic coding sequence
atgcactggaagatgctgctgctgctgctgctgtactacaacgccgaggcatctatgtgccacagatggagtagagctgtgctgtttcccgcagcgcaccgccctaagcgctctagtagtctgcccctgaatcctgtgcttcagacttcattggaggaagtcgaactgctgtacgagtttctgttagcagaactggagatctcacccgatctacagatatctattaaagatgaggaattggcttcgttgagaaaagcatctgattttcgtacggtctgcaataacgtgatccccaaatcaattcccgatataagacgcctttcagcatctctgtcctcccaccctgggattctgaaaaaagaggactttgaacggacagtgctcacacttgcttacactgcttaccgaactgccctgtcacacggacaccagaaggatatctgggctcagagccttgtgtccctgttccaagccctgagacacgatctcatgaggtcctcacaacccggtgtccctccttag

SEQ ID NO: 8893 - DNA, 1473 bp, Artificial Sequence
  Description of Artificial Sequence: Synthetic coding sequence
atggaggacagcgacagcgccgccaagcagctgggcctggccgaggccgctgccgtcgccgcggccgcggcggtcgcagcagcggcagcagccgccgcggggggggaggccgaagagccggttctgagtcgagacgaagactccgaagaggacgctgactctgaagctgagcgggagaccccgcgcgtgactgccgtagccgttatggccgcggaaccaggtcatatggatatgggtgcagaagccttgcctggaccagatgaggcggccgccgctgccgcttttgccgaggtcaccaccgtgacagttgcgaatgtcggtgccgccgccgataacgtgtttaccacatctgtggccaacgctgccagtattagcggtcacgttctgtccggccggactgccctccagatcggagatagtttaaacactgaaaaagcaaccctcatcgtcgtgcacaccgatgggtctatcgtggagaccacgggactgaaaggacccgccgcacccctcactcctggaccgcagtcccccccaacaccgctggctcccgggcaggagaaaggcggaacgaagtataactgggatccctcagtttatgactccgagttgcccgtgcggtgcagaaacatctccgggacgctatacaagaatcgacttgggagcgggtgggatttgaaaccctcacggtgtctcctccatctgtgctgtctgcttcggcgtcatgacttaatcactgtaacacctagtggccagattaccactagcggcgccctgacattcgaccgcgcctctacagtggaggcaactgccgtgattagcgaatctccagcccagggcgatgtgtttgcaggcgcgacagtgcaggaggctagcgtgcaacctccatgcagggcaagccatccagagcctcattacccaggctaccaggactcctgccagatagccccatttccagaggcagctctgcctacaagtcacccaaagatcgtgttaacatctttgcccgcgttggctgtgcccccgcctacacctacaaaggcagctcctcccgccctggtgaacggactggagctgtctgagccaagaagctggctttatttagaggagatggtcaatagtctcctgaatactgcacagcagttaaagactttgtttgaacaggctaagcatgccagcacttaccgcgaggccgccactaaccaagctaagattcacgccgacgccgagagaaaggaggtcatccaccctccacgcctgcccaaagtactgggattgcaacaaagctgtgtgaattgtggccgtgaggccatgtctgagtgcacaggctgccataaggttaactattgttccacgttctgccagagaaaagattggaaagaccatcagcacatttgtgggcaatccgccgcagtaacggtgcaagctgacgaagtgcatgttgccgaaagtgtgatggaaaaggtgaccgtctag

SEQ ID NO: 8894 - DNA, 1476 bp, Artificial Sequence
  Description of Artificial Sequence: Synthetic coding sequence
atgcccagcaccgtgctgcccagcaccgtgctgcccagcctgctgccaaccgccggagccggttggtctatgagatggatcctctgttggtccctaactctttgcctgatggcacagacggccctgggtgccctgcacacgaagaggccccaggtggtcaccaagtatgggactctccagggtaagcaaatgcacgtcggcaagacacccattcaagtgttccttggagtgccattttcccgaccccccctgggaattcttcgttttgctcctcccgagcccccggaaccatggaagggcatccgggacgccaccacctatcccccgggctgcctccaagagtcttggggccagttggcatctatgtatgtatctacccgcgaaagatacaagtggctaaggttctctgaggattgtttgtacctcaacgtctatgccccggcgagagctcctggcgacccccagctcccagtgatggtgtggttccctgggggagctttcattgtgggagcagcctcatcttatgaagggtctgatctggccgcacgcgaaaaggtggtacttgtgttcctccagcacagattaggaatttttggcttcctctcaactgatgactctcatgctagagggaattgggggctgcttgaccagatggccgcacttcgttgggtgcaggagaatatcgcagccttcggcggcgatcccgggaatgtcaccctctttggccagagtgccggtgctatgtccatttcaggtctcatgatgtctcccctggccagtggcctattccaccgggcgatatctcaatctggcacagccctgtttcggttgtttatcacgagtaatccccttaaagtcgcaaagaaagtcgcccaccttgcgggctgtaaccacaacagtacacaaattctggtaaactgtctgcgcgccttgagcggaactaaggtgatgcgagtgtctaataagatgcggttcctccaactcaacttccagcgggatccggaagagattatctggtccatgagtccggtggtggacggggtcgtaattcccgacgatcccctggtgctgttaactcaagggaaagtgagcagcgtgccttacttgttgggggtgaacaatctcgaattcaattggttgctgccctacatcatgaaattcccactgaaccgccaggcaatgcggaaggagactatcacaaaaatgctgtggagcacacggactcttctcaacatcactaaagagcaagttcccctggtggttgaagaatatctggataatgtcaacgagcatgattggaaaatgcttcgtaataggatgatggacattgttcaagacgctacgtttgtctatgcaaccctccagaccgcccactaccatagggaaacacctatgatgggaatttgtccagcgggccacgccaccacccgaatgaaatctacctgctcttggatcctgcctcaagagtgggcatag

SEQ ID NO: 8895 - DNA, 753 bp, Artificial Sequence
  Description of Artificial Sequence: Synthetic coding sequence
atgcccgccagcagccccttcctgctggcccccaagggcccccccggaaatatgggcggtcctgtacgcgagccagctttgagtgtggctttgtggttgagctggggggcagccctgggcgccgttgcatgtgccatggccctgttgactcagcagacagagctacagagtcttcggcgggaggtttcccgcctgcagggcacgggtggacccagtcagaatggcgagggatatccttggcagtctttacctgagcaaagttctgacgccctcgaggcatgggagaacggggaacgcagccgcaaacgccgagcggtcttaacacagaaacaaaagaagcagcactccgtcctgcacctggtgccaataaacgctacctcaaaggacgactcagacgtgacagaggtgatgtggcagccagccctccgcaggggcaggggcctccaagcccaggggtatggcgttcggattcaagatgccggcgtgtacctgttgtattctcaagtgctattccaggacgtgaccttcactatggggcaggtagtgtcccgagaagggcagggtcgccaagagacccttttccgctgcatcagatccatgcctagtcatccggaccgagcatacaactcctgttatagtgcgggggtgttccacctgcatcagggtgatatcctctcagttattatcccaagggcgcgcgcaaagctgaacctgtccccgcacggcacattcctgggttttgtcaaactgtag

SEQ ID NO: 8896 - DNA, 1437 bp, Artificial Sequence
  Description of Artificial Sequence: Synthetic coding sequence
atgagcccccccctgctgaagctgggcgccgtgctgagcaccatggctatgatatccaactggatgtctcagacattgcccagcctggtcggcctgaataccacaaggctttccacccctgacaccctcacgcaaatctcaccaaaagagggctggcaggtttactcaagtgcccaggatccagacggccggtgtatttgtaccgtggtggcccctgaacagaacctgtgttctcgcgacgccaagtcccgacagctgagacagctactagaaaaggtacagaacatgtcacagtcgattgaggtcctgaacctgagaacccaaagagactttcaatacgtgttaaaaatggagactcagatgaagggcctgaaggctaaatttcggcaaattgaggatgatagaaaaacactcatgacaaaacacttccaggagttgaaggagaaaatggacgagctcctgccgctgatcccagtgctggaacaatataagacagatgctaaattaatcacacagttcaaggaagagattcgcaatctgagcgcggtcctgaccgggatccaggaggaaataggcgcttacgactacgaggagctgcaccagagggtgctcagcctcgagactcgtctgcgggattgcatgaaaaaactcacctgtggtaagctgatgaaaatcaccggaccggtaacggttaagacctcggggacgaggttcggtgcttggatgaccgaccccctggcctctgagaagaataaccgcgtctggtatatggactcttacaccaacaataagattgtgcgcgagtacaaaagtatcgcagattttgtgtccggcgctgagtcccgtacctataacctgcctttcaagtgggcaggcacaaatcatgtggtgtataatggctccctgtatttcaacaagtatcagtctaacatcattatcaagtacagtttcgatatgggccgagtgctggcccagaggagcctggagtatgctgggttccataacgtgtacccttacacctggggtggattctccgacatcgacctgatggctgatgagattggactgtgggcagtgtacgcgaccaaccagaacgccggtaacatcgttatcagccaactgaatcaggacacactagaagtgatgaagagctggtccaccggttatccaaagcgaagtgcaggcgagagctttatgatctgcggtaccttgtatgttactaactcgcacttaacaggcgctaaggtctactattcctattccacaaaaacctcgacatacgagtacactgacattcctttccataatcagtactttcatatctcaatgctggactacaatgctcgtgatagagccctctacgcctggaacaatggtcatcaggtcctttttaacgtgaccctgttccacataataaagaccgaagacgatacgtag

SEQ ID NO: 8897 - DNA, 1101 bp, Artificial Sequence
  Description of Artificial Sequence: Synthetic coding sequence
atggcccgggagcggccccccggccggggctgcggcgtgctgcggagatgcctcctgggagctgtgctcctcttcggtctgagactgtgcgctgagttacgtcgagcgggaccaggatctccgacccgatccgccccgcccgggcctgcctggcgcccaccaggcccccaccttccacccgcccccggccaaccacggggagcttctcgcaggcaagtcacgtacgtgcgttccggcaggagggctcccccaggcggcgggggatccgggacaccagaacccggctgctgcgcccctcgcggacgcccgcgcaggaaagggccgagatggcacatcgatcttcagccctgggcagggtccgcccagagtcttgacgaagaagcgtggaggtttctccgctacatttcaaccacccaaattgcatgcaatcacatgaacaccgacagcctggccacagatagttcacccactcacaaaccatggagcgtttgcctcgacgaccgtttcaaccttgcccaccagattcgcaacaagcagtgccgtttgtattcgctgggtcttggcagtgacgacacccactttgaagttagcatggccaacaatggatgcgaagttcacaggtttgatccctcagtcaagtcagctcatatactggaatctcaacacctctggtaccatcggctgagtatcgattggagagatccgcacccagccgtagccgcccagaagccccattccaatacaaggaagctcgggagcatcctgaatgagttcggccaccacaagatcgatgttcttaaagctgaccttgagtccgcggaatggaaagtgctggaaaacctcatcctcgaggacgtcctggagcaaatcggacagttgatcttcgaaattcatctccactggccaggctttgaggttagcggctcagatagcagcgtggttcgcttctggtacagcctgctcaaagaactggaacagaaagacttccggctttttcatagctacaaagatctgtcaaaacctcagttgttcctgaaaaaagacatctttaatgccagcagctgctacacattgagctgggttaacacacgttggaagtag

SEQ ID NO: 8898 - DNA, 300 bp, Artificial Sequence
  Description of Artificial Sequence: Synthetic coding sequence
atgaagatccccgtgctgcccgccgtggtgctgctgagcctgctggttctccattccgcacaaggcgccacgctcgggggtcctgaagaggagagcaccatcgagaactatgcatccaggccggaagccttcaacacaccctttttaaacattgacaagctgcgctctgcattcaaggcagatgaattcctgaattggcacgccctttttgagagcatcaagaggaagctgcctttcctgaactgggacgcattccccaagctcaagggtctccgtagtgccaccccggatgcccaatag

SEQ ID NO: 8899 - DNA, 618 bp, Artificial Sequence
  Description of Artificial Sequence: Synthetic coding sequence
atgatgcggaccctgatcaccacccaccccctgcccctgctgctgctccctcaacaactgctgcagctggtccagttccaggaggtggatacagactttgattttccagaggaagacaaaaaagaagagttcgaggagtgtttggagaaatttttttccactggacccgcacgccctccaacgaaagaaaaagtgaagcgcagggttttgatcgaacctggtatgccactcaaccacattgaatattgtaaccacgagatcatgggcaagaatgtctattataagcacaggtgggtcgcggaacactacttcctcctcatgcagtacgacgagcttcagaagatctgctataaccggttcgttccgtgtaagaacggaatcagaaagtgtaatcgtagcaaaggactggtggaaggtgtgtactgcaaccttactgaggctttcgagatccctgcttgtaagtatgagagtctatatcggaagggatacgtacttatcacatgttcttggcaaaacgagatgcagaaaaggatcccacacaccatcaacgatctggtcgagccccccgagcaccgctcattcctgagtgaggacggcgtgttcgtgatttcaccatag

SEQ ID NO: 8900 - DNA, 402 bp, Artificial Sequence
  Description of Artificial Sequence: Synthetic coding sequence
atgctggactggcggctggccagcgcccacttcatcctggccgtgaccctgaccctgtggagtagtggtaaggtactctcagtcgacgtcactacaaccgaagccttcgactccggcgtcatcgacgttcagagtaccccgacggtacgtgaggagaaaagcgccaccgatctgacggccaaactcttactgctggacgaactcgtatccctggaaaatgatgttattgaaaccaagaaaaaacgatcattttccggcttcggtagcccgctggataggcttagcgcggggtctgtggaccacaagggaaaacagagaaaggtcgtggatcaccccaagcggaggttcggcatccctatggatcgcattggtcgcaatcggctgagtaactcacggggctag

SEQ ID NO: 8901 - DNA, 846 bp, Artificial Sequence
  Description of Artificial Sequence: Synthetic coding sequence
atgggcagccggggccagggcctgctgctggcctactgcctgctgctggcgttcgcgtcgggtttggttctgtcccgagtgccccatgtgcagggcgaacagcaggaatgggagggcacagaagagctccccagcccaccggatcacgctgaacgagccgaagagcagcacgagaaataccggccttctcaggatcagggtcttccagcttctaggtgcctccgctgctgcgaccccgggacatccatgtatcctgcgaccgcagtcccacaaatcaacatcacaattctcaaaggcgagaaaggtgaccgtggagatcggggattgcagggaaaatatggtaagacaggaagtgcaggagcgcgcggccacacggggcccaagggccaaaaggggtcaatgggtgctcccggggagcgttgcaagagccattacgcagcgttctcagtgggccgaaaaaagcctatgcatagcaaccattattaccagacagtcatctttgacaccgagttcgtgaacctgtatgatcactttaatatgtttactggcaagttctactgctatgtaccaggtctgtatttctttagcctgaatgtccacacttggaaccaaaaagaaacttatctccatataatgaaaaacgaggaagaggtggtcatactttttgcccaggtgggagaccgatccattatgcagagtcagtctttgatgctggagctgcgcgagcaggaccaggtctgggtcagactctataaaggtgagcgggagaacgcaatcttctctgaggaactggacacgtacattaccttctccggttacctggtgaagcacgctactgaaccatag

SEQ ID NO: 8902 - DNA, 132 bp, Artificial Sequence
  Description of Artificial Sequence: Synthetic coding sequence
atgaagctgctgtacctgttcctggccatcctgctggccatcgaggagcccgttataagcgccctggtgcgcactgtggggtgttgtctggacaccgctaggcagaccccgcaccccagcatgcatgggtag

SEQ ID NO: 8903 - DNA, 861 bp, Artificial Sequence
  Description of Artificial Sequence: Synthetic coding sequence
atgaaggtgctgctgctgaccggcctgggcgccctgttcttcgcctactattgggatgacaatttcgaccctgcgtctttgcaaggcgccagggttcttctgactggggccaacgccggcgtcggtgaagagttagcgtaccattatgccaggctggggagccacctggtcctgacagctcatacagaggccctcttgcaaaaggtggttggcaattgccggaagctgggagcgcctaaagtattttacatcgcagcggatatggccagccccgaggctccggagagcgtcgtgcagttcgcgctggataagctgggtggactggactacctggtactcaaccatattggcggggcccccgcaggaaccagggctaggtctccccaggctacgagatggttaatgcaagtgaattttgtgagctatgtgcagttgacatcacgggctctgccctccttgactgactcgaagggctccctcgtcgtggtgtctagtctgctgggcagagtcccaacatcattctccactccctatagcgctgctaagttcgccctggatggcttttttggctccctgaggagggagctggacgtacaggacgtgaacgtggcaattaccatgtgtgtattgggacttcgtgaccgtgcatctgcagctgaggccgtccggggggtcactagagtgaaagctgcacccggtccgaaggctgctctggcggtgatccgaggcggggcaactcgagctgctggggttttctatccctggcgattccgcctgctttgcttgttgagacgctggttgcccaggccgagagcctggttcatccgccaggagctgaacgtgacggcagccgccgcttag

SEQ ID NO: 8904 - DNA, 1326 bp, Artificial Sequence
  Description of Artificial Sequence: Synthetic coding sequence
atgcgggtggtgaccatcgtgatcctgctgtgcttctgcaaggccgccgaactccggaaggctagcccaggttcagtgcgttctcgagtgaaccatggcagggcaggcggtggtaggagaggaagtaatcctgtgaaacggtatgcacccggcctgccctgtgatgtctacacttatttgcatgaaaaatacctggattgtcaggaacgcaagcttgtgtatgtgttaccgggatggccccaggatcttctgcacatgttgctggccaggaacaagattcgtacattaaagaacaatatgtttagcaagttcaagaaattgaaaagcctagaccttcagcaaaatgagatttccaaaattgagagcgaagcttttttcggacttaacaagttgactaccctcctgttgcagcacaaccaaattaaggttctgaccgaggaagtttttatctacactcctttgctcagctatctgcgtctctatgacaacccatggcattgtacctgcgaaattgagaccctcatctccatgctgcagatccccaggaaccggaatttggggaattatgccaaatgcgagagtccgcaagagcagaagaacaaaaagctcagacaaattaaaagcgaacagctctgcaatgaggaggagaaggaacagctggaccctaaacctcaggtctcagggcgacctccggtcataaagccagaggtggattcaaccttctgccacaactacgtgttcccgatccagaccctcgattgcaagcgcaaggaattgaagaaggtgcccaataatattccccccgatattgtgaagctggatctgagctataacaagatcaaccaacttaggcccaaggagttcgaagacgtccacgagttgaagaaactcaatttatcctcaaacgggatcgaattcatcgacccagccgcctttctcggcttaacccatcttgaggagcttgatctgtccaataattctttacagaattttgattacggcgtactggaagatctctatttcttgaagcttctgtggctgcgagacaatccttggcgatgtgactataatatccactacctctattattggctgaaacaccactataacgtgcattttaacggccttgagtgcaaaactccggaggagtataaagggtggtcagtggggaagtacatcagaagttactatgaagaatgcccaaaagataagttgcccgcttatccagaatcattcgatcaagatactgaggacgacgagtgggaaaagaagcaccgggatcacacagccaagaagcaatctgtgatcattactatcgttggctag

SEQ ID NO: 8905 - DNA, 1539 bp, Artificial Sequence
  Description of Artificial Sequence: Synthetic coding sequence
atggccgagagcggcctggccatgtggcccagcctgctgctgctgctcctacttcccgggcctcctcccgtggctgggttagaagatgctgcctttcctcaccttggggagagcctgcagccgctcccgcgcgcgtgcccccttcggtgcagttgtcctcgcgtcgacacagtggattgcgacggccttgacttaagagttttcccagacaatattacacgcgccgcccagcacttatcccttcaaaacaaccagctgcaggagctgccttataacgagctgtctcgcctctctggcctgagaaccttaaacttgcacaacaatttgattagtagcgagggcctgcctgatgaagcattcgaatccctgacacagctgcagcacctttgtgttgctcataacaaattgtctgtcgcccctcagttcctgccacgcagtctccgtgttgccgatctggctgcgaaccaggtgatggagatcttccctctgactttcggcgaaaaacccgctttacggtccgtatacctgcataacaatcaactgtctaacgccgggcttcctccggatgccttccgagggagtgaagcaattgccactctgagcctgtctaacaaccagctgtcttacctgcctccatcacttcctccatcactggaaagactgcacctgcaaaacaacctaatctcaaaggttcctcgcggtgccctgtcccggcaaactcaattaagggaactctaccttcaacataaccagttgacagatagcggattggacgcaaccactttttccaaactgcacagccttgagtatctcgatttatctcacaaccagttgaccactgttcccgcaggtctgccgcgtacactcgctatcctgcaccttggacgcaaccgaatacgacaggtggaagccgccagactgcacggagcaagaggactcagatacctgctccttcagcacaatcaattaggaagttcaggactccccgctggcgccttgcgccccttgcgagggttgcatacgctgcatctgtacggaaacggcctagaccgcgtgccgccagctctccctcgtcggctacgggccctggttctaccccacaaccacgttgcagcattgggcgcacgagacctggtcgccacacctgggcttaccgaactaaatttggcttacaaccgccttgccagcgcccgtgtccaccaccgcgcctttcggaggctcagagccttgagaagtttggatctggccggaaaccagctgacaagactgccgatgggtctgccaacagggctgcggacgctgcagctgcagcggaatcagctccgtatgctggagcccgaacctctagcaggattagatcagttacgggagctgtccttagcccacaaccgccttcgtgttggcgatattggcccgggtacatggcatgaactgcaggcattgcaggtccggcatagactggtcagccacactgtgccgcgggccccaccatccccctgcctgccatgccacgtccctaacatactcgtgtcatggtag

SEQ ID NO: 8906 - DNA, 2328 bp, Artificial Sequence
  Description of Artificial Sequence: Synthetic coding sequence
atgaaggagggccccgaggaggccggcagcggccggtacggcccccggtatatcactgatatgggcgcaggcgaggatgacgagggattcgaggacgatctggacctggatatatccttcgaagaggtaaaacctctccctgcaaccaaaggtggaaacaagaaattcctggtcgaatcaaagaagatgtccatctcaaatccaaagaccatatctaggctaatccccccgacctccgccagcctgccagtaactacggtagctccacagcccatccctatacaaaggaaaggaaaaaacggcgttgctatcatgtctcgactctttgacatgccatgcgacgagactctgtgctcagcagattcattctgcgtgaatgattacacttggggggggagtcggtgccagtgcactcttggaaagggcggtgagagctgttcagaggatattgtgattcagtacccgcagtttttcgggcacagctacgttacttttgagccgctgaagaacagctatcaggctttccagataacactcgagtttagagccgaggcagaagatggcctgctcctgtattgcggagagaacgaacacggcaggggcgacttcatgtccttggcaatcatccgtagatccctgcagtttagatttaactgtggtacaggcgttgccatcattgtcagcgagacaaagataaagttaggcggatggcacaccgtgatgctgtaccgggacgggctaaatggccttttgcagcttaacaatgggacccctgtgactggacagagccagggacagtactccaagataaccttcagaactccactctatttggggggagctcctagcgcctactggctggtacgcgccacgggaactaacaggggattccaaggctgtgtacagagcctggcagttaacggacgcaggatagacatgagaccatggcccctgggcaaagctctgagcggcgccgatgtcggagagtgctcttccggaatttgtgatgaggcctcctgtatccacggggggacatgcactgccattaaagctgactcatacatctgtctgtgtcccctcgggttcaaggggaggcattgcgaggatgcattcactttaactatcccacagtttagagagtctctcagaagctacgcggctaccccctggcctctggagccacagcactacctctcctttatggagttcgagatcactttccggccagactccggggacggagtgcttctgtattcatatgacactggatcaaaagacttcttgtctataaatctcgccggcggacacgtggaattccggttcgactgtggcagtggcaccggggtgttgcggagcgaagacccccttactctcgggaactggcacgagcttagagtcagcagaacggccaaaaacggcatccttcaggtagataagcagaaaattgtcgaaggcatggctgagggagggttcacccaaataaagtgcaacacagatattttcattgggggggtgcctaactacgacgacgtgaaaaaaaattccggagtgcttaagcctttcagcgggtccattcagaagatcatactcaatgatagaaccattcatgtgaagcatgatttcacatccggtgtgaacgtggaaaatgcagcacatccctgcgttcgggcaccgtgtgcccatggaggatcttgccggccccgtaaggagggctacgactgtgattgtcccctcgggtttgagggcctgcactgtcagaaggccattatcgaggccatcgaaattcctcaatttataggacgatcatacttaacatacgataatcccgacatcctcaagagagtgtctggtagtagaagcaacgtatttatgaggtttaagacaacggccaaagacggattgctgttgtggcgcggcgactcacccatgcggccgaattctgatttcataagtctggggctgcgggacggcgctctagtgttttcatataatttgggtagtggagtcgcctccatcatggtgaacggatcatttaatgacggcaggtggcaccgggtgaaagctgtgcgggacggacagtccggcaaaatcaccgtcgacgactatggagcaaggaccggtaagtctcctgggatgatgcggcagctgaatattaatggtgccctatatgtgggtggtatgaaggaaattgccctccacaccaatagacagtacatgcggggcctagtcgggtgtatttcacactttaccctctccacggattaccacatcagtttggtggaagacgcagttgatggcaagaatatcaacacctgcggtgcgaaatag

SEQ ID NO: 8907 - DNA, 1431 bp, Artificial Sequence
  Description of Artificial Sequence: Synthetic coding sequence
atgaagttccagggccccctggcctgcctgctgctggccctgtgcctcgggtctggtgaggccggcccactgcaaagtggagaagagagtacaggaactaatatcggagaggcgctgggacatgggctcggcgacgccctgagtgagggtgtcggtaaagcaatcggaaaagaagccggaggcgccgccggtagcaaagtttcagaagcgcttggacaggggacccgggaggctgtgggcaccggcgttcgccaggtgccagggtttggggtcgccgatgcgctgggaaacagggttggcgaagctgcacacgccctagggaacaccggccacgagatcgggcggcaggcggaggacgtgatccgacacggcgctgatgctgttcggggcagctggcagggtgtaccaggccacaacggcgcctgggagacctcggggggacacgggattttcgggtcacagggaggattgggcggtcagggccagggtaaccccggtgggctcggaactccctgggtgcacggctaccccgggaacagcgctggctctttcggcatgaatccccagggcgccccttggggccaggggggcaacggaggtccacctaacttcggaaccaacacgcagggtgccgtggctcagcccggatatgggtccgtccgcgcaagcaatcagaacgagggctgtactaatccaccaccttctggcagcggggggggttcttccaatagcggaggaggttccggctcacagtcaggaagttctggaagtggatctaacggcgataacaataatggatcatcttccggaggaagctctagcggaagctcctctggaggatcctccggtggctcgtctggaggatcctccggaaatagcgggggaagcaggggcgactccggctcagaatcatcctgggggagctctaccggatcttccagcggaaaccacgggggctctgggggaggtaacggacacaagcccgggtgtgagaagccaggaaatgaggccaggggttcaggggaatcaggtattcagaatagcgagacctcgccagggatgtttaactttgataccttttggaagaattttaagtctaagctgggcttcataaactgggacgcaataaataagaatcaggtcccaccaccctccacaagagctctactttactttagtaggctgtgggaggactttaaacagaacacaccttttcttaattggaaggccattatcgagggggcagacgctagctctttacagaagcgggcaggcagggatgatcaaaactacaactacaaccagcacgcctatcccactgcgtatgggggcaaatatagtgttaaaactcctgctaaggggggtgtttcacccagttccagtgcaagcagagtccagccgggtcttctacagtgggtcaaattttggtag

SEQ ID NO: 8908 - DNA, 1911 bp, Artificial Sequence
  Description of Artificial Sequence: Synthetic coding sequence
atgaccacctggagcctgcggcggcggcccgcccggaccctgggcctgttgctgcttgtggtgctggggttcctcgtgctcagacgcctggactggtctactcttgtacctctgcgattgcggcaccgccagttaggcctccaggcaaaaggctggaacttcatgctggaagactccactttttggatctttggcgggtctatccattactttagggtgccgagagagtactggcgggatcgactcctgaaaatgaaggcgtgtggtctgaatactctcacaacctatgtgccttggaatctacatgagcctgaaaggggcaaattcgatttctctgggaacctggacctggaagcctttgtgctgatggctgcggagataggactgtgggtaattctgcgacccgggccttatatatgcagcgagatggacttgggcggactgcctagctggctcctgcaggatcccggcatgcgcctgagaacaacgtacaaggggtttacagaagccgtggacttgtacttcgaccaccttatgtctcgggtggttccactccagtataaacgtggcggtcctatcatcgctgtgcaggtagaaaacgaatatggtagttacaacaaagatcctgcctatatgccttatgtgaagaaagctctggaagaccgcggcatagtcgagctcctgctgacctccgacaataaggacggcttgtccaagggcatcgttcagggcgttctggcgacaatcaacctgcagtcgacccacgaactgcaattgctaacaacctttttgttcaatgtccagggtacccagcccaagatggtaatggagtattggacaggttggttcgatagctggggaggccctcacaatattcttgattcctctgaggtgctcaaaacggtgagcgcaattgttgacgctgggtcctccattaatctgtatatgtttcatggtggcacgaactttgggtttatgaatggggcaatgcacttccacgattacaagtccgacgtcacaagctacgactatgacgccgtgttaacagaggctggagactatactgccaaatatatgaagctgagggacttttttggatctataagcgggatacctctccctccccccccggatttgctgcctaaaatgccttacgaacccctaaccccggtgctgtatctcagcctatgggatgccctgaagtacttaggcgaaccaattaagagcgaaaaacccatcaatatggaaaatttacccgttaacgggggaaatggccagtcattcggatatatcctgtatgagacttcaatcacctctagtggaatcttgagcggacatgtacacgaccggggccaggtctttgtgaataccgtctccatcggctttctggattataaaaccaccaagatcgccgtaccactgattcaggggtacactgttctgcggattttggttgaaaacagggggagagtcaactacggcgaaaatattgacgatcaaaggaagggactcatcggtaatctgtatctaaatgatagcccactgaaaaactttcgcatctactccctggacatgaagaagtcctttttccagcgattcgggctggacaagtggtcaagccttccagagactcctacactccccgccttcttcttgggatccctgtccatttcatcaaccccgtgcgacacatttttgaagcttgaaggatgggaaaagggggtcgtgtttatcaacgggcagaatttaggtcgatactggaatattggaccccagaaaactttgtacctgccgggtccgtggctgtcgtctggcatcaatcaggtcatcgtgtttgaagagacaatggcagggccggcactccaattcactgagacacctcaccttgggcggaatcagtatatcaagtag

SEQ ID NO: 8909 - DNA, 672 bp, Artificial Sequence
  Description of Artificial Sequence: Synthetic coding sequence
atgacccggtggagcagctacctgctgggctggaccaccttcctgctgtattcttacgagagctccgggggaatgcacgaggaatgtgtgtttccttttacttacaagggaagcgtgtatttcacctgcacacacatacactccctgtcaccgtggtgtgccactcgcgctgtgtataatggccagtggaagtactgccagagcgaggactatccacgctgcatcttcccattcatctaccgaggcaaagcctataacagttgcatttcacaggggtcattccttgggtcactctggtgctccgtcacatcggtcttcgacgaaaagcagcagtggaagttttgcgaaactaacgagtacgggggcaacagtctccggaaaccttgtattttcccctcgatttaccgaaataatgtggtgtccgattgtatggaagacgaatctaataagctttggtgccctacgacggagaatatggacaaggacggtaaatggtctttttgcgctgacacaaggatcagcgcattggtgcctggattcccctgccacttccctttcaattacaagaacaaaaactattttaattgcaccaatgaaggctcgaaggaaaacttggtgtggtgcgcaactagctataactacgaccaagatcacacttgggtttactgttag

SEQ ID NO: 8910 - DNA, 1368 bp, Artificial Sequence
  Description of Artificial Sequence: Synthetic coding sequence
atgctgcaccccgagaccagccccggccggggccacctgctggccgtgctattagccttgcttggcaccacctgggctgaggtttggcccccccagctgcaagagcaggccccgatggccggggcgctaaatcgaaaggagagtttcctgttactgagtttacacaaccgcttgaggagctgggtgcagccccctgctgcagacatgaggaggctggactggtccgattcccttgctcaactcgcccaggcccgcgccgcgctgtgtggcatccctacacctagtctcgccagtggtctgtggcgaacactgcaagttggatggaacatgcaactcttacctgccggactcgccagcttcgttgaggtggtgtcattgtggtttgccgagggtcagcggtacagccacgcagcaggcgagtgtgcacgcaatgcaacatgtacgcactatacacaattagtgtgggcaacatcatctcagctgggatgcgggagacacttgtgcagtgccggccagacggcaattgaggccttcgtctgtgcatatagcccagggggaaactgggaagtgaacgggaagacgatcattccttacaaaaaaggggcttggtgttctttgtgcactgcctctgtgtccggctgctttaaggcatgggaccacgctggtggcttgtgcgaggtgccaagaaatccgtgcagaatgtcatgtcaaaatcatggaagactgaacatctccacatgccactgccactgcccgccaggctacactggacgctattgtcaggtgcggtgctcgttgcaatgtgtccatggaaggtttagggaggaagagtgctcatgcgtttgtgacatcgggtatggaggggcccaatgtgctacgaaggtgcacttcccctttcatacatgcgatttgcgaatcgacggcgattgtttcatggttagctctgaagccgacacctactatcgtgcgcgcatgaaatgtcaaagaaaaggaggggtgcttgcgcaaattaaatctcagaaagtgcaagacatcttggccttttacctgggacgactggagacaactaacgaggtgattgacagcgatttcgagacaaggaacttttggattggcttaacatacaagacagctaaggactccttccgttgggctaccggcgagcaccaggcgttcacttctttcgccttcggtcagcccgacaaccatgggctcgtgtggttgagcgctgccatgggatttgggaattgcgtcgagttgcaggcgtcagcagccttcaactggaatgaccagcgctgtaagacaaggaataggtacatctgtcagtttgctcaagaacacatttcaaggtggggcccaggctcatag

SEQ ID NO: 8911 - DNA, 1425 bp, Artificial Sequence
  Description of Artificial Sequence: Synthetic coding sequence
atggccgacatgcagaacctggtggagcggctggagcgggccgtggggaggctggaagctgtatcccatacttcagatatgcatcgcggctatgcggattccccctctaagggcgctgcaccttacgtgcaggcctttgactcattgttagccggacccgtagccgagtacctgaagatctctaaggagattgggggagatgttcagaagcatgctgagatggtccataccggcctgaagttggagagagctctcctggtcactgcctcccaatgtcagcaacctgcagaaaacaaactgtctgacctattggccccaatcagcgagcagatcaaagaggtcattacattcagggagaaaaatcgaggctctaaactttttaaccacctgtcagcagttagtgaaagtatacaggccttgggctgggttgctatggcaccaaaaccgggaccctacgtaaaagagatgaacgacgctgccatgttttacacaaaccgtgtactcaaagaatataaagacgtggacaagaagcacgtcgactgggtgaaagcgtacctgtctatctggaccgagctccaagcctacattaaagagttccacacaacaggcctcgcctggtccaagaccggacccgtagccaaggagctgtcaggccttcctagtggcccctctgctggctcatgtccgcccccaccgccaccctgcccccccccacctccggtgtccacaattagctgcagctatgaaagcgcatccagatccagcctgttcgcacagattaatcagggggaaagcataacacacgctctaaagcatgtgtcagacgacatgaagacacacaagaaccccgctttaaaagctcagagcggccctgtgcgtagtggcccaaagccattttcagcccccaaaccccagacctctccttctccaaaaagggcaaccaaaaaggagcctgccgtgttagaacttgagggaaagaaatggcgcgtcgagaatcaggagaatgtctcaaacctcgtcattgaagatactgaattgaagcaggtggcatacatttacaagtgcgtcaataccacactgcagattaagggtaagattaactcaattactgtggacaattgcaaaaagttggggctggtgtttgacgatgttgtgggcattgtggaaattataaactctaaggatgtcaaggtgcaagtcatgggaaaggtacctacaatttcaataaacaagaccgatggttgtcacgcctatttgtctaaaaattcactagattgcgagattgtctctgccaaatcgtccgagatgaacgttctgatcccaacagagggaggcgattttaacgaatttcccgtccctgaacagtttaagaccctgtggaatggccagaagcttgtcaccaccgtcaccgagatcgccggatag

SEQ ID NO: 8912 - DNA, 360 bp, Artificial Sequence
  Description of Artificial Sequence: Synthetic coding sequence
atgaacaagatcctgagcagcaccgtgtgcttcggcctgctgaccctattgagtgtactgagctttctccagagtgtgcacgggcgaccttatctgacccaagggaatgagatttttccagataagaagtatactaatcgcgaagagttgcttctggctctgctcaataagaacttcgatttccagagaccctttaataccgatttggctcttcccaataagctggaggaactaaaccagttggagaaactgaaggaacaactggtcgaggaaaaagattccgagacatcttatgccgtggacggcttattctcaagccacccctccaagagagcctgcttctggaagtactgcgtgtag

SEQ ID NO: 8913 - DNA, 3756 bp, Artificial Sequence
  Description of Artificial Sequence: Synthetic coding sequence
atgcggctgctgctgctggtgcccctgctgctggcccccgcccccgggtccagcgcccctaaagttaggagacagagcgatacctggggcccctggagccagtggtcaccatgcagtcgcacctgcggcggcggcgtttcctttagggagcgtccttgttactctcagcggcgggacggcggctcaagctgcgttggtcccgcaagatcccacaggtcctgcaggacagagtcctgccctgatggggctcgcgatttcagagcagagcaatgcgccgaatttgatggagccgagttccaagggagacggtacaggtggctgccttactatagtgcccccaacaagtgcgaactgaactgcattcccaagggagaaaacttttattataaacatagggaagccgtggtggatggtaccccctgcgaaccgggcaaacgagacgtatgtgtggacggcagttgtagagtcgtgggttgcgaccacgaactggactctagtaaacaggaagataaatgccttcgatgtggcggggatgggacaacctgctatcctgttgccggcacattcgatgcaaatgacctgtctcgggcggtgaagaacgtgagaggggagtactatctgaacggccattggaccattgaagctgcccgagcactccccgctgcatctaccatcctccactacgagaggggtgccgagggcgacctagctcccgaacgcttacatgcaaggggaccaacttctgagcccctggtgatcgagctcattagccaggagccaaaccccggggtccactacgagtaccacctgcctttgcgccgaccttctcccggcttcagttggtcacacggcagctggtccgactgttctgccgagtgtggggggggccaccagagcagactggttttctgtacgattgatcatgaggcttatccagatcacatgtgtcagagacagccccggcccgccgaccgccggtcatgtaaccttcacccttgccccgagacaaaacgatggaaagccggcccgtgggctccctgttctgcaagttgcgggggcggctcacagagccggagcgtgtactgtatctcttccgacggagcgggaattcaggaggctgtggaagaggctgaatgcgccggcttgcctggtaaaccacctgctatacaagcttgcaatctgcagagatgtgctgcgtggagtccggagccttggggggaatgcagtgtcagctgtggcgtgggtgtgcgaaaaaggagcgtcacttgtaggggagagaggggctctctcctccatactgcagcctgctccctggaggataggccaccactgactgaaccctgcgtgcacgaagattgccccctcctctcagaccaggcctggcatgtaggtacgtggggcctgtgctccaagtcttgctcatctgggacgcgaaggagacaggtgatctgcgccatcggaccaccttcgcactgtggctccctgcagcactccaagccggttgacgtggagccttgtaatacccagccatgccatctgccacaggaggtgccttcaatgcaagacgttcacacgcctgcgtctaatccctggatgcctctgggcccgcaggagagccctgcttcggatagccgcgggcagtggtgggcagcgcaagaacaccccagcgcacggggcgatcacaggggcgagcggggagatcctaggggagaccaggggacccacttaagcgcgctgggtcctgccccgtctctccagcagcctccctatcaacaaccgctgaggagcggcagcggaccgcatgattgccgtcattctccacatggctgttgtcccgatggtcataccgcgtccctggggccccagtggcaaggttgccccggggccccgtgccagcagagtaggtatggctgttgtccggatcgggttagcgttgccgaaggacctcatcacgctgggtgcacgaaaagttatggcggggactctaccggcggtatgcctcgtagccgagccgtggcaagcaccgttcacaacactcatcagcctcaggctcagcaaaatgagccaagcgagtgccggggctcccagttcggctgctgctacgataacgtggctaccgcagcaggacctctgggagaagggtgtgtgggacagccctctcatgcttaccccgtgagatgtttgctgccaagtgctcatggcagctgtgccgactgggctgcgcgctggtacttcgtggcttcagtcggacagtgcaatagattttggtatggtggctgtcacgggaatgcgaataattttgcctccgagcaggaatgtatgtcctcctgtcagggatcacttcacgggcctcgtcgacctcagcctggtgccagcggaagatcgacacacaccgacgggggtggttccagtcccgccggcgagcaggagccatcccagcatcgcaccggagctgccgtgcagagaaaaccctggcctagtggtgggctgtggcggcaagaccagcagccaggcccaggcgaggcccctcatactcaggctttcggagagtggccttggggccaagaacttgggagccgagcacccggcctcgggggggacgctggtagccccgcaccgcccttccactccagctcttaccgtatctcacttgctggcgtcgagccatccttagtacaggccgcactagggcaactggtgagactcagctgttctgacgacacagctccagagtcgcaggcagcttggcagaaggacggtcagcccatcagctccgaccgtcatcgcttgcagttcgatggctcactaatcatacaccctctgcaggccgaagatgccgggacatactcctgcggaagcacaaggcccgggagggacagccagaaaatccaactgcgtattatagggggcgatatggctgtcttatctgaggcggaattgtctcgctttccgcagccacgcgatcctgcccaggatttcggccaggcaggagcagcagggccattaggagcgatcccaagcagccatccccagcctgccaatcggctcagactggatcagaaccagcccagggttgttgatgcgtctcctggccagcgcattaggatgacatgccgcgccgagggattccctccccctgccatcgaatggcagagggacggtcaacccgtctccagtccccgacaccaactgcagcctgatggaagtctcgtcatcagccgcgtggctgttgaagatgggggtttctatacgtgtgtggcattcaatggccaagaccgggatcagcgatgggtgcagttaagagtgctaggggagctcacgatatccggattgcctcctacggtgacagtgcctgagggcgacactgctcgactgttgtgcgtggtcgccggcgagtctgtgaacataaggtggagtcgaaacgggttacccgtgcaggctgacggccatagagtgcaccagtcccccgatgggactctgctgatttataatctccgggcccgagacgaagggagctatacatgcagcgcctatcaaggatcccaagccgtatcccgcagcaccgaggtcaaagtggtctcccccgcccccacagcacagcctagagaccccggtagggactgcgtggatcagccagagttggctaactgcgatctgattctgcaggctcagttgtgcgggaacgaatactattcctctttttgctgtgcctcctgctcccgcttccagccgcatgcccaaccaatctggcagtag

SEQ ID NO: 8914 - DNA, 1731 bp, Artificial Sequence
  Description of Artificial Sequence: Synthetic coding sequence
atggcccagggcgtgctgtggatcctgctgggcctgctgctgtggtctgatcccgggactgcaagcctgcctctactgatggattcggtaatacaggctctggcggagctcgagcagaaagtccccgccgcaaagacccggcacaccgccagtgcttggctgatgagtgcccctaacagcggcccccacaataggctttatcattttctattgggcgcctggagccttaacgcaaccgagttagatccctgtcctctgagtcccgagcttctgggcctcacaaaagaggtcgcaaggcatgacgtgcgcgagggtaaagagtatggggttgtgctggccccagatgggagtactgtggccgtcgaacccttgctggccggcctggaagccggtctgcagggccgaagggtcattaacctgcccctcgacagcatggctgctccttgggagactggggacaccttccctgatgtggtggcaatcgccccagatgttcgcgccacatctagccccggccttagagatggaagtcccgacgtcactaccgccgatattggtgccaatacacccgatgcaaccaaggggtgtccagacgttcaggcgtccctgcccgacgccaaggccaagagtcccccaacaatggtggacagcctcctggcagtcacccttgccggcaatctgggtctaacttttctacgcggtagccagacacagagccaccccgacttgggaactgaggggtgttgggaccagctgtcagcccccaggaccttcaccctgttggaccctaaagcctccctgctgactatggcattcctaaacggagccctcgacggagtgatcctgggcgactacctgtctcggactccagaacctcggccaagcctcagtcaccttctgtctcagtattatggcgccggggtggcacgcgacccgggctttcgctcaaactttcgacgccaaaacggtgctgcactgacctccgccagcatcctggcccaacaggtgtggggaacactggttctccttcagaggctggagcctgtacaccttcagctccagtgcatgtcccaggagcaattggcgcaggtggccgctaacgccaccaaggagttcactgaggcttttttaggctgccctgctatccacccacgatgccggtggggcgcagccccctatcgcgggagacccaagcttttacaattaccattaggattcctttacgtacaccatacgtacgtcccagcgcctccgtgcactgacttcaccagatgtgcagcgaatatgagatctatgcagaggtatcatcaggacacccaaggatggggagacatcgggtattcttttgtggtcggaagtgacggatacgtatacgaagggaggggttggcattgggtgggtgcccataccctcggtcataattctcgcggattcggggtagccatcgtgggtaattatacagccgcccttcctacagaggccgccctgcggactgttcgggacacactgccaagctgtgctgttcgtgccggattattacggcccgactacgccctcctgggtcacaggcagctggtcagaaccgattgccccggggacgccctattcgaccttctccgtacttggcctcattttaccgcgaccgtgaaacccaggcctgctcgcagtgtttccaaacggtccagaagggagccccctcccagaaccctgcctgccactgatctgcagtag

SEQ ID NO: 8915 - DNA, 846 bp, Artificial Sequence
  Description of Artificial Sequence: Synthetic coding sequence
atgctgcccaagagccggcgggccctgaccatccaggagatcgccgcactcgccaggtcgagcctccatggcatcagccaggtcgtgaaagaccacgtgacaaagccgacggcgatggcccagggcagggtcgcacacctgatcgagtggaaaggctggtcaaagccaagtgactcacctgccgccttggaatccgctttcagcagctatagtgatctgagtgaaggtgagcaagaggccagatttgctgccggggtcgcagaacaatttgcgatcgcggaggccaagttgcgggcatggagttctgtggatggggaggactcaacggatgatagttatgatgaggacttcgctggcggcatggatactgacatggccggccagctacccctgggccctcacctccaggatctcttcaccggccatcgatttagtagacccgttagacagggttctgttgaacccgaaagtgattgcagccagacagtgagtcctgataccctttgctcgtcactgtgcagcttggaagacggacttcttggctcccccgcaaggctggcctctcaactgctgggcgacgagctgctgcttgctaagctgcccccctctcgcgaatccgcattcaggtcactgggcccactcgaagcgcaggattccctctacaactctcctctaacagaaagctgcctgagtccggccgaagaagagccggccccctgcaaggattgtcaaccgctgtgcccacccttgaccggctcttgggaacggcagcggcaggcctcagacttagcctcatcgggggtagtctcacttgacgaggatgaggccgagccggaagaacagtag

SEQ ID NO: 8916 - DNA, 2619 bp, Artificial Sequence
  Description of Artificial Sequence: Synthetic coding sequence
atgggcatcgtgtggatcctgatgagcgtgctgccctggtggggccgttgcgctgacttagccatcgcaagtacacagctcgtgccatccaccgcctcagcacggatggccttgtcctcccaactgatgggtcggacagtctggaccccaatgagcgcttctgctctgcaggagcccgcgtatccggccctggccagaacttctcgagctccttccgccgccagcgtgccactggcatctaggtgcagagtgaccactgctttgataagtacatctgcccagcggtctcccacctcagcgagccttgctccggtgcccactgctctcggtgcctccagcgcctctgcacacctcgccctcagctctctcactatgggaactgttgccctcacccacggacgcgtgtctgcttccccagtgctgcgattgggttctgcacgttgtcctaagctctccacacccccgcgacctgcagcagccgccgttaggggactcggcagagcaggggagacaccagccaactgcgtacccaggagagctgtcccaggccctgatgatagtagggaggatgtgaatgagtgcgctgagaaccccggagtgtgtacgaatggcgtgtgtgtgaacacagacggcagttttagatgtgagtgcccttttggctactcccttgatttcaccgggatcaattgcgttgatacagacgagtgctcagtaggccatccttgtggtcagggcacttgcactaatgtgatcggcgggttcgaatgcgcctgcgccgacggcttcgagcctgggctcatgatgacctgtgaggacattgacgagtgttcgctcaacccattactctgtgctttccgttgccataacactgagggctcttacctgtgtacatgtcctgctggctacacgctgcgggaggatggggcaatgtgccgggatgtggatgaatgtgcagacgggcagcaggactgccatgccaggggtatggagtgtaaaaacttgatagggacattcgcatgtgtctgtccccccggaatgcgccccctgccagggagtggcgaaggttgcacagatgataacgagtgccacgcacagcccgatctatgcgtgaatggacggtgtgttaacactgctggcagctttaggtgtgattgtgacgaggggttccagcctagccccaccctcaccgagtgccacgacatacgacaagggccgtgctttgccgaggtccttcaaacaatgtgtcgatccctctccagttctagcgaggccgtcactagggctgaatgctgctgcggtggcgggcgggggtggggaccccgatgtgaattgtgtccattacccgggactagtgcttataggaagctgtgtccccacgggagtggttataccgcagagggcagggacgtcgacgagtgccgcatgttggctcatctatgtgcacatggagaatgcatcaattcactgggatccttcaggtgccactgccaagccgggtataccccagacgcaactgctaccacgtgtctggatatggacgagtgttcacaggtgccgaagccatgtaccttcctttgcaaaaacaccaagggttctttcctgtgcagctgtcccaggggctacctcctggaagaggatggtaggacctgcaaggatctggacgagtgcacctcacgccagcataactgtcaatttctctgtgtgaacaccgtgggggcatttacctgtagatgtcctcccggttttacccagcaccaccaggcctgttttgatgtaaatgaatgtgatgggccccatcgttgtcaacacggttgccagaaccaactcggcggctatcgctgctcgtgcccccaggggtttacgcagcattcgcagtgggcgcagtgtgtagatgaaaacgaatgcgcgctgtctcctcccacgtgcggctctgcctcatgcagaaatactctaggagggttccggtgtgtatgcccttcggggtttgatttcgatcaggcactgggtggttgccaggaagtcgatgagtgtgccggccgtcgcggcccctgttcttactcctgcgccaatactcccggcggtttcctctgtggctgtccacagggttactttagggcgggtcaggggcattgcgtgtctgggctcggcttcagtccaggaccacaggatacgcccgataaggaggagctgctttcttccgaagcatgttatgaatgcaagataaatggcctgtcgcctcgtgataggccccggaggagtgcccaccgggaccatcaggtgaacctggcaaccctggacagtgaagccctcctgaccctcgggctcaatttatctcatctaggaagggcggagagaatactagagctccggcctgccctagaggggcttgagggcaggatcaggtacgtgatcgttagggggaatgagcaagggttttttcgcatgcatcatctaaggggcgtgagctctcttcagctgggccggcgcagaccgggtccaggaacctacaggttggaggtggtctcccacatggcaggcccttggggcgtacaaccagaaggccagcccggaccctgggggcaggcactgcggctcaaagttcagctgcagctactctag

SEQ ID NO: 8917 - DNA, 1368 bp, Artificial Sequence
  Description of Artificial Sequence: Synthetic coding sequence
atggcccggaaggccctgaagctggccagctggaccagcatggcccttgccgcatcagggatttatttttattccaacaagtatcttgaccccaacgacttcggggccgtgagagtcggccgggcagtggccactaccgccgtaatcagttatgattacctcaccagcctcaaatcagtgccgtatggcagcgaagagtatctgcaattgcgctccaagatccacgacctgttccagtccttcgatgacactcccctgggaactgcttcgctcgcccaggtacacaaagctgtcctacatgacggaagaacagtcgccgtgaaggtccaacatcccaaagttagagctcaatcttcaaaggacattttactaatggaagttctggtcctggcggtaaagcaactgttccccgagtttgaatttatgtggttggtcgacgaagcaaaaaagaacctgcctctggagttagacttcttaaatgagggacgcaatgcagaaaaggtgtcccagatgcttcgccattttgacttcctgaaagtgccgcgcattcactgggatttgtctactgagcgcgtgcttctgatggagtttgtggatgggggacaggttaatgatcgcgactatatggagagaaataaaattgacgtgaacgaaatcagtcggcatctggggaaaatgtattccgaaatgattttcgtgaatggatttgtacactgcgatcctcacccaggaaacgtgcttgtgagaaagcaccccgggactggcaaggccgagatagtcctgctggatcatggactttatcagatgttaacagaggagttcaggctcaattactgccacctgtggcaatctctgatatggactgacatgaaacgcgtcaaggaatatagtcaaaggctgggggccggggatctgtaccccctgtttgcatgcatgctgacggcccggtcatgggactcagtgaaccgcgggatttcccaggctcccgtcactgcaacagaggacttggaaatccggaataatgctgctaactacttgccacagattagtcacctacttaaccatgttcctcggcagatgcttcttattttgaaaaccaatgacctgctgaggggaattgaggcagccctgggcacccgggcctcagcctcttctttcttgaatatgagtcgatgctgcattagggctctggcggagcataagaagaagaatacttgtagcttttttcggcggacgcagatttcattttccgaagcctttaatctgtggcagattaatctgcacgaacttatcctcagagtgaaagggttgaagctggccgaccgtgtactggccttaatttgctggctctttcccgcacccctttag

SEQ ID NO: 8918 - DNA, 1245 bp, Artificial Sequence
  Description of Artificial Sequence: Synthetic coding sequence
atgaaccccaccctgggcctggccatcttcctggccgtgctgctgacagttaagggactactcaagccttccttttccccgcgaaactacaaagcgctctccgaggtgcagggttggaaacagcgtatggccgctaaagagctcgctcgccagaatatggacttggggtttaagcttcttaagaaactcgcattttataaccccggtaggaacattttcctctcaccattatccatctccaccgccttttctatgctgtgtctgggcgcccaggactccactctggacgagattaagcaggggttcaattttcgcaagatgcctgagaaggatttacacgaagggtttcattatatcatccacgaactcacccagaagacacaggacttgaaactttccatcgggaatacattgttcattgatcagagactgcagccacagcgaaaatttctcgaggacgccaagaacttttactcagcagaaaccattctgacaaattttcagaatctggaaatggcccagaagcagatcaatgacttcattagccagaaaacccacggcaaaatcaataatttgattgaaaatatcgatccagggactgtgatgcttctggccaattacatttttttccgcgctagatggaagcacgaatttgatcccaacgtaaccaaggaagaggatttcttcttagagaaaaattcaagtgtcaaagtgccaatgatgtttaggagcgggatctaccaggtgggttatgatgacaaactgtcttgcaccattctggagatcccataccagaaaaacattaccgccattttcatcctgcctgacgagggcaagttgaagcacctcgaaaaaggcctgcaggtagatactttctctcggtggaagacattactctctcgacgcgtggtggatgttagcgtgccaaggctgcatatgacaggaacattcgacctcaagaaaaccctgtcctacataggagtgtcgaagattttcgaggagcacggggaccttaccaaaatcgctccgcaccggagcttgaaggtcggcgaagccgtccataaagcggagcttaaaatggacgaacggggtacagaaggtgcagcgggaacaggcgcccagacactcccgatggaaacacctttggttgtgaagatcgacaaaccttacctgcttctcatttactccgaaaagatcccatccgtgctgtttttgggaaaaatcgtcaacccaatcggcaagtag

SEQ ID NO: 8919 - DNA, 942 bp, Artificial Sequence
  Description of Artificial Sequence: Synthetic coding sequence
atgagcgacctgctgctgctgggcctgatcggcggcctgaccctgctgctgcttttgacccttctggcttttgctgggtactctggtctgcttgccggggtggaagtaagcgcgggcagccctcccattcgtaatgtgacagttgcttacaagttccatatgggcttgtatggagaaaccggacggttgtttacagaatcctgtagtatcagcccaaaactccgctctattgcagtgtactatgataacccacatatggttccacctgacaagtgccgttgtgcggtcggaagcatattatctgaaggagaagaatcgccatctccagagcttatcgatctctatcagaaattcggtttcaaggtgttctcctttcccgcaccttcacacgttgtgacagccacatttccatacaccacaatcctcagcatctggctggccacccgcagggtgcatcctgctctggacacatacatcaaggagcggaagctgtgtgcctacccgcgcctggagatctatcaagaggaccaaattcacttcatgtgcccgctggctaggcagggcgatttctatgttccggaaatgaaagagacagaatggaaatggcgtggtcttgtggaggcaatagacacccaagttgatggtaccggagcagacactatgagcgacacatccagcgtatccctcgaggtttcacctggttcccgggagacgtcagccgcaactttgagtccaggagcctcgtctcggggttgggatgatggagacacacggtctgagcacagctattccgagagtggggcatcaggcagtagcttcgaagagctcgacctagagggtgagggtccattaggggagtccaggctggacccaggaaccgagccactgggcactacaaaatggctgtgggaaccaaccgcccctgagaaaggcaaggagtag

SEQ ID NO: 8920 - DNA, 603 bp, Artificial Sequence
  Description of Artificial Sequence: Synthetic coding sequence
atggcctggggcggcgtgcacacctgctgcttccacctgtgctgctgctgttcatggcctcagggggcggtgccggaggaactgcacaaacaccctggccagacgctgttacttcagtgtcagtactctcccaagcgcgggccgtatcagccgaagagctggtgccaacagacctcaccgagcagatgcactctcctagtcacgtcttctaaaccgtggaccgctgtgcagaaatcgcattatacaatctgggataagccaaacgccggattcttcaatatcaccatgatccagctaacccagaacgattccggtttttactggtgcgggatctataacgctagcgagaacattattacagtgctcaggaatatcagcctggtggtcagtcctgcacccactacatcccccatgtggacccttccatggctgccaacatcaacagtgctcatcactagtccggaaggcacaagcggacatccctcgatcaacggtagtgagactagaaaatctcgggcacctgcttgcctgggttccggaggaccccggttcctggttctggtcctgtgcgggcttttactcgccaaaggcctgatgctatag

SEQ ID NO: 8921 - DNA, 1035 bp, Artificial Sequence
  Description of Artificial Sequence: Synthetic coding sequence
accacccccagccgggccctgcccggctggagcaactgccggccccgatggcgtgccggccctaccccacaatcgccgacccctcaatcacgcatgcgcctgtccccgggccccccaagcgagtggacttggctgctgcctcacttcaatccctgccatcatcaccacaggcaccaccaccctaatcctacgacaagcctgttgcctacagaaccaccaagcggtcctgaagtctccagtcaaggcagagaggcgagctgcgaaggaaccctcagggcagtcgatccccccgtacggcatcatagctacgggcgacacgagggcgcttggatgaaagaccctgccgccagagatgatcgcatttacgtcactaactactattacggcaactccctagtagaattccggaacctcgaaaattttaagcaaggtagatggtcaaacatgtataaattgccctataactggatagggacaggccacgttgtgtatcagggagccttctactataaccgagcctttaccaaaaatataataaagtatgacctgcggcagaggtttgtggcttcttgggcgttactgccggacgtggtctatgaggacacaacaccatggaaatggagaggtcatagtgacattgatttcgctgtggacgagtccggtctgtgggttatctatcctgccgttgacgatcgcgatgaggcccaacccgaggtgatagtgctgagccggcttgacccgggtgacttgtctgtccaccgtgaaacaacatggaagacacggttgaggcggaacagctacggtaactgcttcttagtttgtgggatcctgtacgctgtggacacttataatcagcaggagggacaggtggcatacgcattcgacacccacaccggtactgatgcccgcccacaattaccatttcttaatgagcacgcttacaccactcaaatcgattacaaccccaaggaacgcgtgctatacgcctgggacaacggacatcagcttacttatactcttcatttcgtggtctag

SEQ ID NO: 8922 - DNA, 2682 bp, Artificial Sequence
  Description of Artificial Sequence: Synthetic coding sequence
atggccgaggccgccctggaggccgtgcggagcgagctgcgggagtttcctgcagcggccagggaactgtgcgtacccctggccgtgccatacctcgataagcccccgaccccactacacttttacagagattgggtctgtcccaacaggccttgcatcattagaaatgccttgcagcactggccagccctgcagaaatggtccctgccttactttagagccacagttggcagcactgaggtaagcgtggccgtcacacccgacggatacgccgacgccgttagaggggatcgttttatgatgccagctgaaaggagactaccactctcctttgtgctcgacgtgcttgagggacgagcacagcaccccggtgtcctgtatgtacagaagcagtgcagcaatcttcctagcgaactgccccagctgttgcctgacctcgagtcccacgtgccttgggcctctgaagccctcggaaagatgcctgatgccgtcaacttttggctcggagaggcagctgctgtgacatccctgcataaagaccactacgaaaacctctactgcgtagtgagtggcgagaagcactttttgtttcatcctccttcagatcgacccttcattccctacgagctgtacacacctgcaacctatcagctgacagaggaggggacattcaaggtggtggacgaggaggcaatggaaaaagcagaggtgtctagaacgtgcctacttactgtgcgggtgctgcaggcacaccgtctgcctagtaaagatcttgtcacacccagcgattgttacgtcactctctggctgcccacagcgtgctcacacaggctccagacaagaacagttaaaaattcctcctcccccgtgtggaatcagagcttccactttcggattcaccgccagctgaagaatgtcatggagctcaaagtgtttgaccaagatctggtcacaggcgatgaccccgtgctgagtgtgctgtttgacgctggtaccctcagggccggtgaattccgtagagaatcattttccctgagcccacaaggggagggcagattggaggtggaattccgactgcagtcattggccgacagaggggaatggctcgtaagtaacggggtcctggtggcacgcgaactaagctgtttacacgtccagttggaagaaactggcgaccagaaaagctccgaacacagagtacagcttgttgtgcctggctcatgcgaaggcccccaggaggctagcgttggaaccggcactttcagattccactgccccgcatgttgggaacaggagctgagcatcaggctgcaggacgctcccgaagagcagcttaaggctcctttatccgcgctgccatctggccaggtagtacggcttgttttccctactagccaggaacccctcatgagagtggaactgaagaaggaagcgggcttaagggaattagcagtgaggttaggcttcgggccctgcgcagaagagcaggcttttttgagtcgcagaaaacaagtggtcgcagctgcacttcgccaggccctccagctggacggggaccttcaagaagacgagatcccagttgtggccataatggctaccggggggggcatcagggccatgacgagtctttacggccagctggccggactcaaggagttagggttgctcgactgtgtaagctacataaccggtgcttcaggctctacctgggctctggcaaatttgtacgaagaccccgaatggagccagaaggacttggccgggcccacagagctattgaagacgcaggtgaccaaaaacaagcttggtgtgctagctcccagccagcttcagagatacagacaagaattggccgaaagagcacgactaggatacccaagttgttttacgaacctctgggctttaatcaacgaggcactgctacacgacgaaccccacgaccacaaactgtctgatcagcgagaggcactcagccatggtcagaatcccctccctatctattgcgcacttaataccaagggacagtccttgacaacttttgagtttggcgagtggtgtgaattctctccttacgaagtgggattccctaaatacggagctttcatccctagcgaactgtttggttcagagtttttcatgggacagctgatgaagcgcttacccgagtcccgtatctgtttcctcgaaggcatttggagcaatttgtatgccgccaatctgcaggattccctgtattgggcctcagagcctagccagttttgggacaggtgggtgcgcaatcaagctaacctcgacaaggaacaggtaccccttttgaaaattgaagaaccacctagcacagcggggaggatcgctgagtttttcaccgacttactgacttggaggccattggcgcaggccacacataacttcctgcgaggcttacacttccacaaggattattttcagcacccccacttttccacttggaaggcgactaccttggacgggcttcctaaccaattgactccatcagagccccacctctgcctcttagacgttggatacttgatcaacacgtcatgtcttccattactgcagcctaccagggacgtcgatttaattctgtcattagattataacctccatggcgcttttcaggggagcggcgggcacccacggcggcggcagctgggccgatag

SEQ ID NO: 8923 - DNA, 354 bp, Artificial Sequence
  Description of Artificial Sequence: Synthetic coding sequence
atgatcatcgacagcagccggatccccagcttcacccagctgcactcaaccatgacacgagcccctctactgttgctgtgtgtcgcactagtgcttcttggtcacgtgaacggggccacagtaaggaatgaagataagtggaaaccactaaacaatccacgtaaccgggacctgttctttcgcagactccaggcctatttcaaggggcgagggctggatcttgggacttttcctaatcccttccctacaaacgagaatcctcgtcctctcagcttccagagtgaactaactgcctccgcctcagcagattatgaagaacaaaagaactcattccataattacctcaaggggtag

SEQ ID NO: 8924 - DNA, 4143 bp, Artificial Sequence
  Description of Artificial Sequence: Synthetic coding sequence
atgcggcacggcgtggcctgggccctgctggtggccgccgccctgggcctcggcgcccgcggcgtacgaggggctgtggcccttgcagatttttacccatttggagctgaacggggcgacgcagtcactcccaaacaggacgatgggggtagtgggctgcggcctttatcggttccctttccattcttcggcgccgagcattcaggactttatgttaacaataatggcatcatatctttcctgaaagaggtttcacagttcactcctgtcgcttttccgattgctaaagatcgatgcgtcgtcgcggcattttgggctgatgttgataacagacgggcaggcgacgtatactacagagaggctacagacccagctatgctgagaagagctacggaagacgttcgccattattttcccgagttactggacttcaatgccacttgggttttcgttgctacatggtatcgtgtgaccttttttggggggtcttcttctagcccagtcaacaccttccagacggtcctaattacagatggaaaactttcgttcacaatcttcaactacgaatcgatcgtgtggacaaccggaacacacgcttctagtggcggaaatgccaccggtttaggcggcatcgcagctcaggcaggcttcaatgctggcgacggccagcgttatttctcaattccagggtctcgtaccgctgacatggccgaggtcgagactacaaccaatgtaggcgtgcccggccgttgggccttcaggatcgacgatgcccaggttcgggttggtggatgtggacacactacgagtgtatgcttggcactgagaccatgtttaaacggagggaaatgcattgatgactgcgtgaccgggaacccatcctacacctgctcatgcctatctgggttcactggccggaggtgtcatttagatgtgaatgagtgcgcctcccagccatgtcaaaatggaggcacctgcacacatggtataaactcgtttagatgccagtgccctgctggcttcggcggtcccacgtgcgaaactgcacagtccccctgtgacacgaaagaatgccaacatggcgggcagtgtcaggtggagaacggctctgccgtgtgtgtttgccaggccggatatacgggcgctgcttgcgaaatggatgtggacgactgttcaccggacccttgcctgaacggcgggtcttgcgtagatctcgtcgggaactatacttgtctgtgcgccgaaccttttaagggcctgagatgcgagacaggcgatcacccagtgcccgacgcctgcctgtctgccccttgccacaatggtgggacctgcgtggacgcggaccagggatatgtatgcgaatgccctgaaggcttcatgggcctcgactgccgagaacgtgtgccagacgactgcgagtgccgcaatggggggcggtgccttggagctaatacaaccctctgtcagtgcccgttgggattctttgggctgttgtgcgagtttgagataaccgctatgccatgcaatatgaacactcagtgccctgacggcggatactgtatggaacacggtggttcgtacctgtgcgtttgccacaccgatcacaacgcttcgcatagccttccaagcccatgtgattctgatccctgcttcaatggtgggtcatgtgacgcgcacgatgacagctatacatgtgagtgtccacgggggttccacggcaaacattgcgaaaaagctcgcccacatctctgttccagcggaccctgccggaatggaggtacttgcaaagaagccggcggcgagtatcactgcagctgcccctaccggttcaccggaagacactgtgagataggtaagccggacagttgtgcaagcggtccctgccacaacggcggaacatgttttcattatatcggtaagtataaatgtgattgccctccagggttctctggcagacactgtgagattgccccgagcccttgttttagatctccctgcgtgaacggcggcacctgcgaagacagagacacagattttttttgtcactgtcaggccggctacatgggccgaaggtgtcaggccgaggtggactgtggtccacccgaggaggtgaagcatgcaacactgcgtttcaatggaacgcgcttgggggccgtggccctttatgcttgcgacagaggatactccctgtccgcccccagccgaatcagggtttgccagccacacggggtgtggtcggagcccccacagtgcctggaaattgatgagtgcagatctcaaccctgtctgcacggcggaagctgtcaagaccgggtggccggatacttgtgcctctgctctaccggttacgagggggcccactgtgagctcgagagagacgaatgtcgcgcacatccttgtcgcaatggtggttcttgtcggaacctgcccggcgcctacgtttgtcggtgccccgcaggttttgtaggcgtccattgcgagacggaggtagatgcttgtgactccagcccttgtcagcatggtgggcggtgtgaatctgggggcggcgcatatctctgtgtctgtccagaatccttttttggttatcactgcgagacagtgtctgatccatgcttctcctccccatgtggcggccgcgggtattgcttagcctccaatggctcacactcatgcacatgtaaggtaggctatactggagaggattgtgccaaagaactatttccaccgacagcattgaagatggagcgagttgaggaatctggagtgagtattagctggaaccctcctaacggacctgccgctaggcagatgctggacggatacgcagtcacgtacgtatcttccgacggttcttatcggaggacagattttgtggatcggacccggtcctcacatcagctgcaggccctggcagcaggccgagcctataatatttcagtcttttctgtaaagcgcaacagtaataacaaaaacgatatttcaagacctgcagttctcctagcccggaccaggccccggccagtggaaggattcgaagtcactaacgtaacagctagcaccatctccgtacaatgggctcttcatcgcatcagacacgctaccgtctccggggtacgggtgagtatccgccaccctgaagcactgcgagatcaggccactgacgtcgatcgaagcgtggataggtttaccttcagggctctgctgccagggaagcgttataccatccagttaactaccttgtccggcctccggggtgaggaacatcctaccgagagtctggctacagcaccaacccatgtctggactagacctcttccccccgccaatttgaccgcggccagagttacggccacctctgctcacgtcgtgtgggatgcccccacacctggctccctgttggaggcctacgtaatcaatgtgacaacaagtcagagcacaaagtcgcgctacgtacccaatggcaagctggcatcctacacggtgcgagatttattacctggccggcgctaccaattgagcgtcattgccgtgcagtctaccgaactgggtccccagcattccgaaccagctcatctgtacataattacaagtcctcgagacggtgctgaccgtaggtggcatcaaggaggacaccaccctcgggtactgaaaaatcgccccccccctgccagattgccggagcttcgcttactcaatgaccactctgcgcctgagacacctacccagccgccgcggttctctgagctcgtggacggcaggggccgggtttccgcccggtttggtggctctcccagtaaggctgccaccgtgaggtcacatgtgcctgggaattgctcggagaacccctgccagaatggcggcacctgtgtgcccggggcggacgctcattcttgcgattgtggcccgggatttaagggccgcaggtgcgagttggcttgcattaaggttagcaggccctgcactcgcctgttctcagaaactaaagcttttccagtctgggagggaggcgtctgccatcatgtgtataagcgtgtttacagagttcaccaggatatctgttttaaggagtcctgcgaatctacatcactgaaaaagacccctaatagaaagcagagcaagagtcagactctggaaaaaagctag

SEQ ID NO: 8925 - DNA, 474 bp, Artificial Sequence
  Description of Artificial Sequence: Synthetic coding sequence
atggaggccctgcggcgggcccacgaggtggccctgcggctgctgctatgccgtccatgggccagtcgggccgcagcgcggccaaaaccttctgcatctgaggtgttaactcggcaccttttacaaagacgacttccacattggacttcattttgtgtgccatacagcgcagtgcgtaacgaccagtttggattgtctcacttcaactggcctgtgcagggtgcaaactaccacgtgctaaggaccggatgcttcccttttataaagtaccactgttcaaaggctccttggcaggacttggcaaggcagaacaggttctttaccgccctcaaagtggtcaacctcggcatcccgaccttactgtatggtcttggaagttggctgtttgcgcgggttaccgaaacagttcatacctcttacgggcccataactgtgtactttctcaataaagaggacgaaggagcaatgtattag

SEQ ID NO: 8926 - DNA, 288 bp, Artificial Sequence
  Description of Artificial Sequence: Synthetic coding sequence
atgaagggcagccgggccctgctgctggtggccctgaccctgttctgtatttgccgaatggcaacaggtgaggacaacgatgaattttttatggacttcttgcaaacactgcttgttgggacccccgaggagctctatgaggggaccctggggaagtacaacgtgaacgaggatgccaaggcagccatgactgagctgaagagctgtatcgatggcctgcaaccaatgcacaaagcggagctcgtgaagcttttagtacaggtcctgggaagccaggatggcgcttag

SEQ ID NO: 8927 - DNA, 1053 bp, Artificial Sequence
  Description of Artificial Sequence: Synthetic coding sequence
atgaagtgcagcctgcgggtgtggttcctgagcgtggccttcctgttggtctttatcatgtctctactttttacatattcgcatcattccatggcaaccctaccttatttagatagcggggcccttgatggcacacatcgggtgaagttggtgccgggctacgctgggcttcaacggttgtcaaaggagaggttatcaggaaaatcgtgcgcctgccgtcggtgcatgggggatgccggcgcttctgactggttcgattcccactttgatgggaacatctcacctgtgtggacgcgtgagaatatggatctccctcccgatgtgcagaggtggtggatgatgctgcaacctcagtttaaaagccacaacaccaatgaagtgcttgaaaagctctttcaaatcgtaccgggcgagaacccctacagattccgtgacccacatcagtgcaggcgttgtgcagtggttggtaactccgggaatctgcgtggcagcggctacgggcaggacgttgacggtcataatttcattatgcggatgaaccaagcccctaccgttggctttgagcaagacgtggggagcagaacgacgcaccatttcatgtacccagaatcagccaagaatctgcccgccaatgtatcgtttgttcttgtcccctttaaggttttggatcttctatggatcgcaagtgcactctcgacagggcagatccgttttacatatgctcctgtgaaaagcttcctgcgggtggataaggagaaagtgcagatttataaccccgccttctttaaatatattcacgacagatggacagagcatcatgggcgctacccgtccacaggcatgctggtgctgttctttgcattacacgtgtgcgacgaagtgaatgtatacgggtttggcgctgactccagaggtaattggcatcactactgggagaataaccgctacgccggcgagttcagaaaaaccggagttcatgacgcagacttcgaggctcatattattgatatgctggcgaaagcctccaagatcgaagtgtatcgtggaaattag

SEQ ID NO: 8928 - DNA, 600 bp, Artificial Sequence
  Description of Artificial Sequence: Synthetic coding sequence
atggccagccccgaggcccccgagagcgtggtgcagttcgccctggacaaattggggggcctcgactacctggtcctgaaccatatagggggcgcacctgcgggcacacgcgccaggtctccccaggctaccaggtggttgatgcaggtcaattttgtttcatacgtgcaattgacttctcgcgctctgcccagtctgacggactcgaaagggtccctggtggtggtgagcagcctgctgggccgcgttcctacgagttttagtaccccttactcagccgcaaaattcgcactcgacggattcttcggttccttgaggagagaacttgatgtgcaggatgtaaacgtggccataactatgtgcgtactgggactaagggatcgtgctagcgctgccgaggccgtgcgcggcgtcacccgagtgaaagcggcaccggggcctaaagccgcgctggcagtcatccggggaggggcgacaagagctgccggcgtcttctacccctggcgattccgactactgtgtctcctcagaaggtggctacccagaccgagagcctggttcatacgccaggagctgaatgtcaccgccgccgctgcttag

SEQ ID NO: 8929 - DNA, 411 bp, Artificial Sequence
  Description of Artificial Sequence: Synthetic coding sequence
atggtgcggccctaccccctgatctacttcctgttcctgcccctgggcgcgtgctttccactcctcgacagaagagaaccaacagatgctatgggcggcctaggggcaggcgagcggtgggcagatctggccatgggcccccggccgcattccgtgtggggaagctctaggtggctgcgcgcatcccagccacaagccctactcgtcatcgcgaggggcctccagaccagtggtagagaacacgcaggttgccgtttcagatttggacggcaggacgagggtagtgaggccaccggattccttccagccgccggggagaagacctctggaccactgggaaatctggctgaggaactgaacgggtactctaggaaaaaggggggcttcagtttcaggttcgggaggcggtag

SEQ ID NO: 8930 - DNA, 663 bp, Artificial Sequence
  Description of Artificial Sequence: Synthetic coding sequence
atgcggggccagggccggaaggagagcctgagcgacagccgggacctagacggctcttacgatcagctgactgacagtgtagatgatgagtttgagttatccacggtgtgtcatcggccagagggtctggagcagctgcaggagcagaccaagttcactagaaaggagctccaggtgctttatcggggattcaaaaacgaatgccccagcggcattgtaaacgaagaaaattttaagcagatttacagtcaattctttccacagggcgattccagcacctacgccacgttcctgtttaatgctttcgataccaatcatgacggatccgtgtcatttgaggactttgttgctggcctatccgtgatactgagggggacagtcgacgataggctgaactgggcctttaatctttacgatctgaacaaggacggctgtatcacaaaagaggaaatgctggacattatgaagtccatctacgacatgatgggaaagtacacgtaccccgcccttcgggaggaagctcctagggagcacgtggaatccttctttcagaaaatggataggaacaaggatggggttgtgaccatagaagagttcatagagtcctgtcagaaggacgagaacattatgaggtctatgcagctgtttgataatgtgatttag

SEQ ID NO: 8931 - DNA, 2175 bp, Artificial Sequence
  Description of Artificial Sequence: Synthetic coding sequence
atgctgcggaccagcacccccaacctgtgcggcggcctgcactgcagagccccttggttgtcttccggcatcctttgcctgtgtctcatctttctcctgggtcaggttggtctcctgcaggggcacccacagtgtcttgactacggcccgccattccagccccctctgcacttggaattttgctctgactatgagagctttggatgctgcgaccaacacaaagacagaagaatcgccgcacggtactgggatatcatggagtactttgacttgaagcggcatgagctgtgcggggactatataaaagatatcttatgccaggaatgttcgccatacgcagctcatctctatgatgcggaaaatacccagacccccctgagaaatcttcctggcctgtgctctgattattgttctgcttttcatagcaattgtcactctgctatcagtctgctgacaaacgacagggggctgcaggagtctcatgggagggacgggacaagattctgtcacctgctggacctgccagataaagattactgctttcccaacgtcctcagaaacgactacttaaaccggcacctagggatggtggcccaggacccacagggatgtctgcagctgtgtcttagcgaggtagccaatggcctcagaaaccctgtgtcgatggttcacgccggagacggcacccaccgcttctttgtggctgagcaggtgggggttgtgtgggtgtacttaccagacggatcacgcctggaacagccattcctcgatctaaaaaatatcgtgctgacaacaccttggattggcgacgaacgcgggttccttggcttggcattccaccccaaatttcgacataaccggaaattttatatctactattcttgtctggacaagaagaaggtcgagaagatcaggatctccgagatgaaggtctctcgggctgaccctaacaaggccgatttgaaaagcgagcgcgtgattctggagatcgaagaacctgctagcaaccacaatggtgggcagctcctcttcggactcgacggttatatgtatatctttactggggatgggggccaagcaggtgacccgttcggcttatttggcaacgcacagaataagagctcactcctgggcaaggtacttcggattgacgtcaacagagcaggctctcatggaaaacgataccgagtaccaagcgacaacccgttcgtcagtgaacccggagcccaccctgctatttatgcttatgggattaggaatatgtggagatgtgcggtagaccgaggcgatccaattaccagacaaggaaggggccggatcttctgcggcgatgtaggacagaacagatttgaagaggtggacctgattcttaaaggtggcaattacgggtggcgcgctaaagagggctttgcctgttacgacaagaaactgtgtcacaatgcctccctggatgacgttctccccatctatgcttatggccatgctgtgggtaagtccgtcaccggtggctatgtctataggggctgcgaaagcccaaatttgaacgggctgtacatttttggagactttatgagtggcaggctgatggccctccaggaggatagaaagaacaaaaaatggaagaagcaggatctctgtctgggatcgaccacttcatgtgcatttcccgggctgattagcactcacagcaagtttattatttcatttgctgaagatgaagccggtgagttgtatttcctggccacctcttatccaagcgcatatgccccacggggaagcatttacaagtttgttgacccttctaggagagcaccacccggcaagtgcaagtacaaacctgtgcccgtgcgaaccaaatcaaagcgcatcccttttcgccctctcgccaagacggttctggacctgctgaaggaacagtcagagaaagccgcccgcaagagcagctcagcaaccctcgcttctgggcctgcgcagggcctttccgagaaaggctcctctaagaaactggcctccccaacgagttccaaaaacacactgcggggtccaggtacaaagaagaaggcacgggtcggaccacatgtgcggcaggggaagagaagaaagtctctgaagagccactccgggcgaatgaggccttccgctgagcagaaaagggctggacgcagtttgccctag

SEQ ID NO: 8932 - DNA, 1218 bp, Artificial Sequence
  Description of Artificial Sequence: Synthetic coding sequence
atgtggtacgtgagcacccggggcgtggccccccgggtgaacttcgagggcgcactgttcagcggttacgctcccgatggcgggctcttcatgcctgaggagttgccacagctcgatcgcggcaccctatgccaatggtccacactcagttaccctgggctggtaaaggagttgtgcgccctgttcattggcagcgaactgctgccaaaagacgaactcaatgacctgattgacagagccttctcacgattccggcaccgagaagttgttcaccttagcaggctcaggaatggtttaaatgtactcgagctgtggcacggcgtgacctatgcttttaaggacctgtccctctcatgcaccacacaatttctccagtacttcctcgaaaaacgagagaagcacgtgacagtagtggtgggcacaagcggggacacggggtccgctgcaatcgaaagcgtgcagggcgcaaaaaacatggatatcatcgtgcttctgcctaagggacactgtacgaagatccaagaactgcagatgacaacagttctgaaacaaaacgtgcacgtcttcggcgtggaaggcaatagcgacgagctcgacgagccgatcaaaacagtgtttgctgatgtcgcatttgtgaaaaaacataacttgatgagtctgaatagcattaattggtcccgggtgctcgtgcagatggcgcaccacttcttcgcatactttcagtgtaccccctcacttgacacacacccattgcccctggtcgaggtggttgtcccaaccggtgccgctgggaacctggcggccggttatattgctcaaaagattgggctcccaatcagattagtggtggctgtgaacagaaatgatataatccataggaccgtgcagcagggagatttctctctcagcgaggcagtgaaatccacactcgcgtctgccatggacatccaagtgccctataacatggagagggtgttttggttgttgagcggatcagatagccaggtgacgagggctctcatggagcagtttgaacggactcagagcgttaatcttcctaaggaactgcacagtaaatgggaacgccaagattatgaaaaaatggcggtgatggaatgtgacggatgttgtgtggagctgtgcctaggcaactgtgggccacggagaggttctgtcacagacatacccgggacggcaatggttcgcggcggcggctag

SEQ ID NO: 8933 - DNA, 492 bp, Artificial Sequence
  Description of Artificial Sequence: Synthetic coding sequence
atgaccatgcggcacaactggacccccgacctgagccccctgtgggtcctcctcttatgtgcccacgttgtgactctcttggttcgcgctacacctgtgtcccagaccactactgccgcaaccgcctctgtacgaagcactaaggatccgtgcccatcccagccccctgtttttcccgctgcgaaacagtgtccggcactggaagttacctggcccgaggtggaagtccccctgaacggaaccctaagcctgtcatgcgtcgcctgtagtagattcccaaatttctcaatcctgtattggctgggcaacgggtccttcatcgaacacctgcccggtcgattgtgggaaggatctacatcacgcgaaagaggcagtactggatgggccgaggggaatctcgcacctcacccacgtagccctgccctgcagccacaacagagtactgccgcaggtctgcggctgtcaactggccctgctgcagcccaaccttag

SEQ ID NO: 8934 - DNA, 1590 bp, Artificial Sequence
  Description of Artificial Sequence: Synthetic coding sequence
atggcccccgcccggaccatggcccgggcccggctggcccccgccggaatacctgcggtggctctctggctactttgcactctcgggctgcagggcacccaggcgggtcctcctccagcacctcccggcctgccagccggcgcggactgcttgaatagcttcacggccggagtgcccggcttcgtgttggataccaatgcaagcgtcagcaatggggccacattcctggaaagtcccaccgtgcgaaggggttgggactgcgtccgggcgtgttgtacaacacaaaattgtaatctagccttggttgaacttcagcccgatcgcggagaagacgcaattgctgcttgttttctaataaactgcctctacgagcagaatttcgtgtgtaagttcgctcctcgggaaggtttcatcaactatctcacgcgtgaggtgtacagatcttaccggcagctgcgtactcagggcttcggagggtccggcatcccaaaggcttgggcgggcatcgaccttaaagtccagcctcaggaacctttggtactgaaggacgtcgagaatactgactggcgtctcctgaggggggacaccgacgtccgagttgagaggaaagaccccaaccaggtcgagttgtggggtctgaaggaggggacttacctgttccagctgaccgtgacgagcagtgaccacccagaagacacagcgaatgtgacagtgacggttttaagcactaagcagacggaggactactgtctggcgtcaaataaagtcggacgatgccgaggttcttttccccggtggtactacgatccaacagagcagatttgtaaaagttttgtttatggcggttgcctcggtaataaaaacaactatcttcgggaagaggagtgcattctggcatgtcgaggcgtccagggcggtccactgagagggagctctggagctcaggcaacctttcctcagggaccatcaatggagaggcgccatccagtctgttcaggaacatgtcaacccacccaatttcggtgtagcaacggctgttgcatcgattctttccttgaatgcgatgacacccctaactgtcccgacgcgtcagacgaagctgcctgtgaaaaatatacctcagggtttgacgagctgcagcgcattcattttccatctgataaaggccactgtgttgatctccctgatacgggattatgtaaagagtcgatacctcgctggtactataatcccttctccgagcattgcgcgaggttcacgtacggcggctgttacggaaataagaacaacttcgaggaggaacagcagtgtctcgagtcatgcagagggatatcaaaaaaggacgtgttcgggttgcggcgggagattccgatcccaagcaccggttccgtcgaaatggccgtggctgtattcctggtgatctgtatcgtcgtagtggtcgccattttgggatactgcttcttcaagaaccaaaggaaagactttcacggccatcatcaccaccctccgccaactccagcctctagcacagtgtcaaccactgaggacaccgagcacctggtctacaaccacaccaccagaccattatag

SEQ ID NO: 8935 - DNA, 1803 bp, Artificial Sequence
  Description of Artificial Sequence: Synthetic coding sequence
atgcagggccccctgctgctgcccggcctgtgcttcctgctgagcctgttcggagcggtcacccagaagactaaaactagctgtgcaaaatgtcccccaaatgcttcttgcgtgaataatacccactgtacatgtaaccatggatacaccagtgggtctggccagaagttgtttaccttcccccttgagacctgtaacgatactacctcctccaaaactacagaggggagaaaggagctacagaaaattgtggataagtttgaatccctcttgactaatcagactctgtggaggaccgagggacggcaggaaataagctccacggctaccactattctgcgggatgtggagagcaaggtgttagaaacagccctcaaggatccggaacagaaggtccttaaaatccagaatgattctgttgctatagagactcaagccatcaccgataattgttcagaggagaggaagacgttcaatttgaatgtgcagatgaacagcatggatatccgctgttctgacattattcagggtgacacacagggccctagcgctattgccttcatctcttattctagcttgggcaatatcattaacgccactttcttcgaggaaatggacaaaaaagaccaagtgtatctgaattctcaggtggtgagcgcagctataggaccaaaaaggaatgtgagtcttagcaaaagtgtcacgttgaccttccagcatgtaaagatgacaccttctaccaagaaagtattttgtgtgtattggaagtcaacaggtcaggggtctcagtggtcccgtgacggatgttttttaatccatgtcaataagtctcatactatgtgtaattgctcacacctttcaagctttgctgtgctaatggctttgacctcacaagaggaagaccccgtgctcaccgtaatcacttacgttgggttgagcgtgtccttactgtgtttacttctcgcggctctcacctttcttctgtgtaaggctatcagaaacacctcaactagtctgcacctccagctgtccctgtgcctgtttctggctcacttgctctttctggtgggcattgatcgcaccgaacccaaggtgctctgctctatcatcgctggcgcccttcattacctgtacctcgcagccttcacatggatgttgttggaaggtgtccacctgttccttactgcgagaaatctgaccgtggtgaactatagctctattaataggcttatgaaatggattatgtttccggtgggctatggtgtgcccgccgtcactgttgctatttctgcggcctcctggcctcacctatacggtacagcagatcgttgctggctccacctggaccaaggcttcatgtggtcttttctaggacctgtgtgtgctattttttcagcaaatctggttctctttatcctagtgttttggatcttaaaacgaaagctgagctcacttaatagtgaggtttccacaatccagaacacccgcatgctggccttcaaggccacggcacagctgttcatcctgggctgtacttggtgcctcggcctgctgcaagttgggcctgctgcccaggtgatggcctacctcttcactataatcaacagtctgcagggattcttcatttttctggtttattgtctgctgagccagcaagtgcagaaacagtaccagaagtggtttcgcgagattgttaaatcaaagagcgaaagtgaaacgtacactctttcttccaagatgggaccagactctaagccctctgagggcgacgtatttccaggccaggtgaagaggaagtattag

SEQ ID NO: 8936 - DNA, 660 bp, Artificial Sequence
  Description of Artificial Sequence: Synthetic coding sequence
atgaagctgctgctgtgggcctgcatcgtgtgcgtggccttcgccaggaagcgccgattccctttcattggggaggatgataacgatgacggacatccccttcacccctctctgaacattccatacggcatcagaaacctgccgccgcctctctactatcgacctgtgaacacagtccctagctatccagggaacacatacaccgatacaggcctgccatcttacccttggatcctgactagtccaggctttccctacgtgtatcatattagagggttcccactggccactcagttgaacgtgcccccattacccccccgaggcttcccttttgtgccgcctagtagattcttctccgctgcagctgcaccagccgctccacctatagcggcagagcccgccgcggcagcgcccctcacagcgactcctgtggccgctgagcccgcagccggtgcacctgttgctgctgaaccagctgccgaagcccccgttggagccgaacctgccgccgaggccccggtggccgcggaaccggcggcagaggcacctgtgggagtcgagccagctgccgaagaaccgagtcctgccgaacctgcaacagccaagcccgctgccccagagccccatcccagccctagtctggaacaagccaatcagtag

SEQ ID NO: 8937 - DNA, 1743 bp, Artificial Sequence
  Description of Artificial Sequence: Synthetic coding sequence
atgcacctgagcgccgtgttcaacgccctgctggtgagcgtgctggctgcagtcctgtggaaacatgtccgactgcgcgaacacgccgccacactggaggaggagctggcactgagcaggcaagcaacagaacccgccccagcacttcgcattgattaccctaaagcgctgcagatcctcatggagggcggaacccatatggtgtgtactggccgcacacacactgacaggatttgccgttttaagtggctttgttattctaatgaggccgaagagtttatttttttccacggcaatactagcgtgatgttaccaaacttgggatcccgtagattccagcccgctctgttggatctgtccacagtcgaggatcataacacccaatacttcaactttgtcgagctgcctgccgcggcccttcgatttatgcccaagcccgtgttcgtgccagacgtggcactcatcgcaaataggtttaatcccgataatcttatgcacgtatttcacgatgacctgttgcccctcttttatacactgcgacagttccccggactcgctcacgaagcccgccttttcttcatggaaggatggggtgagggggcacacttcgacttatataaattgctgtcaccaaagcagccgctgttgagggctcagctgaagacgctcgggcgcttactgtgcttttcccatgcgtttgtcgggctgtctaaaatcacgacttggtaccagtatgggtttgttcaaccccagggaccaaaagctaacattttggtgagcgggaacgaaataagacagttcgcccggtttatgacggagaagctgaacgtaagtcataccggtgtgcctctgggggaggagtatattttagtgttctcgcggacacagaacagattaattctgaacgaggctgaactgctgctcgctctggctcaggagtttcagatgaaaacggtcaccgtgtctctggaggaccatacgttcgctgatgttgttcgtctagtttctaatgctagcatgctggtctccatgcatggcgcacaactggtcactactctcttcttgccacggggggcgactgtggtggagctgtttccatatgccgttaatcctgaccactacaccccttacaagactctcgctatgttgcccgggatggatttgcagtacgttgcctggaggaacatgatgcccgagaacacagtgacacacccagaaagaccatgggatcagggaggtataacccatctggatagggccgaacaagccaggattttacagagtagggaggtgcctcgccacctctgttgtcggaatccagagtggctctttcggatctatcaagataccaaagtcgacatcccttctcttatccagaccatccgccgggttgtgaagggacggcctggccctagaaagcagaagtggaccgtcgggctttatcctggaaaagtccgggaagctcgctgccaggccagcgttcatggggcatctgaagcccgcctgactgtctcgtggcagattccttggaatctgaagtacctgaaagttagagaagtcaaatatgaggtgtggttacaggagcagggagaaaacacctatgtgccctatattctcgcgttgcagaatcacacatttactgagaacatcaaaccattcacaacctacctcgtttgggttaggtgtattttcaataagattctccttggcccatttgccgacgtgctcgtatgtaacacatag

SEQ ID NO: 8938 - DNA, 5130 bp, Artificial Sequence
  Description of Artificial Sequence: Synthetic coding sequence
atgggcttcctgcccaagctgctgctgctggccagcttcttccccgcgggacaggcatcttggggcgtctcgagcccacaggacgtgcagggggttaagggaagctgcttgctaataccatgtatcttctccttccccgcagacgttgaggttccggatggcatcacggctatctggtactatgactactcagggcagagacaggtggtttctcatagcgccgacccaaaactggtcgaggcaaggttccgtggcaggacggaatttatgggaaatcctgagcacagagtttgtaacctcctgctgaaggaccttcagcccgaggattcaggttcatataatttccggtttgaaattagcgaagtcaatagatggtctgatgttaagggaaccttagttaccgtgacggaggagcccagggtgcccacaatagcatctcccgttgaattgttagagggaacagaagtcgatttcaattgctccaccccttatgtgtgcctgcaggaacaggtaaggctccagtggcaaggacaggatccagctagatctgtgacttttaacagccagaagttcgaaccgacgggcgttggccacctcgagacccttcacatggcgatgagttggcaggatcacgggcgcattcttaggtgccagctctccgtagccaaccatcgagctcagagcgaaatccacctgcaggtgaaatatgcacccaaaggagtgaagatactcctgtctccttctgggcggaatattctcccaggagagttggttacgctaacctgccaggtgaactcatcctatccagcagttagctctatcaaatggcttaaagacggagtacgtttgcagacaaagaccggggtgttgcacctcccccaagccgcctggagtgacgcaggcgtctacacctgccaggcagagaacggagtgggctccctggtgagcccaccaatttccctgcacatctttatggctgaagtgcaagtaagccctgcaggccctatcctggaaaatcagaccgtgaccctggtctgtaatacccctaatgaagctccttctgatctcaggtattcctggtataaaaaccacgtgctcttggaagatgctcactctcatacactgagactgcaccttgcgacaagagctgacacaggtttttacttctgtgaggtgcagaacgtccacggctcagagcggagcggcccagtgagtgtggtggtaaatcaccctcccttaactccagttctcacagcatttctggagacccaggcagggcttgtggggatcctgcattgttctgtggtgtctgagccccttgccacactggtgctgtcgcatggcggacacatactggcatctacaagcggtgatagtgatcattcccccagattttctggcacctccggacccaatagccttcggctggaaatccgagaccttgaggaaaccgattccggcgagtataagtgttcagcaacgaactcattgggtaatgctacgagcaccctcgactttcatgctaatgctgcccgacttctcatttccccagctgctgaggtggtggaaggccaggctgtcaccctttcgtgccggtccgggctgtcccctactcctgacgcacgatttagctggtacctgaatggtgcgttactgcatgaggggccggggagctctctactgctgccggccgcttccagcaccgatgcaggctcctaccactgccgcgccagagatggacactcagctagcggaccgagcagtcccgccgtgctaactgtgctttatcctcccaggcagcccacctttactacaaggctcgatttagatgcggcgggggccggtgcaggaagaaggggactcctgctgtgtcgcgtggactctgatccgcccgcccggcttcagctgctccataaagatagagtcgtcgccacatcccttccctcaggagggggttgcagcacttgtggagggtgcagcccgagaatgaaggtgactaaggcgcccaacttattgcgggtggagattcacaaccctctgttggaggaggaagggctgtatttgtgcgaagcgagtaacgcccttggaaacgcttcaacgagtgctactttcaatgggcaggccacggtcttggctattgcccctagccatacccttcaagagggtaccgaagctaacctgacctgtaatgtcagccgcgaggccgcgggctctccagccaacttcagttggttccgcaacggtgtgctgtgggcccagggcccgctggagaccgtcacactgttaccagtagctaggactgacgcagccctttacgcatgtagaatcctgacagaggcaggcgcccagctgagcaccccagttctattatctgtgctctatccccccgataggccaaagttgtcagctcttcttgatatggggcagggccatatggccctttttatctgcactgtggacagtcggcccctcgcactgcttgccctgttccatggagagcacctgttggccacttctcttggccctcaagttccctctcatggaagatttcaggccaaggctgaggctaattctttgaagttggaagttcgcgaattgggcctcggcgacagtgggtcttacagatgtgaagcgacgaatgtactgggctccagtaataccagtttattcttccaggtccggggggcttgggtccaagtcagtccgtctccagaattgcaggaagggcaggccgtggtgctaagctgccaggtccatacaggtgtcccagaaggcacttcctatcgctggtaccgagacggtcagccacttcaagagtcgacctctgctacattaaggttcgctgccatcacattgactcaggcaggcgcctatcattgtcaagctcaagcccccggctccgcaactacatccctggccgcccctatttctctccatgtgagctatgctcctcgtcatgtgaccctgactacgttaatggacacaggaccaggccgcctgggactgctcttgtgccgcgtcgatagcgaccccccagcccagctgaggttactgcatggcgaccggctcgtggcctcaacactacaaggggttgggggtccagaagggtcatcaccccggctacacgtggccgtggcaccgaatacattgaggctcgagatacatggggccatgttggaagacgagggcgtgtatatctgcgaggccagcaacacgctcggtcaggcaagcgcgagcgcggactttgacgcacaggccgtaaacgttcaggtctggcccggggctaccgtgagggagggtcagctcgttaatctgacttgcctcgtgtggacaacccatcctgcccaactgacttatacatggtaccaggacggtcaacagagactggacgcccactctatccccttacccaacgtgaccgtgcgggacgcaacttcttatcgctgtggcgtgggccctcccggtagggcgcccagattgagccgccccattaccctcgacgtgttatacgcccctaggaacctgagactgacgtatttattagagtcccacggtggccagttagccttggtgttgtgcactgttgatagtaggccacctgcccaactggccctctctcacgccggacgcctactggcatcgagtacagcggctagtgtgcctaataccttaaggctggagttgcgcggaccacagcctagagatgaggggttttactcatgttcggcaagaagtccactcggccaggcgaacacctctctcgaactgaggcttgagggtgttagggttatcctcgcaccggaagcagctgttcctgagggcgcccctatcacggttacgtgcgctgaccccgctgcacacgccccaacactttacacctggtatcataatggaagatggctgcaagaagggcccgccgcttccttgagtttcctcgtggctaccagagctcacgccggagcttacagctgtcaggcacaggacgctcagggcacgcgaagttcgagaccagcggctttgcaagtgctgtacgccccccaggacgcagtgctctcaagcttccgcgactccagggctaggtctatggccgtgatacagtgcaccgtcgactcagagccaccagccgagttagctctgtcccatgacgggaaagtgctggcaactagctcaggcgttcacagcttggcctctggtaccggccacgtgcaagtggcacgtaacgcactgaggttgcaagtgcaggacgtgcccgcaggcgatgatacctacgtctgtactgcacagaacctgctgggcagtatttccacaattggaaggcttcaagtggaaggagccagggtagtcgctgagcccggactggacgtgccagaaggcgcggctcttaatctgagctgcaggctcctgggtggacccggccctgtcgggaattccacctttgcctggttctggaacgaccgacgacttcacgctgagcctgtccctactctcgccttcacgcacgtagccagagcgcaagccggaatgtaccactgtctggctgagctcccgaccggagcggccgccagtgcccccgtaatgcttcgtgtgctgtacccccccaagactcccacgatgatggtttttgtcgagcccgaggggggcctgcgggggatcctggactgcagggtggacagtgagccattagcttccttaacactccaccttggctcaagactcgttgcaagctcgcagcctcagggcgcccccgcagagccacatatccacgtgctggcctctcctaacgctctgagggtagatattgaagcgctcaggccctccgatcagggagagtatatctgctccgcttccaacgtgctgggtagtgcttctaccagcacgtactttggggtcagagccctacaccggctgcaccagttccagcaactgctctgggtactgggtctgctggtgggcctcctgttgctactgctggggctcggagcttgttacacatggagaagacggcgggtttgtaaacaatcaatgggagaaaacagcgtggagatggccttccagaaagagaccacacaactgatcgacccagacgccgccacctgcgaaacctccacctgcgcccccccactaggctag

SEQ ID NO: 8939 - DNA, 693 bp, Artificial Sequence
  Description of Artificial Sequence: Synthetic coding sequence
atgtgcgtgacctaccacaacggcaccggctactgcaagtgccccgaaggattcctaggggagtattgccaacaccgcgacccctgcgagaaaaaccggtgccagaacggcggaacttgcgtggcccaggcaatgctgggaaaggccacctgtaggtgcgcgagtgggtttactggtgaggactgtcagtatagcaccagtcacccttgctttgtgtcccggccatgccttaacggaggcacctgccacatgttgagtcgtgacacctacgaatgcacttgtcaggtaggctttaccggcaaggagtgtcaatggaccgatgcttgtctatctcacccgtgtgcaaatggttcaacctgtactaccgttgctaatcagttctcttgcaagtgtctgacagggttcaccggccagaagtgcgaaactgatgtcaacgaatgtgacattccggggcattgtcagcatggaggcacctgcctgaacctgccagggtcataccagtgccagtgtctacagggctttaccggtcaatactgcgacagcctgtacgtcccttgtgcacctagcccctgtgttaacggaggaacttgtagacagaccggcgacttcactttcgagtgtaattgcctcccagccacttggccaatattcccaaagttgttgtcgttacaggagaaggagtcctattgttag

SEQ ID NO: 8940 - DNA, 660 bp, Artificial Sequence
  Description of Artificial Sequence: Synthetic coding sequence
atgttcgtgagctacctgatcctgaccctgctgcacgtgcagaccgccgttttggctcgcccaggcggtgagtccataggctgcgatgattaccttggttccgacaaagtagttgacaagtgcggtgtttgcgggggagacaataccggatgtcaagtagttagtggcgtgttcaagcacgcactcacatccttgggctatcatagggtcgtcgaaatccctgaaggggcaaccaaaattaatatcacagaaatgtacaaatcaaacaagaagaaatcacatcttaaacccgctacacgtggctctcagttctcttccgttaaagtatgctcagtgccagctgcctgtaaacttcttggaacccctggccgggcacgtcagcctgttcccgcaccaagggagctggagcacgacaagaattccccacattgcgcatatttatccctgtacctcacctccctagctcagtcctcatggagggtcttctctttgttttcatatgtgctgatttacttgtttagcaaatacctggctttcaataccttgtttgcacttaagcggatggctctccagcgggaccgtaaagaaaaaactcgggcatggtgtatctttatcaagctgtgcggacgggagattcagattctgcccgggcccgtgtag

SEQ ID NO: 8941 - DNA, 363 bp, Artificial Sequence
  Description of Artificial Sequence: Synthetic coding sequence
atggacaacgtgcagcccaagatcaagcaccggcccttctgcttcagcgtaaagggtcatgttaagatgctcagattggccttgacagtaacaagcatgactttttttattatagcccaggctcccgaaccatacattgtgattactggattcgaggtgaccgtgatccttttttttattctgctgtacgttttgcgtcttgatcggctgatgaaatggctgttttggcccctgctagttttcgccctcgtcacagctgtatgctgcctcgccgatggggcactgatttaccggaaactgctgttcaatcctagtgggccctatcagaagaagcccgtgcacgagaaaaaggaggtactttag

SEQ ID NO: 8942 - DNA, 864 bp, Artificial Sequence
  Description of Artificial Sequence: Synthetic coding sequence
atggccccctggagccaccccagcgcccagctgcagcccgtgggcggagacgccgtttctcctgctctgatggtcctgctgtgcttgggaaatttgtcgaaagccactctatgggccgagcctggatctgtgatttctagaggtaattcagttacaattaggtgtcaaggaacactggaggctcaggaataccgccttgttaaggaaggctctcccgagccatgggacacccagaatcctctcgaacctaagaacaaggcacggttctcaattccttccatgaccgagcaccacgcgggcaggtatcgctgctactactactccccagccggttggtctgagccatcagatcctcttgagttggttgtgaccgggttctataacaagcccacattgagcgctttgccatctccagtggtgacgtctggggaaaacgtgacgctccaatgcggtagcagactgcgctttgataggtttatcctaacagaagaaggcgaccacaaattgagttggaccctggacagtcagctgactccgtcaggacaatttcaggccctgttccctgtggggcccgtgaccccgagccaccgctggatgctgaggtgctatggctcacggcgccatatactgcaggtatggtcggaaccctcagaccttctggaaatacccgtctcaggtgccgctgacaatctgagcccaagtcagaataaatccgattccgggacggcaagccacctgcaggactatgctgtggaaaatcttattagaatgggcatggctggactgattctcgtggtgcttggcatcctcatctttcaggattggcattcacagcgctccccccaggccgccgccggccggtag

SEQ ID NO: 8943 - DNA, 438 bp, Artificial Sequence
  Description of Artificial Sequence: Synthetic coding sequence
atgggcatcggctgctggcggaaccccctgctgctgctgatcgccctggtattgagcgctaaactgggccactttcagcgttgggagggatttcaacaaaagctgatgagtaagaagaacatgaactcaacacttaacttttttatacagtcctataataacgcctcaaacgatacctacctttacagggtacagaggctgattcgatctcagatgcaattgacgactggggttgagtatatagtgacagtcaaaatcgggtggactaaatgtaagcgcaatgacactagcaactcctcatgcccacttcagagtaagaagctgaggaaaagtctcatctgtgaaagccttatctacacaatgccctggatcaactatttccagctgtggaataactcttgcctcgaggctgagcacgtcggccgaaacctcagatag

SEQ ID NO: 8944 - DNA, 1776 bp, Artificial Sequence
  Description of Artificial Sequence: Synthetic coding sequence
atgcagcaggacggcctgggcgtgggcacccggaacggcagcggcaagggccgatctgttcacccttcatggccgtggtgtgcacccaggccgctcagatacttcggcagagacgcaagggcccggcgggcccagaccgctgcgatggccttggctatccaggttaccgtgtcaaacccctatcacgttgtcattctcttccaacctgtgaccctcccatgtacctatcagatgacatctacgcccacacagccaatcgttatatggaaatacaagtctttctgcagagacagaatagcagatgctttctccccagcctccgttgacaaccagctgaacgctcagctggcagctggtaaccccgggtacaacccttacgtggaatgccaggactctgtgcgtactgtgcgggtggtggccaccaagcaggggaacgcagtcaccttaggtgactactaccagggcaggaggattacaatcactggtaacgcagatctgacatttgaccagacagcctggggcgacagcggcgtgtattattgcagcgtggtcagtgcccaggacttacagggtaacaatgaagcttacgccgaactcattgtcctagggcgtaccagtggggtggcggagttactgcccggcttccaggccggccctattgaagattggttgtttgttgttgtggtttgtctcgctgcatttttgatctttctcctgctgggaatttgttggtgtcagtgttgtccacacacctgttgctgttacgtgcggtgcccctgctgcccagacaagtgttgctgtcctgaggcactgtatgccgcaggaaaagccgccacttccggtgttccctcgatatacgccccatccacctatgcgcacttgtcgccagctaagaccccgcctccaccagcaatgatccctatgggacctgcctacaacggttacccaggcggataccccggagacgtagatcgcagttcctccgtcaggagcggatacaggatccaagcttcccaacaagatgattccatgcgggtactctattacatggagaaggaactggcgaacttcgatccgtctcgccccggacctccgagcggacgcgtcgagcgtgccatgtcagaagtgaccagccttcatgaagatgattggaggtctcgcccatctcgcggtccagccctgactccgattagagacgaggagtggggtggacattccccccgctcaccgcgtggttgggatcaggagcccgccagggaacaggccggcggtgggtggagggccagaagaccccgcgccaggagtgtagacgcactcgacgacctgactcctcctagcactgctgagtcaggttcacgctcccctacgtctaatgggggccgttctcgcgcctatatgcccccccgctcccgcagcagagacgatttgtacgaccaagatgactctcgtgattttccccgatctcgcgatccccactatgacgattttcgaagcagggagagacctcctgccgacccaaggtctcatcatcaccggacgagggatcctcgcgataatggttctcggagcggggatcttccttatgacggccgcttattagaagaagccgtgagaaagaagggcagtgaagagaggagaaggccacacaaagaggaggaggaagaggcttattatcccccagccccacccccgtactcagagactgattctcaggcctcaagagaaagacggctgaaaaagaatttggcattgtccagagagtcactcgtagtctag

SEQ ID NO: 8945 - DNA, 678 bp, Artificial Sequence
  Description of Artificial Sequence: Synthetic coding sequence
atgaaccggtgcccccggcggtgccggagccccctgggccaggccgcacggtccctctaccaactggttaccgggtctttgagtccggatagcgtggacgatgagttcgaacttagtactgtctgtcacaggcccgaaggcctcgaacaactacaagaacagacaaaattcactcgaaaggaactgcaagtgttgtaccggggattcaaaaacgagtgcccctcaggcatcgttaatgaggaaaactttaaacagatctactcacagttctttccacagggagattcctcgacatacgccacgttccttttcaatgcctttgacaccaaccatgacgggtcagtgagttttgaagacttcgtcgctggactcagcgtgattctaaggggcaccgtggatgaccggttgaattgggcttttaatctctatgatctcaataaagatggttgcattacgaaagaggagatgctggatatcatgaagtcaatatacgatatgatgggcaaatatacctacccggccctgcgggaagaagctcctcgcgagcatgtcgaaagcttttttcagaaaatggaccgcaacaaggatggagtggtgaccatagaggaatttattgagtcttgccaaaaagatgaaaacatcatgcggagtatgcagttgttcgacaacgtgatctag

SEQ ID NO: 8946 - DNA, 705 bp, Artificial Sequence
  Description of Artificial Sequence: Synthetic coding sequence
atgcccgccagcagccccttcctgctggcccccaagggcccccccggcaatatgggtggacccgtcagggagccagcacttagcgtcgctctgtggcttagctggggcgccgctctcggggccgtggcttgtgccatggccctgctgacccagcagactgagttgcagagcctgagacgggaagtatccagactgcaaggcacggggggccctagtcagaatggggagggatatccgtggcaaagcctgccggagcagagttcagacgccctagaggcctgggagaatggagaaagatcacggaagcggcgggccgtgcttacccagaaacagaagaacgactctgacgtcacagaggttatgtggcagcctgctcttaggcgggggcggggcctgcaggcccagggttatggggtgagaattcaggatgcaggggtttaccttctatattcgcaggttctcttccaagacgtgacctttacaatgggccaggtggtttctcgggagggacagggtcgacaggaaaccctgtttcgctgcatacgctccatgccttcgcatcccgaccgcgcctataattcctgctattctgctggggtttttcacctgcaccagggcgatattctcagcgtaatcattccccgcgctagagctaaactgaacctcagcccacatggtaccttcctaggctttgtaaagctgtag

SEQ ID NO: 8947 - DNA, 2400 bp, Artificial Sequence
  Description of Artificial Sequence: Synthetic coding sequence
atgaagcccatgctgaaggacttcagcaacctgctgctggtggtgttgtgtgattacgtcctcggggaggcggagtacctgctcctaagagagcccggccacgtcgccctgtcgaacgacacagtatacgtcgacttccagtacttcgatggggccaatggaacccttcgcaacgtctcggtgctgttactcgaagcgaacacaaaccagaccgtcactactaagtacctgctgacgaatcagtctcagggcaccctcaaatttgaatgcttttactttaaagaggccggcgactattggttcacaatgactcccgaagccaccgacaattcaactccattcccatggtgggaaaagtccgcctttctgaaagttgagtggcccgtctttcacgtcgatttaaacaggtctgccaaggcagccgaagggaccttccaggtcggcctttttacttcacaacctctttgtcccttcccggtggacaaacctaatatagttgtggatgtcatctttaccaatagtttgcccgaggctagacgcaattccaggcagcccctggaaattcgtacgagcaaacgaacagaactggctcaaggccagtgggtagaattcggttgcgccccactgggtccagaggcttatgtcacagtcgtgctcaagctcttggggagggactctgtaatcactagcacagggccaatcgatctagcccagaagttcggttacaagctggtaatggtgcccgagttaacttgcgagtctggggtagaggtgaccgtgctaccacctccctgtacattcgtgcagggagtagtaacagtctttaaagaagccccccggtacccaggaaagaggaccattcatcttgcagagaattcattacccctgggtgagcggcgaacgatttttaactgtaccctgtttgacatgggcaaaaacaaatattgcttcgactttggcattagttcccgaagtcacttttcagccaaagaggagtgtatgcttattcagagaaatacggcttttcaacccagctcgccttctccactccaacctcagggcccggtcaaatctaacaacatagtcacggtgactggcattagtctctgcttattcatcataatagcaaccgtgctcattacactgtggcgacgcttcggacgacccgccaagtgtagtacccccgcccgccacaacagcattcactcccctagctttagaaagaactctgacgaagagaatatttgtgagttatcagaacagcgaggctcttttagcgacgggggggatggaccaaccggcagccctggggacaccgggatacctcttacctatcggcgttcagggcctgtgccacctgaagacgatgcaagcgggagcgaaagttttcaatcaaacgcccaaaaaatcatcccaccgctattcagttaccggctcgctcaacagcagctgaaggagatgaagaagaagggcttgaccgagacaacgaaagtgtatcacgtctcccagtctcccctcaccgacaccgccattgacgccgccccctctgcccctctggatctggagagtcccgaggaagcagcagcaaataagttccggataaagtcacctttccccgagcagcccgcggtcagcgcaggggagcggccaccttccaggctggacctaaacgtaacacaggcctcgtgcgctatatcccccagccagactttaattaggaaaagtcaggcccgtcatgtgggatctcgcgggggcccaagcgagagatcacacgccagaaatgcgcattttaggcgcactgccagcttccacgaggcccgccaggccaggccatttagagagcggtccatgtccacattgactccccggcaggcgcccgcttactcatcacgtactagaacctgcgaacaagccgaggatagatttcgtccccagtcacgcggcgctcatctgttcccagaaaaattagagcattttcaggaggcatccggaacccgggggccgctgaaccccctgccaaagtcctatacgctcgggcaacctttgcgcaagccagacctgggcgatcaccaggctgggctggttgcaggtatcgaaaggacggaaccgcatcgagcccggagagggccgtccccctctcataagagcgtgagtcggaagcagtcttctccaatctcccctaaagacaactaccagagggtgagttctctgtccccctcacaatgcagaaaggacaaatgccaatcctttccaacacatcccgaatttgccttctatgacaatacgagtttcggtctaaccgaagccgaacagcgaatgctggacttgccgggttacttcggctctaatgaagaggatgagacaacgtctacgctctccgtcgaaaagctggtgatctag

SEQ ID NO: 8948 - DNA, 927 bp, Artificial Sequence
  Description of Artificial Sequence: Synthetic coding sequence
atgcggctgctgcccgagtggttcctgctgctgttcggcccctggttactgaggaaagcagtgagtgcccagattccagagtccgggaggcctcagtaccttgggctgcgccctgcagcagctggggcgggggcccctggccagcaactgccagaacctaggtcctccgacgggttaggcgtaggtcgtgcctggagctgggcctggcccaccaaccataccggtgcgctggctagagcaggagcggcaggggccctgcccgcacaaagaacaaaacgcaagccaagcataaaggccgctcgcgccaaaaaaatcttcggatggggcgacttctatttcagagtccatactctaaaattttcattactggtaaccggaaaaatcgttgatcatgttaacggaacattctccgtgtacttcagacataatagtagctcccttgggaacctgtccgtgtctatagtgcctccttccaaacgagtggagttcggcggagtttggttgccaggtcctgtcccacacccccttcaaagtacgctagccctcgagggagttctccccgggttaggacccccattgggtatggccgccgccgccgccggacctggactcgggggaagcttggggggcgccctagctggaccactgggcggagccctgggggttcctggcgcaaaggagtcgagagccttcaattgccacgtcgaatacgagaagacgaacagggcacgaaagcacagaccctgcctttacgacccttcgcaagtgtgtttcactgaacatacccagagtcaggccgcctggctttgcgcaaagcctttcaaagtaatctgtatctttgtatcattcctgagcttcgactacaagcttgtccagaaggtttgccctgattataatttccagagcgaacacccttactttggatag

SEQ ID NO: 8949 - DNA, 795 bp, Artificial Sequence
  Description of Artificial Sequence: Synthetic coding sequence
atgaagctgggctgcgtgctgatggcctgggccctgtacctgagcctgggcgtcctttgggtggcgcagatgctcttggccgctagctttgaaacactgcagtgcgagggcccagtgtgcactgaggaaagttcctgccataccgaggatgacttgacagatgccagggaagctgggttccaggtcaaggcatacactttttccgaacccttccacctcatagtgagttacgactggctgatcctgcagggacccgcaaagccagtgtttgagggggacctcttggtgctgcgctgccaggcatggcaagattggccactaacccaggtaactttctaccgggatggcagcgctttagggccgcccggccctaatcgggagttttccatcaccgtggtgcaaaaggccgattccggccattaccattgttctgggatctttcagtctcctggtccaggaattcctgagacagcttctgttgtggccataacagttcagggtgcctccagctccgcggcccccccgaccttaaaccccgctccacaaaaatctgccgcaccaggaaccgctccagaagaggctccagggcccctccccccaccccccaccccgtctagcgaagatccgggtttctccagccctttgggaatgccagatccgcacttgtatcaccagatggggctgctgctaaagcatatgcaggatgtcagagtgttgttgggacatctgctgatggaattacgggagctctcaggccatagaaagccagggacaactaaggccacagccgaatag

SEQ ID NO: 8950 - DNA, 1362 bp, Artificial Sequence
  Description of Artificial Sequence: Synthetic coding sequence
atgctgcggatcctgtgcctggccctgtgcagcctgctgaccggcaccagagctgacccaggggcactcttaagactaggtatggatattatgaatcaggttcagtcagctatggacgaatctcacattctcgaaaagatggcagccgaggccggcaagaaacagccgggcatgaaaccaattaagggcattacgaatctcaaagttaaggacgtgcagctacctgtgattacgcttaactttgtgcctggtgtaggcatttttcagtgcgtgagcacgggcatgacagtcaccgggaaatctttcatgggcggaaatatggaaattattgttgccttgaatataactgcaactaaccggctgctaagagacgaggagactggactgcccgtgttcaagagcgaagggtgtgaagtgattttggtcaacgtaaaaaccaacctgcccagcaacatgttaccaaagatggtcaataagtttctggacagcacgctccataaggtcctgccaggattgatgtgtcctgcgatagacgccgtactcgtctatgtcaacagaaaatggaccaatctcagcgaccccatgccagtggggcagatgggcaccgttaagtatgtgttgatgtctgctcccgcaactaccgccagttacattcagcttgacttctctccagtcgtgcagcagcagaaagggaaaaccataaaactggccgacgcaggtgaggctttgacctttcccgagggttatgccaaaggctcaagccagctcttactgccagcgacattcctgagcgccgaattggccctgctacagaagtccttccacgtcaatattcaagataccatgataggtgaactaccaccgcaaacaactaaaacgttggcaaggttcatcccagaggtggccgtggcttacccaaaatctaagccccttaccactcagatcaagataaaaaagcctcctaaagtgactatgaagacaggtaagtccttgctgcacctacactcaacgcttgaaatgtttgctgccaggtggcgcagcaaagctcctatgtctttattcctgctagaagtgcatttcaatctgaaagtacaatacagcgtccatgagaaccagcttcagatggccacttctcttgaccggcttctgtcactgtcccgcaaatcaagcagcataggcaactttaacgagcgcgagcttaccgggtttattacatcttatcttgaagaggcctatattccagtggtgaatgacgtcctccaggtggggttacctctgccagatttcctagccatgaactacaatctggccgagctggacatagtcgaaaacgccctcatgctggatctgaaattgggctag

SEQ ID NO: 8951 - DNA, 1323 bp, Artificial Sequence
  Description of Artificial Sequence: Synthetic coding sequence
atgagcgcccggggccggtgggagggcggcggccggcgggcctgcaggggctctcttggactcgctcgagcccagggagccgagagagtaacctcaagcgagcagagacctgcaatggcctccttaggactcctcctactcctgctgctcacagctcttccccctttgtggagtagttctttgccaggcttagacacagcagagagcaaggccactatagcagatctgatcctatcagcactggagcgggcgactgtttttctggaacaaaggctccctgaaattaatctggatggaatggtgggcgtcagagtgttggaggagcagctcaagtctgtgcgggaaaaatgggcgcaagagcccttgcttcagcccctctccttgagggtcgggatgctaggggagaaactggaggcggcaattcagagatccctccattatctcaaacttagcgaccccaaataccttagggaatttcagttaacactacagccgggcttctggaagctcccgcatgcatggatacatactgatgcctctctagtttacccaaccttcggcccacaggatagcttcagtgaagaaagaagcgacgtgtgcctggttcaacttctcggtacgggaactgactctagcgaaccatgcggcctgagtgacttatgccgttctctgatgaccaaacctggttgcagtggatactgtctgagccatcagctgttatttttcctatgggccaggatgagaggatgcacgcagggcccactgcagcagtcccaggattatataaacctgttttgcgcgaacatgatggatctgaaccggcgagcagaagccattgggtacgcctaccccacccgtgacatctttatggagaatattatgttttgtggcatgggtggcttttctgatttctacaaactgagatggctagaggccattctatcttggcagaaacagcaggagggttgtttcggagagcccgacgcagaggacgaggagttatccaaggcgattcaataccagcagcacttttctcgccgcgtgaaacgtcgagagaaacagttcccagattctcgctcagtagcacaggctggcgttcagtggcgaaatctaggaagtttgcagccgctccctcccggtttcaagcagttttcttgcctgattctgcccagcagctgggactacagaagcgttccaccatatttggcaaacttctacatttttttagtagagactggtttccaccatgtcgcgcatgcgggtctcgagcttcttatcagccgagacccaccaacgagcggcagccagagtgtgggcctgtag

SEQ ID NO: 8952 - DNA, 708 bp, Artificial Sequence
  Description of Artificial Sequence: Synthetic coding sequence
atgaagtacgtgttctacctgggcgtgctggccggcaccttcttcttcgctgacagcagtgtgcagaaggaagatcccgccccttatttggtttacttaaaatcccacttcaacccctgcgtaggtgtgctgattaaaccaagctgggtactggctccggcccattgttacctgcctaatctgaaggttatgctcggaaattttaaaagtcgcgttcgtgacggaaccgagcagaccattaatcctattcagattgtgaggtattggaattatagtcatagcgcacctcaagatgatctcatgttgatcaaactcgccaagcccgctatgctgaacccaaaggtacagcctctgacactggccaccaccaatgtacgtcccggtactgtgtgcctgctgtccgggctggattggtcccaggaaaatagcggtagacaccctgacctgaggcagaatttggaagctccagtcatgtctgatagggaatgccagaaaactgaacaagggaaatcccataggaactccctgtgtgttaagttcgtgaaagtcttctcacggatctttggcgaggtcgctgtggctaccgttatctgtaaggacaagctccaaggcatagaggtgggccactttatggggggggatgttggtatttatacgaacgtgtacaaatacgtgagctggatcgagaataccgctaaagataaatag

SEQ ID NO: 8953 - DNA, 426 bp, Artificial Sequence
  Description of Artificial Sequence: Synthetic coding sequence
atgctgaagaagatcagcgtgggcgtggccggcgacctgaacaccgtgacgatgaagctcggttgcgtgctaatggcctgggcgctatacctctccctgggtgtactctgggtggcccagatgttgctcggggcttcatcctccgccgcaccgccaacactgaatcctgcacctcagaaaagtgcggctcctggcacggcccctgaggaagcgcccggcccattacctccaccccccactccatctagcgaggatcctggcttttcaagccctctggggatgccagaccctcacctgtatcaccaaatggggctcctgctgaagcacatgcaggacgtcagagtgctattaggacatttgctgatggagctgagggaactctcgggccaccggaagccgggaaccacaaaagccacagcagagtag

SEQ ID NO: 8954 - DNA, 2886 bp, Artificial Sequence
  Description of Artificial Sequence: Synthetic coding sequence
atgctggccccccggggcgccgccgtgctgctgctgcacctggtgctccagagatggctggctgctggagcacaagccaccccccaagtcttcgatctgttaccgtcctcaagccagagactgaatcccggcgccctcctgcctgtcttaactgaccctgcccttaacgatctgtacgtaatttctacctttaaactgcagaccaagtcaagcgccaccatatttggcttatacagctcgacggacaattccaagtactttgagttcactgtcatggggcgtttaaacaaagccatactgaggtacttgaagaacgatgggaaggttcatctagttgtgtttaataacttacaactggcagacggtaggcgacataggattctgcttcggctctctaacctccagaggggcgcgggctctttggagctttaccttgattgtatccaagtggatagcgtgcacaatctgccaagggcttttgctggaccctcccagaagcccgagacaattgagcttagaacctttcagaggaagcctcaggacttccttgaggaacttaagctggtagtacgtgggagtcttttccaagttgcttcgctacaggattgttttctgcaacaatcagaacctctggctgccacaggaacaggcgactttaatcgtcagttcttgggccagatgactcagctgaaccagctcctcggggaagtgaaggacctcctgcgacaacaggttaaggaaacgtctttcctgcgcaacactatcgcggagtgccaggcctgcggacccctgaagtttcagagcccaacgccgtctactgtcgttccaccagcacctcccgcacccccaacacgcccgccaaggcgctgcgattcaaacccttgcttccgcggcgtccaatgtacagattctagggacggatttcagtgcggcccttgccctgaaggctacaccggaaatggcattacctgtatcgatgtggacgaatgcaaataccatccttgctaccctggagtacattgtattaacctgtctccaggctttcgctgtgatgcctgtccagtgggtttcacaggccctatggtgcaaggggtcggtatatcctttgccaagtcaaacaagcaggtttgcaccgacatcgacgaatgccggaatggtgcatgtgtgcctaacagcatctgcgtgaatactctcggctcctatcggtgcgggccttgcaagcccggttacacaggtgaccagatccgggggtgcaaggcagaaaggaattgcagaaatcctgagctcaacccatgcagtgtaaacgcgcagtgcatcgaggaacgccagggagatgtgacgtgtgtttgcggtgtggggtgggccggcgatggatatatatgcggcaaggacgtggatattgactcatacccggacgaggagcttccatgttccgcccggaactgcaagaaagataactgcaagtacgttcccaactcagggcaggaggacgctgatagggacgggattggggatgcttgtgatgaagatgcagatggcgacggtattcttaatgaacaagataactgcgtcttgatccacaacgtggatcagcgaaacagcgataaggatatcttcggcgatgcgtgtgataactgcctatctgtgttgaataacgatcagaaagatacagacggagatggcagaggggacgcttgtgatgatgacatggacggtgacggtattaagaacatcttggacaattgtcccaagtttccgaatcgggatcagcgagataaagatggcgacggagtcggtgatgcatgtgactcctgcccggacgtttctaaccctaatcaatcagacgtggataacgacctggtgggcgactcatgtgacacgaatcaggatagcgatggtgacgggcatcaggactctacggataactgccctacagttattaactcagcacagctggataccgacaaggatggaattggggacgagtgtgacgatgatgacgataatgacgggatcccggatctggtcccgccagggccagataactgcagactcgtgccaaatcccgcgcaggaagatagcaattcagacggggtgggagacatatgtgagtccgacttcgaccaagatcaggtgatcgatcggatcgatgtgtgcccggagaacgctgaggtgacattgaccgatttccgtgcgtaccaaacggttgtgctggatcctgaaggagacgcccaaatcgaccctaactgggtggtgctgaaccagggcatggaaatcgtgcagacaatgaacagcgaccctggtctggcggtgggatacacagcattcaatggtgtcgatttcgaagggacctttcacgtgaacacccagactgacgatgactacgccggtttcatctttggataccaggacagtagcagtttttatgtggttatgtggaaacagactgagcaaacttactggcaagcaacaccattcagagctgtcgccgagcccggcatccaacttaaagccgtcaagagcaaaaccggaccaggggagcacctgcgaaatagcctgtggcatactggagatacatccgaccaagtgcggctactgtggaaggactccaggaatgtggggtggaaagataaggtgagttaccgctggttcttgcaacatcgccctcaggtgggctatatccgcgtccggttctacgaagggtcagaactcgtggccgattctggagttaccatagacacaacaatgcgcggcggacgccttggagtgttttgtttctcacaggaaaatataatctggtctaatctgaaataccggtgcaatgatacgatacctgaggatttccaagagttccagacccaaaactttgaccgattcgacaattag

SEQ ID NO: 8955 - DNA, 300 bp, Artificial Sequence
  Description of Artificial Sequence: Synthetic coding sequence
atggacaacgtgcagcccaagatcaagcaccggcccttctgcttcagcgtcaaaggccacgtcaaaatgttgcggctggatattattaactctttggtaaccactgttttcatgctgatcgtgtcagtcttggcgctcatacccgaaacaacgaccctgacggtgggtggaggagttttcgcgctggtgacagcggtgtgctgtctggccgacggggccctgatctataggaagctgctgttcaaccctagcggcccatatcagaaaaaacccgtgcatgagaagaaagaagtactctag

SEQ ID NO: 8956 - DNA, 408 bp, Artificial Sequence
  Description of Artificial Sequence: Synthetic coding sequence
atgagcccccacctgaccgccctgctgggcctggtgctgtgcctggcgcagaccatacacacccaggaaggagcactcccaagacctagcatttccgccgaacctggaaccgtcatctcccctggttcacacgtgacttttatgtgtcgcggacccgtcggtgtccagactttccgactcgagagggaagatcgggccaaatataaggactcttacaatgtgtttcgccttgggccttctgagagtgaggccagattccacatcgatagcgtgtctgaagggaatgcagggctgtaccgttgtctgtactataaacctcccggatggtcagaacattcggatttcctggagctgctggtgaagggaacggtgcccggcaccgaagcaagcggattcgatgcgccatag

SEQ ID NO: 8957 - DNA, 231 bp, Artificial Sequence
  Description of Artificial Sequence: Synthetic coding sequence
atgctgccctgcctggccctgctgctgctgatggagctgagcgtgtgcaccgtggcgggggacggtggggaggaacaaacactgtctacagaagcagagacttgggaaggcgctggccccagcatacagctacagctccaggaagtgaaaacgggcaaggcctctcagttctttgggcttatgggcaaacgggtgggcggtagagaagacgaagcccaggggagcgagtag

SEQ ID NO: 8958 - DNA, 684 bp, Artificial Sequence
  Description of Artificial Sequence: Synthetic coding sequence
atgcggggccagggccggaaggagagcctgagcgacagccgggacttggatggctcgtacgaccaattgactgatagcgtggacgatgagttcgagctgagcaccgtctgtcacagaccggaaggcctcgaacagctccaagaacagacaaagtttaccagaaaagagttgcaggtactgtatcgggggtttaaaaatcctggcgcgctgtctttccaggaatgcccatccggaatcgtcaacgaagaaaacttcaagcagatctattcgcagttctttccacagggagatagttccacttacgcaacattcctttttaatgcatttgataccaatcacgacggttcagtctcatttgaagacttcgtcgccggtctgtctgttatcctgcgcggcaccgtggacgatcgtctgaactgggcatttaacttgtatgaccttaacaaggacgggtgcattacaaaagaagaaatgctcgatatcatgaagtctatctacgacatgatgggaaaatacacgtaccccgctctccgagaagaggctccacgagagcacgtggaatcgtttttccagaagatggaccggaataaggacggcgtcgttacaatagaggaattcatcgaaagttgtcagaaggatgaaaacatcatgaggtcgatgcagttgttcgacaatgtgatatag

SEQ ID NO: 8959 - DNA, 876 bp, Artificial Sequence
  Description of Artificial Sequence: Synthetic coding sequence
atgatgagcgccaccggccccggccggaagatgggcagccggggccagggcctgctgttggcctactgtttactcctcgcttttgcatctggcctagtcttaagccgcgtgccccacgtccagggcgagcagcaggagtgggagggcacggaagagttgccctctccaccagatcacgcggaacgagccgaagaacaacatgaaaaatatagacctagccaagatcaggggctcccagcatcacgttgcctgcggtgttgtgacccaggcacatccatgtaccctgctaccgcagtgccccagattaatattacgatcctgaagggagaaaaaggcgacaggggtgaccggggactgcaggggaagtacgggaagaccggatccgctggtgcacggggccatacggggcccaagggtcagaaggggtcaatgggcgcacctggagagcgatgcaagtcacattatgctgccttcagcgtcggcaggaaaaaaccaatgcacagtaaccactactatcagactgtcattttcgatacagaattcgtcaatctgtacgaccacttcaacatgttcacaggtaaattttattgctacgtacccggcctgtattttttctcactgaacgtccacacctggaaccaaaaagagacctacctacacatcatgaagaatgaagaggaagttgttatcttatttgcacaggtgggcgatcgttccataatgcaaagccagtcactgatgctggagctgcgggagcaggaccaggtgtgggtccggctatacaaaggggagcgagaaaacgctatctttagcgaggaactggacacgtatattaccttcagtggatacctagtcaaacacgctacagagccatag

SEQ ID NO: 8960 - DNA, 213 bp, Artificial Sequence
  Description of Artificial Sequence: Synthetic coding sequence
atggagcggggcgccggcgccaagctgctgcccctgctgctgctgctgagggcaacaggtttcacatgtgcccagactgatgggcgcaatgggtacaccgcggttattgaagtgacttctggaggaccatggggggattgggcttggcctgagatgtgcccagacggctttttcgcttccgggttctcgctcaaattaggtcgcatggaatag

SEQ ID NO: 8961 - DNA, 402 bp, Artificial Sequence
  Description of Artificial Sequence: Synthetic coding sequence
atgggcagcagcggcctgctgagcctgctggtgctgttcgtgctgttggctaacgtacagggcccagggctgacagattggctattcccccggagatgcccaaagatccgggaggagtgcgaattccaggaaagagatgtgtgtaccaaggatcgtcagtgtcaggataacaaaaaatgttgcgtgttcagctgtggaaagaaatgcctggacctcaagcaggacgtgtgtgagatgcctaaggaaacagggccttgcttggcctatttcctgcactggtggtatgacaaaaaagataatacttgctctatgtttgtctatggtggttgtcaagggaataataacaactttcaatcgaaggccaactgcctgaacacatgcaagaataagcggtttccatag

SEQ ID NO: 8962 - DNA, 771 bp, Artificial Sequence
  Description of Artificial Sequence: Synthetic coding sequence
atgttccagaccggcggcctgatcgtgttctacggcctgctggcccagacaatggctcagttcggtgggctgccagtccccttggatcagactctgccgcttaatgtcaaccccgccttgcctctgtcccctaccggcctcgccgggagcctgactaatgctctgtctaatggattgctgtccggaggacttcttggcatcctagaaaacctacctctcttggatattctgaagccaggcggtgggacatcggggggactgctgggcggtctcctcggtaaggtgactagtgtgatacccgggctcaacaatattatcgacattaaagtaacggacccgcaactgcttgagctgggattagtgcaatcccccgatgggcaccgcctgtatgttacaattcctctgggtatcaagttgcaggtcaatactcctttggttggcgcttctctgcttcgactagcggtgaagctggacatcaccgctgagatcttagccgttcgcgacaagcaagaacggatccacctagtgctgggcgattgcacacattctcctggatccctgcagatcagtttgctggacggcttgggacctctgcctatacagggccttttggattcacttacaggaattcttaataaagtgctccctgaactggtacagggtaatgtctgccccctggtgaacgaggtgcttagaggtctggatatcacactcgtccacgacattgtaaatatgctcatccatggtttacagttcgttataaaagtctag

SEQ ID NO: 8963 - DNA, 1386 bp, Artificial Sequence
  Description of Artificial Sequence: Synthetic coding sequence
atgagcctggacatccagagcctggacatccagtgcgaggagctgagtgatgcacgctgggcagaactcttgcctttgctacagcagtgtcaggtggtgagattggacgattgcgggctgaccgaggctcggtgcaaagatattagctcggccctcagagtgaatcctgcactggctgagttgaatttgcgatctaacgaactgggggacgtaggcgtacactgtgtgttgcagggtttgcagaccccttcttgcaagatccagaaactgtccctgcagaactgctgcctgaccggcgctggctgtggcgtgctgtcttccacgcttaggaccttgcctactctgcaggaacttcacctcagcgataacttactgggggatgcggggctgcagctgttatgcgaggggctcttggatccacagtgccgcctggaaaagctgcaactcgaatattgttcgctgagcgcagcatcttgcgaacccctggcgagtgtgctccgagcgaaaccagactttaaggagcttaccgtgtcaaataacgatattaatgaggccggggtacgcgtcttgtgtcagggcctcaaggacagcccttgtcagctcgaggcattgaaactggagtcttgcggagttacaagcgataattgtcgagatctttgcgggattgtagcctcgaaggcttccttgcgagaactggctttgggtagcaacaagcttggggacgtcggcatggctgaactgtgcccaggcctcttacacccttcaagccgcctccgaaccctgtggatctgggagtgcggcatcacggctaaaggctgcggggatctttgcagagtgctgcgtgctaaggaatccctcaaagagttgagcctggctggaaacgaactgggagacgagggggctcgcttgctgtgcgaaacattgctggagcccggatgccagctggaaagtctatgggtcaaatcttgtagtttcactgctgcttgttgcagtcattttagcagcgtgttagcccagaatagattccttctcgagctacagatatcaaataacagacttgaggacgctggagtgagagaattgtgccaggggctgggacagccaggaagcgtgttaagggtgctgtggctggccgattgtgatgtgagtgacagttcttgttcaagcttggcagccactctcctggctaaccactcccttcgtgaactggacctttcaaacaattgtctgggcgacgctggcattctgcagctagtcgaatccgtgagacagcccggatgccttctggagcagcttgtcctctacgatatatactggtccgaagagatggaagatcggttacaggccctggagaaagataaaccttccctgcgggtaatcagctag

SEQ ID NO: 8964 - DNA, 534 bp, Artificial Sequence
  Description of Artificial Sequence: Synthetic coding sequence
atgcggctgctgatcctgacctgcctggtggccgtggccctggccaggccaaaactccccttgcggtacccagagcgactccaaaatcctagcgagagctctgagccaattcccctcgaatcccgagaggaatatatgaatggtatgaacaggcagcgcaatattcttagggaaaaacagactgacgaaattaaaaactgcgttgtggcagagccagagaaaatggagtctagtattagctcaagctccgaggaaatgtctctctctaagtgcgctgagcagttctgccgactcaacgaatacaaccagcttcagctgcaaaaaatgtccaagcaggaacagatccgcaggatgaatgaaaacagccacgtgcaggtgccttttcagcagctaaatcagctcgcagcctatccttatgccgtttggtattatccacagatcatgcaatacgtgcccttcccccctttctccgacatctccaaccctaccgcgcacgaaaattacgaaaaaaataatgtgatgctgcagtggtag

SEQ ID NO: 8965 - DNA, 3054 bp, Artificial Sequence
  Description of Artificial Sequence: Synthetic coding sequence
atggacctgatccggggcgtgctgctgcggctgctgctgctggcctcatcgctgggaccgggtgcggtttctctgcgagctgccatcagaaagccaggcaaagtgggccccccactcgacatcaagttgggggctctaaactgtaccgccttttcaatccagtggaagatgcccagacacccaggatcccctatactcggctataccgtcttttattctgaggttggcgctgataagtccctgcaagaacagctgcactccgtgcccctgagcagggacattcctaccacagaagaggtgattggcgacttgaaaccaggaacagagtaccgtgttagcatcgccgcatattctcaggcaggtaaaggacgcctctcttccccacgccacgtaaccaccttgtcacaagacagttgcttgcctcctgctgcacctcagcagccccacgttattgtggtgtccgacagtgaggtggccctcagttggaagccgggggcctctgagggctccgcaccaatacagtactatagtgtcgagtttatcagacctgatttcgataagaagtggacaagtattcatgagcggatccagatggactcaatggtgattaaggggctggaccccgacacgaactaccagtttgccgtgcgtgcgatgaattcacatggacctagccccaggagttggccctccgacatcatccggacattgtgccctgaggaggcgggcagcgggcgttacggcccccggtatatcacagatatgggcgccggcgaggatgatgaagggttcgaagacgacctcgacctggacatatcttttgaggaggttaagcctctgcctgccacaaaaggtggcaataagaagttcttggttgagagcaaaaagatgtctatttcgaatcctaaaacaatttcacgcttaatccctccaacgagtgccagcctgcccgtgaccaccgtcgcgcctcagcccatccctatccagagaaaaggcaagaatggggtggccataatgtcccgcctgtttgatatgccctgtgatgaaaccctgtgttccgccgattctttttgcgttaacgattacacatggggaggatcccgatgtcagtgtactttgggaaaagggggggaaagctgtagcgaggatattgtgatccagtaccctcagttcttcgggcacagctacgtcactttcgagcctttaaaaaattcctatcaggcttttcagatcactttggaatttcgggcagaggccgaagatggcctgctcctgtattgtggcgaaaatgagcatggtaggggggacttcatgtctctggcgatcatacgccggtctttgcagttcaggttcaattgcggcaccggagttgctattattgtcagcgagactaagattaagctgggtgggtggcacactgttatgctctatcgggacggtctgaatggactgctccaactgaataatggaacacccgtgacggggcagtcccaggggcaatatagtaagatcactttccggacccccctttatctgggaggtgccccaagcgcctattggttagtgcgggcgacagggaccaatcgcggattccagggttgtgtgcagtcactggctgtcaatgggaggcgaatagatatgagaccttggcctctgggcaaggcactgtccggagctgacgtcggcgaatgctcgtctgggatctgcgacgaagccagttgcattcacggggggacttgtacagcaatcaaagccgacagctatatttgtttatgtcccctcggcttcaagggccggcattgtgaggatgcattcaccctaaccattcctcagttccgcgagtctcttagaagctacgcagcgactccctggccccttgaaccgcagcattacttgtccttcatggaatttgaaattaccttccgacccgactccggcgacggcgttctgctgtactcctatgacaccgggagcaaggattttctttctatcaacttggcgggcggccatgtggagtttcgattcgattgcggttccggaacaggcgttttacgctcagaggaccctctcacactaggcaactggcacgaactgcgtgtcagcaggaccgcaaagaatggcattttacaagtggataagcagaaaatagtggaagggatggctgaagggggcttcacccaaataaagtgtaatactgacatctttatcgggggtgtccctaactacgatgatgtaaagaagaattctggcgttctgaagccgttttctggcagtattcagaaaatcatactcaatgatcgcactatccacgtcaagcatgactttaccagcggagttaacgtggagaacgcggctcacccatgcgtgcgcgctccgtgcgcccatggggggtcctgtcggccccggaaggagggctatgactgcgactgccccctggggtttgaggggctccattgtcaaaaggagtgtggtaactactgtctcaacaccattattgaagccattgagatccctcaatttattgggcgaagctatctcacctatgacaaccctgatattctgaagcgtgtttccggctcacggagcaacgtcttcatgaggtttaaaacaaccgccaaagacggactgctgttatggcgtggagattctcctatgagacccaactctgatttcattagtttgggactgcgagacggagcacttgtttttagctacaacctcggctccggagtagcttctataatggtgaatgggtctttcaatgacggcagatggcaccgagtaaaagcagtcagggatggccagtctgggaagattaccgtagatgactacggggccaggaccggaaaatccccagggatgatgcgacagctgaacatcaatggcgcgctctacgtcgggggcatgaaagagattgccttgcacaccaaccggcagtacatgcgaggactggtaggatgtattagccacttcacactgagcaccgattatcatatcagtcttgtagaagatgccgtagacgggaaaaacattaatacttgcggggcaaagtag

SEQ ID NO: 8966 - DNA, 1893 bp, Artificial Sequence
  Description of Artificial Sequence: Synthetic coding sequence
atgcagcaggacggcctgggcgtgggcacccggaacggcagcggcaaagggcgctctgttcatccaagctggccgtggtgcgcaccaagacccctaagatattttgggcgggatgcacgagcccgcagagcacagacagctgcgatggcgctgttggccggcgggctgtccagaggactcgggagtcaccccgcggctgcaggccgcgatgccgttgtctttgtctggctgctgctttccacctggtgcactgctcctgctagagccatccaggtgacagttagtaatccgtatcatgtagttatccttttccagcccgtgaccctcccttgtacctatcagatgacctctacccctacccagcccattgtcatatggaagtacaagtctttttgcagagatcggatcgcagacgctttttcacccgcctccgttgacaatcagttgaatgcacaattggccgccgggaatccaggatataatccctacgttgaatgccaggactcagttcgaacagtgcgcgtggtggcgaccaagcagggtaacgcagtcactctgggcgactattatcaaggaagacggatcaccattaccggcaatgccgacctgaccttcgatcagactgcctggggagacagtggtgtatattattgctccgttgtgagcgctcaggacctccaggggaacaacgaggcatatgccgagttgattgtactagactggctatttgttgtcgtggtgtgcctggccgcttttttgatcttcctgctgttgggcatatgctggtgtcagtgttgtccgcacacctgttgctgttacgtgcgatgtccttgctgccctgataaatgttgttgtccggaggccctctacgccgctgggaaagctgctaccagcggtgtgcccagcatttatgcaccatccacttatgcgcacttgagtccggccaaaaccccacccccccccgctatgatccctatgggcccggcttacaatggatatcctggcgggtatcctggagacgtcgatcggagtagctccgcaggagggcaaggttcctatgtgcccctcctgagggataccgattcttcagttgcgagcgaagtgcgcagtggctacagaatacaggcaagtcagcaggacgactctatgagagtcctgtactatatggaaaaggaattggcgaattttgatcccagccggcccggccctccgtcaggccgcgtggagcgggctatgtcagaggtgaccagccttcacgaggacgactggaggagtcggccaagccgcggccccgccttaacaccgatcagagatgaagagtggggcggtcactctcctaggtcaccccgaggttgggaccaggaacctgcccgagagcaagccggtgggggttggcgggccaggagaccacgagctaggagcgtggatgcattggatgaccttactcccccttccacggccgaatcagggtcacggtctcctacgtccaatggtggacggtccagagcatacatgccgccaaggtctcgttcgcgggacgacctgtacgaccaggacgatagccgggattttccacgtagtcgggacccacactatgacgatttcagaagccgcgaacgtcctccagccgatccacgctctcaccatcaccgcacaagagacccccgagataatggctcacggagtggggacctaccatacgatggacgactcctggaagaggccgtgagaaaaaagggaagcgaggaacgcagacggccccataaagaggaagaggaggaggcttactatccgcctgccccacccccctacagcgaaacagacagtcaagctagccgggagcggcgactaaagaaaaacttggcacttagcagggagtccttggtcgtctag

SEQ ID NO: 8967 - DNA, 750 bp, Artificial Sequence
  Description of Artificial Sequence: Synthetic coding sequence
atgctgcagctgtggaagctggtgctgctgtgcggcgtgctgaccgggacttcagagtcacttctggacaacctgggtaacgacctgagtaatgtggtagacaaactcgaaccagtcctgcatgaaggccttgagacagttgacaacactttgaaaggaatcctggaaaagctcaaggtggatctaggggtgctgcagaaatccagcgcctggcaattggccaagcagaaggcgcaggaggcggaaaagttgttgaacaatgtgatcagcaaactgcttccaaccaatactgacatctttggcttgaagatttctaactcactcatcctcgatgtgaaggcagagcccatcgatgatgggaagggcctgaacttgtctttccccgtgaccgccaacgtgactgtcgccggccccattattggtcagataattaaccttaaagcttctctcgacctgctgaccgccgtcaccattgaaaccgacccccaaactcaccagcctgtagccgtgctgggcgaatgtgcctcagatccaacgagcattagcctctctctcctagataaacattcacagattataaataagttcgtcaactctgtcatcaatacactgaagtcaaccgttagtagtctactccaaaaggagatatgtcctttgatacggatctttattcattctctggacgtcaatgtcattcagcaagtggtggataatccccaacataagacacagctccagacgcttatctag

SEQ ID NO: 8968 - DNA, 3057 bp, Artificial Sequence
  Description of Artificial Sequence: Synthetic coding sequence
atggtgagccacttcatgggcagcctgagcgtgctgtgcttcctgctgcttctcgggtttcagttcgtctgcccacaaccatcaactcagcaccgcaaggttcctcagagaatggccgctgagggcgctcctgaagacgacggggggggcggggccccaggtgtgtggggcgcctggggaccttggagtgcctgctcccggtcctgtagcggcggagtgatggagcagacccggccctgtctgccccggagctatcgtcttagaggcggccagaggcccggcgcacccgctagagcctttgccgatcacgtcgtgtctgcggttaggacatccgtccctctccaccggagtcgggatgagacccccgccctggctggcactgacgctagtcgtcaaggacccactgtcctaagggggagtcggcatccccaaccacagggactggaggtcaccggtgacaggcggtcacgtactaggggaacaatcggcccagggaagtatggttatggaaaagctccttacatcctacccctccagacggacacagcacacacccctcaaaggttacgccgccagaaactgagcagccgacactctagatcccagggggcctcaagcgcgaggcatggatatagctcccctgcacaccaggtgccacagcacggaccgctgtaccagagcgactccggtcctcgttccggactgcaggccgccgaagctccaatctatcagctacctttgacacacgatcagggttaccctgccgcgagcagtctgttccactctcctgagacgtccaacaaccacggcgtggggacgcatggcgccactcagtcattcagccagccagccagaagcacagcaatcagctgcatcggcgcctaccggcagtacaaattgtgcaatacaaacgtgtgccccgaatcctcacgcagcatccgcgaggtccagtgtgcttcttataacaacaaaccttttatgggccgtttttacgaatgggagccgtttgcggaggttaagggcaaccggaaatgtgagttaaattgccaggctatgggataccgattctatgtccgccaggcagagaaggttatcgatgggactccatgtgaccaaaatggaactgccatctgcgtgagtgggcagtgcaagtccatcgggtgtgatgactacctgggatctgacaaggtcgttgataaatgcggtgtctgtggtggggacaacactggctgccaggtggtctccggcgtctttaaacatgcactgacttctcttggctaccaccgcgtagtcgagattcccgaaggagctacaaagatcaatatcaccgagatgtacaagtccaataattacctcgctcttaggagtcgaagtggaaggtcaatcattaacggaaattgggctattgatcgccccgggaagtatgaggggggagggaccatgttcacctacaagcgcccaaatgagattagctcaacggccggtgagagcttcctagcggaaggaccaactaatgagattttggacgtctacatgattcatcagcaacccaaccctggcgttcattacgaatacgtaatcatgggcacgaatgcaatcagccctcaggtcccccctcatcgcagacccggagagccattcaacggacagatggtcacggaggggcggagtcaggaggaaggggaacagaagggaaggaatgaggaaaaagaggatctgcgcggagaggccccggagatgttcacaagcgagagtgcacagacttttccagtgcgtcatccagatcgcttcagtcctcatcgacccgataatcttgtaccccccgccccacagccacctagacgtagtcgggaccacaactggaaacaactggggacaaccgaatgctcaacaacttgcggcaaaggaagtcagtaccccatattcaggtgcgtgcatcggagcacccatgaggaggcacctgagagctactgcgacagcagcatgaaacccacacctgaagaggaaccttgtaatatttttccttgcccggctttctgggatatcggagaatggagcgagtgttccaagacatgtgggcttggaatgcagcaccggcaggtcttgtgccgtcaagtgtacgcaaatagaagcttgacagtgcaaccctataggtgtcagcacctggagaagccagaaactactagcacctgtcagctgaagatatgcagcgaatggcagatacggacagactggacttcttgcagcgtgccatgtggagttggccagagaacccgcgatgtgaagtgtgtaagtaatatcggagatgtggtggatgacgaagaatgtaacatgaaactgcgtccaaacgacatcgaaaattgcgatatgggaccttgtgcaaaaagctggtttctcaccgagtggtctgagagatgtagtgcagagtgcggggcaggcgtgaggacaaggtccgttgtttgtatgaccaaccatgtgtccagtctgccattggaaggctgtggtaacaatagacccgctgaagctactccctgcgacaacggcccatgtacgggaaaagtggaatggtttgccggaagttggagccagtgctctattgagtgcggcagcgggacccaacagagagaggttatctgcgtccgcaagaatgccgacacatttgaagtgctcgacccatctgagtgctctttcttggagaaacccccttcccaacaaagctgccatctaaaaccctgcggggctaaatggttctcaaccgaatggtccatgtgctctaaaagttgccaggggggatttcgcgtgagagaggtccggtgtctttctgatgacatgactctctccaacctctgcgatccccaactcaaaccagaggaacgggaatcctgcaatccccaagactgtgtgcctgaggtggacgagaattgtaaagataagtactacaattgcaatgtggtggttcaggcgcgactgtgtgtctataattattataagaccgcctgttgtgcgagctgtactcgcgttgccaatagacagacaggatttcttggcagccgttag

SEQ ID NO: 8969 - DNA, 1311 bp, Artificial Sequence
  Description of Artificial Sequence: Synthetic coding sequence
atgcagggcacccccggcggcggcacccggcccggccccagccccgtggataggcgcacactgcttgtcttctcctttattctcgccgcagcccttggacagatgaatttcactggagaccaggtcctacgcgtattagctaaggatgaaaaacagctgtctcttctaggtgacctggaaggcttgaaaccccagaaagtcgacttctggcgaggcccagctagaccaagccttcctgttgatatgcgagtgcccttctccgaactcaaggatatcaaggcctatttagagtctcacggtttggcttacagtatcatgattaaagatatccaggtcctacttgatgaggaaagacaagctatggccaagtctaggcggctcgaaagatccacgaattcattcagctactcttcttatcataccctggaggagatttattcttggatcgacaattttgtgatggagcatagtgatattgtgtccaagattcagattggcaacagctttgaaaaccagtctatccttgtacttaaattttccacgggcggatcccgccaccctgctatctggatcgacactggaatccacagtcgtgagtggattacacacgctaccggcatttggaccgccaacaagatcgtgtcagattacggtaaagatagagtcctgactgatattcttaatgctatggacatttttattgagctagttaccaatccggacggctttgcctttacccatagcatgaaccggctgtggcgtaagaacaagtcaattcgtcccggaatcttctgcattggcgtcgacctaaaccgcaactggaaatccgggtttggcggtaatggcagcaattccaatccgtgtagcgaaacatatcatggtccgtcaccacagagcgaacctgaggtcgcagctatcgtcaatttcattacagcccatggcaatttcaaggcactgatatccatacactcatacagccagatgttgatgtacccatacgggcgactgctggagcccgtaagcaatcagagagaactgtacgacctcgctaaggatgctgtggaggccctgtataaagtccacggaatagagtacattttcgggtcaatatcaaccactctatatgtggcctccggcatcactgtggactgggcttatgattctgggataaagtatgcgttcagtttcgagcttcgggatacaggccaatacggattcctgcttcctgctacacagatcatcccaaccgcccaggagacgtggatggctttgcgcaccatcatggagcatacactgaaccatccgtactag

SEQ ID NO: 8970 - DNA, 492 bp, Artificial Sequence
  Description of Artificial Sequence: Synthetic coding sequence
atgttccagggcctgctgctgctgctgctgctgagcatgggcggcacttgggctagcaaggagcctctccgccctagatgcaggcccattaacgccactcttgctgtggaaaaagagggatgtcccgtatgcattacggtgaatacgaccatctgcgccggatactgtcctacgatgacaagagttctgcagggggtgctgccagccctcccccaggttgtgtgcaactatcgagacgtgcgcttcgaatccataaggcttcccggctgcccccgcggcgttaatccagtcgtcagctatgctgtcgctctgtcctgtcagtgtgcactgtgtcggcggagcaccactgattgtggaggcccaaaggaccacccactgacttgtgatgacccacgatttcaggatagcagctctagcaaagccccccccccatctcttccaagccccagccgactacctggccctagcgatacaccaattttacctcagtag

SEQ ID NO: 8971 - DNA, 213 bp, Artificial Sequence
  Description of Artificial Sequence: Synthetic coding sequence
atgcccggcgccatgaagatcttcgtgttcatcctggccgccctgatcctgttagcgcagattttccaagcacgcacagctattcaccgtgcccttatctcaaaaagaatggaaggacactgtgaggcagagtgcctaacgttcgaggtgaagattggagggtgtagggccgagctggcaccattctgctgcaaaaaccggaagaaacactag

SEQ ID NO: 8972 - DNA, 1098 bp, Artificial Sequence
  Description of Artificial Sequence: Synthetic coding sequence
atgtggctgctgctgaccatggccagcctgatcagcgtgctgggcacaactcacggtttatttgggaagttacatcccggatcccccgaggttacgatgaatatatcacagatgattacatattggggctaccctaacgaggaatacgaggtggtcactgaggacgggtacatactggaggttaatagaattccttatggtaaaaaaaatagtggaaatactgatgcaggctacgatgtgtggttgggtaactccagaggaaacacgtgggcgcgtaggaacctatactattccccagattccgtggaattctgggctttctccttcgacgaaatggctaaatacgacctgccagcgacaatagatttcatcgtcaagaaaaccggccagaagcaactgcattacgtcggtcacagccaggggacaaccattgggtttattgcatttagtaccaatccatctttagctaaaaggatcaagactttctatgctttagcacccgtagcaaccgtgaaatatacaaaaagcctgattaacaagctgcgttttgttcctcagagtttgtttaagttcatattcggcgacaaaattttctatccacataacttctttgatcagtttctggccacagaagtttgcagtcgagagatgctgaatctactgtgttccaacgcattgtttattatttgcggctttgatagtaagaacttcaacactagtcggctagacgtgtacctgtcccacaaccccgccggaaccagtgtgcagaatatgtttcactggacccaggcagtcaaatctggaaagtttcaggcctacgactgggggagtcctgtgcagaatcgcatgcactatgaccagagtcagcctccctactataatgtgacagccatgaacgttccaatcgccgtgtggaacggcgggaaggatttactggccgatccacaggacgtgggtctcttgttaccaaagctccccaatctcatctaccataaggagatccccttttataatcatctggattttatctgggccatggatgccccgcaggaggtgtataacgatattgtcagcatgattagcgaggacaaaaaatag

SEQ ID NO: 8973 - DNA, 2535 bp, Artificial Sequence
  Description of Artificial Sequence: Synthetic coding sequence
atgggccccggcgcccccttcgcccgggtgggctggcccctgcccctactcgttgtgatggcagcaggagtcgctcctgtgtgggcgtcccattctccgcaccttccacggcctcacagtagggtgcccccacatccctctagcgaaagacgcgccgtgtacataggggcactgttccccatgagtggagggtggcccggtggacaagcttgtcagcccgcagtcgaaatggcgctggaagatgttaactcacgcagagacatcctccctgattacgagcttaaactgattcatcacgattctaaatgcgaccctggccaggcaaccaaatacttgtacgagcttctgtacaacgatcccattaagattattcttatgccgggttgcagttccgtgagcaccctcgtggccgaggcagcccgcatgtggaacctcatagtgttgagctatggttctagttctccggccctgtccaatcggcaacgcttccccacattcttccgcacacacccctctgcaacactgcataatcctactcgcgttaaattgttcgaaaagtggggctggaaaaaaatagccacaatccagcagacaacagaggtgttcaccagtacgctggacgacctggaggagagggtgaaagaagccggaatagagattacattcagacagtcattcttctcggatcccgccgtcccagtcaagaatctgaagcgccaggacgcccgtatcattgtcgggcttttttatgagacagaagctcgcaaggtattttgtgaagtgtataaggagagactttttggcaaaaagtatgtgtggtttctgatcgggtggtatgccgacaattggttcaaaatatacgacccaagtattaactgcaccgttgatgaaatgacggaagccgttgagggccatattacgactgagattgttatgctcaatcccgcaaatactagaagcattagcaacatgacaagtcaggaattcgtcgagaaactgacaaagcgcctgaaacgccacccggaggaaacaggggggtttcaggaggccccactagcttacgatgctatttgggccctggctttagctctcaataaaacttcagggggcggtggaagatccggagtccgcctggaagacttcaattacaataatcagactatcacagatcagatatatagggcaatgaacagcagcagcttcgaaggagtgagtggacacgttgtcttcgacgcgtctggcagcaggatggcatggactctaattgagcaactccagggaggatcatataagaagattggttactatgactcgaccaaggatgacctatcttggtccaagacagacaagtggatcggcggcagcccgccggccgaccagacccttgtgattaagaccttccggtttctcagccagaaattgttcatatccgtgtccgttcttagtagtttggggattgtcctggccgtagtgtgtctgtcttttaacatctacaacagccacgtgcggtacatccagaatagccagccaaatttgaataacttaactgctgtaggctgctctctggccctcgccgccgtgtttccgctgggcttagacggctaccacatcggtagaaaccagttcccatttgtgtgtcaggctcgtctgtggctgttgggtctggggttctctctggggtacggctccatgtttaccaagatttggtgggtgcatactgtctttacgaaaaaggaggaaaagaaagagtggcgcaaaactctggagccctggaagctctatgctacagtgggcctactggtgggaatggacgtgctgaccttggcaatatggcagatcgtagatcctcttcacaggacaatcgaaacgtttgcaaaggaggagcctaaggaggatatcgacgttagtattctgcctcaactggagcattgctccagccgcaagatgaacacctggctcggaatcttctatggctataagggactactgctgcttctgggcatctttttagcctacgagaccaaatcagtgagtaccgagaagatcaacgatcatagggcagtaggtatggcaatctacaacgttgcggtgctctgtctgattactgctcctgtgaccatgatcctgtctagccagcaggatgctgcgtttgcctttgccagtttggccattgtgtttagctcctatatcacgctagtcgtcctgtttgtgccgaaaatgaggcgactgataacccgaggcgagtggcagtctgaagctcaggacaccatgaaaaccgggtctagcactaacaacaacgaggaagagaaatcaagacttctggaaaaagaaaatagggagctggaaaaaatcatagctgagaaggaggagcgcgtaagcgagttgaggcaccaactgcaaagtcggcagcagctgcggtcgaggcgacacccccctacgcctcctgaacccagcggtgggctgcctcgagggccaccggaacccccggatcggctgtcatgtgacggctcgagggtccacctcctgtacaagtag

SEQ ID NO: 8974 - DNA, 1020 bp, Artificial Sequence
  Description of Artificial Sequence: Synthetic coding sequence
atggtgagcaagagccggtggaagctgctggccatgctggccctggttctcgtcgtaatggtttggtattcaatcagcagagaagaccggtacatcgaactgttttactttcccatcccggagaagaaggaaccttgtctccagggggaggccgagagcaaggcatcgaaactgttcggaaagttgagcccactatgctcatactcccgggaccagccaatcttcttaagattggaggattatttctgggttaagacaccctctgcatacgagttaccttatggaacaaagggtagcgaggacctgttgctaagagtgttggcaataacatcgtctagtattcctaagaacatccagagtctgcgttgtagaaggtgcgtggtggtcggcaatgggcaccggttgcgcaattccagcctgggagacgccatcaacaaatacgatgtggtgatccgcttaaataacgcgcctgtggccggctatgaaggggacgtaggatctaagacaaccatgaggttgttctaccctgagagcgcccattttgacccgaaagtggagaataatcctgacacccttctggtgctggtcgctttcaaggccatggacttccactggatcgagaccattttatcagataaaaagagagtgcggaaggggttttggaaacagcctccgcttatatgggacgttaaccccaagcagattagaatactcaacccctttttcatggaaatcgcagccgacaagctgttatcactgcccatgcagcagcctcgcaaaattaagcagaagcctaccaccggcctgctagccattactctggcgctgcacctttgtgatctcgtgcatatcgcggggtttggctatccagatgcatacaataagaaacagaccatccattattacgagcagatcactttaaagtctatggctggcagcgggcataacgtttcacaagaagccctcgctattaagagaatgctggagatgggcgccattaaaaatttgacgtccttctag

SEQ ID NO: 8975 - DNA, 1386 bp, Artificial Sequence
  Description of Artificial Sequence: Synthetic coding sequence
atgagcctggacatccagagcctggacatccagtgcgaggagctgtcagacgctcgctgggctgagctccttccactgctccagcagtgtcaggtcgtgcggttagatgactgcgggctgaccgaggctagatgcaaggacatttcctctgccctgcgtgttaacccagctttggccgaactaaatctgagaagtaatgagctaggggatgtgggcgtgcactgtgtgctgcagggcctgcaaacaccgagttgtaagatccaaaaattgtccctccagaactgctgcttgaccggggccggctgcggcgtcttatcctctactctgcgaactctgccaaccctgcaagaactgcatctcagcgacaatctcctgggggacgccggactgcagctgctgtgtgaagggctgctggaccctcaatgtaggttagaaaaactccaactcgaatattgttccttgagtgccgcgagctgtgaacccctggcatccgtacttagagcaaagccggactttaaagagttgaccgtaagcaacaacgatataaacgaggctggcgtgagagttctttgtcaaggattgaaagattcaccgtgccagctggaagcattgaagcttgaatcctgtggggtaacctcggacaattgtagggacctatgtgggatagtggcctctaaagcgagtttacgtgaattggctctgggttccaataaattaggagatgtgggaatggcagagctgtgccctggcctactgcacccctcctctagacttaggaccctttggatctgggagtgcggaattacagctaaagggtgtggcgacttatgtcgcgttctgagggccaaggagtcgctgaaagaattgagcttagctggtaatgagctgggggacgaaggggcccggttactgtgtgagaccctacttgagcccggatgtcagctggagtcactttgggtgaagtcttgcagtttcacagcggcctgctgctcccatttttcctcagtgctggcccagaacagatttctgctcgagctgcagatcagcaacaaccggcttgaggatgccggggtacgggaactgtgccaaggcctcggtcaaccaggctccgttttgagggtcctttggctggcagactgcgacgttagtgactcatcctgttccagcctcgccgcgaccctactagccaaccacagcctgagagagctggatctctccaataactgccttggtgatgccggaatactgcagctcgttgaatccgttcgccagcccggctgtctgctggaacagctggttctctacgacatttattggtcagaggagatggaggatcgcctgcaggccctggagaaggataaacccagcctacgcgttatcagctag

SEQ ID NO: 8976 - DNA, 1695 bp, Artificial Sequence
  Description of Artificial Sequence: Synthetic coding sequence
atggcccccaagaagctgagctgcctgcggagcctgctgctgcccttgtccctgaccctcctgctcccccaggccgatacccggtcatttgttgttgacagagggcacgaccgctttctactggacggggcaccttttcggtatgtcagcggatctctgcactactttcgcgtcccaagagtcctctgggccgatcgcctgttgaagatgcgttggtctggactgaacgccattcagttctatgtgccctggaattatcacgagccacagcccggcgtgtacaattttaacggaagtcgggacctcattgcattcttgaatgaagctgccctggccaatctgctagtgatcctccggccaggtccctacatctgcgccgagtgggaaatgggtggcttaccttcttggctgctgagaaaacccgaaatccatttgaggactagtgaccccgcggacaatatgacgaagatctttacccttctccggaaatatgagccccacggccctctggtcaatagcgaatattataccggctggctagattactgggggcagaaccactcgacccgcagcgtctctgccgtgacaaaagggctggaaaacatgctgaagcttggtgcttccgtaaacatgtacatgttccatggcgggaccaattttggatattggaacggtgcggacaaaaaggggagatttttgccgattactaccagctacgactatgacgcgcccatcagcgaagccggggacccgactccaaagctgttcgcacttcgggacgtgatctccaaatttcaggaagttccccttggaccactgcccccccctagcccaaagatgatgctgggacctgttactcttcacttggtgggacatctgcttgctttcctagatctactgtgcccccgagggcctatccacagtattctgcctatgacatttgaagccgtgaagcaggaccacggattcatgttgtacagaacgtacatgacacacactatttttgagccgactccgttttgggtccctaacaatggcgtgcacgacagggcttatgtgatggttgacggagtgtttcagggggtagttgaacgcaacatgagggacaagttgtttctcacagggaaactcggtagtaagctggacattctcgtcgaaaatatgggccgactaagtttcggctctaacagcagcgacttcaaaggtctgctgaaaccaccaatcctgggccaaaccattctgacacagtggatgatgttccctcttaagatcgacaatctggtgaagtggtggttccctctacaattgccaaaatggccgtatccacaggcaccctcaggtccaactttttatagtaagacttttcctatccttggctctgtcggggatactttcctctatctgcccggctggaccaaggggcaggtctggattaatggtttcaatcttggccggtactggaccaagcagggcccccagcaaaccctttatgttcccagatttcttctgttcccgcgaggtgctcttaacaaaattacactgctggagctggaagatgttcccctgcaaccacaggttcaatttctcgacaagccaattctgaattcaactagtactctgcatcgcacccacatcaattctctgagtgccgacacgctttcagcttccgagcccatggagctgagcggacactag

SEQ ID NO: 8977 - DNA, 1317 bp, Artificial Sequence
  Description of Artificial Sequence: Synthetic coding sequence
atgatgtacgcccccgtggagttcagcgaggccgagttcagccgggccgagtatcagcggaagcagcagttttgggactccgtcagattggccctctttactctggccattgtcgccataattggcatcgccatcggaattgtgacccattttgtcgtggaggacgacaagtctttctactacctcgcatcctttaaggtgaccaatatcaagtataaggaaaattatggaattaggtcttcgcgtgagttcattgagaggtcgcaccagattgaacgaatgatgtcacggatcttccggcattcttctgtcggcggacgttttatcaagagccatgtcatcaaactgtccccggatgagcagggcgtggacatccttattgttctgatctttcggtatccatctaccgactctgccgagcagatcaagaaaaagatcgagaaggcgctgtaccagtctctcaagaccaagcagctgagcctcacaatcaataagccaagttttcggttaaccccgattgacagcaaaaagatgaggaatttgctgaactcccggtgtggaattcggatgacatcttctaacatgccactgccggcttcctccagcactcagagaatcgtacagggtagagagaccgccatggagggcgagtggccgtggcaggctagtcttcaacttataggctctggccaccagtgcggggcctctcttatcagtaacacatggctcctaactgccgcccactgcttctggaaaaataaagacccgactcagtggatcgcaacttttggggcgacaatcactcctccagccgtcaagcgcaatgttcgtaaaatcatcttgcatgagaattaccacagagagacaaatgagaatgacattgcattggttcagctcagtaccggagtcgaattctccaacatcgtgcaaagggtctgcttgcctgactctagtatcaaattgcccccaaagacatccgttttcgtcactggcttcggctcaatcgtcgacgacgggcctatccagaatacactgcggcaagcccgggttgagaccatatcgaccgacgtttgcaatagaaaggatgtgtacgatgggctgatcacccctggcatgctatgcgccggttttatggagggcaaaatagacgcttgcaaaggtgattcaggagggcctttagtgtatgacaaccatgacatatggtacatcgtgggtattgtatcttgggggcagtcttgcgctttgccgaaaaaacccggagtctatacacgtgtaactaaatacagagattggatcgcatcaaaaactggcatgtag

SEQ ID NO: 8978 - DNA, 4392 bp, Artificial Sequence
  Description of Artificial Sequence: Synthetic coding sequence
atggagccccggctgttctgctggaccaccctgttcctgctggccggatggtgcctgcccggcttgccttgccccagtcgatgcctgtgtttcaagtccaccgtacgatgtatgcatttaatgctggatcacattccgcaggtcccacaacagaccactgtattggacttaaggttcaaccgtattcgggagatccctggctcggcctttaagaagctgaagaaccttaatacactgttgctcaataacaatcacatacggaaaatcagtcggaatgccttcgaggggttagagaacctgctctacctgtacctgtataagaacgagatccacgcgcttgacaaacaaacattcaaggggctaatcagcctggagcacctgtatatccactttaatcagctcgaaatgttgcagcctgagacctttggtgacctgttaaggttagagagactttttctgcacaacaacaaattatcaaaaattccagccgggtcattttcaaatctggatagtctgaagcgcctgcgcctggacagcaatgccttggtctgcgattgcgacctgatgtggctaggggagttactgcagggatttgcacagcatgggcacactcaagctgcagccacttgtgagtatcccaggcggctgcacggacgcgctgtggcctcggtcacagtggaggagttcaactgtcaatctcctaggatcacgttcgagccacaggacgtggaggtgccatcgggaaacacagtttactttacttgccgggcagagggcaatcccaagcccgagatcatttggatccataataaccactcattggacttggaggacgatactagactgaacgttttcgacgacggcacattgatgatccgcaatacaagggaatccgaccaaggggtgtaccagtgtatggccagaaactctgccggagaagcaaagacccagagtgcaatgctccggtacagctccctgccggcaaaaccatcttttgttatacaacctcaggataccgaggttctgatcggcactagtaccaccctagaatgtatggccacggggcacccccaccccctgatcacctggactcgggacaatggactcgaacttgacggctccagacacgtggctaccagttccggactctatttacagaacatcacgcagagagatcatggtcgcttcacatgtcacgctaataatagccacggaaccgttcaagcagctgctaatatcatcgtgcaggctccacctcagtttacagtcacacccaaagaccaggtggtgctcgaagaacacgccgttgagtggctttgcgaggctgatggcaacccacccccagtgatcgtatggacaaaaactgggggccagcttcccgtggaagggcagcacaccgtgctttcttctgggacgctgagaatagacagagctgctcaacatgatcaggggcagtacgaatgtcaagccgtctcatccctgggcgtcaaaaaagtctctgttcaactaacggtcaaacccaaagctctggccgtgtttacacaactgccacaggacactagtgtggaggttggcaagaacattaatatatcttgccatgcacagggggaaccccagccaatcattacatggaacaaagagggggtgcaaatcaccgaatctggcaaattccatgtggatgatgaaggcacattgaccatttatgacgccggattccccgaccaagggcgttacgaatgcgttgctcggaactccttcggcctggcggttactaatatgttcctgaccgttaccgcgatacagggccggcaggctggcgatgatttcgtggaatcaagcattctggacgcggtccagagggtggactctgcaatcaactctacaaggaggcacctgttctctcagaagccgcatacaagcagcgatctgcttgcacagtttcactatccaagagaccccctgatagtggaaatggctcgagctggcgaaatattcgagcatacactgcagttaattcgggagcgggtgaagcagggactcacagtggacctggaggggaaagagtttaggtacaatgaccttgtgagcccaaggagcctaagcctaattgcgaacctgtcaggctgtactgctaggcgccccctgcccaattgctcgaatagatgcttccacgcaaagtacagggcccacgacggcacctgcaataacctccaacagccaacctggggggccgcactgacagccttcgctcggctcctccagcctgcctaccgggacgggatacgggccccccgtggtctgggcctgccggtcggtagccgtcagccacttccacccccccgattagtagctaccgtttgggcccgtgcggccgctgttactccagaccacagctatactaggatgcttatgcattggggttggtttctcgagcacgacctcgatcacaccgtacctgcgctctcaactgccaggttcagcgacggccgcccttgctcaagcgtttgtactaatgatcccccgtgttttcctatgaacacccgacacgctgatcctcgcgggacccatgcaccttgcatgctgttcgcaagatcctcacctgcgtgcgcaagcggtagaccgtctgcgacggtggactctgtctacgcacgggagcagataaatcagcagaccgcttacattgatggttccaatgtttacggttcctccgagcgggagtcccaggccctgagggacccctctgtaccccggggtctgctgaagactggtttcccatggcccccttcggggaagccacttctgccattctcgactggccctcccacagagtgcgccagacaagaacaggaatctccatgtttccttgccggcgatcacagggctaacgaacatctggccctagcagcgatgcataccctatggttcagagaacataataggatggcaacagagctgtccgctctgaaccctcactgggagggcaataccgtatatcaggaagcacgtaaaattgtgggtgcagaattgcagcacatcacatattcgcattggttacccaaagttctgggggacccaggtacacgaatgctgcggggatacagaggctacaatcccaacgtgaatgcaggtatcatcaattccttcgctacggctgcttttagatttggacacacactgattaacccgatactatatcggctgaacgctaccctgggcgagatcagtgagggacaccttccatttcataaagccctgttctcaccctcacgcataattaaggaaggaggtatagaccccgtgctgcgcggcctgtttggcgtagctgcaaaatggagggcccctagctacttactatcccctgagttgactcaacgactcttcagtgcagcatattccgctgcggtcgattcggccgcaacaatcatccagcgcggtcgggatcacgggatccctccctatgtcgatttcagggttttttgtaatcttactagtgtgaagaacttcgaagatttgcagaacgagattaaggatagcgaaattcgccagaagttgcgtaagctttatgggtcccccggggacattgatctttggcctgctcttatggtcgaggatctgatcccggggacccgagtcggaccaactctgatgtgcctgtttgtaacacaattccagcggctgcgcgacggcgaccggttctggtatgaaaaccccggagtcttcacacctgcacagctgacacagctgaaacaagcatccctgagcagggtgctgtgcgataacggagattccattcagcaggtgcaggctgatgtgtttgtgaaggccgagtacccgcaggactacctgaattgctcagagattcctaaggtcgatctgagagtttggcaggactgctgtgccgattgccgcagtaggggacaatttagggccgttactcaggagtcgcagaaaaagaggagtgcccagtactcttacccggtcgataaggacatggaattgagtcacctgagatctcgtcagcaagacaaaatctatgtgggagaggatgcccgcaatgtcaccgtattggctaagactaaattctcccaagatttttcaaccttcgcagcagaaattcaggaaacaattaccgctttgcgggagcaaataaacaaactggaagcaagacttcgtcaggccggctgtaccgacgtcagaggcgtgccaaggaaggccgaggagagatggatgaaagaagactgtacccactgtatctgtgagagtgggcaggtgacctgcgtggtcgagatctgcccaccggcaccatgcccgagcccggagctggtgaaagggacttgctgccctgtatgtcgcgataggggtatgccatctgatagtccagagaaaaggtag

SEQ ID NO: 8979 - DNA, 1206 bp, Artificial Sequence
  Description of Artificial Sequence: Synthetic coding sequence
atgggcctgaaggccctgtgcctgggcctgctgtgcgtgctgttcgtttctcatttctatactcccatgcctgataacatcgaggagagctggaaaatcatggccctagatgcgattgcaaagacgtgtacgtttacagccatgtgcttcgagaatatgagaattatgcgctacgaagagttcatatcgatgatattccgcctcgactacacgcagcccctgtctgacgagtacattactgtgacagatactaccttcgtagacatcccagtgcggctgtacctgcctaaacgcaaatctgagacccgcaggagggccgtaatttatttccacggcggggggttttgcttcggttcgagcaaacagcgcgcattcgacttcctgaatcgttggacagccaatacacttgatgctgtagttgtcggtgtggactatcgtctggcaccccagcaccacttccccgctcagttcgaggatggcctggccgccgtgaaattcttcttacttgagaaaattctcactaagtacggggttgatccgaccaggatctgtatcgccggagactcttcaggaggcaacctggcaaccgccgtaacacaacaagttcagaacgatgcagagattaagcacaagatcaagatgcaagtcctcctgtatccggggttacagatcacagattcttatctaccttctcaccgagaaaatgagcacggcatcgtcctgacaagggacgtggctattaagctggtttctttatacttcaccaaggatgaagcccttccctgggccatgcgccgcaatcagcacatgccacttgagtccagacacctgtttaaattcgtgaactggtcgatccttctcccggagaaatatcgtaaggattacgtgtacaccgagccaatcctagggggcctgtcctactccttaccaggcttgacagactcaagggcccttcctctcctggcgaacgattcccagctacagaacctcccacttacttatattcttacatgtcagcatgatctgctgcgggatgatggtctcatgtatgtgacacgacttaggaatgtgggtgtacaagtggtccacgaacatattgaagatgggatccatggcgcgctctcattcatgacttccccattttacctcagattgggtctacgaatacgggacatgtatgtcagctggctcgacaaaaatctgtag

SEQ ID NO: 8980 - DNA, 264 bp, Artificial Sequence
  Description of Artificial Sequence: Synthetic coding sequence
atggtgagcctgatgaagctgtggatccccatgctgatgaccttcttctgtacagtcctcctgagcgtcctgggcgaaatgcgaaaaaagcgctatgaccgcaaggagttgctactcgaagaatgttggggtaagccaaatgtgaaggagtgcacgaacaaatgttctaaggcctttcggtgcaaagataaaaattatacctgctgctggacctactgtgggaacatctgctggatcaatgtcgagacaagcggcgattactag

SEQ ID NO: 8981 - DNA, 813 bp, Artificial Sequence
  Description of Artificial Sequence: Synthetic coding sequence
atgcggggccagggccggaaggagagcctgagcgacagccgggacctggacggttcatatgaccagctgactgggcacccccccggacccactaaaaaggctcttaaacagagattcctgaaactgctgccctgctgcggccctcaggcactgcccagcgtcagcgaaactcttgccgcccccgcgagcctcagaccccacagaccgcgtttgttagaccctgattccgtcgacgatgaattcgagctgtcaaccgtctgtcacagacctgaggggctggaacagctgcaagaacagacaaagttcacacgcaaggaactgcaggtactgtaccggggattcaagaacgaatgtccatcgggaatcgtgaacgaggaaaattttaaacagatctatagccagttctttccgcaaggcgattcctccacctacgccacttttctttttaacgcatttgatacaaaccacgacggctctgtaagtttcgaggattttgtcgcaggtttgagtgtcattttgcgaggaaccgtagacgataggttaaattgggctttcaacctctacgacctgaacaaggatgggtgcatcaccaaggaagaaatgttggatattatgaaatctatttacgacatgatgggaaagtacacctaccccgccctcagggaggaagctccaagggagcatgtcgagagtttctttcaaaaaatggaccgcaacaaggatggcgttgtcacaattgaggaatttattgaaagctgccagaaagacgaaaacatcatgcgatccatgcagttgttcgacaacgtcatctag

SEQ ID NO: 8982 - DNA, 819 bp, Artificial Sequence
  Description of Artificial Sequence: Synthetic coding sequence
atgcacctgcggctgatcagctggctgttcatcatcctgaacttcatggagtacatcggttcccagaatgcctctcgcggacgacgacaacggcggatgcaccccaatgtctcccagggttgccaaggcggatgcgctacctgcagcgactacaacggttgcctgtcttgcaagccacgtctgttctttgctcttgagaggatcggtatgaagcagattggggtatgcctaagctcttgcccctcgggctattacggtacacgataccccgacattaataagtgtacgaaatgtaaggctgattgcgacacgtgttttaacaagaacttctgcactaaatgcaagagcggcttctacctccatctaggaaagtgtttggataattgtcctgaagggctggaagccaataaccataccatggagtgcgtgagcattgtgcattgtgaagtttccgagtggaacccttggtctccatgcacaaaaaagggaaaaacttgcggctttaaacgggggactgagacacgggttagagaaatcatccagcatccgtctgcgaaagggaacctttgccctccaactaacgagactcgtaaatgcacggttcagaggaagaagtgccagaagggcgagagaggaaaaaagggaagagaacgaaagaggaaaaagcccaacaagggagagtctaaagaagccattcctgattcgaaatccctcgaaagtagtaaagagattcccgagcaacgagaaaataagcaacaacagaagaaacggaaggtccaggacaaacagaaatcggtttctgtgtccaccgtccattag

SEQ ID NO: 8983 - DNA, 294 bp, Artificial Sequence
  Description of Artificial Sequence: Synthetic coding sequence
atggccaagagcttccccgtgttcagcctgctgagcttcatcctgatccatctggttctttcaagcgtaagcgggccgcgtcattggtggccgccacgtggaatcatcaaagtgaaatgtccttacgagaaggtgaacttatcctggtacaatggaactgtaaacccttgtcccggcttgtaccagcctatctgcgggacgaacttcatcacatacgataatccatgcattctgtgtgtggaatccttgaaatcacatggaaggataagattctaccatgacgggaagtgctag

SEQ ID NO: 8984 - DNA, 726 bp, Artificial Sequence
  Description of Artificial Sequence: Synthetic coding sequence
atgtggaccgtgcggaccgagggcggccacttccccctgcacagccccacattttcctggagaaacgtggcctttctgctgcttctttcactggctttggaatggacttctgccatgctaactaagaagattaagcataaacccggtctatgccctaaggaaaggctcacctgtacaacagaattgcctgacagctgcaatacagactttgactgcaaagagtatcagaagtgttgttttttcgcttgtcagaaaaagtgcatggaccccttccaggagccttgcatgctgcctgtaaggcacggaaactgtaaccatgaggcccagagatggcacttcgatttcaagaattaccgttgtacacccttcaagtaccgcggctgtgaaggcaatgcgaacaattttttgaatgaagacgcatgtagaactgcgtgcatgctgatcgtcaaggatggacagtgccccctcttcccattcactgaaagaaaagagtgtccaccatcctgccatagcgacattgattgtccccagacagataagtgctgtgaaagtcggtgtggattcgtgtgcgcccgggcatggactgtcaagaaggggttttgcccccgcaagcccttgctttgcaccaagattgacaagccaaagtgcctgcaggacgaggagtgccccctcgtggagaagtgttgtagccattgtggtctgaaatgtatggacccgagacggtag

SEQ ID NO: 8985 - DNA, 1827 bp, Artificial Sequence
  Description of Artificial Sequence: Synthetic coding sequence
atggcccgggcccgggccggcgccctgctggccctgtgggtgctgggcgctgctgcccacccgcagtgcctggactttagacctccctttcgccccacgcagcccctgcgtctgtgcgctcagtattctgactttggctgctgtgacgagggccgtgatgccgagttgacccgaagattttgggcactggccagtcgtgtggacgcagcagagtgggccgcatgtgcggggtatgcccgggaccttctttgccaggaatgcagtccttacgctgctcatctctacgacgccgaagacccatttaccccccttagaaccgtgccagggttatgtcaagactattgccttgacatgtggcacaagtgtagaggattgtttcgtcatctgtctacagaccaggaattatgggcactcgagggtaacctggctcgtttctgcagatacctgtccctggatgacacggattactgctttccatatctgctcgttaacaagaacctaaactctaacctgggccacgtggtggctgatgctaaagggtgtctgcaactgtgcctagaggaggtagccaacggtctgagaaatccagtggccatggtacacgcccgtgacggaactcatagattctttgtggcagaacaagtggggctagtctgggcataccttccggatagaagtcgcttaggaaaacccttcctaaacattagcagagtcgttttgacgtctccctgggaaggcgacgaaaggggtttcctgggcattgcgttccacccttctttccagcacaaccgccggctgtacgtttactatagcgttgggattcggtcttctgagtggatcagaatttcagaatttcgggtcagtgaggatgatgaaaacgccgttgaccattcgtccgaacgcattattctggaggtgaaggagccagcctccaatcacaatgggggacagttgctctttggagatgacggttacttatacatctttaccggcgacggcggcatggccggggaccccttcggtacattcgggaatgcccagaacaaatcagccctgctgggtaaagtgctacggatcgacgtggatcgcaaggaaaggggcctcccctatgggatcccccccgacaaccccttcgtgggcgaccccgcagcccagccagaggtttacgctctaggagttaggaacatgtggagatgttcctttgatcgcggagatccaagctccggaaccggccgcggccggttgttttgcggagacgtcgggcagaataagtttgaagaggtagacgtagtggagagagggggcaattacggatggcgggccagggagggattcgaatgttacgataggtccctgtgtgccaatacctccctgaatgatctgctgcccatattcgcttaccctcataccgtggggaaatccgtcaccggaggctatgtgtataggggttgcgagtatccaaacctcaacggactctacatctttggggactttatgagtggacggctgatgtccctacaggagaatccgggcaccggccaatggcaatatagcgaaatatgtatgggccacggccagacttgcgagtttccaggcctgattaacaattattatccatacattatctcctttggggaagacgaggccggcgagctatacttcatgagcacaggcgagccctctgctaccgctcctcggggagtggtgtacaaaattattgacgcatcttcatgtaaggctagatcagctatgccaggatacgtccccgctccttccgtgtgctcaagcctgacatcgcagccattcattcttcagtggtggaagtag

SEQ ID NO: 8986 - DNA, 351 bp, Artificial Sequence
  Description of Artificial Sequence: Synthetic coding sequence
atggccccccccagcgtgcccctggtgctgctgctggtgctgctgctgagcctggccgaaacacccgcatctgcccccgcacatcggggacgtgggggctggacccttaatagcgctgggtatctgctgggcccagttcttcatttgccgcagatgggggatcaggatggtaaaagagaaaccgctctggaaatcctggatctttggaaggccatcgacggtttgccgtattcacatccaccccagccctcaaaaagaaatgtgatggaaacatttgccaagcccgaaatcggagatctggggatgctcagtatgaagatcccaaaagaggaagacgttctcaagtcatag

SEQ ID NO: 8987 - DNA, 3618 bp, Artificial Sequence
  Description of Artificial Sequence: Synthetic coding sequence
atgcggaagccccggcggaagagccggcagaacgccgagggccggcggtctccgagcccatactccctgaagtgcagccccaccagggagactttaacctacgcccaggctcagagaatcgtcgaagtcgatatcgacggccggcttcacaggatcagtatttacgaccccctgaagatcattaccgaagatgagttgaccgcacaggatattaccgaatgtaactctaataaggaaaatagtgaacagccacagtttcctggtaaaagcaagaaaccaagttccaaaggaaaaaagaaggagagctgctccaaacacgccagtggcacctccttccatttgccccagccaagttttcgtatggtggactcaggcatccagccagaagcccccccacttcctgccgcctattacaggtatatcgaaaaacccccggaggatctggacgctgaggtggagtatgacatggacgaggaggacctagcttggctcgatatggttaatgagaaacgacgagtcgatggtcacagcctggtaagcgccgacacctttgaactgctcgttgaccgattggagaaggagtcatacctggagtcaagatcatccggggctcaacagtctttaatcgatgaagatgctttctgctgtgtgtgtttggacgacgagtgtcacaactccaatgttattctgttttgcgacatctgcaacctcgccgtccaccaggaatgttacggcgtaccttatatccccgaggggcagtggttgtgtaggtgttgccttcagagcccttcgcggccagtggactgtatattgtgccctaacaagggaggggcctttaaacagacctctgatgggcactgggcccatgtggtctgtgcgatctggattcccgaggtgtgctttgctaacacagtgtttctcgaacccatcgaggggatcgataacatccctcccgcccggtggaaactcacctgctatatatgcaagcagaaagggctcggcgctgccatccagtgtcataaggtaaattgttacacagcatttcacgtaacatgcgcacaaagggctggactctttatgaagatcgaacctatgagggagaccagcctgaacggcacaatcttcaccgttcgcaaaaccgcctactgcgaggcacacagtcctccaggtgcagcaaccgcccgccggaaaggcgattcacccaggagtatatccgagactggggatgaggagggtctgaaggaaggagatggcgaggaagaggaggaggaggaggtggaggaggaagagcaagaggctcagggcggggtcagcggttcccttaagggggttccaaaaaagagtaagatgagtttgaagcagaaaattaaaaaggaaccagaggaggcgggacaggacaccccctctacactcccaatgttggccgtgcctcagattccgagctacagactgaataagatatgctcagggctttcatttcagcgcaaaaatcagtttatgcagaggctccacaactactggctgctgaagagacaagcccgcaatggcgtgcccttaattcggaggctccactcccacctccagagccaaaggaacgccgaacagcgggagcaggacgaaaagacaagcgccgttaaagaggagctcaagtactggcagaaactgaggcatgatctcgaacgggctagattgttaatagaactgatccgcaagcgggagaagctgaaacgagagcaggttaaagtacagcaggcagccatggaactggagctgatgcctttcaacgtcttactgcgcaccaccttggacctgctgcaggaaaaggatccggcgcatattttcgcggagcccgtaaatttaagcgaagttccagattatctcgagtttatatctaagccaatggatttctctactatgcggaggaagctggagagccacctttataggactctggaggagttcgaagaagatttcaatttgatcgttacaaactgcatgaaatacaatgccaaagacacaatttttcatagggccgccgtcaggctccgagatctcggaggggccattctgcgccacgctagaaggcaggccgagaatatcggctacgaccccgagcgcggcacccacttgccagaatcccctaagctggaggacttctatagattttcatgggaagatgtggataatatattgattcccgagaacagggcacatctttctcctgaggttcagctgaaagagctcctggagaaactggatcttgtcagcgccatgaggagctccggcgcacgaacaagacgggtgaggctgctaagacgggaaatcaatgcattgaggcaaaagctcgcccagccaccccctcctcagccaccttccctgaacaaaactgtttccaacggtgagttgcctgcaggtcctcaaggggacgcagcagtactcgagcaagctctccaggaggagcctgaggatgacggagatcgcgatgattctaagcttccgcctcctccgacccttgagcctacgggtcccgctccttctctgagcgagcaggaaagtccacccgaacctcctacgctgaaacccattaatgactcaaagcccccctctaggttcttgaagccaagaaaggtagaagaggacgagctgcttgagaagagtcctttgcagttgggtaacgaaccactgcagcggctcctgtcagataatgggataaatcgcctgagcctgatggccccagatacacccgccgggacacctttgagcggtgtgggtcgaagaaccagcgttctgtttaaaaaggccaagaacggtgtgaagctgcagagatcaccagatcgcgtcttggaaaacggcgaggaccacggcgtcgctggatctccagccagtccagcttccatcgaggaagagcggcatagcaggaaacgcccaagatcccggagctgtagcgagtctgaaggtgagcgctctccacagcaggaggaagagacagggatgactaatggctttgggaagcataccgagagtggtagtgactccgagtgctcactcggattgtcaggtggactggcttttgaggcgtgttcaggactcactcctcctaagaggtctcggggcaaacctgctctgtcaagggtgccctttctggagggcgttaatggagactctgactacaacggatccggccgatctctgttgctgcctttcgaggacagaggtgatctggaacccctggaactggtgtgggccaagtgtaggggctacccttcatatccagctctcatcattgaccctaagatgcctcgggaaggattactacacaacggggttcctatcccagtgccccctcttgacgtgctgaagctgggcgaacagaagcaagctgaggcaggcgaaaagttgtttttggtattgttttttgacaataagcgaacttggcagtggctcccacgggacaaagtccttcctttgggcgtagaggacaccgtcgataaactaaaaatgctggaggggaggaagacgtccattaggaagtcagtgcaggtcgcctacgatagggccatgatccatctgagcagggtccgggggccacattctttcgttacatcctcctatctctag

SEQ ID NO: 8988 - DNA, 1977 bp, Artificial Sequence
  Description of Artificial Sequence: Synthetic coding sequence
atgttcgtgagctacctgatcctgaccctgctgcacgtgcagaccgctgtcttagcgagacctgggggtgagagcataggctgcgatgactatctcgggtctgacaaggtcgtcgacaagtgcggcgtttgcggaggtgataataccggctgtcaggtcgtgtctggagtttttaagcacgcgctaacttcactggggtatcatcgggtcgtggagatacctgagggagccaccaaaatcaatatcaccgaaatgtacaagtccaacaactatctggctttgagaagtcggagcggtcggtctatcataaacggcaattgggctattgatcggcctggaaaatatgaggggggaggcacaatgttcacatataaacgacccaatgagatctcatccactgcaggcgaaagcttcctggcagaaggaccaacgaacgaaattttggatgtgtacatgatccatcagcagcccaatccaggggtccactacgagtatgtgatcatgggtaccaatgccatctccccacaggtcccccctcaccgacgacctggcgaaccgtttaatgggcagatggtgaccgaggggaggtcacaggaagagggtgagcagaagggccgtaacgaggaaaaggaagacctgcgcggagaagcacctgagatgttcacatccgaaagtgcccaaacattccctgtgaggcatcctgatcggtttagcccccatcgcccagacaacctggtgccacccgcgcctcagcctcctcggcgcagcagggatcacaactggaagcaactcgggacaaccgaatgctctacgacctgcggaaagggatcacaatacccaatttttcgttgcgtgcacagatctactcacgaagaggccccagaatcttactgtgactcatctatgaaacccacccccgaagaggagccctgcaatattttcccatgtccagctttttgggacattggggaatggagtgaatgttccaagacgtgtggcttaggtatgcagcacaggcaggtgctttgtcggcaggtatacgccaatcgatcattaaccgtgcagccctacaggtgccagcatctcgaaaagcctgaaactacttccacttgccagttaaaaatttgctccgagtggcagattaggactgattggacctcttgttcggtgccctgcggggtaggccagagaacaagagacgtaaagtgtgtgtccaatattggtgatgttgtcgacgatgaagagtgcaatatgaaattaagaccgaatgatatcgagaattgcgacatgggcccatgcgccaagtcttggttcctcacggagtggtctgaacggtgcagtgctgagtgcggggcgggcgtgcggacccgtagtgtggtgtgtatgactaatcatgtgagttccctgccactggaaggttgcgggaacaatcgacctgcggaggcgacaccttgtgacaacgggccttgcacagggaaagtcgagtggttcgcgggcagctggtcccagtgcagcattgagtgtgggagcggtactcagcagcgagaggtaatatgcgtccggaagaatgcagatacgttcgaggtgcttgacccatcggaatgctcttttctggagaaaccacctagtcaacagagttgtcacctcaaaccttgtggggcaaaatggttcagcaccgagtggtcaatgtgttctaaaagttgtcagggcggattccgcgtccgggaggtgcgctgcctaagtgacgacatgacactgtctaacctctgcgatccgcagttaaaaccggaagagcgcgaatcatgcaacccacaggactgcgttccggaggtcgatgagaactgcaaagataagtattacaactgcaatgtcgtggtccaggctcgtctatgcgtgtataactattacaagaccgcctgttgcgcttcgtgcacgcgggtcgcaaatcggcaaacggggtttcttggcagtcggtag

SEQ ID NO: 8989 - DNA, 708 bp, Artificial Sequence
  Description of Artificial Sequence: Synthetic coding sequence
atgcggcccctggccggcggcctgctgaaggtggtgttcgtggtgtttgcctctctctgtgcgtggtatagtggctaccttctggctgagctgatccccgatgccccgctttcatcagccgcgtatagcattcggtcaattggtgaaagacctgtcctcaaggcaccagtgccaaaacgccaaaaatgtgatcactggacaccctgtcccagtgatacatacgcttatcgtttgttgtcaggcgggggccggtctaagtacgctaaaatctgcttcgaagacaacctgctcatgggcgagcaactaggaaatgtggcacgggggattaatattgcaatcgtgaactacgtgaccggcaacgtgactgcaaccagatgtttcgacatgtacgagggcgataattcgggacccatgacaaaattcatccagtctgccgctcccaaatccctactgtttatggtaacatacgatgatggctctaccaggctgaataatgacgccaagaacgccatcgaggctcttggatccaaggagatacgaaatatgaagttccggtcttcatgggtattcattgcagctaaaggactcgaactaccgtctgagattcagcgcgaaaaaattaaccatagtgacgctaagaataatcgctattcagggtggcccgccgagatccaaattgagggctgtatacccaaggagaggtcatag

SEQ ID NO: 8990 - DNA, 759 bp, Artificial Sequence
  Description of Artificial Sequence: Synthetic coding sequence
atgcggggccagggccggaaggagagcctgagcgacagccgggaccttgacggctcatatgaccagcttacagggcaccccccagggcccaccaaaaaagccctgaagcagcggtttctcaagctgcttccatgttgtggaccgcaggctcttccctctgtctccgaaaactccgtggatgatgagtttgagctctcaaccgtgtgccacagacctgaagggttggagcaattgcaggagcagacgaaatttaccaggaaggagctgcaagtgttgtaccgcggcttcaagaacgagtgcccatccgggattgtcaacgaggagaattttaagcaaatttattcccaattctttcctcagggggatagcagcacctatgcaacttttctcttcaatgcctttgacactaatcacgacggctccgtgagtttcgaggatttcgttgctggcctcagtgtgatccttaggggcaccgtcgatgaccgcctgaactgggcttttaatctttacgatcttaacaaggatgggtgtatcaccaaggaagaaatgctcgatattatgaaatcaatttacgatatgatgggcaaatacacatacccggcccttcgtgaagaagctccccgagaacatgtggaatccttctttcagaaaatggaccgaaacaaagatggcgtggtcacaattgaggagttcatcgaatcatgccaaaaagatgagaatatcatgcgttccatgcagttgttcgacaatgtcatatag

SEQ ID NO: 8991 - DNA, 312 bp, Artificial Sequence
  Description of Artificial Sequence: Synthetic coding sequence
atgagcggccggggcaagggcggcaagggcctgggcaagggcggcgctaaaagacatcgcaaggttcttcgcgacaacattcaggggattaccaaaccagcaatccgccgcttggcgcgacgaggaggcgtgaagcgcattagcggcctgatatatgaggagacgcggggtgtcctaaaggtgtttctggagaatgtgatacgtgatgctgttacttacaccgagcatgccaaaagaaagacggtcactgccatggacgtcgtgtacgccctgaagcgccagggtagaactctctacggattcggaggctag

SEQ ID NO: 8992 - DNA, 3120 bp, Artificial Sequence
  Description of Artificial Sequence: Synthetic coding sequence
atggaggtgaccgccgtggccacccagggcggctacggcagcagcgactgggtgacttcatacctgctcatgtttagtgatggcgggcgtaattggaaacaatacagaagggaggaatcaatttggggatttcctggaaacacgaacgccgattcggtggttcattaccgactgcagccgcccttcgaggccagatttctgcggttcctccctttggcctggaaccccagaggccgcatcggtatgaggatcgaagtatacggatgtgcatacaagtcggaggtggtttacttcgatggccagtccgcactgctataccggcttgacaaaaagcccctcaagcccattcgcgacgtcatcagtcttaagtttaaggcgatgcagtccaatggtattttgttacatagagagggtcagcatggaaatcatattaccctggagctgataaagggtaagctggtgttttttttgaacagcggtaacgccaagttgccctccacaatcgcaccggtaacccttacccttgggtcccttctagacgaccagcactggcatagcgtgctaattgaactgttggatacacaagtgaatttcactgtcgataaacacacccatcacttccaggcaaagggtgactcttcttatctggacctgaattttgaaatatcttttggcggaattcctacgcccggccggagccgagctttcaggaggaagtctttccatggctgccttgagaatctctattacaatggcgtcgatgtgactgagctggcgaagaagcataagccccaaattttgatgatgggcaacgtgtccttttcctgtcctcaaccacagactgtgcctgtgacatttttgagctccagaagttatctggccctcccaggcaatagcggcgaagataaagtttccgtcacatttcagtttcggacgtggaaccgcgcgggccacctgctctttggcgaactgcggaggggctccggatcttttgtgctcttcttaaaagacggcaaattaaaactgagcctgttccagcctggacagtcacccaggaacgttaccgccggtgcagggcttaatgatggtcagtggcacagcgtgtctttttcagcgaagtggagtcatatgaacgtggttgtcgatgatgacacggctgtccagccgctggtggctgtgcttatagattccggagacacttattacttcggagggtgccttgacaactctagcggcagcggatgtaaatccccactggggggcttccagggatgtctgcgtctaatcacaatcggcgacaaagcagtcgaccccatactcgtccagcagggcgcattaggaagttttagggatctacaaatcgactcctgcggcattactgataggtgtctcccatcctattgtgaacatggaggagagtgcagccagtcctgggacacattctcctgcgactgtctgggtaccgggtatactggggagacctgccactcaagtctgtatgaacagtcttgtgaggcccacaagcataggggaaatccaagcggtctgtactacattgatgcggatgggtcaggaccacttggccccttcctcgtgtactgtaatatgacggctgatgctgcctggactgtcgtgcaacatggtggaccggacgccgtaactctgcgtggcgcacctagcggacatcctcgaagtgcagtgagtttcgcgtatgccgctggtgccgggcagctcagatctgctgtgaatctggccgagaggtgcgagcagcgactggctctccggtgcggtaccgcccggcgccccgactcgcgggacggaacccccttaagttggtgggtgggccgcacaaacgaaacccacactagctggggaggttctctgccagatgctcagaagtgtacctgtggactggagggtaattgtattgacagtcagtattactgcaactgtgacgccggtcgaaatgaatggacctctgacacaatcgtgctctctcaaaaggagcatctccctgtcacccagatcgttatgacagatgccggcagaccccattccgaagccgcttacacactcggccccttattatgccggggtgatcagagcttctggaatagtgcaagctttaatacggaaactagctacctgcatttccctgcgttccatggggagctcactgcagatgtttgtttcttcttcaagaccactgtgtcctcaggagtcttcatggaaaatctcggcatcacagattttattcgaattgagctcagggcacccactgaagtgactttcagcttcgatgtgggtaatgggccctgtgaggtcacagtgcagtctcccacaccatttaacgacaatcagtggcaccatgtgcgggccgagcgcaacgtaaagggcgcttccctgcaggtggaccaactccctcaaaagatgcagccggctcccgctgatggccatgtccgcctccagctgaattctcagcttttcataggtggtaccgcgacccgccaacgcgggtttctgggttgcatcagatctctgcagctcaatggggtagcgctagacttagaggaacgtgcaacggtcactcccggtgttgaaccaggctgcgccggacattgttccacatacggccatctatgccggaacggcgggcggtgccgtgaaaaacgaagaggggtcacctgcgactgcgcgttctccgcttacgatgggccattctgcagcaacgaaatcagcgcttacttcgcaacaggctcatcaatgacctaccacttccaggagcactacactctgtccgagaatagcagcagtctggtgagttccctccatcgcgatgtgacattgactagagagatgataactctgagctttcggactacccgcacgcctagcctcttactatacgtgagctccttttacgaagaatacttgtccgtgatactggccaacaatggctccctgcagatcaggtataaactggatcgccaccagaaccccgacgcgttcactttcgacttcaaaaatatggcagatggacaactgcaccaggtgaagatcaacagggaggaggctgtcgttatggtcgaggtgatcccacagatgcagaaatctaattag

SEQ ID NO: 8993 - DNA, 1257 bp, Artificial Sequence
  Description of Artificial Sequence: Synthetic coding sequence
atgcggagcctgctgctgctgagcgccttctgcctgctggaggccgccctggcagccgaagtcaaaaagcccgcagctgccgcggcccccgggaccgccgaaaagcttagtccaaaggctgctacactcgccgagcggagcgctgggctcgccttctccctctatcaggctatggctaaagaccaggctgtcgagaatatcctcgtaagtcccgtggtcgtcgcttcctcactaggtctggtttctttggggggcaaggccactacggcgtctcaggctaaagccgtgctctccgctgaacaactgcgcgacgaggaagtccacgccggcctcggcgagctgttgcgaagtctgtcgaatagcactgccaggaacgtgacatggaaacttggctcacgactgtatggaccctcctctgtgtcttttgcagacgattttgtgcggagctctaaacagcactacaattgtgagcactctaaaataaatttcagggacaagcggtcagccctgcagtccattaacgagtgggcagctcagacaaccgacgggaaactcccagaggtgacaaaggatgtggaacgcacagacggcgccctgctggtgaacgctatgttctttaaaccgcactgggatgagaagttccatcacaagatggtcgataataggggatttatggtgaccagaagctatactgttggtgtgatgatgatgcatagaaccggactgtacaattactatgacgacgagaaggagaaactgcagatcgtggaaatgcctctcgcccacaagctctcttcgctaataatcctcatgcctcaccacgttgaacctctggaacggctggaaaagctgttgactaaggagcaattaaaaatctggatggggaagatgcagaagaaagctgtcgccatctctttgcccaaaggcgtggtcgaggtgacccacgacctacaaaagcatctcgcaggattgggcctgacggaggccattgacaaaaacaaggctgatctcagccgcatgtcaggcaaaaaggacttgtacctagcttctgtgtttcatgcaactgcattcgagctcgataccgacggaaaccctttcgatcaggacatctacggacgtgaagagctccgttctccgaaactgttttatgccgatcacccattcatctttttggttagggacactcaatcaggttctttgctgtttattggcagactggtgagaccaaagggggataagatgagagatgaactgtag

SEQ ID NO: 8994 - DNA, 378 bp, Artificial Sequence
  Description of Artificial Sequence: Synthetic coding sequence
atgcagctgctgaaggccctgtgggccctggccggcgccgccctgtgctgttttctagtactcgtgatacatgcccagttcttaaaagagggccagcttgctgccggcacgtgcgaaatcgtgaccttggaccgcgactcctctcaacctaggcggacaatcgccagacagacagcccgttgcgcctgtaggaaaggccaaatagcggggaccactagagcccgcccagcttgcgttgacgcccgcatcataaagactaagcaatggtgcgacatgctgccatgcttagaaggagagggctgcgacctcctgatcaataggagtgggtggacatgcacacaaccagggggcaggatcaaaacaactactgtgtcttag

SEQ ID NO: 8995 - DNA, 5859 bp, Artificial Sequence
  Description of Artificial Sequence: Synthetic coding sequence
atgcccgccctgggccccgccctgctgcaggccctgtgggccggctgggtgctgactctccagccactgccaccaactgcttttacccccaatggaacttatctgcagcatttagctagggatccgacaagcgggacactgtatctcggggcgacaaacttcctgtttcagctctccccggggctgcagctggaagccaccgtcagtaccggccctgttctagactctcgcgactgcctacccccagtgatgccagatgagtgtcctcaggcccagcccacgaacaatccgaaccagctgctgctggtcagccccggcgctctcgtggtctgtggcagcgttcaccagggggtgtgtgagcaacgacgacttggccagttggaacagctcctgctgcggccagagcgtccaggggacactcaatatgtggctgccaatgatcccgcagtgagcaccgtgggtttagtggcccagggcttggccggcgagccgctcttatttgtgggtaggggctatacatctcgcggcgtgggcggaggcatccctcccattactactcgtgcactgtggcctccagacccgcaggctgccttcagttatgaagagacagccaaactggcggttggaagattgtccgagtactcgcaccactttgtttcagcatttgctagaggggccagtgcttactttctatttctcagacgcgacctccaggcacaatctagggccttcagggcctatgtctcgagagtctgcctgcgcgaccagcactactactcctacgttgaactaccattagcctgcgagggcggcaggtatggcctgattcaggccgcagcagtggctaccagtcgggaggttgcccatggcgaagtgctatttgcggcattcagctctgctgcaccgcctaccgtcggacgcccaccatccgctgctgctggagcctcgggggcaagcgccctttgtgcttttccacttgatgaggttgatagactggcaaatcgtacgagagacgcatgctatacgagagagggaagggctgaggatgggaccgaggtagcctacatagagtatgacgtgaattcagactgcgcccagcttcctgtcgatactttggatgcatacccctgtggcagcgatcacactccgtccccaatggcgagccgcgttcctctggaggccacgcccatactggagtggcctggcatccagctcaccgccgtcgcagtcacaatggaagacggacacacaatcgctttcttaggcgattcgcaggggcagctgcaccgcgtttacctagggccgggtagcgacggtcatccctattctacgcaatcgatccagcaaggctcagcagtgtcccgcgacctgaccttcgacgggacgtttgaacatttgtatgtcatgactcagtcaaccctgcttaaggtgcccgttgcatcctgcgcccagcacctggattgcgcatcttgccttgcccatagagacccttattgcggatggtgtgtactgctgggccgttgttcccgtagatccgaatgctctaggggacaggggccggagcagtggctgtggtccttccagcccgagctcggttgtctgcaagttgctgccatgagcccggcaaatatcagtagggaggagacccgggaggtcttcctgtccgtgcctgacctgccacccttatggccaggcgaatcttacagttgccacttcggcgagcatcagtctcccgcccttctgacggggagcggtgtcatgtgcccttcccctgacccaagtgaagcccccgtgctcccaaggggggccgactacgtatcagtatctgtcgaactgcgtttcggggcagtcgtaatcgctaaaaccagtctttccttctatgactgcgtggccgtgaccgaactgcggcctagcgcgcaatgtcaggcatgtgtaagcagcagatggggctgcaattggtgcgtgtggcagcatctatgcacacacaaggcttcttgcgacgcgggacccatggtggcatctcaccagagtcccctcgtgtccccagatcctccagcccgaggagatggagactctgccgaattagagggcccaccagcccctctcatcctcccaagctccctcgattaccagtacgacacgccaggattgtgggagctggaggaagcgactcttggagctagttcttgtccatgcgtggagtccgtgcaagggtcaacgctgatgcccgtgcacgttgagagggagattagattactgggacgtaatctgcatttgttccaggatggacccggagacaacgagtgcgtgatggaacttgaggggctcgaggtggttgtggaagcgagagtggaatgcgagcctccccctgacacacagtgtcacgtgacctgtcagcagcaccagctaagttacgaagctctccagccggaactccgggttggattatttctccggagagcaggcagattgcgtgtcgacagcgccgaaggactgcatgttgtattgtacgattgttcagttgggcatggggactgcagccggtgccagactgcaatgccacaatacgggtgcgtctggtgcgaaggggagcgaccccgttgtgtcactagagaagcctgcggcgaggcagaggcggtcgcgacccagtgccccgcccctcttatccatagcgtcgagcctttgaccgggcctgtagacggtggtacacgtgtgaccataaggggtagcaacctcggccagcatgtgcaggacgtgctgggtatggtgacagtggctggagtgccctgtgccgtagacgcccaggagtatgaagtctccagcagcttggtttgcatcaccggcgcctcaggggaagaggtcgccggagccacagccgtggaggtgcccgggagagggcgcggggtatctgagcacgacttcgcttatcaagacccaaaggtgcactccattttccctgctagaggaccccgcgccggcgggactcgcctcacactcaacggaagtaagctgctcactggacgccttgaggacattcgagtggtggtgggcgaccagccttgtcacttactgccggagcaacagtctgagcagctgcgctgtgagactagtcccaggccaactcctgctacgctgcccgtagcggtgtggttcggggcgactgaaagacgcctgcagcgagggcagtttaaatatactctagacccgaacataacctccgctggacctactaagagctttttgtccggtggtcgggaaatttgtgtgcgcgggcaaaatctggacgttgtgcaaacaccacgaatccgggtgactgttgtttccaggatgctgcagcctagccagggcttgggtaggagaagaagggttgtgcctgaaaccgcctgcagcctgggaccttcttgcagttcccagcagtttgaagagccatgccatgtgaacagtagtcaacttatcacgtgtaggaccccagcactgccaggcctgccagaagatccttgggtgagggtggagtttatcctggacaatttggtcttcgattttgcaacactcaaccccacacctttctcatatgaagcagatcctacgctgcagccattaaatcccgaggaccccactatgcctttcagacacaagcccggttccgtattctctgtggagggggaaaatttggaccttgccatgagcaaagaggaggtggtggccatgatcggggacgggccttgcgtcgtcaaaaccttgacaaggcaccacctgtattgcgagccacctgtggaacaacccctgcctagacatcatgccctgagagaagcaccagattccctccccgagtttaccgtgcagatgggtaatttgaggttctcactgggtcacgttcagtacgatggagaaagtccaggtgcctttccagtagccgcccaagtcgggttgggggtggggaccagcttactagccctcggggtgatcatcattgtgctcatgtacagacggaaatccaagcaggccttaagggattataagaaggtgcaaatccaactggagaacctggaaagcagcgtgcgcgatcgttgtaaaaaagagtttacggacttgatgacagagatgacggatctgacctccgaccttctcggatccggtattccatttctcgactataaggtgtacgccgagcgtatttttttcccgggccaccgggaatcccctctgcatagagacctcggggtgccggaaagccggcgtccaacggtcgagcagggccttggccagctgagcaatctgctgaatagtaagctttttttgactaaatttatccacaccctagaaagccagcgcacattctctgcaagggatagagcctacgtagcgagcttgttaacggtggcactccatggcaaactggagtatttcactgatatcctgcgtacgctgctaagcgatctagtggcccagtacgtggccaaaaacccaaaacttatgctgaggcgaactgagacagtagttgaaaaactactcactaattggatgagcatatgcctttatacttttgttagggattctgtgggggagccgctgtatatgctcttccgtggtataaaacaccaggtcgataagggcccagttgacagcgtgaccggaaaagcaaaatacacacttaatgacaacagactgctgcgtgaagatgtggagtatcggccgctgaccctgaacgcccttctcgctgttggccctggagcaggcgaagcgcagggtgtgcccgtgaaggtcctggattgtgacacgatttcgcaggcgaaggagaagatgctagatcagttgtataagggagttccacttacgcagcgacccgaccctcggaccctcgatgtggagtggagatccggagtggccggccatttaatacttagcgacgaagacgtgacgtccgaagttcaggggctttggcggaggctgaacaccctgcaacactacaaagtgccagacggtgctaccgtggcactggtgccctgccttaccaaacatgtgttgagggaaaaccaggattacgtgcctggagagcgcacaccaatgttggaagatgtagacgaaggaggcatacggccatggcatttggtgaagccatctgatgagccagagccacctagaccacgccggggatcactgcgcgggggcgagcgggaaagggcgaaggcaatcccagaaatatatttgacaagacttctgtcaatgaaaggaactctccagaagttcgttgatgacctgttccaggtgattctgtctaccagtcgccctgtacccctcgccgtcaaatatttttttgacctgttggatgagcaagcccagcagcacggcattagcgatcaagacaccatccatatttggaagacgaacagcctgccactgcgtttctggatcaacatcattaagaatccacagttcgtatttgatgtgcagacgtctgacaacatggatgctgtgctgctggtgatcgcccagactttcatggacgcctgcaccctagccgaccataagctgggacgggactcccccattaacaaactgctgtatgctcgtgacatcccaaggtacaagcgtatggtcgagcggtactacgcagacattcggcagactgtgcccgcatcagaccaggagatgaatagcgtactcgctgagctatcctggaattactccggcgatttgggagcccgggtcgctcttcatgagctgtacaagtacatcaacaaatattatgaccagatcattacagccctcgaagaggatggaactgcccaaaagatgcagctcggttatcgactccagcagatcgccgccgccgtagaaaacaaggtcaccgatctctag

SEQ ID NO: 8996 - DNA, 342 bp, Artificial Sequence
  Description of Artificial Sequence: Synthetic coding sequence
atgctggtgctgttcctgctgggcaccgtgttcctgctgtgcccctactggggggagctacacgaccccataaaggccacggagatcatgtgttacgagtgcaaaaaatatcatctcggcctgtgctacggggtgatgacttcctgttcccttaagcacaagcagagctgtgctgtagagaatttctacattctgacccgtaagggccagagtatgtaccactattccaagctgagctgcatgacgagttgcgaggacattaactttctcggatttacgaaacgagtggaacttatctgctgtgaccacagcaactactgcaacctcccagagggcgtctag

SEQ ID NO: 8997 - DNA, 6408 bp, Artificial Sequence
  Description of Artificial Sequence: Synthetic coding sequence
atgcccgccctgggccccgccctgctgcaggccctgtgggccggctgggtgctgaccctgcagccactgcctcctactgcgttcactcctaatggcacttatttacagcatctggccagggatccaacttcgggtacactatacctgggtgccaccaactttctgttccagttgagtcctgggttgcaactggaagccacagtctccaccggccctgtactggatagcagggactgtctgcctcccgtaatgcctgatgagtgtccccaggcacagccaaccaataatcctaaccagctgctactggtgtcccctggtgctcttgtggtttgcgggagtgtccaccagggagtctgtgagcagcgcaggttgggccaactcgagcagctcctattgcgccctgaaaggccgggtgacacacaatatgtggctgcgaatgaccccgctgttagtactgtgggactggtggctcagggcctcgccggggagccacttctctttgtggggcggggctatacatctagaggggtgggaggcggaatcccccccatcaccaccagagcgctgtggccccccgaccctcaagcggcattttcatatgaggaaacagctaaactggccgtgggccgactctctgagtattctcaccactttgtgagtgcttttgcacgcggagctagcgcatacttcctctttctgcggcgggatctgcaggcacagtctagggcctttcgggcttatgtgagcagggtctgccttcgggaccagcattactacagttacgtggagctaccacttgcttgtgagggtgggcggtacggcttgattcaggctgcagcagtggccacgtctcgcgaagtagcacacggcgaggtgctgtttgcagccttctcttccgctgctcctccaaccgtggggcgtccacctagcgcggcggccggcgcctccggtgcatccgcgctttgcgccttcccactagatgaagtggacaggcttgccaaccgcactcgcgacgcttgttacactcgggaaggcagggccgaggatggcacagaagtggcatatattgaatacgacgtgaacagtgactgcgctcagctcccagttgacactctcgacgcatacccatgcggatccgaccatacaccaagccctatggctagcagggtgcccctggaggctacccccatcctggagtggccaggaatacagctgacagcagttgcagtaaccatggaggacgggcacactatagcgttcctgggggactcgcagggacagttgcacagagtttacttggggcctggatccgatggccatccatattccacccaaagcatccagcaaggctctgccgtttcgcgcgacctgacgtttgacggaactttcgagcacctgtatgtcatgacccagtccaccctccttaaagtgcccgtggcgtcatgcgctcaacacctcgactgtgcatcatgccttgcgcacagagatccatactgtggctggtgcgtgctgctgggccgatgttcccgcagaagcgagtgctcccgcgggcaggggcccgagcagtggctctggtcattccaacccgagctgggatgtcttcaggtcgctgccatgagtcctgccaatattagcagggaagagaccagggaagtttttctctccgtgcccgatctgccacctttgtggccaggagagagctactcttgccatttcggggagcaccagagccccgccctgctgacaggatccggcgtgatgtgtccgtcccccgaccctagcgaggcccctgtgcttcctaggggcgccgactacgtgagtgtgagtgtggaactccggtttggagcggtcgttatcgctaaaacttccctgtctttctacgactgcgtcgctgttactgagttaaggccgtcagctcaatgccaggcctgtgtatcgtctagatggggttgcaactggtgcgtttggcagcatttatgcacgcacaaggcctcatgtgatgccggccctatggtggcaagtcaccagtctccactcgtgtcacctgacccgcctgcaagaggcggtcctagtcctagtccccccactgccccgaaagctttagccactcctgctccagatacacttccggtggaacctggcgctccttccactgcaacagctagcgacatttcccccggcgctagccccagcctgttgagtccctggggtccatgggccggtagcggcagtatcagtagcccagggtccacgggaagtcctctccatgaagagccctctccaccttctccgcagaacggccccgggaccgctgtgccagctccgactgactttaggccctccgccacccctgaggatctcctcgcctctcctctctcaccatcagaggtcgcggccgtgccacctgccgatcccggcccagaggcccttcaccccaccgtgccactggatctccctccagcaactgtgccagctaccacattccccggagccatggggtccgtgaaacctgccctcgactggcttacaagggaggggggagagctacccgaagccgatgaatggactggtggagatgcacccgcattctccacgtctaccctactgtccggcgacggtgattctgctgagctcgaggggcctccggctcccctgatactcccctcgagcttggactaccagtatgacacgcctggcctttgggagttggaggaggccacattaggggcgtcaagctgcccttgcgtcgagtcagtgcagggctcaaccttaatgccagtgcacgttgaacgggaaattcggctcttgggacgaaacctccatctctttcaggatgggccgggcgacaatgaatgcgtgatggagcttgaagggctagaggttgtcgtggaagcacgggtggaatgtgagcctccacctgacactcagtgccacgtcacctgccagcagcatcagctctcctatgaggcccttcagccagaacttagagttggactgttcctcaggcgcgctggacggctgcgggtggattcagcagaaggcctgcatgtggtgctctacgattgctcagttggacatggcgattgttctcggtgccagactgcgatgcctcagtacggatgtgtctggtgtgagggggaacgcccacggtgcgtaactagagaggcctgtggcgaagcagaggccgtggctacccagtgccctgcaccactgatccacagcgtcgaaccgctcacagggcctgtggacggtgggacccgtgtgacaatccggggaagcaatctgggccaacacgtccaggacgtcctgggcatggttaccgtggcaggtgtcccctgtgccgttgatgcccaagagtatgaggtctcaagttcattggtctgcattaccggcgccagtggcgaagaggtggctggcgcgactgccgtagaagtgcccggaagggggcgcggagtctccgagcatgacttcgcatatcaagatcccaaggtgcactcaattttccctgcccggggaccgagagcaggtggcacccgtctaaccctcaacggttctaagctgctcaccgggagactggaggatatacgggtcgtagtgggcgaccaaccatgccatctgctcccagagcagcagtctgagcaactgcgatgcgagacttctccacgccctactcccgccacactcccggtcgcagtgtggtttggggctacagagcgcagactgcagcgggggcagttcaagtacacgctggaccccaacattacttcagccgggcctaccaaatcattcttgtccggcggcagggagatctgcgtacgcggacagaatttagacgtggtgcagacccccagaatacgcgtaaccgtggtctccagaatgctgcaacccagtcagggcttggggcggagacgccgggtggtacccgagaccgcttgtagcctggggcccagctgctcttctcaacaattcgaggagccttgtcacgtaaactccagccagctcatcacctgtcgaacacctgccctccctggcctccctgaggatccgtgggtgagggtcgaattcattttggacaacttggtattcgacttcgctaccctaaatcccacacctttctcctacgaggcggaccctaccctccaacccctgaaccctgaggaccccaccatgcccttcaggcacaagccaggttccgtgttcagcgtggagggcgagaatctggacctcgcgatgtccaaggaggaagttgttgccatgataggtgacggtccctgtgttgtcaagaccctgacacgacatcatctctattgcgaacctcctgtagaacagcccttgccgcgacatcatgctctgagggaggctcccgattcattaccagaattcactgttcagatgggtaatcttcgattttcactcgggcatgttcagtatgacggtgagtcaccaggggcattccccgtggcggcacaagtaggactaggtgtgggcacgtcactactggctctgggagtgattatcatcgtgctaatgtaccggcggaagtctaagcaagccctccgagactacaagaaagtccaaattcagctagagaacctggagagcagtgtgagagatagatgtaaaaaggagttcacagatttaatgaccgaaatgactgacctcacgtccgatttactgggctcggggataccgtttctggactataaggtttacgcggagaggatctttttcccgggacatcgggaatctccactccatagggacctgggggtgcctgagtcgcggagacccacagtggagcaaggtctggggcagctgtccaacctcctgaactccaaactgttcctaaccaagtttatccatacgctcgagtcacagcgcacattttccgcccgggacagagcctatgttgcgtccttgctgaccgtagctctccacggcaagttagagtactttaccgacatactgagaacactgctttcagacctcgttgcacagtatgtagccaagaacccgaagttaatgctccgacgaacagaaaccgttgttgagaagctgctcaccaattggatgagcatttgcctgtacacatttgtgcgggactccgtaggcgaacctctctatatgttgtttcgaggtatcaagcaccaagttgataaagggccagtggattcagtcacagggaaggccaaatacacccttaacgacaataggcttctgagagaggacgtagaatatagacccctgaccctcaatgcccttttagctgtgggtcccggggcgggcgaggctcagggagtgcctgtgaaagtgctggattgtgacacaatctcacaggccaaagagaaaatgctcgatcagttatataagggcgtccccttgacacaaaggcccgatccgcggacactcgatgtggagtggcgctctggtgtcgcaggacacctcatcctgagcgatgaggatgtcacctccgaggtccagggtttgtggcgtaggctaaatactctacagcattataaggtcccagatggagcaacagtcgcccttgtgccctgcctaacaaagcatgtcctgagggagaaccaggattacgttcccggcgaaaggactcctatgttggaggatgtcgatgagggtggcatcagaccttggcatcttgtaaagccatccgacgagcctgaaccgcctcgacctcgccggggaagcctccgaggcggggaaagggagcgggccaaagcaatcccggagatctacctcacccgtcttctgagcatgaaaggtactttgcagaagttcgtggacgacctctttcaggtgatcctatccacctcccggccggtgcctctggccgtaaagtatttctttgacttactggatgaacaggcgcagcaacacggcatcagcgatcaagacacaatccacatttggaaaacgaatagcctgccactgaggttctggatcaacatcattaaaaacccccagttcgttttcgacgttcagacctcagacaatatggatgcagtactgttggttatcgctcaaacattcatggacgcctgcaccctggctgaccataaactgggacgggattcacctataaacaaattgctctatgccagagatatcccacgctataaacgcatggtcgagagatactatgcagatatcaggcagactgttccagcctcagaccaagagatgaacagcgtgctcgccgagcttagttggaactactctggagatctgggtgctcgagtggctctgcacgagctgtacaaatacataaacaagtactacgaccagattatcactgctttggaggaggacggcaccgcccagaagatgcaattgggttaccggttacagcagatagccgcagcagtcgaaaacaaggttaccgacctgtag

SEQ ID NO: 8998 - DNA, 390 bp, Artificial Sequence
  Description of Artificial Sequence: Synthetic coding sequence
atgcggcccctgaagcccggcgcccccctgcccgccctgttcctgctagcacttgccctgagccctcacggcgctcatgggcgcccgaggggaaggagaggcgcccgggtgacggacaaggagccaaagccgcttctgtttcttcccgccgcaggagccggccggactcccagcggctccaggtctgcagaaatttttccaagagactcgaacctgaaagacaagtttataaagcacttcaccggccccgtgacattttctcctgaatgttccaaacacttccatcggctgtactataacacgcgagagtgcagtacccctgcctattataaacgctgtgccagactgttaactcggctggccgtaagccctttatgctcgcagacttag

SEQ ID NO: 8999 - DNA, 252 bp, Artificial Sequence
  Description of Artificial Sequence: Synthetic coding sequence
atgcggctgagcgtgtgcctgctgatggtgagcctggccctgtgctgctaccaggcccacgccctagtatgccccgctgttgctagtgagattacggtgttccttttcttaagcgatgccgcagtgaacctgcaggtggctaagctgaatccaccaccagaggcccttgccgctaaactggaagtcaagcattgtactgaccagatctcttttaaaaaaagattgtctctcaagaagagttggtggaaatag

SEQ ID NO: 9000 - DNA, 1455 bp, Artificial Sequence
  Description of Artificial Sequence: Synthetic coding sequence
atgtggtacgtgagcacccggggcgtggccccccgggtgaacttcgagggagcattattttcaggctatgccccagacggcgggctcttcatgccggaagaattgcctcagctggatcgagggaccctgtgccagtggagtactctttcatacccaggcttggttaaggaactttgtgcactgttcatagggtcagaactattacctaaggatgaactgaacgacctgattgaccgggcctttagcagatttaggcaccgcgaagtagtccacctcagtcgacttaggaacggactcaacgtcctggaattatggcacggggtgacctacgccttcaaggacttgtcacttagctgtactacgcagttcctccaatattttcttgaaaaaagggagaagcatgtcacagttgtggtcggaacaagtggggatacaggcagcgcagcaatcgagagcgtccagggggctaagaatatggacattatcgtcctccttccaaaaggccattgtacaaaaatccaagagttgcagatgaccaccgtcctgaagcagaacgtccatgtgttcggcgtggagggtaacagcgatgagctggacgagcccattaaaacagtgttcgccgacgtggctttcgtcaagaagcacaacctgatgagtctcaacagcatcaactggagtcgggtgctggtgcagatggctcatcacttcttcgcttacttccagtgtactccatcgctggacacacatccgttgccgctcgtggaagtcgtcgttccgaccggcgccgccggaaatctcgccgctgggtatattgcgcagaaaatcggtctgcccattcgcctcgtggtggccgtcaaccggaacgacataattcaccgcacagtgcaacagggtgacttttccttgagcgaggcagtgaaatccactctggcatcagccatggacatccaggtgccttacaatatggagagagtcttctggctcctctctggcagtgattcccaagtcaccagggcactgatggagcagttcgagcgcactcagtctgtgaatctgcccaaggaattacacagtaaattaagtgaggccgttaccagcgtttcagtgagcgatgaggccatcactcagacaatgggaagatgttgggatgaaaatcagtacctgctttgtccccactcagccgtggcagtgaactatcactaccagcagatcgatagacagcagccttcaacaccccgctgctgccttgcccccgcaagcgctgctaagttcccagaggccgtgctggctgcaggcctaacaccagagaccccagccgagatcgtggccctggagcacaaggagacccgctgtacactcatgagaagaggcgacaactggatgctcatgctgcgggacacaattgaggacctctcacgtcaatggcgtagccatgcgctgaatacctcacagtag

SEQ ID NO: 9001 - DNA, 159 bp, Artificial Sequence
  Description of Artificial Sequence: Synthetic coding sequence
atgaagctgtgcgtgaccgtgctgagcctgctggtgctggtggccgccttctgtagtctggcgctcagtgcgccttccaataagcccctcgaggcgagcaaaagtgcactgactcctgttagcccagggagtcgatctacttgcatgacatggaactag

SEQ ID NO: 9002 - DNA, 675 bp, Artificial Sequence
  Description of Artificial Sequence: Synthetic coding sequence
atgcgggtgagcggcgtgctgcggctgctggccctgatcttcgccattgtgacaacctggatgttcatacgctcttatatgagcttctctatgaagactatcagactgccgaggtggctcgcagcatccccaacaaaagagatccaggttaagaagtataaatgtggtcttatcaagccctgtcccgccaactactttgcatttaaaatctgtagtggcgctgcaaatgtggtagggcctacgatgtgctttgaggacaggatgatcatgagccccgtcaagaacaatgtagggagaggactgaatatcgctttagtaaacgggacgaccggcgccgtgctaggacagaaagcatttgacatgtatagcggggacgtaatgcatctggtgaagtttttaaaagaaatccctggtggagccctagtcctagttgcctcatatgatgatcctggaactaaaatgaatgatgagtccagaaaactgttttctgatttgggatcctcttatgccaaacaattagggttccgcgatagttgggtgttcataggcgcaaaagatctgcgtggcaagtctccctttgaacaatttctaaagaattcccccgatacaaataagtacgaagggtggccagagctattagaaatggaagggtgcatgcctccaaagcccttttag

SEQ ID NO: 9003 - DNA, 1404 bp, Artificial Sequence
  Description of Artificial Sequence: Synthetic coding sequence
atgctgatcttctggaccatcaccctgttcctgctgggcgccgccaaaggcaaggaggtctgttacgaagacctaggctgtttttccgatactgagccctggggagggactgctattagacccctgaagatcctgccttggtccccggagaaaattggaacacgttttctcctgtacactaatgaaaatccaaacaattttcagatcctcctcctttccgatcccagtacaatcgaggcttcgaacttccaaatggacaggaagacccgcttcataatccacggcttcattgataagggagacgagtcttgggtgactgatatgtgcaagaagttgtttgaagtcgaagaagttaactgtatttgcgtggattggaagaaagggtctcaggcaacctacacacaggccgctaataatgtaagagtggtgggggcacaagtcgcccagatgctggatatattgttgaccgagtattcttacccccccagcaaggtccacctgattggacatagtctgggggctcacgtggctggagaagccggcagcaagactcccgggctgtcgcggatcacaggccttgatccggttgaggcgtcatttgagagcactcctgaagaggtgagattggacccaagcgatgcagactttgtcgatgtcattcatacagatgccgccccactgatcccatttctgggcttcggaaccaaccagcagatggggcaccttgattttttccctaacggcggagagtctatgcctggctgcaaaaaaaatgccctcagccagatcgtggatctggacggaatctgggccggtacaagagacttcgtggcttgcaaccatctgcggtcctacaagtactacctagagagcatactcaaccctgacggatttgctgcctatccctgcacaagctacaaaagcttcgagtccgataaatgcttcccctgtcctgatcaggggtgtcctcagatggggcactatgctgataaattcgccggtcgcacttccgaagaacagcagaagtttttcctgaacaccggagaggcttctaactttgcaagatggaggtacggcgtgtccatcaccttatcgggtcggaccgccacaggacaaatcaaagtcgctttatttggaaacaaaggtaatacacatcagtactctatattcagaggtattctcaagcccggatctacccacagctatgagttcgacgcgaagctcgacgtgggcaccatagaaaaggtcaaattcctctggaacaacaatgtgatcaatcctaccctgcccaaagttggtgctacaaagatcaccgtccagaaaggggaagagaagaccgtctataacttttgtagcgaggataccgtgcgcgaagatactctgctgacactgacgccctgttag

SEQ ID NO: 9004 - DNA, 237 bp, Artificial Sequence
  Description of Artificial Sequence: Synthetic coding sequence
atgggcagcggcctgcccctggtgctgctgctgaccctgctgggcagctcccatgggacaggtcccggcatgaccctacagctgaaattgaaagagtctttcctcaccaattcttcctatgaaagcagtttcttagagctgctggagaagctgtgcctgcttctccatcttccatcaggcacgtccgtgactctacatcatgctaggagtcagcatcacgttgtgtgtaatacctag

SEQ ID NO: 9005 - DNA, 291 bp, Artificial Sequence
  Description of Artificial Sequence: Synthetic coding sequence
atggagcacaaggaggtggtgctgctgctgctgctgttcctgaagtccggccagggggaacccttagatgactacgtgaacactcagggtcctagcctgttttctgtgaccaaaaagcagcttggcgctggctcaagagaggaatgcgcggccaaatgcgaagaggacaaggagtttacgtgccgcgcttttcagtatcactccaaagagcaacaatgcgtaattatggcggagaataggaagtcttccattataattcggatgcgagatgcggtgttgttcgaaaaatag

SEQ ID NO: 9006 - DNA, 1083 bp, Artificial Sequence
  Description of Artificial Sequence: Synthetic coding sequence
atgggcctgctgctgctggtgcccctgctgctgctgcccggcagctacgggctgccgttttacaatgggttctattacagcaatagcgctaacgatcagaatctggggaacggtcacggaaaagacctgctgaatggcgtgaagctcgtggtggaaacacctgaggagaccctgtttacctatcagggagcctccgtcatccttccctgccgttatcgctatgagcccgccctggtatccccacgacgcgtgagggtcaagtggtggaaactgagtgagaacggggcccccgaaaaggatgtgctggtggctatcggattaaggcataggagctttggagactatcaaggcagagttcacctccggcaagacaaagaacatgatgtgagcctcgaaatccaagatctgcgcctagaggattacgggcggtacaggtgtgaggtgatcgatggccttgaggatgaaagtggactggtcgagctggaactgcgcggcgtagtgttcccttaccaatccccaaatgggagatatcagtttaatttccacgagggccaacaggtgtgcgccgagcaagccgccgtcgtcgcctccttcgaacagctgtttagagcctgggaagaggggctcgactggtgtaacgcaggctggctgcaggatgccaccgtgcagtacccaattatgttgccccgccagccttgcggagggcccggactggctcccggggtgagatcatatggaccacggcaccgccgcctgcaccggtacgacgtgttctgctttgcaactgcactcaagggtcgtgtttattatctggagcatccagaaaaactgacactgaccgaggcccgggaagcctgtcaggaggatgacgctaccatagcgaaggtgggtcaactctttgcagcctggaaattccatgggctcgatcgttgtgacgccggttggttggctgatggatctgtgaggtaccctgttgtgcacccacatcctaactgtggccctccagagcccggagtaagatctttcggcttcccggaccctcaaagtcgattgtacggggtgtactgctaccgacagcattag

SEQ ID NO: 9007 - DNA, 810 bp, Artificial Sequence
  Description of Artificial Sequence: Synthetic coding sequence
atgatccggaccctgctgctgagcaccctggtggccggcgccctgtcctgtggggatcctacttaccccccttatgtgacgagggtggtggggggcgaggaagcgcgtcctaatagttggccatggcaggttagcctgcaatacagttccaacgggaaatggtatcacacatgcggaggctcacttattgcaaacagctgggtcttgactgccgctcattgcatatctagcagcagaacctatcgcgtcggacttgggcggcataacttgtacgtggccgaatcggggagtttggccgtttcagtcagcaagattgtggtgcataaggactggaattctaaccagatttcgaaaggcaatgatatagctctcctgaaacttgcgaatccggtgagcttgactgacaaaatccaattggcgtgtctgccccccgctgggaccattctgcccaacaactacccctgctacgtaactggatggggtcgactacagacaaacggcgccgtccctgatgtgctgcagcaaggcaggttgctggttgtcgactatgcaacctgttcaagcagcgcgtggtggggtagttctgtgaaaacctccatgatctgcgcaggcggagatggagttatctcctcatgtaatggcgacagtgggggcccactaaattgccaggcgtctgatgggcgttggcaggtgcacggaatcgtttctttcggtagcaggctcggctgcaactactaccataagcctagcgttttcacaagagtgtccaactacatcgactggattaattctgtcatcgccaacaactag

SEQ ID NO: 9008 - DNA, 1122 bp, Artificial Sequence
  Description of Artificial Sequence: Synthetic coding sequence
atgctgccctggctgctggtgttcagcgccctgggcatccaggcctggggtgactcctcctggaataagacccaggctaagcaagtgtccgaggggttgcagtatttgtttgaaaacatctcacaattgacagagaaaggtttgccgaccgatgtcagtactactgtctcccggaaggcgtggggagctgaggccgtggggtgttccatccaactcaccaccccagtcaatgtgctggttatccaccatgtgccgggactagagtgccacgatcagaccgtatgtagtcaacggttacgggaattgcaggcacatcacgttcacaacaattctggctgtgacgtggcgtacaattttctcgtgggagatgacgggagagtgtatgaaggggtgggctggaatatccaaggagtgcacacacaaggttacaataatattagtctaggtttcgccttcttcgggacaaagaaaggtcatagcccctcccctgcagccctgtccgccatggagaacttaataacatacgcagtgcaaaagggacacctaagcagcagctacgtgcagccactgctgggtaagggcgagaactgcctggctccacgacagaagacttcattgaaaaaagcctgccccggtgtcgtgccacggtcagtgtggggtgctcgtgagacgcactgtcctagaatgaccctgccggcgaagtacggcatcataattcatacagccggacgcacctgcaacatttcagacgagtgcagattattggtcagagacattcaatcattttacattgaccgcctaaaatcgtgcgacattggatataacttcctagtgggccaggacggggccatttacgagggggtggggtggaacgtgcagggctccagcacccccgggtatgacgatattgcattggggattactttcatgggaacatttacagggataccaccaaacgccgcagccctggaagccgctcaggatctcatccagtgcgctatggtgaagggctatttgacccctaactacctactggtggggcacagtgatgtggcccggaccctctcacccgggcaggctttatataatatcatctctacttggccacactttaagcattag

SEQ ID NO: 9009 - DNA, 327 bp, Artificial Sequence
  Description of Artificial Sequence: Synthetic coding sequence
atgcggcagcggctgctgcccagcgtgaccagcctgctgctggtggcactcctctttccaggatcatctcaagccagacacgtcaaccactccgcaactgaggctctcggcgagctgagggaaagggccccagggcagggcaccaatggattccaattacttagacatgccgtgaagagggatctattacccccaagaactccaccataccagggggacgtgcctccaggtatacgaaatacaatttgccacatgcagcaaggcatctgtagacttttcttttgtcattccggcacagggcagcaacatcgacaaagatgcggctag

SEQ ID NO: 9010 - DNA, 708 bp, Artificial Sequence
  Description of Artificial Sequence: Synthetic coding sequence
atgagcccccccctgctgaagctgggcgccgtgctgagcaccatggcgatgatctcgaactggatgtcccagaccctgcccagtctcgtgggcctcaataccactagactttcgacacccgacaccctgacccaaatctcaccaaaggaggggtggcaggtatactctagtgcacaggaccccgacggccgctgcatctgtactgtggtcgcacccgagcagaacttgtgctctcgggatgccaagagccgtcagctcagacagttattagagaaggttcagaacatgagccaaagtatagaggtgctcaaccttcgtacacaaagagatttccagtatgtgttaaaaatggaaacccaaatgaaaggactcaaggcaaaattccgacagatcgaggacgacagaaagactctaatgacgaaacacttccaagaactcaaggagaaaatggatgagctactgcccctgataccagtgttggagcagtataaaacagacgctaaactgataactcagttcaaagaagaaatacggaatttgtccgccgtgctaactggaattcaggaggaaatcggagcttatgactacgaggagctgcatcagcgggtcctgagcctggagacccggctgcgagactgtatgaaaaaacttattgacctcaagaagaggaaagaagaagagaagagacagcaaaaaggcgaagcttag

SEQ ID NO: 9011 - DNA, 606 bp, Artificial Sequence
  Description of Artificial Sequence: Synthetic coding sequence
atgaacctgaactgccccccctgcgtgaccggcctgcgggtgtggagctcatgtcgctcaaagccaaatagccgcgcccgctcttgccggagttgtacaggcgcttcaagaaccctgccttcgcatcacatgtctcacgtagagtgtccatctggaatcgtgaacgaggagaactttaagcagatctatagccaatttttcccacagggtgattcatccacttacgccacctttttgttcaatgccttcgataccaaccacgacggttcagtgagcttcgaggactttgtggctggtctgagcgtcatcctgcgtggcacggtagacgatagacttaattgggccttcaatctttacgatcttaataaggatggctgtatcacaaaggaggagatgctggatatcatgaaaagtatctatgacatgatgggcaaatatacataccccgctctaagagaggaagctcctcgggagcacgtcgagagctttttccagaaaatggacaggaataaagacggagttgttaccatcgaggagtttattgagagctgtcagaaggatgagaatattatgagatcaatgcaactcttcgacaacgtaatctag

SEQ ID NO: 9012 - DNA, 693 bp, Artificial Sequence
  Description of Artificial Sequence: Synthetic coding sequence
atgcggctggccggccccctgcggatcgtggtgctggtggtgagcgtaggagttacgtggattgtggtcagcattttgctgggaggtccagggtccgggtttcctaggatacagcagttgttcacttcaccggaaagctctgtgaccgccgccccacgtgcccgcaagtataagtgtggattacctcaaccttgtccagaagaacacctggcatttcgcgtggtaagtggggccgcaaacgtcattggccccaaaatctgcctggaggataaaatgttaatgtccagtgtgaaggacaacgtaggaaggggattaaacattgccttagtcaacggggttagcggagaacttattgaggcccgtgcattcgatatgtgggcaggcgatgttaacgatttgctgaaattcataaggccacttcatgaaggaaccttagtgttcgtggccagctatgatgaccccgcaaccaagatgaatgaagagacacggaagctgttctctgagctggggagtcggaatgccaaggagttggcctttcgtgactcctgggtgttcgtcggcgccaaaggagtgcagaataaaagcccctttgagcagcacgtgaagaatagcaagcacagcaacaagtacgaaggctggcccgaggctcttgagatggagggctgtataccccggcgatctaccgcttcatag

SEQ ID NO: 9013 - DNA, 684 bp, Artificial Sequence
  Description of Artificial Sequence: Synthetic coding sequence
atgcgggtggccggcgccgccaagctggtggtggccgtggccgtgttcctgctgacattttatgttatcagccaggtgtttgagattaagatggacgcttccctgggaaatctgttcgcaaggagcgccctcgatactgccgcccgctctacaaaacccccccgctacaaatgcggtatttcaaaagcctgccccgagaagcattttgccttcaagatggcatccggggcggcgaacgtcgtgggaccaaagatctgcctcgaagataacgtactaatgagtggagttaagaataatgtggggcgcgggattaacgtggcactggcgaatggaaagacaggggaggttctggacaccaaatactttgacatgtgggggggcgacgtggccccttttattgaattccttaaagccattcaagatgggaccatcgtcctaatggggacctatgacgacggcgccacaaagcttaatgatgaggctaggagactgatcgccgatctcggatctacaagcattacaaatctgggattccgggataattgggtgttctgcggtggcaaaggcatcaagacaaaatctccattcgaacagcatatcaaaaacaataaagatactaataaatatgaagggtggcctgaggtggtcgagatggaaggttgcattccgcagaaacaggattag

SEQ ID NO: 9014 - DNA, 1656 bp, Artificial Sequence
  Description of Artificial Sequence: Synthetic coding sequence
atggaggacagcgacagcgccgccaagcagctgggcctggccgaggcagccgcggcagggggcgaagccgaagagccagttcttagtcgggacgaggattccgaggaggatgctgattcagaagcagagagggaaacccctcgtgtcaccgccgttgcggtcatggcggccgagcccgggcatatggatatgggagctgaggcactgccaggtcctgatgaagccgcggcagccgcggcgttcgccgaggtgacaactgttaccgtcgccaacgtgggggcagcagccgacaatgtgttcaccacttcagtggctaatgcagcctctatttcaggacacgtgctcagtggccgcacggcgctgcagattggtgattcgctgaacactgaaaaagctaccctcattgttgttcacaccgatgggtcgatagtcgaaactacgggtcttaagggacctgcagccccgctgacacccgggccacagtccccacccaccccgctggcccccggacaggagaaaggaggcactaagtacaattgggatccaagcgtctacgatagtgaattaccagtccggtgtcggaatatctctggcacactgtacaagaacaggctaggcagtggtggtcgaggcagatgcatcaaacagggagagaactggtactctccaactgaattcgaagctatggcaggtcgtgccagttcgaaggactggaagaggtctatccggtacgccggacgaccactccagtgtttgattcaggacggaattttgaacccccacgccgcttcttgtacctgtgcggcatgctgtgatgacatgacactcagtggccccgtaagactgtttgttccctacaagcgccggaaaaaggaaaatgaacttcccacaacacccgttaagaaggattctcccaaaaatatcacactgctaccagccacggccgctactacttttaccgttactccaagcgggcagatcaccacgtccggagcactgacttttgatcgagccagtacagttgaagctaccgcagttataagcgaaagccccgcccagggagatgtgtttgccggtgccacggtgcaggaggcctctgtccagcccccctgccgcgcttcgcatcctgagccccattaccctggatatcaggactcgtgccagatcgcacctttcccagaggccgctctgcctactagccaccccaagatcgtgctgaccagtctgcctgccctggccgtccccccccctacaccgacaaaggctgctcctcctgcactcgtcaacgggctcgaactatccgagcctcgttcctggctttacttggaagaaatggttaatagccttctgaatacagcacagcagttgaaaacacttttcgagcaggcaaagcatgctagcacctacagagaagcggctacaaatcaagcaaaaatccacgctgatgccgagagaaaagagcagtcttgtgttaattgcgggcgagaagcgatgtctgaatgtactgggtgccacaaggttaattactgctccacattctgccaacggaaggactggaaggatcaccagcacatctgcggccagtcagccgcggtgaccgtgcaggcggacgaggtgcacgtggccgagtctgttatggagaaggttaccgtttag

SEQ ID NO: 9015 - DNA, 2022 bp, Artificial Sequence
  Description of Artificial Sequence: Synthetic coding sequence
atgaagcccggcggcttctggctgcacctgaccctgctgggcgcctctctcccagcggctctgggttggatggacccaggaactagccgggggcccgacgtcggcgtgggagaatctcaggctgaagagcccaggagttttgaggtgacccgtcgagaaggactgtcctcgcataatgagctgctcgcttcttgtggaaaaaaattctgtagcaggggctcaagatgtgttcttagcctggcccccgaggatagggtttccgtgaccacagtcaccgtcggtttatcaaccgtgttgacctgtgcagtgcatggagacctacgaccccctatcatttggaagcggaatggattgactcttaactttcttgacttggaagatattaacgacttcggcgaggatgacagcctctacatcaccaaagtgacaacgattcacatggggaattatacttgccatgcttctggtcatgaacaattattccagacccatgtgttgcaggtgaatgtcccaccggttatcagggtttacccagaatcccaggcccaagaacccggcgtcgctgcgagcctgaggtgccatgccgaagggatccctatgccccggataacttggctcaaaaatggggtcgacgtgtccactcaaatgtctaaacagttgagcttgctggctaatggttcagagttacatatttcatcagtgcgctatgaggatactggcgcttacacatgtattgctaaaaacgaggttggcgtggacgaagacattagctcactgtttatcgaagattctgcgcgtaaaactttagcaaatatcctgtggcgggaggaggggctctccgtgggaaatatgttttacgttttttcagacgacggcatcatcgtgatacaccccgtcgattgtgagatccagcggcacctgaaacctaccgagaagatcttcatgtcttatgaggaaatctgccctcagcgtgagaagaacgcgactcagccatgccaatgggtgtctgccgtgaacgtaaggaatcgatatatctatgtggcacaacctgctctttccagggtcctggtggtggatatccaggctcagaaggttctgcaatccatcggtgtcgaccccctgcccgccaaattatcctacgacaaatcacacgatcaggtctgggtactgagttggggtgacgtccacaaaagcagaccctccttgcaggtcattaccgaggcatctaccggtcagtctcagcatctgatcagaactcctttcgccggggttgacgatttcttcataccacccacaaacttaatcatcaaccacatcaggtttggcttcattttcaacaagtctgacccggccgtgcacaaggtcgatttggaaacaatgatgcccctcaaaaccatcggattacatcaccatggctgcgtgcctcaggccatggcacacacccatttgggaggatattttttcatccagtgccgccaggattctcccgcttcagccgctcgccagctcctggtggactctgtcactgattccgtgctggggccaaatggggatgtcaccggaaccccccataccagtcctgatggtcggttcatagtttcagctgcggcagattcaccgtggctgcatgtccaggaaatcacagtgcggggcgaaatccagaccctgtatgacctgcagattaacagcggcatatctgacttggcgtttcaaagatccttcaccgaatctaatcagtataatatttatgccgcactgcataccgaacccgatctccttttcctggagctctcaaccgggaaagtgggcatgcttaagaaccttaaagagccacctgcaggacctgcccaaccctggggtgggacacatcggatcatgcgagacagcggcctgttcggtcagtacttgctaactcctgctcgggaaagtctgtttctgattaatggtcggcagaatacgttgaggtgcgaggtgagtgggatcaaaggtggcacaaccgtggtttgggttggagaggtgtag

SEQ ID NO: 9016 - DNA, 2007 bp, Artificial Sequence
  Description of Artificial Sequence: Synthetic coding sequence
atggacctggtgctgaagcggtgcctgctgcacctggccgtgatcggggccttgctggcagttggcgctactaaggtgccccgcaatcaggattggctgggcgtctctcggcagttacggactaaggcttggaaccgacagctttaccctgagtggaccgaggctcagcgcttggattgctggagaggcggccaggtgagcctgaaggtgtccaatgatggcccaacactcatcggtgccaatgcctccttttccattgcactcaattttcctgggtcccagaaggtcttacctgacgggcaggtaatttgggtgaacaatacgatcattaacggagatcaggtgtggggcggccagcccgtgtacccccaggagacagatgacgcttgtatatttccagatggaggtccctgcccatcagggagctggtcgcagaagcgtagcttcgtgtatgtgtggaagacttgggggcaatactggcaggtacttgggggccctgtctcaggactttcgattggaactgggagggccatgcttgggacccacacaatggaggtaacggtttatcacagacgcggatcccgcagttacgttccattggcacatagctcctccgcctttactattaccgaccaggtgccattttcagtatctgtgagccagctaagagctctggacggggggaacaaacactttctgcgaaatcagcccctcacctttgcactccagctgcatgatccaagcgggtatctggccgaggcagacctgagctatacctgggatttcggcgattctagcgggaccctgatctcaagggccctggtagttacccacacctacctcgaacccggacctgtgaccgcacaggttgtcctgcaggccgctattccactcacaagctgcggatcaagtccggttcctggcaccactgatggtcatagacctacagcagaagctcctaatacaaccgccgggcaggtgcctacaacggaagttgtgggtactaccccaggtcaggctccaacagctgaacctagcggaaccacttccgtacaggtgccaactactgaagtgatatccaccgcgcccgtccagatgccaaccgccgagtctaccgggatgacaccagaaaaggtacccgtgtcggaagtgatggggacaaccctggctgaaatgtctaccccagaggccaccgggatgactccagctgaagtaagcatcgtggtgctatcggggaccaccgccgcacaagtgaccacaacagaatgggtagaaaccacagcacgcgagctgccgatcccggaaccagagggccccgatgccagcagtatcatgagcacagagtccattacaggctcgttaggccccctgttagacggcactgccactctgcggctagtcaagcggcaggtgccactggactgcgttctctaccgctacggctcattcagcgtcactctggatatagtgcagggcatcgagtccgccgagattctacaggccgtgcctagcggtgagggtgatgcctttgaactaaccgtgtcttgccaaggggggcttccaaaagaagcatgcatggaaatcagttcgccaggatgtcagcctcccgcccaacggctttgccagcctgtattgccatcaccagcatgccagctggtgctgcaccagattcttaaaggcggatccgggacttactgcctgaatgtatccctggcggacacgaactccctagccgtggtctctacacagttaatcatgcccgtgcccggtatcctgctgaccgggcaggaggcaggtctcggacaagtaccactgattgtgggcattctgttggtgcttatggcagttgtcctggcttcactaatctatcgccgacgactcatgaaacaggacttctcagtaccgcagttaccacactctagtagccattggttgcgactcccccgtatattctgtagttgtccgatcggtgaaaactctccgctgctgtctgggcagcaggtctag

SEQ ID NO: 9017 - DNA, 1746 bp, Artificial Sequence
  Description of Artificial Sequence: Synthetic coding sequence
atgcagcaggacggcctgggcgtgggcacccggaacggcagcggcaaagggcggagcgtgcacccctcttggccatggtgtgcgccccggcctttaagatacttcgggagagatgctagagcgcggcgcgcccagacagcggctatggctctacttgctggcggattgagtagagggctgggcagtcaccccgcagccgccggccgcgatgctgtagtatttgtttggttacttcttagcacttggtgcacagccccagctagggctatccaggtcacagtgtccaatccttaccacgtcgtgattctgttccagccagttacactcccgtgtacttatcagatgacaagtacgccgacccagcccatcgttatttggaagtacaagagtttctgtagggaccggattgccgatgcgttttctccagcttccgtggacaatcagctgaacgcccagctggccgccggtaatcctggctacaatccttacgtcgagtgccaggactctgtgagaacggttagggtggtagctaccaaacagggcaatgccgtcacgttaggagattactatcagggaaggaggatcacaataactgggaacgccgatttgacatttgatcaaaccgcctggggagacagcggtgtatactattgttccgtggtgtccgctcaagatttgcagggtaataatgaagcctatgcagagctgatcgtgctagtctacgccgctggtaaggccgccacttctggagtcccatccatatacgccccctctacctacgcacatctgtcgcctgcgaaaacccccccccctccagctatgattccaatgggtcctgcttataacggatatccgggcggctaccctggcgacgtggatcggtcttcttcggcgggaggccagggtagttatgtcccgctgttaagggacacagattcgtccgtcgcgtcagaggttcggtccggataccgaattcaggcctcacagcaggatgactcgatgcgagtgctgtactatatggaaaaggaactggctaattttgacccttctcgcccggggccacccagtggtagggtggaacgagcgatgagcgaggtgactagcctgcatgaggacgactggcgtagccgcccaagtcgtggaccagccctgacacctatccgcgatgaggagtgggggggccatagtccacgttcccccaggggttgggatcaggaacctgccagggagcaagctggcggcgggtggagagctcgcaggccccgcgctcgctctgtagatgcactggacgacctgactccacccagcacggctgaatctggcagtaggtctcctacaagcaatggtggcaggtctagggcttatatgccacctagatctaggtcccgggacgatctgtacgaccaagacgattctcgcgactttccccggagccgggatccacactacgatgactttaggtcaagagaacgaccccctgctgatcctcggagccaccatcatcgaactcgcgacccccgcgataatgggagccgctctggggacctcccttacgacgggcgcctgctggaggaagccgtgcgcaagaagggaagtgaggagcgccggcggccacataaagaggaggaggaggaagcctattacccccccgctccaccaccctatagtgagaccgactcccaagcatcccgtgaacgacggttaaagaagaacctggccctctcccgcgaaagtcttgttgtgtag

SEQ ID NO: 9018 - DNA, 1959 bp, Artificial Sequence
  Description of Artificial Sequence: Synthetic coding sequence
atgcccccccccctgcccctgctgctgctgaccgtgctggtggtggctgcagcccgcccgggctgtgagtttgagagaaacccagccggggagtgtcatcgcccccccgccgccgatagtgctacatgtgtagacctgcagctgcgcacttgttctgatgccgcctacaaccacaccacgttccccaacctattgcaacataggtcctgggaggtcgtggaggcatcatccgagtacattctgctttcagtgctgcaccagctgttagaaggccaatgcaaccccgacctgcgcctgcttggctgtgcagtgttggccccacgctgtgaagggggatgggtgcggcgtccttgtcggcatatctgtgagggattacgggaggtgtgtcagccggcttttgacgctatcgacatggcctggccatactttttagattgccaccggtatttcacaagggaggacgagggctgttacgaccctctggaaaagctcaggggaggcctcgaagctgatgaagcgcttcccagtgggttgcctccaactttcataagattttcccaccacagctacgctcagatggttcgggtcctgagacgcaccgcttcgagatgcgctcatgttgctcgaacttattccatcggaagaagttttgatgggcgggagctacttgtgatcgaatttagctccaggcccggccagcatgaattgatggagccagaggtcaagctgattggtaacattcacggtaacgaggtggccggccgagagatgttgatttatttagcacaatacctctgctcagagtatctactcggaaatcctagaatccaacggctccttaacacaacgcggattcatttgctaccatccatgaacccggatggatacgaggtcgcggccgcagaaggagctggatataatggatggacaagcgggcgtcaaaatgcccagaacctggatctgaaccgaaatttcccagatcttacgtccgagtattacagattggcagaaaccagaggtgccaggtcagaccatataccaattccccagcattattggtgggggaaagtcgctccagagacaaaagcaatcatgaagtggatgcagacgatcccattcgtcctgagtgcgtcactccatggcggcgacctggtcgtatcttaccctttcgatttctccaagcatccacaggaagaaaaaatgttctctccaactccggacgagaagatgttcaaactactgagtagggcatacgcagatgtacatcccatgatgatggatagatctgaaaatagatgtggcggtaatttcttaaaacgcgggtctatcatcaatggagcagattggtacagcttcactgggggaatgtctgatttcaattacttgcacacaaattgttttgagattacggtcgaactgggctgcgttaagttcccgcctgaggaagctttatatatattatggcaacataataaagaatccttactgaacttcgtggagaccgtgcatcgcggcatcaaaggggtggtcacagataagttcgggaagcctgtcaagaacgcacgcatcagcgttaaaggaattagacatgacataaccactgcccccgatggggactactggcgtctcctacctcctgggatacacatcgtgatcgcccaggctcctggatatgccaaagtgattaagaaagtgattatcccagccaggatgaaacgcgccggccgtgtggacttcattcttcagcccctcggaatggggccaaagaatttcattcacggcctcaggcgaacgggcccccatgaccccctgggtggtgcaagcagtctaggcgaagcgacagagcctgatcctttgcgagctcgccggcaaccatcagccgatggttccaagccttggtggtggtcctattttacaagcctgtctacacaccgtcctagatggctcctcaaatattag

SEQ ID NO: 9019 - DNA, 279 bp, Artificial Sequence
  Description of Artificial Sequence: Synthetic coding sequence
atgaagctgtgcgtgaccgtgctgagcctgctggtgctggtggccgcattctgcagcttggccctcagtgctccgatgggaagtgacccacctactgcctgttgcttcagttacaccgcacgaaagttgccgagaaactttgttgtggattactacgagacttcctccctctgtagccagcctgcagtggtgggtttcttgggcaggaaaggcaaacaagtgtgcgccgatccatcggaatcctgggtgcaggagtacgtttacgatttggagctatag

SEQ ID NO: 9020 - DNA, 249 bp, Artificial Sequence
  Description of Artificial Sequence: Synthetic coding sequence
atgcggcagcggctgctgcccagcgtgaccagcctgctgctggtggctctactcttccctgggagttctcaggctcgccacgtgaatcactcagcaaccgaagctctcggggagctaagggagcgggcacccgggcaagggacaaatgggtttcagttactcagacatgctgtgaaaagagatttgctcccaccaaggacaccaccctaccaagggacagggcagcaacatcgccagagatgtggttag

SEQ ID NO: 9021 - DNA, 411 bp, Artificial Sequence
  Description of Artificial Sequence: Synthetic coding sequence
atggacaacgtgcagcccaagatcaagcaccggcccttctgcttctccgttaaaggacacgtgaaaatgcttcgccttgcactcaccgtgacaagcatgacttttttcataattgctcaggctcccgaaccttacatagttatcactgggtttgaggtaaccgtgatactcttttttatcttgctgtatgttctgcggctggatcgccttatgaaatggctgttctggccactgttagatattatcaacagcctggttactacggttttcatgctcattgtaagcgttttggcactgatacctgaaacaactacgctgacagttggaggcggcgtgttcgcgctcgtcaccgccgtgtgctgcctggctgatggggccctaatttaccgcaagctcctctttctgagatag

SEQ ID NO: 9022 - DNA, 1068 bp, Artificial Sequence
  Description of Artificial Sequence: Synthetic coding sequence
atgcagctgaccacctgcctgcgggagaccctgttcaccggcgcctctcagaaaacatccctgtggtggttgggaatagcatcttttggcgtgcctgaaaaactgggatgcgccaacctacctctcaatagtagacagaaggaactctgcaagcggaaaccctatctcttaccatctattcgcgagggggccaggctcggcattcaggagtgtggctcacaatttagacatgagcgctggaactgcatgatcaccgctgccgcgactactgcaccgatgggggccagtccactgttcggctatgaactctcctccggaactaaagaaaccgcctttatatacgccgtgatggcagccgggctggttcattccgtcactcgatcttgctcagccgggaatatgacagagtgctcgtgtgataccaccctgcagaatggtgggtcagcttctgaggggtggcattggggagggtgtagcgacgatgtccagtacggcatgtggttttcaagaaaatttcttgactttcccatcggaaataccaccggcaaagagaataaggtcctgctggctatgaatctccacaacaatgaggccggcaggcaggccgttgcgaagctcatgtccgtagactgccggtgtcacggtgtgagcggctcgtgtgccgtgaagacctgctggaagacgatgtccagctttgagaaaatcgggcacttgctaaaggataagtatgagaacagcatacagatttcagataagaccaagcgcaagatgcgaagacgggagaaagaccaacgtaagatcccaattcataaggacgatctgctgtacgtcaacaaatcccccaactactgcgtagaagataaaaagctgggcatccctggaactcaaggacgcgagtgtaacagaacatctgaaggtgcggacgggtgtaacctgctctgttgcggtcgggggtacaatactcacgttgttcggcacgtggaaaggtgtgagtgtaagttcatctggtgctgctatgtaaggtgccgccggtgtgaatctatgacggatgttcacacctgtaaatag

SEQ ID NO: 9023 - DNA, 2916 bp, Artificial Sequence
  Description of Artificial Sequence: Synthetic coding sequence
atgctgcggcggcccgcccccgccctggcccccgccgcccggctgctcttagcagggctgctatgcggtggcggggtttgggccgcacgggtgaataagcataagccctggctggagcccacctatcatgggatagtgaccgagaacgacaacactgtccttctcgatcctcctttgattgctctcgataaagacgcccctttgaggttcgccggcgaaatctgtggatttaaaattcacggtcagaacgtgcccttcgacgctgtggtcgtagacaagtcgacaggtgaaggagtaattcggagtaaggagaagctggactgcgagctgcagaaggattactcattcacaattcaggcatacgattgtggaaagggccccgatgggaccaatgtcaaaaagtctcacaaagctaccgtgcacattcaagttaatgatgttaatgagtacgcaccagtgttcaaggagaagtcatacaaggccaccgttatcgagggcaagcaatatgactccatactaagagttgaagccgtggacgccgactgcagtccgcaattctcccagatctgctcttacgaaattatcacccctgacgtaccttttaccgtcgataaagatggttatattaagaatacagagaaactgaattacggcaaagaacatcaatataagctgaccgtgaccgcttacgattgcgggaagaagcgagccacagaagacgtgctcgtcaaaataagcattaaaccaacttgcacaccagggtggcagggctggaataatagaatcgagtatgaacctggcacaggcgcactagctgtctttcccaacattcacctcgagacttgtgatgagcctgtagccagcgtgcaggccacagtggagcttgaaacgtcccacattggcaagggctgcgaccgagacacttactccgaaaagtctctccaccggctgtgcggggctgcagcaggaacagcagagctgctcccgtctcccagcgggtctctgaactggaccatggggctccccacagacaacggccacgactctgaccaggtatttgaatttaatggtactcaagctgtgaggatccctgatggcgtggtctctgtcagtccgaaagaaccgttcacaatctcggtgtggatgcgccacggaccctttggcagaaaaaaagaaaccatcctctgcagcagcgacaagacagacatgaatcggcaccattattctttatatgtgcacggctgccgtttaatctttttatttcgtcaggatccctccgaagaaaagaagtatcgccctgcggagtttcactggaagcttaaccaggtctgcgacgaggaatggcaccattatgtcctcaatgtggagttccctagcgtgacgctgtacgttgatggtacgtctcatgagcctttttctgtgacagaggactatcctctgcacccaagtaagatagagacccaactggtcgtcggggcctgctggcaggagttctccggcgtagaaaacgacaatgagactgaacccgtcactgttgccagcgcaggaggcgacctccacatgacccagttcttccgcggcaatctcgctggccttaccctgcgcagtggcaagttggctgacaagaaagtgatcgattgtctctacacatgcaaggagggtctggatctgcaggtgctcgaagacagtggtaggggcgtacagattcaagctcacccgtcacaactggtcctgactcttgagggagaggacttgggggaactggacaaggctatgcagcatatttcctatctcaacagtagacagttcccgacgcccggtatccggcgactgaaaatcacttccacgataaagtgcttcaatgaggccacttgcatttccgtgccccccgtggatggctacgtgatggtactgcagcccgaggagccaaagataagcctctccggagtgcaccactttgctagagctgcttccgagttcgagagcagcgaaggggtcttcctgtttcccgaactcaggatcattagcaccataaccagggaagtggagcctgagggagatggggcagaggatcccacggttcaggagagtctcgtgagtgaagaaattgtgcatgacctcgacacgtgtgaggtgaccgtggagggggaagagctgaaccacgaacaggaatcactggaggtagacatggcacggctccagcagaaaggaatcgaggtttcctcttctgaattgggcatgaccttcaccggggtcgacactatggcatcatacgaagaagtgctgcacttgttacggtataggaattggcatgcacggagcctccttgaccgcaagttcaagttgatctgcagcgagctgaatgggcggtatatttcgaatgagttcaaggtggaggtcaatgtcatccacaccgccaacccgatggagcatgccaatcacatggcagctcagccacaattcgttcatccagagcaccgatcattcgtggatttgtctggacataatttagctaatcctcacccctttgcggtggtgcctagcacagccacagtggtaatagtggtttgtgtatccttcctggtcttcatgattatcttaggagtcttccggatccgggccgcccaccggaggaccatgcgggatcaggacaccggaaaggagaacgagatggattgggacgactcagccctgacaatcactgtaaacccaatggaaacctacgaagaccagcacagcagcgaagaggaggaggaagaggaagaggaggaagagagtgaagatggtgaggaagaggatgatattacttctgccgagtcagaatccagtgaagaagaggagggtgagcagggagacccgcagaacgcaacccgccagcagcagctggagtgggatgactccacactgtcctactag

SEQ ID NO: 9024 - DNA, 564 bp, Artificial Sequence
  Description of Artificial Sequence: Synthetic coding sequence
atggtggccgccaccgtggccgccgcctggctgctgctgtgggccgcagcctgtgcccagcaggagcaggatttctacgacttcaaggcagtgaatatccgcggaaagctggtgtcactggagaagtatcggggaagtgtgagtctagtagtgaacgtggcctcagagtgcgggtttactgatcagcactatagggcccttcaacagctgcagcgcgatctgggcccacaccactttaacgtcctcgcgttcccctgtaaccagtttggccagcaggaacccgatagcaataaggaaatcgagtccttcgctagaagaacctactcagtgtcattcccgatgtttagtaagatcgcagtgaccggaacgggcgcccacccggccttcaagtatctggctcagacttctggcaaagagccaacgtggaatttttggaagtacctggtcgcccccgatggtaaggtggtaggagcatgggatccaacagtgtctgtcgaggaggttaggccccagatcacggccctggtgagaaagcttatcttacttaagagggaagacctatag

SEQ ID NO: 9025 - DNA, 303 bp, Artificial Sequence
  Description of Artificial Sequence: Synthetic coding sequence
atgtggggcttcctggtgctgaaggcccggtggctggtgacccccgttcgtacactcgcaaccgaggcaggacagaaaccttcattgcggggcctgcttgacgtaggcaacatccagcaccgagccgccagagcccgcggattaactcgcggggtcatccgagtaagccctcaggagcgctcacaacagaaccagtctgcacctaagggaccaactccctcgacaaggcccaagcccagaacactcggtccccaggcccacagcctggccctgcaatccgttgatttactgtttaggccatag

SEQ ID NO: 9026 - DNA, 2352 bp, Artificial Sequence
  Description of Artificial Sequence: Synthetic coding sequence
atgcggtggcagtgcggcacccggttccggggcctgcggcccgccgttgccccttggacggcccttcttgctctggggctccctgggtgggtgctcgccgtgtccgcaacggcggcagcggtggtccccgagcagcacgcatctgtcgcaggacagcaccccctcgactggctgctgaccgatcgcggaccatttcatagggcccaggaatacgcagattttatggaaagataccggcaggggtttactacacggtatcggatctaccgcgaatttgctaggtggaaggtgaataacctggctctggaaaggaaagattttttttctttgcccctaccactcgcgcccgagttcattcggaatattcgtctgctggggcggcgtcctaacctccagcaggtcaccgaaaatcttataaagaaatacggaacccatttcctgttgtccgctacactcgggggcgaggagagcctcacaatcttcgtagacaagcagaaactcggacggaaaactgagacgacgggcggcgccagtattatcgggggaagcggcaattctacagccgtctccttggaaactctgcatcagctcgcggcatcctatttcattgaccgcgagagcacattgagacgccttcatcatattcaaatagccacaggcgcaatcaaggtaactgagaccagaaccggacctctgggatgttctaattatgacaacttggacagcgtgagcagcgtacttgtacagtctcctgagaacaaggtgcaactgctcggcctgcaggtcctccttccggagtatctcagagagaggttcgtggccgccgcactgagctacattacatgcagcagcgagggggagctggtttgtaaggaaaatgattgctggtgtaaatgcagtcctacattcccggagtgtaactgtccagatgctgatatccaagcaatggaggatagcctgcttcaaatccaagactcttgggcaacacacaatagacaattcgaggaaagtgaggaatttcaggcactcctaaagcgtctcccggacgaccgcttcctgaacagtacagcaatctctcagttctgggcaatggacacttctctccagcatcgttaccagcaactgggggccggcctgaaagtcttatttaagaagacccaccggatccttcgtcggttgtttaacctgtgcaagagatgccatcggcagccacggtttcgtctgcccaaagagcgaagcttatcatactggtggaacaggattcagagcctcctctattgcggcgagagcacatttcccgggacgtttctggagcagtcgcactcttgcacctgcccatacgatcagtccagctgtcagggtcctatcccctgcgcgctgggagaaggacctgcgtgcgcacattgtgcgccagacaactccactcgatgcgggtcttgcaacccgggctacgtgctggcccaggggctgtgccgccccgaggtagctgaatcgctggagaacttcctggggctggagacagatctgcaggatttggaactgaaatatctgctgcaaaaacaagactccaggatcgaggtgcattccatttttataagcaatgacatgcggttaggaagctggttcgatcctagctggcgcaagcgcatgctgttgaccctgaagagcaataagtataagccgggactggtgcacgtaatgctcgcactctccctccagatctgcctgactaagaactctactctggaacccgtgatggcaatatacgtgaatcccttcgggggtagtcatagcgaatcttggttcatgcccgtgaatgaaggctcttttcccgattgggaacgtactaacgttgatgcggccgctcagtgccagaactggacgattactctcggaaaccgctggaagacattctttgagaccgtgcatgtgtatcttcggagccgcattaaatccctggatgattcttcaaatgagactatttactacgagcctcttgagatgaccgaccctagcaagaaccttggctatatgaaaatcaataccctgcaggtctttggatattcacttcccttcgatcctgacgcgattcgcgatttgattttgcaactggactatccctacacccaggggtctcaggacagcgcactgttgcagctcattgaactaagggatcgggttaatcagctgtctccccctggcaaggttaggctggacctcttttcctgcttactcagacaccgccttaagctggccaataatgaagtgggcaggattcaatcatccctgcgcgcatttaacagcaagctgcctaatcccgtggaatacgagaccggtaaattgtgttcgtag

SEQ ID NO: 9027 - DNA, 2016 bp, Artificial Sequence
  Description of Artificial Sequence: Synthetic coding sequence
atggcccagctgttcctgcccctgctggccgccctggtgctggcccaggccccagcagccctggcggacgtcttggagggcgacagttccgaggaccgtgcctttcgagttaggattgccggggatgccccactgcaaggagttctgggcggggcgttgacaatcccttgccatgtccactacctgcgtccccctccatccagacgcgccgttctgggctcaccacgtgtcaaatggacatttctgtccaggggaagagaagctgaagtcctggttgcccgcggggtcagagtgaaagttaatgaagcttataggttccgggtcgcattgcctgcgtacccagcctcgctgaccgacgtgtccttggccctgagcgagcttagaccgaatgattccggaatttatcgatgtgaggtgcagcacgggatcgatgacagtagtgacgcagtagaggtcaaggtgaagggcgtggtgttcttgtatagagaggggagtgcacggtatgctttctcattctcaggagctcaggaagcctgtgccagaatcggcgcccatattgccacccctgagcagctgtatgctgcttacctaggcggctatgagcagtgcgacgccggctggctgagcgaccagacggttcggtacccaatccagacaccccgtgaagcctgttacggggatatggatgggttccctggggtgagaaactacggagttgtcgaccctgatgatctgtacgacgtctattgctacgctgaagacctcaatggcgagctgttcttgggagatccacccgaaaaattaaccctcgaggaggcaagagcttactgccaggaaaggggagctgagatagccaccactgggcaattatacgcagcctgggacggaggcctagaccactgcagcccagggtggttggcggatggaagtgtccgctatcccattgtaacaccttcccagcgatgcggggggggcttgcctggcgttaagaccctatttctctttcctaatcaaactgggtttccaaataaacacagtagatttaacgtttattgtttcagggactctgcgcagcccagcgctatccctgaggccagcaacccagcaagcaacccagcgagcgacggactggaagcaatcgtgacagtgactgagaccttggaagaactgcagttgccacaggaggccactgagtccgagagtaggggggcgatctattccataccaataatggaggatgggggcggggggtccagcactccagaagatccagccgaagcccctcgcactctgctggaattcgagacacagtcaatggttccacctacaggcttctcagaggaggaaggcaaggcgctagaagaggaggagaaatacgaggatgaggaggagaaggaggaggaggaggaggaggaagaggtcgaggatgaggcgctatgggcatggcctagtgaactgtcctcccctgggcccgaagcctctcttccaacggagccagccgcccaggaggaatccctcagtcaggcgccggccagagctgtactgcaacctggtgctagcccactgcccgacggagaatctgaggcatcaaggccgcctagggttcatggcccaccgactgaaaccctgccaacacctagggagagaaacctagcgtcgccgagccctagcaccctggtggaggccagggaggtaggcgaggccaccggcggacctgagctatctggggttcctcgaggcgagagcgaagaaacaggatcctccgaaggggcaccctctttactgcctgcgacccgagcccccgaaggcacccgagagcttgaagcccccagtgaggacaacagtggacgtaccgccccggccggaacaagtgtgcaagctcagccagtgctgccaaccgacagtgcgtccaggggaggggtggccgtggtccccgcgtcaggtaattccgcacagggctccactgctctcagtatccttctgctcttttttcctctccagctgtgggtgacttag

SEQ ID NO: 9028 - DNA, 375 bp, Artificial Sequence
  Description of Artificial Sequence: Synthetic coding sequence
atgtacaagctggccagctgctgcctgctgttcatcggcttcctgaaccccctgctttctctgccactgctcgattcaagagagatctcattccagctgtctgcccctcatgaggacgcgcgcctcacccccgaagaactggaacgcgcttcattgctacagatcctgcccgagatgcttggggcggaaagaggcgatattttaagaaaggccgatagctcaaccaacatattcaacccgcgcggcaatctccgcaaatttcaggatttttccggacaggaccccaacattctgctatctcaccttttagccagaatttggaaaccttataaaaaaagagaaacaccggactgcttctggaagtactgtgtgtag

SEQ ID NO: 9029 - DNA, 1326 bp, Artificial Sequence
  Description of Artificial Sequence: Synthetic coding sequence
atggagttcgagttcgaccggctgcgggccttccaggccatgcaggtgcactgcaacaacatgcacacgctcggcgctcgcctgccaggcggggttgaatgcagattccgacggggacctgccatggcctgggaaggcgagcctatgcgccataaccttggaggtaatctgggcgatcctagagcacgtgccgtgtccgtgccattgggaggtcgggtggccagattcttacagtgccggttcctgttcgctggaccctggttgctgttttccgaaatatccttcatctccgacgtggttaataactctagcccagcacttggtgggacctttccgcccgcgccgtggtggccccccggcccgccccccaccaactttagcagtctggagctggagccaagaggtcaacagccagtagcaaaggccgagggctctccaacggccattctgataggctgtctcgttgccatcatacttctcctgctgctaattatcgcactgatgctttggcggttgcactggaggcgcctcttgagcaaagtcttagagtcccacccccgtacccgtagcccaggactcgttggtatcagacccacacctctgcctgtgagtccgatggccttgcggtgctgttctccaatacagcccacggcatctttttggcccctgactcccgtgccactggaggcccgggctcccccacacccccccggacccaaccctcctacacctcgcggggtcacaggcgggaacacttacgctgtacccgcgctcccacctggagccgttggcgatggtccgccccgtgtggacttccctcggagtcggcttcggtttaaagagaagttgggggaaggacagttcggagaggtccacctctgcgaggtagactctccacaggacctagtgtccctcgatttccccctgaatgtcaggaagggccacccactcctggtggccgtcaaaattctcaggcccgatgctactaagaacgctagaaatgattttcttaaagaggtcaagatcatgtccagactgaaggatcctaatatcatacgcttgctgggcgtgtgtgtgcaggacgacccattgtgcatgatcaccgactacatggagaacggcgacctcaatcagttcctgtccgctcatcagctggaggacaaggccgctgagggagccccgggcgacgggcaggcagcccaaggccccaccataagctaccctatgttactgcacgtggcggcacagatcgcttctggtatgcgctaccttgccaccctcaattttgtccatttttggggtgagaggcatagatttctgcactag

SEQ ID NO: 9030 - DNA, 1950 bp, Artificial Sequence
  Description of Artificial Sequence: Synthetic coding sequence
atgcagcaggacggcctgggcgtgggcacccggaacggcagcggcaaagggaggagtgtgcatccatcttggccgtggtgtgcccctaggccgttgagatacttcgggcgggatgctagagcacgaagggcccagacagcagccatggccctactggctggaggactttccaggggactgggcagtcaccccgcagccgctgggcgggacgccgtggtgttcgtctggctgttattaagcacctggtgcacagcacccgctcgggctatccaggttacagtgtctaacccttatcatgtcgtgattctttttcagcctgttaccttaccctgcacttaccaaatgacttcaactccaacccagcctatcgtcatttggaagtataagtcattctgtcgggaccgcatcgccgacgccttctcacctgcttcagtggacaatcaactcaacgcacaactagccgccggcaaccctggctacaatccatatgtagagtgtcaggatagtgttcgcacagtaagggtggtagcgaccaagcaggggaacgctgtgacgctcggggattattatcagggcaggcgcatcaccattactggtaatgctgatttaacctttgaccagactgcttggggcgattccggcgtgtattattgtagcgtggtgagtgcacaggacctgcaaggaaataatgaagcctatgcagagctgatcgttctggggagaacgtccggcgttgccgagctgttacctggttttcaagctggaccaatcgaggactggctgttcgttgtcgtcgtctgcctggcggcttttctgatatttctgctcctgggcatctgttggtgccagtgctgcccccacacatgctgttgttacgtacgatgtccgtgttgcccggataaatgctgctgtcccgaagccttgtatgctgcagggaaagctgctactagcggcgtgcccagcatctatgccccttccacttatgcccatttaagcccagccaagaccccaccaccccccgctatgatccctatgggccctgcctacaatggctatcccgggggatatcccggtgatgtagataggtcatcaagcgctggtgggcaggggtcttatgtgcccctacttagagacaccgattccagcgtggcatccgaagtgcggagtgggtatagaatccaggcaagccagcaggacgattccatgcgagtgctttactatatggagaaagagctcgctaatttcgacccttccagacctggacctcctagcggtcgagtggaacgcgccatgtctgaggttaccagcttacatgaagatgattggcgtagcaggccgtccagggggccagctctgactcctatcagagacgaagaatggggcgggcactctcctaggagccctcgaggatgggatcaagagccagcaagggagcaggctggaggtgggtggcgggcaaggcgacccagagctaggagcgtcgacgctttagatgatcttacccctccgtcaacagctgagtcaggatcacgtagccctacatctaacggaggccgctccagagcctatatgcctccgaggtccagaagcagggatgacctgtatgaccaggatgacagtcgcgatttcccaagaagtcgcgatccccactacgacgactttaggtcacgggaaaggccgccggccgatccacgcagtcaccaccaccggacacgcgatccgcgggacaatggctctcggtccggagacttaccatacgacgggagactgctggaagaggctgtccgcaaaaaagggtcggaagaaaggagaaggccacacaaggaggaggaggaagaagcttactatccccccgcccctcccccatacagcgagactgactcacaagcctccagggaaaggcgactgaagaagaatctggccctgagtcgggagtcactggttgtgtag

SEQ ID NO: 9031 - DNA, 402 bp, Artificial Sequence
  Description of Artificial Sequence: Synthetic coding sequence
atgagcgagcgggtggagcggaactggagcaccggcggctggctgcttgctctctgtttggcttggctttggacccacttgacattagcagccctgcagccccccacagccactgtccttgtccagcagggcacgtgtgaggtgatcgctgcccatcgctgttgtaaccgcaacagaatagaggagcgttctcaaacagtgaagtgctcttgtttttctggacaggtcgctggcacaaccagagcaaaacccagttgtgtggatgcttctatcgtgctgcagcggtggtggtgccagatggagccttgccttccgggagaagagtgtaaagtgttaccggatctgagcgggtggtcctgttcaagcgggcataaggttaagactaccaaggttacccgatag

SEQ ID NO: 9032 - DNA, 699 bp, Artificial Sequence
  Description of Artificial Sequence: Synthetic coding sequence
atggtggccgccaacacccgggcccccgaggacacccgggcccccgctgggcctaaaccctcgagctgcgaatgggccgtttgctgggcccctgctcgttgtaggatctctgcgacggcatgtggcaactcttgggacagacctgccggtagaacacagctgctgtggacacccgcagcacccactgctatggctgaagtggggcccgggcacactcctgcccatccttcccagggtgccgtcccaccaagccgagccgcagcagaacctcatctgaagcctagtccatctgagctacagactgcaggccctgccgccactatcccagctcggctttgtacgaggaagcctagactggtgtacacccagtgctggtatgtcaaggagcctaaacaccctgagattgtgacaccctggggtaccgccgcccggcactcatggaggcagcatcagatgctctccgcctccgagagaagatgtttaccaagagacgtcgagcagaagcttggacccgagcataccgggccctgcttggatgagcagggtagggaagctgaacttgccagatccgggccgtcagccgccggccctgtgcgcctgaagcccggcctggtaccagggctgtttctgctctcctgtactactagtccttctacttgtttaccggtgggccaggaaggagaaagaggtatgctatag

SEQ ID NO: 9033 - DNA, 711 bp, Artificial Sequence
  Description of Artificial Sequence: Synthetic coding sequence
atgtgcgtgacctaccacaacggcaccggctactgcaagtgccccgagggctttttgggcgagtattgccagcaccgcgatccctgtgagaaaaacagatgccaaaacggtgggacctgtgtagcacaggcaatgctgggaaaggctacatgcagatgcgcctccggcttcacaggagaagactgccagtacagcacaagtcacccctgttttgtgagtaggccatgtctgaacgggggtacatgtcacatgctatcccgggacacctacgagtgtacctgtcaggttggcttcaccgggaaagagtgtcaatggacggacgcttgtctgtcccacccgtgcgctaatggttctacttgcactaccgttgctaatcagtttagttgtaagtgtctaaccggattcacggggcaaaagtgcgaaacagatgtaaacgaatgcgatatacccggtcactgccagcacgggggcacttgcttgaatctgccgggctcctaccagtgccagtgtcttcaggggttcactggtcaatattgcgacagtctttacgtaccctgtgcccccagtccatgcgtgaacggcggcacctgcagacagaccggcgattttaccttcgaatgcaattgtctgccggagacagtgaggaggggaacggaactgtgggagagggatcgggaggtgtggaatggaaaagagcacgatgagaattag

SEQ ID NO: 9034 - DNA, 204 bp, Artificial Sequence
  Description of Artificial Sequence: Synthetic coding sequence
atggacaacgtgcagcccaagatcaagcaccggcccttctgcttctcagtgaagggacatgtaaagatgctgcggctcgtcttcgctctagttacggctgtgtgctgtttggcagatggagccttgatctatagaaagctgcttttcaatcccagtggcccttaccagaagaaacctgtccacgaaaagaaggaagttctctag

SEQ ID NO: 9035 - DNA, 75 bp, Artificial Sequence
  Description of Artificial Sequence: Synthetic coding sequence
atgctggtggacggccccagcgagcggcccgccctgtgcttcctgcttctggctgttgcaatgagctttttttag

SEQ ID NO: 9036 - DNA, 3345 bp, Artificial Sequence
  Description of Artificial Sequence: Synthetic coding sequence
atgctggccagcagcagccggatccgggccgcctggacccgggccttactgctccctctcttattggccggtcctgtggggtgtctcagtagacaggagctgttccccttcggcccaggccaaggggacctggagctcgaggacggagatgatttcgtgagtccagccctcgaactatcgggagcgttacgcttctatgatcgctctgatattgacgccgtgtacgtgacaaccaacggcatcatcgcgacatcggaaccccccgcaaaagagagtcacccggggttgtttccccccacttttggggctgtagcaccgtttctggcagatctcgatacgacagatggacttggaaaagtgtactaccgcgaggacctgagtccgtccatcactcagagggccgccgagtgtgtacatcgcggctttccggaaatctctttccagcccagttcagccgtggtggtgacctgggaatctgtggccccctaccaggggcccagtcgggatcccgaccagaaaggcaagcggaatactttccaagctgttcttgcgtccagcgacagttcttcatatgctatattcctctatccagaagatggcctccagtttcacaccactttctcaaagaaggaaaacaaccaggttcctgcagtagtcgccttctctcagggaagtgtaggattcctctggaaaagcaacggggcgtacaacattttcgcaaatgaccgcgaatcagttgagaatctggccaaaagctcaaactccggtcagcagggcgtctgggtcttcgagatcggatctccagcaacaaccaatggtgtcgtgcctgccgacgtcatccttggaaccgaagacggggccgagtacgacgacgaggacgaagactacgacctcgccaccacaaggctcggtctggaggacgtgggcacaaccccattttcatacaaggcattgcggagaggtggggctgatacctattcagtccccagcgtgctcagcccccggagagctgcgaccgaacgccctttgggtcctcccaccgagcgcacaagatcctttcagcttgcagtagaaacgttccaccagcagcatccccaagttattgatgtagacgaagtcgaggagacaggagtcgtcttcagttataacaccgacagccgccagacgtgtgccaacaaccgccaccagtgtagcgttcatgcagaatgtcgagattacgccactggtttttgctgcagctgcgtcgccggctacactgggaacggccgccagtgtgtggccgagggttcccctcagcgagtcaacggtaaggtgaaaggccgcatcttcgtcgggtccagccaggtccccatcgtattcgagaataccgatctccattcatacgtagttatgaatcacggccgatcctacacagccatctcaactatcccagaaaccgttggatacagcctgctgccccttgcccccgttggaggtattattggctggatgtttgccgtggaacaagacggtttcaagaatggctttagcattactggcggagagtttacgagacaagctgaagtgacatttgtgggtcatccaggcaatctggtaattaagcagcgcttctccgggattgatgaacacggtcacctcactatcgatacagagcttgaggggcgggtgccccaaattcccttcggtagctcagtccatatagagccttataccgagctctatcattattcaacatcagtgattacatcttccagcactcgagagtacaccgtgaccgaacctgagcgagatggagcttcaccgtcaaggatttacacataccagtggagacaaaccatcaccttccaggaatgtgtccacgatgactccagaccagccctgccaagtacacagcaactgagcgtggattctgtgttcgtcctgtataatcaggaagaaaagatcctgagatacgctctatcgaattcgatcggccccgtccgggaggggtcgcccgatgcgctgcaaaacccctgctatatcggaacccacggctgcgacacaaacgctgcatgccgaccaggtccccgaacccaattcacttgtgagtgctctattggattcagaggggacggccggacttgttatgaggttgagaaaacccgatgtcagcatgagagggaacacatcctgggagcggcaggggcgaccgaccctcagaggcctatcccacccggactctttgtgcctgagtgtgacgctcacggccactatgcgcctacccaatgccacggaagtacaggctactgttggtgcgtggatagagacggtagggaagtagaaggcacccgtacacgccccggaatgacacccccatgtttatcaacagtggctccacccattcaccagggccctgcggtccccacagcagtaattccccttccacccggcacacatctcctattcgcgcagacaggcaagatcgagcggctgccacttgagggaaatacgatgagaaaaaccgaggctaaggcgttcttacatgtgccagccaaagtcatcattggtctcgcattcgactgcgtggacaagatggtctattggacagatatcacagaacctagcattggtagggcctccttacatggcggcgaaccaacaacgatcatccgtcaggatctgggttcacctgaagggattgctgtggatcacctgggccgaaacatattctggacagattctaacctcgatcgaatcgaggtggctaaactagacggcactcaaaggcgcgtgctcttcgaaaccgacttggtgaatccaaggggaattgtgacagatagcgtgcgcggcaacttatactggacagattggaatcgggataaccccaagattgagacctcatatatggacggcacgaatcggcgaatcctggtgcaagatgacttggggcttccaaatggcttgacatttgacgcattttcatctcagctgtgctgggtggacgctggcactaatcgcgcggaatgtctgaatccatcacagccaagtagacggaaggcactggagggattgcagtacccatttgcagtcacctcttacggaaagaacctatatttcactgactggaaaatgaattccgtcgttgcattagacttggctatttcaaaagaaaccgacgccttccagccccataagcagacacgcctttacggaattaccactgcattatcccagtgccctcagggacataactattgtagcgtcaataacggaggctgtacacacctgtgtctagcaactcctggatcccggacctgccgctgtcccgacaataccctgggtgttgactgcatagaacagaaatag

SEQ ID NO: 9037 - DNA, 2172 bp, Artificial Sequence
  Description of Artificial Sequence: Synthetic coding sequence
atgggcagccggtgcgccctggccctggccgtgctgagcgccctgctgtgtcaagtgtggtcctccggagtgttcgagctcaaactccaggagtttgtgaacaagaagggtcttctgggaaatcgaaactgttgtaggggcggtgccgggccgcccccgtgcgcttgccgtacttttttccgggtgtgcttgaagcactatcaagcaagcgtttctccagagccgccttgcacctatggctcagccgtgactcctgtcctgggcgtggactctttctccctccccgatgggggcggagctgattcggctttttcaaatcctattcgcttcccattcgggttcacctggcccggcactttcagcttaattatcgaggctcttcataccgactctcccgacgatctggccacggagaacccagaacggctgatctctagacttgcaacccagcgccatctgactgtgggtgaagagtggtcacaggaccttcacagttctggccggactgacttaaaatacagttatcggttcgtctgtgacgagcactactacggtgaaggatgctcggtgttctgccggcctagggacgatgccttcggtcacttcacttgcggagaaaggggcgagaaagtgtgcaacccaggctggaaaggcccatactgcaccgagcccatatgcctacccggttgtgacgagcagcacggcttttgtgataaaccaggggaatgcaaatgcagggtcggatggcaggggcgctactgcgatgagtgtatccgttatcctggctgtctgcatggcacctgtcagcaaccctggcagtgtaattgccaagaaggatgggggggtctcttctgcaatcaggatttaaattactgcacccatcataaaccctgcaaaaatggcgctacctgcacaaatactggacaggggtcctacacctgcagctgtaggcctggttacacaggcgccacttgcgaactgggcatcgatgagtgtgacccttcgccctgcaagaacggaggttcttgcaccgacctggaaaactcctacagttgcacgtgccctcccggcttttatggaaagatatgcgaactgtctgccatgacatgtgccgatgggccttgttttaacggtgggaggtgctccgattcacctgacggagggtactcatgcaggtgtcctgttggttatagcggctttaactgtgagaaaaagatcgactactgctcttcatccccttgctccaacggagcgaaatgtgtcgacctgggcgacgcttacctgtgccggtgtcaggcaggattttctggcagacactgcgatgacaatgtagacgactgcgcttcctcgccctgcgcaaatggcggaacctgccgcgacggcgtgaatgactttagctgtacctgcccacccggttatactggccgaaattgttcagcccccgtatccaggtgcgaacacgcgccttgtcacaatggagcaacatgtcatgagagaggtcacagatacgtgtgtgaatgtgccagaggatatggcggccccaattgccagttcctgctaccagagctgccaccaggccctgcagttgttgatctgaccgagaagctggaaggacaaggcggtccgtttccctgggtcgccgtgtgcgccggagtcatccttgtgttaatgctgctgcttggatgtgctgccgttgttgtgtgcgttagactcaggctgcagaagcacagacctcctgcagacccctgccggggcgagacggagaccatgaacaatctggcaaattgccagcgggagaaggatatatctgtttcaattattggagcaacccaaatcaagaataccaataaaaaggctgacttccatggggaccactcagcggataaaaatgggttcaaagctaggtaccccgcggttgactataatctcgtccaagacctgaagggtgacgacactgccgtgagagacgcacacagtaagagggacacaaagtgccagcctcagggctccagcggggaggagaaggggacaccgacgacgttgcgcggtggggaagccagcgagcgcaagcggcctgacagcgggtgctcaacttctaaggatacaaagtatcagtctgtttacgtgatttcagaggagaaggatgagtgtgttatagccactgaagtatag

SEQ ID NO: 9038 - DNA, 981 bp, Artificial Sequence
  Description of Artificial Sequence: Synthetic coding sequence
atggccgcccccgccagcgtgatgggccccctgggccccagcgccctcggtctcctgctcctcctgctggtcgtcgctccccctagggttgctgcactggttcatagacaacccgagaatcagggtatctctttaaccgggagtgtggcttgtggcagaccatctatggagggaaagatcttaggaggtgtgcctgcaccggagcgcaaatggccatggcaagtgtccgtgcactatgcaggcctgcacgtctgcggaggatctatcctgaatgagtactgggtgctgtccgcagcacactgctttcatcgggacaagaatataaagatttatgacatgtacgtgggactagtcaatctccgtgtcgcgggcaaccatacccagtggtatgaggtgaacagagtgattctgcacccaacttacgagatgtaccacccaattggcggagatgtggctctggtgcaactgaagacccggatagtcttctccgagtccgtccttcccgtttgtctggccacacctgaagtcaacctgacctcggcaaattgttgggccactggctggggcctcgtgtctaaacagggggagacatccgatgaactacaggaaatgcagttacccctgatacttgaaccttggtgccacctgctatacggacatatgtcatatataatgccggacatgctatgtgcaggagacatccttaacgccaaaacggtatgcgaaggtgatagcggcggcccacttgtttgcgaattcaataggagttggctgcagatcggcattgtgagctggggccgtggttgctctaatcccttgtaccccggagtctacgctagcgtctcgtatttcagtaagtggatttgcgacaacattgagatcaccccaactcccgcccagcccgctccagccctatccccggcgctgggacctaccctctcagtactgatggccatgctggcgggatggtctgtgctatag

SEQ ID NO: 9039 - DNA, 1596 bp, Artificial Sequence
  Description of Artificial Sequence: Synthetic coding sequence
atgagcctggccgcctactgcgtgatctgctgccggcggatcggcactagcaccagccctcccaagtccggcacccactggcgggacatccgcaacatcataaagttcactggatccctgatacttggggggagcctgtttctgacctatgaggtgcttgctctcaaaaaggctgtgacactggacacccaggttgtggaacgcgagaagatgaagtcctatatctatgtgcatactgtgagcctcgataaaggggagaaccatggaattgcctggcaagcccgcaaagagctgcacaaggcagtgcggaaagtcctcgccacatccgccaagatcctgaggaacccctttgccgaccctttcagtaccgtggacatcgaggatcacgagtgtgccgtttggttgctgctgaggaagagcaagagcgatgacaagactactcgcctagaggctgtacgggagatgtctgagacccaccactggcacgattatcaatacaggatcatcgcacaggcctgtgaccccaagaccctgattgggctggcccgaagcgaggagtctgacctgagattttttctcctgccgcctccacttcctagcctgaaggaagattcaagcacggaagaagagcttcgccagctgctggcttccctgccacaaactgaacttgacgagtgtatccagtatttcacttccctcgcattatccgagagttcacaatctctggccgcacaaaaggggggactgtggtgcttcggaggaaacggcctcccatatgccgaatcatttggagaggtaccttccgcaactgtcgagatgttttgccttgaagcgatcgtgaaacactccgaaatctcgactcactgcgataaaatcgaggccaacggcggcttgcaactgcttcagaggctgtaccgtctccacaaagactgccctaaggtgcaaagaaatattatgcgagtgataggcaatatggccttgaatgagcatctgcatagctccatcgtgagaagcggctgggtaagcataatggccgaggcaatgaaatctccccacattatggagagtagtcatgctgctagaatcttggcaaatctcgatagagagaccgtgcaggagaaataccaggacggggtgtatgtgcttcatccacaatatcgaaccagccagcccattaaagctgacgtgctcttcatccacggccttatgggcgccgctttcaagacatggcggcaacaggacagcgaacaggctgtgattgaaaaacctatggaggatgaggacaggtataccacctgttggcccaagacttggctggcaaaggattgccccgccctccgtatcattagcgtagaatatgacacatcgctgagcgattggcgtgcacgctgccctatggagagacgcagtttactctcaatcagcagcggaatagtggaaggcctcgaatcgccactgcactccgaggccaccaatttccttggttcaagcgagctgttggtactgggaatcggtcagtggtttggataccatatcgcttgggaggtttttctttccaagcgttgctgctggaaaccattgagatcccagaagtag

SEQ ID NO: 9040 - DNA, 1596 bp, Artificial Sequence
  Description of Artificial Sequence: Synthetic coding sequence
atgagcctggccgcctactgcgtgatctgctgccggcggatcggcactagcacttcacctcccaagagtggcacccactggagggacatcagaaacatcattaagttcacaggcagcctgatcttgggggggtccctctttctcacatacgaagtcctggccctaaagaaggccgtgaccctggatacgcaggtggttgagagagagaagatgaagagttacatctacgttcacactgtctctctcgacaaaggcgaaaatcacgggatcgcttggcaggcaagaaaggagctccacaaggctgtccgaaaagtgctggccacgtcggctaaaatcctaagaaaccctttcgccgaccctttctccaccgtggacattgaagaccatgagtgcgctgtgtggcttttattaaggaagtccaaaagcgacgacaagactacacgcctcgaagctgtgcgtgaaatgtccgaaacccaccactggcatgactatcagtatcgtataatagcccaggcttgcgatccaaagactctgatcggcctagcccgaagcgaggagtcagatttacgttttttcctgctgccaccccctctcccctccctgaaggaagattcatcaacagaggaagagctccgccagttactggcctcgctgcctcagactgaactggacgaatgtattcagtactttacttccttggcactgtctgagtcatctcaatctctcgcagcccagaaaggcggtctctggtgttttggcggaaacggtttgccatacgcggagtccttcggagaggtcccctctgccaccgtggagatgttctgtctggaagccatcgtgaagcatagtgagatatcaactcattgcgataaaatcgaggccaatggtggcctccagctgctccagaggttgtaccggctgcacaaagactgccctaaagtacagcggaatattatgagagtcatcggaaatatggcccttaatgaacacttgcactcaagcatcgtgcggagcggctgggtgtccatcatggccgaggccatgaaatcacctcatattatggagtcctcacacgctgccaggattctcgccaacctggaccgcgaaacggtgcaggagaagtatcaggacggcgtctacgtgcttcaccctcagtaccggacgagtcagccgatcaaggccgatgtgctcttcatccatggcctgatgggagcagcttttaaaacctggaggcaacaggactctgagcaggctgtcattgaaaaaccgatggaggacgaggacagatacactacgtgctggccaaaaacctggctcgctaaggactgccctgccctccgcattattagcgtggaatacgatacgagcctttctgattggagggcaaggtgtcctatggagaggaggtcactcctgtccatcagtagtggaatagtggaaggattggaatctcctctgcacagcgaggcaactaattttctgggatcttcagaactgcttgtgctgggaatcggacagtggttcggctaccacattgcttgggaagtctttctgtcaaaacgatgctgctggaaaccactccggagtcaaaaatag

SEQ ID NO: 9041 - DNA, 1965 bp, Artificial Sequence
  Description of Artificial Sequence: Synthetic coding sequence
atgagcctggccgcctactgcgtgatctgctgccggcggatcggcacatcaacctcaccgccaaagagcggtacccactggcgggacatcaggaacataattaaatttacagggtccctgattctgggaggctccctgttcctgacatacgaagttctagccttgaagaaggctgtgaccttggatactcaggttgtggagagagaaaagatgaaaagttacatctacgtgcatacagtgtcgctggataagggcgaaaaccacggtatcgcatggcaggctcgcaaagagctgcataaggcggtgaggaaagtgttggctacgtcagccaaaatactcagaaacccattcgcagatccatttagtactgtggacatcgaagaccatgagtgcgcagtgtggttgttgctgaggaaatcaaagtctgacgataagacgacccgcctggaggctgttagggaaatgtcagagactcaccattggcacgactatcagtacagaatcatcgcccaggcatgtgaccccaagacattgattggcctggcccggtcagaagaatctgacttgcggttcttcctcctaccccctccacttcccagcttgaaggaggactcatcaactgaggaagagcttcggcaactgctagcttccctcccacagactgagctggacgagtgcatccagtactttactagcctcgccttgtccgagtcatcccagtcccttgccgcccagaagggagggctgtggtgtttcggggggaacggcttaccatatgccgagtcctttggggaggtacctagcgcaacagtagaaatgttctgcttggaagcaatcgtgaaacactccgagatctctacacactgtgataagattgaggctaatggagggctacagctcctccagagactgtaccgactccataaggactgtcccaaggttcagagaaacatcatgcgagtaattggaaatatggcactgaatgaacacctgcattcttccattgttcggagcggatgggtgagcatcatggcagaagccatgaagtctccacatatcatggaatcttctcacgctgccagaatcctggccaatttagatcgagagactgtgcaagagaagtatcaagacggagtgtatgtccttcatccgcagtatcgcacgtcacagcccattaaagctgacgttctgttcattcatggcttgatgggcgccgcttttaagacttggagacagcaggatagtgagcaagcggtgatcgagaagccaatggaggacgaagaccgctacacaacttgctggccaaaaacctggctggcaaaggattgccccgcactccggataatttctgtggaatacgataccagtctatccgactggcgggccaggtgtcccatggagcgcaagagcatagcgttccggtcgaatgagctgttaagaaaactacgcgctgccggggtgggcgatagaccggtcgtgtggatcagccattcaatgggtgggttgttggtcaaaaaaatgctcctcgaagcatcaacgaagcctgagatgagcaccgtgattaataacaccagaggcatcattttctactcagtcccccatcacggaagtcgcctagccgagtactcagttaacatccggtacctgttattcccatctctggaggtcaaggagttgagtaaggactccccggctctgaagacactgcaggacgacttcctggagttcgctaaagataagaactttcaggttctgaatttcgtggaaaccctccctacctatattggctcaatgataaagcttcacgtcgtccccgtggaatcagctgacctgggcatcggcgacctcattccggtggatgtgaaccacctcaacatatgcaaaccaaagaaaaaagatgcttttctgtatcaaaggacccttcagtttatcagagaggctctagccaaagacctggaaaattag

SEQ ID NO: 9042 - DNA, 1509 bp, Artificial Sequence
  Description of Artificial Sequence: Synthetic coding sequence
atggcccagcggtgcgtgtgcgtgctggccctggtggccatgctgctgctagtgttcccaacggtgagccgctccatgggcccacggtctggcgagcaccagcgcgcctcaaggattcctagccaattcagtaaagaggagagggtggcaatgaaggaggccctgaaaggagccatccaaatacccaccgttacattttccagtgaaaaatctaataccaccgccctggccgagttcggaaagtacattcataaggtgttcccgactgtggttagcacatcctttatccagcacgaagtggtcgaagagtactcccatcttttcacaattcagggctctgatcccagtctgcaaccatacctgctgatggcccattttgatgtcgtacccgctccagaagaaggttgggaggtacctccctttagtggcctcgaacgcgacggcatcatttatggccgcggcacactggacgacaagaactctgtgatggcgctcctgcaagcactggagttacttctgatacggaaatatattccccgccgcagcttctttatctctctcggtcatgacgaagaatcttctggaacaggggctcaacggatctccgctcttcttcagtcgagaggtgtccagcttgctttcattgtggatgaaggaggcttcatcctggacgactttattcccaattttaagaaacctattgctttaatagccgtttccgagaagggatcaatgaatctgatgctgcaggtcaacatgacaagtggccattcaagtgccccacctaaggaaaccagtatcggtattctcgccgcggccgtctccaggctggaacagactcccatgcctatcattttcggctcaggaactgttgtaacggtccttcaacagctggctaatgagtttccctttcctgtgaatatcatactgagcaacccctggttgttcgagcctttgatcagtagattcatggaacgaaatccactgacaaatgccatcattcgtactaccaccgcgttgactattttcaaggcaggggtgaaatttaacgtaattcctccagtggcacaggccactgtgaactttcgcattcaccctgggcagaccgtgcaggaggtcctggaattgactaagaatattgtggcggataatcgagtccaatttcacgtgctgtcagcattcgatccgctgccggtctctcccagcgatgataaagccctgggctatcagctgctgaggcagacagtgcagagcgtgtttcccgaggtgaacataacggcgcctgtgacatcaataggcaacaccgacagtcgattctttactaacctgactactggcatttaccgattttacccaatctatatccagcctgaggattttaaacgtatccatggagttaacgaaaaaatctctgtgcaggcctatgagacccaggtcaagttcatctttgagctaatacagaatgccgacaccgaccaggagcccgtttctcacttgcacaagctttag

SEQ ID NO: 9043 - DNA, 999 bp, Artificial Sequence
  Description of Artificial Sequence: Synthetic coding sequence
atgcggctgctggccttcctgagcctgctggccctggtgctgcaggagaccggcacagcaagtctgccccggaaggaaagaaagcgcagagaagaacagatgccacgcgagggggatagctttgaggtccttccactgcgcaatgacgtgctgaatcccgataactacggcgaggtgatagacttgagtaactatgaggagttaactgactacggggatcagctgcccgaagtgaaagtgacttcgctcgctcctgccacctccatatccccagccaaatccacaaccgcccctggaaccccctcgtcgaaccccacaatgacccgacccacaactgcaggccttttactatcgagccaaccgaaccacgggctgcctacgtgtttggtttgcgtttgcctgggctctagtgtatattgtgatgatattgatctggaagacataccacctctgccgaggaggacagcatacttgtacgcacgttttaataggattagtcgtattcgtgccgaggatttcaagggtctgaccaagctgaagcggatagacttgtcgaacaatctgatctccagcattgacaacgacgcatttagattgctgcacgccctgcaggatttaatccttcccgagaatcagctggaggctctccctgttctcccgtctggcatcgaatttcttgatgtccgccttaaccggctacaatcgtccggcatccagccagctgcctttcgcgccatggaaaagctgcagttcttgtacctttctgataacctactggatagtataccggggccactgcccctctcgctccgaagtgtccatttgcagaacaacctgatagagaccatgcagcgcgatgtcttttgcgatccagaggagcacaagcacacgagacgtcaactggaggacatccggctggatggcaatcctatcaatctcagcctgttcccgagtgcctatttctgtctcccgagactccccatcggccgtttcacatag

SEQ ID NO: 9044 - DNA, 1401 bp, Artificial Sequence
  Description of Artificial Sequence: Synthetic coding sequence
atggtgcggagcgtggcctgggccggcttcatggtgctgctgatgattccctggggttcagcggctaagctggtatgttattttaccaattgggcccagtacaggcagggggaggcaagattcctgccgaaagacttggacccttcgctgtgtactcacttgatctacgcatttgccggtatgaccaaccatcagctctccaccaccgagtggaacgatgagaccctgtatcaagaattcaatgggctcaagaagatgaaccccaaactgaagaccctcctggcaatcggcggttggaacttcgggacccaaaaatttacagacatggtggctaccgcaaacaatagacagacattcgtgaacagcgcgatacggttcctgagaaagtattcatttgacggtcttgacttagactgggaatatccgggctcccagggcagtcctgcagtggacaaagagcgctttaccacgcttgtacaagacctggcgaatgccttccagcaagaggcacaaacctcaggcaaggaacggctcctgctgagtgccgccgtgccagctggccaaacttacgtggacgccgggtacgaggtggacaagattgctcaaaacctggatttcgtgaaccttatggcttacgactttcatgggagctgggagaaggtgacaggacacaattcgcctctttataagagacaggaggaatccggggcagcggcgagtctgaacgtggacgctgccgtccagcagtggctccagaagggaacccctgcatcaaaactcattcttggcatgcccacgtacgggcgaagcttcacactggcgtcctcatccgatactcgggtgggcgcccccgcgaccggaagcggaacccctgggccattcacaaaagagggcgggatgctggcctactacgaggtctgcagttggaagggtgcaaccaagcagcgcatccaggatcagaaggttccatacatttttcgcgacaaccaatgggtggggttcgatgacgtggagtccttcaagactaaggtatcctatctaaagcagaaagggctcggaggggcaatggtttgggctctggatctggatgatttcgccggtttcagctgcaatcagggcaggtatccgctgattcagactcttcgccaggagctgtcactgccatacttgcctagcggtacccctgagctggaagtgccgaagccaggtcagcctagcgaaccagagcatggcccaagccccggccaggatacattctgccaaggcaaggccgatggattgtaccctaatccccgcgaaagaagcagcttctactcttgtgctgcagggaggcttttccaacagtcttgtccgaccggcctcgtgtttagtaattcctgtaagtgttgtacgtggaactag

SEQ ID NO: 9045 - DNA, 1596 bp, Artificial Sequence
  Description of Artificial Sequence: Synthetic coding sequence
atgcggctgtgcctgggccggccccacccccggggccacagccgggtggggaagagcgagagaggtaggggcgcccggggactggccaggcagcgtactttggaagacgaggaagaacaggagagagagcgacggagaaggcacagaaatctttcctccacgaccgatgatgaagcaccacgcttgagccagaacggggatcgacaggcatcggcatcagaaagactgccctccgttgaggaggcagaggtgcctaaacccttgccaccagccagcaaagacgaggacgaagatatccagtctatcctgaggaccagacaggagagaagacagaggcgccaggtggtggaagcagcccaggctcctattcaggaacggctggaggcagaggaggggagaaatagcctgagtccagtgcaggccacgcagaagcctctcgtatccaagaaggaactcgaaatcccaccccgacgtagactgagccgtgagcagagaggaccgtgggcactcgaggaggagtcactggtgggtcgagaacctgaggagagaaagaagggtgtgcctgaaaagtctccagtcctggagaaatcctcaatgcctaagaagaccgcgcctgagaagtcattagtgagcgacaaaacctctataagtgaaaaggtgctggcttcggaaaagactagcctctctgagaaaattgccgtatcggaaaaacgtaactcttccgagaaaaaatctgtgctggaaaagacaagcgtcagtgagaagagtctggcacctggaatggccctaggaagcggacgccggttggtgagcgagaaagctagcatatttgagaaagccctggccagtgagaaaagcccgactgccgacgcgaagccagcgcccaaaagagctaccgcaagtgagcagccactggctcaagagcctcctgcctccggcggctccccggccaccacgaaggagcagaggggccgggcactccccggtaagaatctgcctagtctcgctaaacaaggagcaagtgatcccccgaccgtggcctcccgccttcccccagtgacacttcaggtgaaaattccctccaaagaggaagaggcagacatgtcatctcccacccaaaggacttacagctcatcactgaaacggagcagccccagaaccattagttttagaatgaagcctaagaaggaaaactcggaaaccacgctgacgaggtccgccagcatgaagctgccagacaacactgtgaagctgggggaaaagctggagcgctatcatacggctattcgaagatctgagagcgttaaaagccgtggtctgccctgtaccgagctctttgtcgctcccgtgggtgttgcctcaaagcggcatctcttcgaaaaggaactcgctggccagagtagggccgaacccgcgtcaagtcgtaaagaaaacttgaggctttccggcgtggtgacatctagactgaacctttggatcagtagaacccaagagagtggagatcaggaccctcaggaggctcagaaggcttcttccgcaaccgagcgcactcagtgggggcagaagtctgactcatccctggacgccgaggtgtag

SEQ ID NO: 9046 - DNA, 1782 bp, Artificial Sequence
  Description of Artificial Sequence: Synthetic coding sequence
atgaaggccgacctgaagcagcaccaccaccactggagcatcttctcatacattcggctccgtctgccttccatgttacttttgttttctgtaatccttatcagttgggtttctacggtgggcggcgaagggactctttgtgattttcctaaaatccaccatggatttctctatgatgaagaggattacaaccccttttcacaggtgcctactggtgaggtgttctattattcatgtgaatataatttcgtgtctccgagcaagagcttttggacgcggataacttgcaccgaagaagggtggtcccctactccaaaatgtctacggatgtgctcattcccatttgtgaagaacggccattccgagagcagcggcctgattcatctcgagggtgataccgtgcaaatcatctgcaatactgggtatagcctccaaaataacgagaagaatatctcctgtgtcgagagagggtggtcaactccaccgatttgcagcttcaccaagggcgagtgccacgtccccattctcgaggctaacgtcgacgcccagcctaagaaagagtcatacaaggtcggggacgtcctgaagttctcctgccgaaagaacctgatcagggtcggctctgattccgtgcagtgttatcaattcggttggagtccaaacttcccaacctgcaaggggcaggtgcggtcttgtgggcctccccctcagttgagtaacggtgaggtcaaagagatacgcaaagaggagtatggtcataacgaggttgtcgagtatgactgtaacccaaacttcattattaatggccccaagaagatccaatgcgttgatggagaatggactaccttgccgacctgcgtggagcaggtaaaaacctgtggctatatcccagagctggagtacggatacgttcagccctctgtgccaccatatcagcacggcgtcagtgtagaagtgaattgtaggaacgagtatgctatgatcggtaataacatgatcacgtgtataaatggcatctggacggagctgcctatgtgtgtagcaacacatcagctaaagagatgcaagatcgccggggtgaacatcaaaaccctcctgaagctgtctggcaaagaatttaatcacaatagccgaatccgataccgttgtagcgacatttttagatatcgccactctgtatgtatcaacggcaagtggaaccccgaggttgattgcacagagaagagagaacagttttgcccaccacccccccagattcccaatgcccaaaatatgaccaccacagttaattatcaagacggggaaaaggtcgcggttctgtgtaaggaaaactatctgctgcctgaggccaaggaaatcgtgtgcaaagatggacgctggcagagcctcccccggtgtgtagagtccacggcctattgcggcccacctccatcaatcaacaatggtgacacaaccagcttccccctaagcgtgtatccgcccggaagcactgttacctacaggtgccagagcttttacaaactccaaggttcggtcactgtgacatgcagaaataaacagtggagcgagccgccaagatgcttggacccatgcgtcgtgtccgaggagaacatgaataagaacaatatccaactcaaatggagaaatgacggaaaactatacgcaaagacaggtgacgccgttgagtttcaatgtaagttcccacacaaggcaatgattagcagcccgcctttccgggctatatgccaggaaggcaaatttgaatacccgatatgtgagtag

SEQ ID NO: 9047 - DNA, 2301 bp, Artificial Sequence
  Description of Artificial Sequence: Synthetic coding sequence
atgatctggcggagccgggccggcgccgagctgttcagcctgatggccttatgggaatggattgctttatccctccactgttgggttctagccgtggccgcagtttccgaccagcatgcaacctcgccttttgattggctgctctctgataagggtccctttcacaggagccaggagtacaccgattttgtcgaccggagccggcaggggttctccacccggtataagatttacagggagttcggcaggtggaaagttaacaatctggcagttgaacgccgaaattttctgggctctcctcttccactcgccccagaattctttagaaacattcgcctgctcgggcgaagacctactctgcagcaaatcaccgagaatctaatcaaaaaatatgggacacattttctgctgtctgctacccttggaggtgaggagagtttgactatcttcgtcgataagcggaagctgagtaagcgcgctgagggtagcgactccactacaaatagctcatcagtaacactggaaactctacatcagctggctgcatcatatttcattgaccgagattctacactgcggagactgcaccatattcaaatcgcctctaccgctatcaaagtgactgaaacccgaacaggaccgctgggttgcagcaactatgataacttggactctgtctcgagtgtgctcgtacagagcccagagaacaagatacagttgcagggactccaggtgttgctgcccgattacctgcaggagcgcttcgtgcaggcagcattatcctacattgcatgtaactcagaaggggaatttatttgcaaagagaacgactgctggtgccactgcggtccaaagttcccggaatgcaactgccctagcatggacattcaggctatggaagagaacctgttgcggatcacagaaacatggaaagcctacaactccgacttcgaagaaagcgatgaattcaaactgtttatgaagaggctcccgatgaactacttcttaaacacaagtacaattatgcacctgtggactatggatagtaacttccaacgccggtacgaacaattagagaactcaatgaagcaactcttcctcaaggcccagaaaattgtgcataagctgttctccctttctaaaaggtgccacaaacaaccgcttatttctttgccccggcagaggacctctacctactggctgactcggatccagtccttcctctactgtaatgaaaatgggctgcttggctcattcagtgaggagactcatagctgtacatgtccgaacgaccaagtggtgtgtaccgcattcctaccctgtaccgtcggcgatgctagcgcatgcctgacttgtgcccctgacaaccgcacccggtgcggcacgtgtaacacaggatatatgctatcgcagggcctgtgtaaacccgaagtcgcagaatccacagatcattacatagggttcgagactgacttgcaggacctcgagatgaaatacttgctgcagaagacagatagaaggattgaagttcacgccatcttcatctcaaacgacatgagattgaatagttggtttgaccccagttggaggaaacggatgcttctgacacttaaaagtaacaagtataaatccagccttgtgcacatgatcctcgggctgagcttgcagatctgcctcactaagaattccaccctcgaaccagtcttggctgtgtacgtgaacccttttggaggtagtcactctgagagctggttcatgcccgttaacgaaaactcttttcccgactgggagcggacaaagctggatctgcctctccagtgctacaactggactctgactctgggcaataagtggaagaccttttttgagacagtgcatatttatctgcgcagtcgcatcaagtctaatggccctaatggcaatgaatcgatctattacgagccactggagttcatcgacccatcaagaaatctcgggtacatgaaaataaacaacattcaggtgttcggctactctatgcattttgatcctgaggctattcgcgatctcattctccagctggattacccttacacccaagggtcgcaggacagtgctctgctgcaactgctcgaaatcagagaccgcgtaaacaagctgtccccacccggacagaggcgcttggatcttttcagctgcctgctgagacacagactgaagttaagtactagtgaggtggtcagaattcagtccgccctacaggcatttaacgcgaagctgcctaataccatggactacgacacaactaagctctgttcttag

SEQ ID NO: 9048 - DNA, 1815 bp, Artificial Sequence
  Description of Artificial Sequence: Synthetic coding sequence
atgcggcggtgcaacagcggcagcggccccccccccagcctgctgttgttactgctttggctcctggccgtgcccggcgccaatgcggctcctaggtccgccctgtactccccatctgatccgttgactctcctccaggcggacaccgttaggggtgctgttttggggagtagatctgcttgggcagtggaattcttcgcctcttggtgtggacactgtatagcattcgctcccacctggaaagcacttgcggaggacgtaaaagcctggagaccagcactctatcttgctgccctcgattgtgcagaggagacaaacagtgcggtttgtcgagatttcaacatacctggctttcccaccgtgcggttttttaaagcctttacaaagaacggctccggggctgtttttccggtggcaggggccgacgtccaaacactccgagaaaggcttatcgatgctctcgaaagccaccatgacacctggcctcctgcatgtcccccgctcgagcctgccaagctcgaagagattgacgggttctttgcccgaaataatgaggagtacctagccctaatttttgaaaaagggggatcatacctgggcagggaggtcgccctggatctctctcagcataagggagtcgcagtacgccgcgtgctgaacacagaggccaatgttgtgaggaagttcggagttactgacttccccagctgctacctgttgtttcgcaacggcagcgtttcaagagtgcccgtactgatggaatcccgctctttctatacggcttatctgcagaggctgtccggactcacccgggaggccgcccagactaccgttgctcccactactgccaataagatagcccctaccgtatggaaactggcagatagatccaagatctatatggctgatctggagagtgcgcttcactacatccttcgcattgaagtgggtagatttccggtgctggaggggcaacggctagttgcattaaagaagttcgtcgctgtgcttgccaagtatttccctgggcgccctcttgtgcaaaactttttgcactccgtgaacgagtggctgaaacgtcagaagaggaataagatcccgtattcatttttcaaaaccgctctcgacgatcgcaaggagggtgctgtgctcgcgaagaaagtgaattggataggatgtcagggctctgagcctcattttagagggttcccatgcagcctctgggtcctcttccatttcctgaccgtgcaggcggcccggcagaatgtggatcactcgcaggaagccgccaaagcgaaagaggtcctgcctgctatccgcggttacgtgcattactttttcggatgtagggactgcgcatcacatttcgaacaaatggcagcggctagtatgcatagggtcgggtcgcctaacgcagcggtgctgtggctctggtccagccacaacagggtcaacgctaggcttgccggagctccttctgaagaccctcaatttccgaaagtccaatggccgcccagagaactctgttctgcctgtcataacgagagactggacgttccagtctgggacgtcgaagcgaccctcaatttcctcaaggctcacttctctccttcaaacataatactggatttcccagccgcaggctcagccgcgagacgggatgtgcagaacgtcgcggcagctccggaacttgcaatgggggccttggagctggagagcaggaattctaccctcgaccccgggaagcctgagatgatgaagagcccaaccaacacaacccctcatgtgcccgctgaaggcccggagttgatctag

SEQ ID NO: 9049 - DNA, 2244 bp, Artificial Sequence
  Description of Artificial Sequence: Synthetic coding sequence
atgcggcggtgcaacagcggcagcggccccccccccagcctgctgcttttattgctgtggttacttgccgttcccggcgcgaatgccgctccaaggtccgccttgtattccccatccgacccacttactctgttgcaggcggataccgtaagaggagcagtgctgggcagccgttctgcgtgggcggtagaatttttcgcctcctggtgtgggcattgtatcgcttttgctccaacttggaaagccctggcagaggatgtgaaggcatggagacccgccctgtatctggctgccttggactgcgctgaggaaaccaacagcgcagtgtgtcgcgattttaacatacccggttttcccacagtgcgcttcttcaaggccttcactaaaaatggttcaggagctgtgtttccagtggcaggggcagacgtgcagactctccgtgaacggctgatcgatgcgctggagtcccaccacgacacttggccgcctgcctgccctcctctggaacccgccaaattggaggagattgacggctttttcgcccgaaacaacgaggagtatctggccctgatcttcgagaaaggcggtagctacttggggagagaagttgccctggatttgtcccaacataagggcgtggcagtaaggcgtgttttgaatacagaggccaacgtcgtccgaaagttcggtgtcacggacttcccttcctgttacctgctctttaggaatggctccgtgtctagagtgcccgtcttgatggagtcgcgttctttctatactgcctacctacagagattatcaggcctaacccgggaagctgcccagactacagtggcccccaccaccgcgaacaaaatagctcccactgtgtggaagctggccgaccggagcaaaatctacatggctgatcttgagagcgccctgcactatatcctgaggattgaggtagggagatttcctgtcctggagggccagcgattggtggccctcaagaagtttgtggctgtactggccaaatactttccagggcgccctttagtgcagaacttcctccacagtgtaaacgagtggctcaagaggcagaagcgcaacaagatcccatacagtttctttaaaacagccttggatgacagaaaagagggggctgtccttgcaaaaaaagtgaattggattggctgccaaggctctgagccgcactttcgaggatttccatgctccctgtgggtgttgttccacttcctgaccgttcaggctgcacgtcagaatgtcgatcactctcaagaggcggccaaggctaaggaagtgctacctgctattcgagggtacgtccattacttctttggatgtcgggactgcgcgagccatttcgagcagatggcagccgcctccatgcatcgtgttggcagtcccaacgcagccgtgctctggttgtggtcgtcacacaatcgagtgaacgcccggctggcaggggcccccagtgaggatcctcagttccccaaagtgcagtggcctccacgtgagctgtgtagcgcctgtcataatgaaaggctggatgtccccgtgtgggatgtcgaggccacgcttaattttcttaaggcacacttcagtccgtccaacatcattctggattttcctgctgctggaagcgccgcccggagagacgtgcaaaacgtggccgccgcacccgagttggccatgggcgctctggagttggaatccaggaactctacgcttgacccgggcaaacccgagatgatgaagagtcctactaacaccaccccacacgtacccgcggagggacccgaagcaagtagaccaccaaagctgcatcctggcctacgggctgctccaggccaggaacctccagaacacatggctgagctgcaaaggaacgaacaggagcagcccctcggccaatggcatctgtctaaaagagatactggcgccgccttgctggctgaaagcagagccgagaaaaatagactgtgggggccccttgaggtccggagagtcgggcggagctccaaacagctcgtggacatccctgaagggcagctagaggccagggcaggacgcggcagggggcagtggctgcaggtgttaggcgggggattttcctacctcgacatctcattgtgtgtaggtttgtactccctctccttcatgggcctgctggccatgtacacatattttcaagccaagatacgagccctgaaggggcacgctggacacccagccgcatag

SEQ ID NO: 9050 - DNA, 1476 bp, Artificial Sequence
  Description of Artificial Sequence: Synthetic coding sequence
atgaagaccttcacctggaccctgggcgtgctgttcttcctgctggtcgacacaggccattgcaggggcggacaattcaagattaaaaaaataaaccagagacgttacccacgggcaaccgacggaaaagaagaggccaagaaatgcgcttatacgttcctggttccagagcagcggattactgggccaatctgcgtaaataccaagggccaggacgcctccacgattaaggatatgattactaggatggatcttgaaaatctgaaagatgttctcagtcggcagaagagagagatcgatgtcttgcagctggtggtggatgttgatggaaatatcgtcaacgaggtcaaactgcttaggaaagaatctcggaacatgaacagtagggtgacacagctctacatgcagcttctccatgaaattatcagaaagcgagacaatagcctggagctttctcagctcgaaaataagatcctgaatgttactacagagatgttgaagatggctactcggtacagggaactggaagtgaagtatgcctcactgaccgacctggtgaataatcagagcgtgatgattactctgctggaggagcagtgcctgcgtatttttagccgacaggatacacatgtctctcctcccttggtgcaagttgtcccccagcacatcccgaattctcagcagtataccccaggtctgctgggtggcaatgaaattcagagggaccccggctatccgagggatctgatgccgcctccagatctcgcaaccagtccaacaaaatcaccttttaagattccccctgtcacgtttatcaatgagggtccctttaaagattgtcagcaagctaaggaagccggacattcagtgagcggcatatacatgattaagcccgagaattccaatgggccgatgcaactgtggtgtgagaacagcctggaccccggaggctggaccgtcatccagaagcggaccgatggctccgtcaatttttttcgcaactgggaaaactacaagaaggggtttggaaacatcgatggcgaatactggctgggcctcgagaatatttatatgctgtccaaccaagacaattataagcttctgatcgagttggaggattggtcagacaaaaaagtgtacgccgaatactcttcatttagactggagccagaaagtgaattctatcggctgagactcggtacataccagggaaacgctggcgacagcatgatgtggcacaatggtaagcagttcacaacccttgatagggataaggatatgtacgcaggaaattgtgcccactttcacaagggagggtggtggtataatgcatgcgcacatagcaacttgaatggcgtgtggtatcgtggaggccactatcggagcaagcatcaggacggaatattctgggcagagtatcggggtggtagctatagtctgcgagccgtccagatgatgatcaaaccaatcgactag

SEQ ID NO: 9051 - DNA, 2484 bp, Artificial Sequence
  Description of Artificial Sequence: Synthetic coding sequence
atgatgtgcctgaagatcctgcggatcagcctggccatcctggccggctgggcactctgctccgctaattctgaattgggttggacccgcaagaaatccctggttgaaagagagcacctcaatcaagtcctgttggagggtgaacgatgctggctcggcgcaaaagtacgccgcccccgggcatcaccgcagcatcaccttttcggcgtgtatccatccagggccggcaattacctgagaccatatcctgtgggcgaacaagaaattcatcacaccgggcggtcaaagcctgacactgaaggcaacgccgttagcttagtgccaccggatctgaccgagaaccccgctggcctccgaggagctgtcgaagagcctgcagccccgtgggttggtgacagtcctatcggccagagcgaattgcttggcgatgacgatgcttatctgggcaaccagcgcagtaaagagtctttgggagaagctgggattcagaaggggtctgccatggcggcaaccactacaactgcaatttttacaaccttgaatgaaccaaaaccggaaacgcagcggcgcggttgggcgaagagtcgccagagaagacaggtctggaagcggcgcgctgaagacggtcagggggattctggcataagcagccatttccagccttggcctaaacactcactcaaacaccgtgtgaagaaatctccgcccgaggaatccaaccagaacgggggcgaaggatcctaccgcgaagccgaaacattcaatagccaggtgggactacctattctgtatttttcgggacggcgggaacgactactcctgagacccgaagtactcgccgaaattcccagagaggcctttaccgtggaggcttgggtaaaacctgaaggtgggcaaaataaccccgccatcattgctggggttttcgataactgtagtcacacagtttcagacaagggttgggctctgggaatacgatctggcaaagacaaaggtaagagagacgctcgcttttttttcagcttatgcacagacagagttaagaaggccacaattctgatttcacacagcaggtatcaacctggcacatggacccacgtagcagcaacttacgacgggcgccacatggctctgtatgtggatggcactcaggtggcatcaagtctggaccagtctggacctctgaacagcccctttatggctagctgccggagtctgcttctggggggcgacagttctgaggacgggcactatttcagagggcacttaggcacccttgtcttttggtcaaccgcgctgcctcagtcccactttcagcactcaagccagcactcctctggcgaggaagaagccacagatctggttttgacggcctctttcgaacccgtgaatactgagtgggtccctttcagagacgagaaatacccccggctcgaagttctccagggcttcgaacctgagcccgaaattctgtcacctttgcagccccccttatgcgggcagaccgtctgcgacaatgtggagctgatatcacagtacaacggatattggccactccgtggagagaaagtcataaggtatcaagtggtgaatatttgtgatgacgagggcctcaaccctatagtctctgaggaacaaataagactacaacatgaagccttgaacgaggcattctcaaggtacaacatttcctggcagctttcagttcaccaagtgcacaactctaccctgcgtcaccgcgtggtgcttgtcaactgtgaaccttccaaaatcggtaatgatcattgtgatcccgagtgcgagcaccctctcaccggatacgatggaggtgactgcaggctgcaagggcggtgttattcctggaatcgccgggacgggttatgtcatgtggaatgtaacaacatgctgaatgactttgacgacggcgattgctgcgacccccaggtggcggacgtgagaaagacatgtttcgatcctgactctcccaagcgggcttacatgtctgtgaaagaactgaaggaggccctccagctgaacagtactcacttcctgaacatttattttgccagctctgtacgagaggatctcgctggcgctgctacctggccctgggataaagatgcagtcacccaccttgggggcatcgttctgagccctgcatattacgggatgcctggccacaccgacaccatgattcacgaggtcggccacgtgctgggactgtatcatgtgtttaaaggagtgtctgaacgtgaaagttgtaatgatccttgtaaagagaccgtcccttccatggagaccggagatctatgcgctgacaccgcgcccacccccaagagcgaactatgcagagaacccgagccgacaagtgacacatgtggttttacgaggttccccggcgctccgtttaccaactacatgtcatacactgggattaccacagttcttttctgttttctacttagaatccacgggggtctctag

SEQ ID NO: 9052 - DNA, 5376 bp, Artificial Sequence
  Description of Artificial Sequence: Synthetic coding sequence
atgatgtgcctgaagatcctgcggatcagcctggccatcctggccggttgggccctctgttcggctaatagtgaactgggctggacccgtaagaaaagcctggtagaaagagagcatcttaatcaggtgttactagagggggaaagatgctggctgggggcaaaggtacgccgcccacgggcgtcaccgcagcaccatctgttcggtgtttacccctccagggccggaaactacctccgaccatatccagttggtgagcaggaaattcatcacaccggtcgtagcaaaccagataccgaaggaaacgcggtgtcgctcgtccctccggatttaacagaaaaccccgctgggctccggggcgccgttgaagaacctgcagccccttgggtcggagattctcctatcggccagtccgagctcctgggtgatgacgatgcatacctgggaaatcagcggtctaaggagtccctgggtgaagctggcattcagaagggctcagccatggcagctacaaccactactgcgatatttacgaccttaaatgagccgaagcctgagacccagaggcggggctgggctaagtctaggcaaagacggcaggtgtggaaaagacgcgccgaggatggtcagggcgactccggcatctcctcccatttccagccctggcccaaacactctcttaagcacagagtgaagaagagtccacctgaagaaagtaatcaaaatggcggtgaaggttcctatagagaagccgagacctttaacagtcaggtgggcctgcccattctatacttttctggcagaagggagcgactccttcttcggcccgaagtcctggctgaaatccctagggaggccttcaccgtagaggcctgggtaaaacccgaaggcggacagaataaccccgctattatcgctggcgtttttgacaattgctctcacacggttagcgacaaagggtgggcactcgggatccgcagcgggaaagataagggcaagcgggacgcgcgcttctttttttctttgtgtactgatcgcgtgaaaaaggcaactattctcatttcccattctcgctatcagccaggcacttggacacacgtggcagctacatacgatggccgacatatggcattgtacgtagatgggactcaagtggcgtctagcctcgatcaatccggccctttgaactcaccattcatggccagctgtcggtcgctgctgttggggggtgacagttccgaagacgggcattacttcagaggtcatctgggcacccttgttttttggtctacagcactccctcaatctcattttcaacacagtagccagcatagcagtggggaagaggaggcaactgacttggtcttaacggcctcctttgaaccggttaacacagaatgggttccctttcgagacgaaaagtacccaaggctcgaggtacttcagggcttcgaacctgaaccagaaattttgtctccgttacaaccacctctatgcggccagacagtctgtgacaatgttgagcttatctctcagtataacgggtattggcctctgcgaggggagaaagtgatcaggtaccaagtcgtgaatatttgtgacgatgaggggctgaacccgatagtcagcgaggaacagatccggctgcagcacgaagccctcaacgaagcattctctaggtataacattagctggcagttatctgtgcaccaggtacataacagcacattgcggcaccgcgtggttctggtgaactgcgagcccagcaaaatcggcaatgaccattgtgatccagagtgcgagcacccgctgacagggtatgatggcggtgactgccgtctgcaagggcgctgttattcctggaataggcgggatgggctgtgccacgtggaatgcaataatatgctgaatgacttcgatgacggcgattgctgcgacccacaggtggcagatgtgaggaagacatgctttgatcccgattctcccaagagggcatatatgtctgtcaaggaattaaaagaggcactccaacttaacagcacacatttcttaaacatatatttcgcttcctcagtgcgtgaggatctggcaggggccgccacctggccctgggataaagacgcagtgactcacctgggggggattgtattgtctcccgcttattacgggatgcctgggcataccgacacaatgatccatgaagtgggccacgttctaggcctgtaccacgtgttcaagggcgtgagtgagcgcgaaagttgtaatgatccttgcaaggagactgtgcctagtatggagactggtgacctctgcgcggataccgcaccaactcctaaaagcgaactgtgtagagagccagagccgacttcagacacctgcggttttactcgattccccggggccccatttacaaattatatgtcctacacagacgacaactgtaccgacaacttcacacccaatcaggttgcacgaatgcactgctacctggacctggtctaccagcaatggacggagagtaggaaacccacccccatccctattccacctatggtaatcgggcagactaacaagtctctaacaatccactggctgccaccaatatcgggtgtggtgtatgatcgagccagtgggagcctctgcggtgcctgtaccgaggacggaaccttcaggcagtacgtccacaccgccagttcgcggcgcgtatgcgactcatcgggttattggacccctgaggaggcggtcggtccacccgacgttgaccagccttgtgagccgagcctacaggcttggagcccagaagtacacctgtatcatatgaatatgactgtaccctgcccgacggagggttgtagcctggaactcctttttcaacacccagtacaggccgacacgctgactctttgggttacttccttctttatggaaagcagtcaagtgctgtttgacactgagatcctgctagaaaataaggaatctgtccatctcggtcctcttgacaccttctgcgacattccactaaccatcaaactgcatgtggacggaaaggtgtcaggggtcaaggtctatacattcgatgaacgaattgaaattgatgccgcactgttgacctcccaaccgcactccccattatgtagcggctgtcgacctgtgcggtaccaggtgttaagggatccgcctttcgcttcaggactgcctgtagtagtcacgcactcccataggaaattcactgacgtagaggtgacacccggtcagatgtaccagtaccaggttctagctgaggcggggggcgaacttggcgaagcctctcctccactgaaccatatccatggagcaccatattgtggggacggaaaagtctccgaacgcctaggtgaagaatgtgacgacggggacctggtgagtggagatggttgtagcaaggtgtgcgaacttgaggaaggcttcaattgcgtgggcgagccttctttatgttatatgtatgagggggatggaatctgtgagccttttgagaggaaaacttctatcgtggattgcggtatttatacacctaagggctacctagaccagtgggctacccgcgcttatagctcacatgaggacaaaaagaagtgcccggtgagcctcgtcaccggcgagcctcactccttaatctgcacttcctatcaccctgacctccctaaccacaggccattgaccggatggtttccttgtgtggccagcgagaatgagacgcaagatgatcgtagcgagcagcccgagggttccttgaaaaaggaagatgaagtgtggctcaaggtgtgtttcaacagacccggcgaggccagagcgattttcattttcctgactacagatgggcttgtgccaggggagcatcaacaaccaaccgttacactgtacctgaccgacgtcaggggatcgaatcacagccttggtacctatggactgagttgccagcataatcctttaatcataaacgtgacacaccaccagaatgtgctctttcatcacaccacatcagtcctgctcaatttcagctcaccaagggtcggcatcagcgccgttgctctccgcactagctctagaatcggactgtccgctccttctaactgcattagcgaagatgagggccagaatcaccagggacaatcatgtatacaccggccttgcggtaagcaagactcttgccccagtctcttgctggaccacgccgacgtcgtcaactgtacctctattgggccggggctgatgaaatgcgccatcacatgccagagggggtttgccctacaagcttcttctggacagtacattagacccatgcagaaggagatcctgcttacgtgctcaagcggccactgggatcagaacgtgtcttgccttcctgtggattgtggggtacccgatccaagtctggtgaactacgcaaattttagctgctcagaagggacgaaatttcttaagaggtgtagtatcagttgtgtaccacctgcaaagctgcaggggctttcaccctggctgacatgcttggaggacggactgtggtcactgcctgaggtttattgcaagctggaatgcgacgccccccctattatcctgaatgccaaccttctgctaccccattgccttcaggataaccatgatgtcggtaccatctgcaaatacgagtgcaagcctgggtactatgtagccgaaagtgctgaaggcaaggttaggaataagctgctcaagatccaatgcctggaagggggaatctgggagcagggctcctgtatacccgtggtatgcgagcctccaccacctgtgtttgagggtatgtatgagtgcaccaatggattcagcctcgattctcagtgcgtccttaattgcaatcaagagcgggaaaaactgcccattttgtgtactaaggaaggtctgtggacgcaggagtttaagctgtgtgagaacctccagggagagtgtcccccacctccttctgagctgaatagcgtggagtacaagtgcgaacagggctatgggatcggcgcagtgtgctcaccactctgtgtaatccctccttccgaccccgtgatgctgccggagaacattaccgccgacacgctcgagcactggatggagcccgtgaaagtacagtccattgtctgtacaggtaggcgccagtggcatcctgatccggtgctggtgcactgtattcagtcctgtgaaccctttcaagcggacggatggtgcgacactatcaataatcgggcctactgtcactacgacggcggggactgttgtagctcgactttgagctctaagaaggtgattcccttcgccgcggattgtgacctcgatgaatgcacatgtagagatcccaaagcagaggagaatcagtag

SEQ ID NO: 9053 - DNA, 702 bp, Artificial Sequence
  Description of Artificial Sequence: Synthetic coding sequence
atgaaggaccccctggccaaggacgagcggatctacgtgaccaactactattacggtaacacgctcgtagagtttcgcaacctcgaaaatttcaagcaggggcgatggtctaacagctataaattgccatactcatggatcggcacgggacacgtcgtgtataacggagcattttattataatcgagcattcactaggaatatcatcaagtacgatctgaagcagcgatacgtggccgcctgggccatgttgcacgacgttgcctacgaggaggcgacgccctggcgctggcaggggcattcagacgttgattttgccgtggatgaaaacggtctatggctcatatatccagccctcgacgacgaaggcttctctcaggaagttattgtgctgtccaaactgaacgccgctgacctgagcactcagaaggaaacaacttggagaaccgggctgcgacgaaacttctatggcaattgcttcgtgatttgtggtgtcctgtacgccgtcgacagttataaccagagaaacgcaaacatctcatacgcctttgacactcacacgaacacccagatcgttcctcgcttactctttgaaaacgaatattcctatacgacccaaatcgactacaatccaaaagataggctgctctacgcatgggataatggacatcaggtgacctatcatgtaatcttcgcctattag

SEQ ID NO: 9054 - DNA, 579 bp, Artificial Sequence
  Description of Artificial Sequence: Synthetic coding sequence
atgctgaagaagatcagcgtgggcgtggccggcgacctgaacaccgtcactatgaaactgggctgcgttctaatggcctgggcattatatctctctcttggcgttctgtgggttgcacagatgttgctggctgccagctttgaaactctgcagtgtgaaggaccggtgtgtacagaagagtcgagctgccacaccgaagatgacctgaccgacgctcgcgaagccggtttccaggtcaaggcctatacttttagtgagccatttcatctcatcgtgagctacggcgctagcagctccgccgcaccacctaccttgaatcctgcccctcagaagagcgcagctccaggaaccgccccagaagaggcccctgggcccctgcccccccccccgaccccatcaagcgaagatcccggtttctcatctcctctcgggatgccagatccacatctttaccatcagatggggctcctcttaaagcatatgcaggatgtgcgtgtcttactaggacacctgctcatggaattgagggaactgtcaggtcaccgcaaacccggaacaacaaaggccacagcagaatag

SEQ ID NO: 9055 - DNA, 459 bp, Artificial Sequence
  Description of Artificial Sequence: Synthetic coding sequence
atgctgctggccgccagcttcgagaccctgcagtgcgagggccccgtgtgcacagaggagagtagttgtcacaccgaagatgacttgaccgatgcccgcgaagcagggtttcaggtgaaagcctataccttttctgagccctttcacctgattgtcagctatggcgcaagctcttccgcggccccacccacgttgaaccccgcccctcagaagtccgcagctccaggaacagccccggaggaagctcccggtcctttacctccacctcctacgcctagctccgaagaccctgggtttagttcgccattgggcatgcccgatccacatctctaccaccaaatggggttgttgctgaagcacatgcaggatgtgcgggtcctcctggggcatctcctgatggaattgagggagctttccgggcatagaaaacctggcacaaccaaagccactgccgaatag

SEQ ID NO: 9056 - DNA, 1098 bp, Artificial Sequence
  Description of Artificial Sequence: Synthetic coding sequence
atgaagctgggctgcgtgctgatggcctgggccctgtacctgagcctgggggtgctctgggtcgcccagatgcttctggcagccggttgtcacgccgccgcatccttcgaaactctccaatgtgaaggacctgtgtgtaccgaagagtcatcctgccacactgaggatgacctgaccgatgcgagggaggcaggcttccaggtgaaagcatatacattctctgaaccctttcacctgatagtgagttatgattggctgatattgcagggtccagctaagccagtcttcgaaggggatctgctggtgctgaggtgtcaggcttggcaggactggcctttgacgcaggttaccttctatagggacggaagtgcccttggccctccaggtccaaacagggagttcagcataacggtggtccaaaaggctgattctggccactaccactgctccggaatctttcagagccccggcccgggaattcccgagacagcctctgtggtcgccatcacagtgcaggaactgtttccagccccaattctgagggccgtaccttcagctgagccgcaggcaggctcacccatgactctttcctgccagacaaaactcccgttgcaacggtcagccgctaggctcctcttttccttctacaaggacggacgcattgtccagagcagggggctttcttctgaatttcagattccgaccgctagtgaagatcattctggctcttactggtgtgaggctgcaactgaagacaatcaggtgtggaaacaaagtccacaattggagatccgggtgcaaggcgcaagttcgtcggccgcccctccaacgctgaatccggccccgcagaaaagcgccgccccgggcaccgcaccagaggaggcaccgggacccctcccacctcccccgacgccgtcatctgaggacccagggttctcttctcctttgggcatgcccgacccccatttgtatcaccagatgggtttgctgctcaagcatatgcaagatgtgagggtgctcctgggccacctgctaatggagctccgcgaactttctggacatagaaagcccggcactacaaaagcaacagccgagtag

SEQ ID NO: 9057 - DNA, 711 bp, Artificial Sequence
  Description of Artificial Sequence: Synthetic coding sequence
atgctgaagaagatcagcgtgggcgtggccggcgacctgaacaccgtgaccatgaaacttggatgcgttctgatggcttgggccctgtatttatctctgggtgtgctctgggtggcccaaatgctgctggagctgttccccgcccctatcctccgcgctgtgccttccgcagagcctcaagccggttcgcccatgacactgagctgtcagaccaaactccctctgcagcggagtgctgccaggctgctgttcagcttctacaaggacgggcgcattgtccagagcaggggactgagcagtgagtttcagattcccacagcctcggaggatcacagcgggtcgtactggtgcgaggccgcaaccgaggacaaccaggtctggaaacagtccccacagttggagatccgggtacagggtgcgagctccagcgctgctccacctactctaaatcccgcgcctcaaaagtctgccgctccaggcacagcccctgaagaagcacccggtcccctccccccccctccaacccccagctctgaagaccctgggttctctagtccgttgggaatgcccgatccacacctttaccatcagatgggcctgcttttgaaacatatgcaggatgtgcgagtgttacttggccatttactcatggagcttagggagctatccggtcatcgaaaaccggggacgaccaaagccactgccgagtag

SEQ ID NO: 9058 - DNA, 1149 bp, Artificial Sequence
  Description of Artificial Sequence: Synthetic coding sequence
atgctgaagaagatcagcgtgggcgtggccggcgacctgaacaccgtcacaatgaagctggggtgcgtgctcatggcatgggctctgtacttgtctttgggggtactctgggtcgcacagatgttgttggctgccggctgtcacgccgctgctagctttgaaacactgcagtgtgagggacccgtgtgcacagaagaatcatcttgtcacaccgaggatgacttaacagatgcccgcgaggccggtttccaagtcaaggcctacacattttcagagccattccatctaatcgtgtcctacgactggctgatcctccagggtcctgcaaaacccgtctttgagggtgatctgcttgtgctccgctgccaagcatggcaggattggccgctcactcaagtaacattttaccgcgacggatccgccttgggaccccctggacctaatagagaatttagcatcacagttgtccaaaaggcggatagtgggcattaccattgcagcggcatctttcaatctcccggtcccggaatacccgagaccgcatcggttgtagcaatcaccgtccaggagctcttcccagcgccaatactccgcgcggtgccctcggcagagccccaggcgggtagtccgatgaccctttcgtgtcagactaagctgccactgcagagaagtgctgctcgccttctattttctttttacaaggatggtaggattgtacagagtcgggggctgagttccgagttccagatccccaccgcctcagaagaccattcaggatcgtattggtgtgaagcggctacagaagacaatcaggtatggaagcagagcccacagcttgagatccgagtgcagggggcatcatcttccgctgccccacctactctgaatcctgcacctcaaaagtctgccgcccccggcaccgcacctgaagaagctcctgggccattgccaccaccaccaactccctccagtgaggaccctgggttctcctctccgctgggaatgccagatccccacctgtaccatcagatggggttgttactcaagcacatgcaggatgtacgagtgttgttggggcacctcctcatggaactgcgggaactcagcggtcatcgcaagccgggaaccactaaggcaactgcagagtag

SEQ ID NO: 9059 - DNA, 738 bp, Artificial Sequence
  Description of Artificial Sequence: Synthetic coding sequence
atgagccggctgcgggccctgctgggcctgggcctgctggtggccggaagccgcgttccgaggatcaagtctcagacaatcgcctgtcgttccggccccacctggtggggcccccagagactcaactccggtggaaggtgggacagcgaggtcatggcatctacagtcgtgaaatatctgtcgcaagaagaggcacaagccgtcgatcaggaattattcaacgaataccagttcagtgtcgatcagcttatggagctggccggcctgtcttgcgctaccgcgatcgccaaagcctatcccccaaccagtatgagccggtcaccgcccacagtactcgtgatatgtggacccggtaacaatggcggggacggcctcgtgtgtgcgcgccatctgaaactgttcggctacgaacccactatctattatcccaagcgaccaaacaagccactcttcactgctctcgtaacacaatgccagaaaatggacatcccgtttctcggggagatgccagccgagccgatgactatagatgaattgtatgagctagtcgtcgatgccatctttgggttttctttcaagggagacgtccgagaaccatttcactccattctgagtgtgctaaaaggtctgacagtccccattgcctctatcgacataccttcgggggcaggcatacagaaagtgggttgggggcgcctggggccctaccctccagattcctgccctcaccaagtgtag

SEQ ID NO: 9060 - DNA, 783 bp, Artificial Sequence
  Description of Artificial Sequence: Synthetic coding sequence
atgagccggctgcgggccctgctgggcctgggcctgctggtggccggctcgcgtgtccctcgaatcaaaagtcagacgattgcctgtcgctctggccccacctggtggggtcctcagcgattgaactccggaggcagatgggatagcgaggtcatggcctctactgttgtgaaatatttgtcccaggaggaggcccaggccgtggatcaggagctctttaatgagtaccagttcagtgtagatcagctgatggagttggcgggtctcagctgtgctaccgccatcgcgaaggcttaccccccgacaagtatgtccagatctccaccaaccgtgctggttatctgcgggcccgggaataatgggggcgacgggttggtgtgtgcaaggcacctgaaattgttcgggtacgaacccaccatatattacccaaaaagacctaacaaacccctctttaccgccctcgtgacccaatgccaaaagatggatattccgttcctgggcgagatgccagcagagcttcagggaagatgtagcggaactgtcccgcaacatccagagtgtccggaagggacgcactgtgcgcattgccagcatcgccatagcctaagaatgggcagaggagaaggaaagtgctggagagatcctgctcggctcgcacatattccgcattctccacaaaagatctgcaatccagtctatagaagccttccactgccaggtgggtcattctgtgcaacctgtagtggggaagaagttccagctgaacccgccacattgccatag

SEQ ID NO: 9061 - DNA, 867 bp, Artificial Sequence
  Description of Artificial Sequence: Synthetic coding sequence
atgagccggctgcgggccctgctgggcctgggcctgctggtggccgggtcaagagtgccccggataaagagtcagaccatcgcctgtcgcagtggcccgacatggtggggaccacagcgcctaaactctggtgggcgatgggactctgaggtcatggccagcaccgtggttaagtatctgtcccaggaggaggcccaggcggtagaccaggagctgttcaacgagtatcaattttctgttgatcagctgatggaacttgccgggttgtcttgcgcgaccgcaatagccaaggcttacccgcctaccagcatgtcacgtagcccccctactgttctggtgatctgcggaccaggaaataatgggggtgacggcctggtctgtgcacgccacttgaaactctttggttatgagcccacgatctactaccctaaaaggcccaataaacctttgttcacggccctagttacacagtgtcagaaaatggatatcccatttttaggcgagatgcccgctgagcctatgactatcgacgaactctacgagctggtcgtggacgctatttttgggttctcgttcaagggggacgtccgcgaaccatttcattcgatcctatctgttttgaaaggattgaccgtgcccattgcgagcatcgatattccgtctggctgggacgtcgaaaagggtaacgccggagggattcaacccgacctacttatcagtctcaccgccccaaagaagtccgccacccagtttactggtcgatatcactatctaggaggaaggttcgtgccgccagccctcgagaaaaagtaccagttaaacctgcctccctaccccgacacggaatgcgtgtatcgtctgcagtag

SEQ ID NO: 9062 - DNA, 879 bp, Artificial Sequence
  Description of Artificial Sequence: Synthetic coding sequence
atgcacctgcggctgatcagctggctgttcatcatcctgaacttcatggagtacatcggatcccagaatgcttcgagaggcaggagacaacgacgcatgcatcctaacgtatcgcagggctgccagggggggtgtgcaacatgcagtgactataacggctgcctcagttgtaagccacgcttatttttcgccctggagcgcatcggaatgaaacagatcggagtgtgtttgtcaagctgtccgtcaggatactacggcactcgttacccagacattaacaaatgcactaaatgcaaagccgactgcgatacttgtttcaacaagaacttctgtacaaagtgtaaatcgggtttctacctacacttaggcaagtgcctcgacaactgtcccgagggcttagaggctaacaaccacaccatggagtgcgtgtcgatagtccactgcgaggtgtcggagtggaatccttggagtccgtgcaccaaaaaaggaaagacatgcggcttcaaacgcggcacagagacacgcgttcgtgagattatccagcatccatcagccaaaggtaatctctgcccgcctactaacgaaacccgcaaatgcaccgtgcagagaaagaagtgccagaagggcgaacgcggcaaaaagggcagggagaggaaaaggaaaaaacccaataaaggtgagtccaaagaggctatccccgatagcaaatccctggaaagttcaaaggagataccagagcaacgagaaaataagcaacagcagaaaaagaggaaagtgcaggacaagcagaagtccgggatagaggtgacgctggccgagggattgactagcgttagtcaacgtacccagcctaccccttgtaggagacgatacctgtag
